United States Patent 7,625,699 (GENETIC POLYMORPHISMS ASSOCIATED WITH CORONARY STENOSIS, METHODS OF DETECTION AND USES THEREOF) - sequence listing, part 13

SEQ ID NO: 20000 - DNA, 201 bp, Homo sapiens
aatgtattggtatagaactgatacacattacttctagtcacatcccattgacaaggaacagccatgtggctcagcctagttgcaggtgagactgggagatytaatccctaattgggcagctgccttctagcaacaaccttgccctgtgggaaggagagcatcaattttggaggacagtaatgatctcttcattatctatgt

SEQ ID NO: 20001 - DNA, 201 bp, Homo sapiens
gctaatgcgactgagaactaaattttaaattttactgacttaattttagttaagtttaaatagccacatatggctagtggctactgtacaggatggcacargcagagggaatacatgatgagtcagaaagcttaagctcccctttggttctgtcatttgttagccttgtaactgggcagggtctccttggcttggtatgca

SEQ ID NO: 20002 - DNA, 201 bp, Homo sapiens
tcaggtgtgtgtgcattttgctcgggtgtgtgtgccctgctcagctgtgtgtgccctgcacagatgtgtgaacattgctcaggtgtgtgtgccctgctcasgtgtgtgtacactgctcaggtgtgtgtgcattttgctcgggtgtgtgtgccctgctcagctgtgtgtgccctgcacagatgtgtgaacattgctcaggtg

SEQ ID NO: 20003 - DNA, 201 bp, Homo sapiens
ttttactccccatctttccacttctgatatggtttggttgtgtccctacccaaatctcaacttgttgtatctcccacaattcccacatgttgtgggagggrcccggggtggggggggcagtaattgaatcatgggggctggactttcccatgctattctcatgatagtgaataagtctcatgagatctgctgggtttatca

SEQ ID NO: 20004 - DNA, 201 bp, Homo sapiens
tgctcaggtgtgtgtgccctgctcaggtgtgtgtacactgctcaggtgtgtgtgcattttgctcgggtgtgtgtgccctgctcagctgtgtgtgccctgcwcagatgtgtgaacattgctcaggtgtgtgtgccctgctcaggtgtgtgtacactgctcaggtgtgtgtgcattttgctcgggtgtgtgtgccctgctcag

SEQ ID NO: 20005 - DNA, 201 bp, Homo sapiens
tgtgggaggggcccggggtggggggggcagtaattgaatcatgggggctggactttcccatgctattctcatgatagtgaataagtctcatgagatctgcygggtttatcaggggtttccacttttgcttcttcctcatttttctcttcctgctgccatgtaagaagtatgtttcacctcctgccattattctgaggcctc

SEQ ID NO: 20006 - DNA, 201 bp, Homo sapiens
caggtgtgtgtgcattttgctcgggtgtgtgtgccctgctcagctgtgtgtgccctgcacagatgtgtgaacattgctcaggtgtgtgtgccctgctcagrtgtgtgtacactgctcaggtgtgtgtgcattttgctcgggtgtgtgtgccctgctcagctgtgtgtgccctgcacagatgtgtgaacattgctcaggtgt

SEQ ID NO: 20007 - DNA, 201 bp, Homo sapiens
ttccagctgtggctgaaaggagccaatgtacagctcaggctgtggcttcagagggtggaagccccaagtcttggcagcttccacatggtgttgagtctgaggtgcacagaagtcaagaattgaggtttgggaacctccacctagatttcagaagttgtatggaaatgcctggattcccaggcagaagtttgctgcaggggc

SEQ ID NO: 20008 - DNA, 201 bp, Homo sapiens
tgctcgggtgtgtgtgccctgctcagctgtgtgtgccctgcacagatgtgtgaacattgctcaggtgtgtgtgccctgctcaggtgtgtgtacactgctcrggtgtgtgtgcattttgctcgggtgtgtgtgccctgctcagctgtgtgtgccctgcacagatgtgtgaacattgctcaggtgtgtgtgcactgctcaggt

SEQ ID NO: 20009 - DNA, 201 bp, Homo sapiens
gcttaggaagggaggtgggaaggaggaattctggaacaactcatgcaggtggcacaggatggagatatttgaactgtcatctatccagttaaggacacaayaatgcagtcatctgaacatcaagtatctgactcaataactaataattgccctttccttctggtacagtgaatggtttgataatctctagggcttctttca

SEQ ID NO: 20010 - DNA, 201 bp, Homo sapiens
gcaacacctttgttttggccaatttttcccatttggaatggctgtattcccccaatacctgtacctccattgtatctgggaagtaactagcttgattttgrttttacaggctcataggtggaagggacttgccttgcctcagataagactttggactgtggacttttgggttaatgctgaaatgaactaagactttggggg

SEQ ID NO: 20011 - DNA, 201 bp, Homo sapiens
aaatctcacaagatctgatgggtttatcggggtttccacttttgcttcttccttatttttctcttgccgccgccatgttaagaagtgcctttcacctcccrtcatgattctgaggcctccccagccatgtggaactgtaagtctaattaaacctctttttgtttccagtttcaggtatgtctttatcagcagcatgaaaat

SEQ ID NO: 20012 - DNA, 201 bp, Homo sapiens
gctttgggggaccctgctccccaaccaaagtcagctgccttgtagggaggtcacataaccactacacagattacattcatgaacctcacagaaccctcatrtttcatgtgtttcatgtctagtgaagtgacttgggcaaacaggtgggcagggacagcatctctggagaaatgtaggagaggaccaggacacctgtgcgtg

SEQ ID NO: 20013 - DNA, 201 bp, Homo sapiens
ataaaactttttgataactgatagtgccaatcttcccctccatttgtctttaaaactggctaatcttagccattataatttcatatgaattagaactaacttgtcaaaatcttcaggttttgtttggaaatgcagtggatttattgactacttttggggaaaattaacattttcacaatgttgaatcttaccaatatttct

SEQ ID NO: 20014 - DNA, 201 bp, Homo sapiens
taaaactttttgataactgatagtgccaatcttcccctccatttgtctttaaaactggctaatcttagccattataatttcatatgaattagaactaacttgtcaaaatcttcaggttttgtttggaaatgcagtggatttattgactacttttggggaaaattaacattttcacaatgttgaatcttaccaatatttctc

SEQ ID NO: 20015 - DNA, 201 bp, Homo sapiens
attctaggtactttataaatattaattaatttatccatgtaataattgattgaagctggtaccattattaccattattgtccccatttttgcacttggggkatagagagtttaagtcacttgcccaagatcataatgtcaaccacctcttaatgagcctccctgcctctgcccctccctgctagactctgtttccccaact

SEQ ID NO: 20016 - DNA, 201 bp, Homo sapiens
tgcaccctgacctcttggttccttagccccttctgtttggtgactttgccttcttgcttcctgctgacagctcacctccatggtctgcctggacattgtcrtaactgcattactccataatctcggtttcaagcatcccactgtgtgatcaccccctcttttctctccactccctctagtgctcagttcccaagattcttt

SEQ ID NO: 20017 - DNA, 201 bp, Homo sapiens
gttgccaccatctacaaactcccaagtcacttgcttcattccaggaagaatgggttagccctgggtttactgcctctcttccccacgtcttcagctgctgkcagttcttagtgatttcagtatccatgtagatgacccttcctgcaccctgacctcttggttccttagccccttctgtttggtgactttgccttcttgctt

SEQ ID NO: 20018 - DNA, 201 bp, Homo sapiens
caaagtggtttcatggtcatttcctcattttggccaggtcccttcattctcttgcatttaatcctctccgaagtctttttctgatttctctggccatcgcrttcctcctcactctcaggttgggatgggtttttgtgttgatttgttcttttcaggatacatatagctttaattgattttgtagtgataaatgaacacatg

SEQ ID NO: 20019 - DNA, 201 bp, Homo sapiens
attaatatagccatacgacattggggctgacccagtgtcacagcagcatatatgatggcagtacatttagttaaatatttgataaatcattcttttggaartgaatatagtatgaggaagctgggttgacccagtgcccttggcagcaaatgtgttggccttgggaatggtgtgacgggcaggccttcctgggcttttgtg

SEQ ID NO: 20020 - DNA, 201 bp, Homo sapiens
gtatgagaatctgaatcatttagaaatgttatgattctatctagaagaaaagtgttgtataagtcactacagaagaacaacaaaaaaagaaaagtattgtratgtgtatataataagtttgtgtaaattcttggtcctgctcagctctatatgtggcagaatccatttgaaatttcttgtctagtccatttatttttgttt

SEQ ID NO: 20021 - DNA, 201 bp, Homo sapiens
aaactttagtgttctttggcctataagttgagggtgtgcatggtttagaaagcgcatttatgtacattgcttcatcttgtcctcataatgccatagaaaasaccttgctagcctcattttacagatgaagaaaccgaggatcagagagggcacatgaattgctagcaggcactagatccaggacttgagaccacatctcct

SEQ ID NO: 20022 - DNA, 201 bp, Homo sapiens
tgaatgactatgatagtacccctgtgagatagtttaaaagaagtgttgggccgggcgcagtggctcacgcctgtaatcccagcactttgggaggccgaggygggcggatcacgaggtcaggagatcgagaccatcctggctaacacggtgaaaccccctctctactaaaaatacaaaaaattagccgggcgtggtggcggg

SEQ ID NO: 20023 - DNA, 201 bp, Homo sapiens
ggtaaagaaggcatgtcactttaactgtcagcatagcatggtttgatgtgtagagagtggatcagagttccagctgatttcttccttaaatggcttgtttkttcactcattcactcaccaattcattaattcagtgaaactagtattgtgttggtgaaggcagaaggcaatgctgggaccgagaaatgtggacgttattat

SEQ ID NO: 20024 - DNA, 201 bp, Homo sapiens
gactatgatagtacccctgtgagatagtttaaaagaagtgttgggccgggcgcagtggctcacgcctgtaatcccagcactttgggaggccgaggcgggcrgatcacgaggtcaggagatcgagaccatcctggctaacacggtgaaaccccctctctactaaaaatacaaaaaattagccgggcgtggtggcgggcgcct

SEQ ID NO: 20025 - DNA, 201 bp, Homo sapiens
tgtaacccatctcagcttggctttcctttatgaaacttcatttatgaagtgaaggtaaaacctgctgtagctacctccaccaggtttcatgacaagcaaakaggatagtgatgatgttgataatgacagctcccatttaaccaggagctcatgtcttattttaaatgcagaaggcttcatattctatattggcacttgcac

SEQ ID NO: 20026 - DNA, 201 bp, Homo sapiens
ggcgtggtggcgggcgcctgtagacccagctactcgggaggctgaggcaggagaatggcatcaacttgggaggcggagcttgcagtgagccgagattgcaycactgcactccagcctgggcgacagagcaagactccatctcaaaaaaaaaaaaaaaaaaaaaagtgttgttcaatccattttatagatgatagtttctaa

SEQ ID NO: 20027 - DNA, 201 bp, Homo sapiens
ttattttaaatgcagaaggcttcatattctatattggcacttgcacatattattttaaatatagaaatgtaaggcaatagtgatattatctccattttacrgatgaggaaaccaaaacttaaagaggcaaagtcacttgctcaaggtcaaatagttactaaggggagagattggccctttaattctattatcaacaattct

SEQ ID NO: 20028 - DNA, 201 bp, Homo sapiens
tcaaaggaaaataaccaacatcccaagaaatctataagaaagctttttcttttaagttcagacccagatggtgtcttctctccggtgtgatatgtcatccmagagggaatcctgtgtggctttgtcctggggcctcctatgtctatgtccccagtgcagacccagaacaccagaatggaagcaacgggatccctctgtgtg

SEQ ID NO: 20029 - DNA, 201 bp, Homo sapiens
gaaacctattgcaaattttaaaactatggtaaatttaaaattttccattagttataattttgcctcaagagagaagtttactacatatcgcacataggatrtatcttatttcctatcagcagcatatctaattttatcaaaattagtcaaatcctgctacagtcattacccataagaacaacaaagaagttccaagagtaa

SEQ ID NO: 20030 - DNA, 201 bp, Homo sapiens
agtggacattaaaacttacccattaggctgggcatggtggctcatgcctataatcccagcactttgggaggccaaggctggtggatcacttgaagccaggwgtttgagaacagcctggccaacatggcaaaaccatatttctacttaaaaaaaaaaaaaaattaagccttgtgtgggtggcgtgtgcctgtggtcccagct

SEQ ID NO: 20031 - DNA, 201 bp, Homo sapiens
gccaccctctgtaggtgggagcacttgtggtgacatgcctacatttagagtggtcatattctcttctgagggctgggggccgtggtttctttttcttttctttttttttttttttttttttgagatggagttttgctcttgttgcccaggctggagtgcagtggcacgatctcggctcactgcaccctccacctccaagat

SEQ ID NO: 20032 - DNA, 201 bp, Homo sapiens
ttctctcttgctccttgaacaggccagtgtgtcctgaacagtgctcctggcttccctccacttggtgaggtagagacccaggctccttctatctggtagcyctgctgtcctctatgatctcgtggtttatgtcccttcaagagaagtggaaagagagagtaagaataaggcatactccttaaatgtattggtatagaactg

SEQ ID NO: 20033 - DNA, 201 bp, Homo sapiens
cctataatcccagcactttgggaggccaaggctggtggatcacttgaagccaggagtttgagaacagcctggccaacatggcaaaaccatatttctacttaaaaaaaaaaaaaaattaagccttgtgtgggtggcgtgtgcctgtggtcccagctactcaggaggctgagacatgagaatcgcttgagtttgggaggtggt

SEQ ID NO: 20034 - DNA, 201 bp, Homo sapiens
ccaccctctgtaggtgggagcacttgtggtgacatgcctacatttagagtggtcatattctcttctgagggctgggggccgtggtttctttttcttttctttttttttttttttttttttgagatggagttttgctcttgttgcccaggctggagtgcagtggcacgatctcggctcactgcaccctccacctccaagatt

SEQ ID NO: 20035 - DNA, 201 bp, Homo sapiens
cactgtgttgcccaggcttgtcttgaactcctgggctcaagcagtcctctcacctcagccccacaaagtgctgggattacaggtgtgagccaccatgcccsgcttgacttgacttaaattatcttagattcaaaataaatagttttggtttcttggactattacacacatactttgtgcaaaatcgcagtgtgctctgcag

SEQ ID NO: 20036 - DNA, 201 bp, Homo sapiens
tggccaggctggtcttgaactcctaacctcaggcgatccacccaccttggcctcccaaagtgctgggattacaggtgtgagccaccacacctggcctgtgrtttctttttaaaaatcagattgtagctactttctgtccagaggggattcatcacaacatctagcctagtgagggtttgtttctcttttttctgtccagtg

SEQ ID NO: 20037 - DNA, 201 bp, Homo sapiens
tgcatttctaataagatccctgctgatgctgatgctgctgatgggtgcgtgtgtcgggaggggaccacactttgggaaccactgttcactagggtttcagkttcctgagtaagagcttaaagaatgaacatgcaaatggccaataagcacaggaactgatgttcatctgctatggactgaatgttcctgtccacaaattca

SEQ ID NO: 20038 - DNA, 201 bp, Homo sapiens
tcacaggagggcatcccactgaatctcactaacttggaacagccaagaacctgggccagaaatacagtgaatgggtgagcagggcagccaggaaacaaggaaacagtgctgttgaacatcaagtcctgtcgattccacctttgttaactctctactctggtctgtgctgtcgtcctgcccctggtagattcaggagtactg

SEQ ID NO: 20039 - DNA, 201 bp, Homo sapiens
catcaagtcctgtcgattccacctttgttaactctctactctggtctgtgctgtcgtcctgcccctggtagattcaggagtactgcaacatcctcccttgrtttcccacccaccctacatgctgctaccaagagttctttctgaatgcaaatgtcactttatctctctcctctctaaacccctttagtagttcctgttgct

SEQ ID NO: 20040 - DNA, 201 bp, Homo sapiens
gtacagcaacctttttgaattgttatgaaggaaaaacagcatgtaaagtacttagtccgatgcttggttgtttttctccttgatgtctggttcctcacctwcaggagcctgtcacttgctatcacttatagtttaaccaaaacattagattgtgaatctaacaatagaagcctgcaacttcttgtctaccgagaaagtgta

SEQ ID NO: 20041 - DNA, 201 bp, Homo sapiens
tttgccttaattttctatctgaggcttcttagagcctcctggttagaggtaggtatactttcccctctgttcccataacactttttttttcttttttttctttttttttttttgagtcagggtctcattctgtcacccaggctggagtgcagtggtgcgatctcagctcaccgcaacctctgcctcccgggctcaagcgat

SEQ ID NO: 20042 - DNA, 201 bp, Homo sapiens
tgtctggttcctcaccttcaggagcctgtcacttgctatcacttatagtttaaccaaaacattagattgtgaatctaacaatagaagcctgcaacttcttrtctaccgagaaagtgtacaagaactgctaactcatgcccccatgcctagcaacatggctttctcaactttgaaaggattagagtcatccgttggtcttag

SEQ ID NO: 20043 - DNA, 201 bp, Homo sapiens
ccatttttacgatattgattcttcctatccatgaagatggaatgttttttccatttgttcgtgtactttcttatttccttgagcagtggtttgtagttctccttgaagaggtccttcacatcccttgttagctgtattcctaggtatcttattctttttgtagcgattgtgaattgggagttcattcatgattcggctctc

SEQ ID NO: 20044 - DNA, 201 bp, Homo sapiens
tcattgtggaggaggtgaacataattggaggaattcgctttggcctttttggctgaaaaaaatatttatgaaattgctgtacacccccgctcccccccccsaccccaagcagagttagacacctatagaattccaggcaccgatgaaaagacctttaaaattaatcgcacataacttctcattgaaggtgcaggtgagaag

SEQ ID NO: 20045 - DNA, 201 bp, Homo sapiens
gtcaggtggtcaggtctaactgcatccccctcctgtcactccatctcaacaattccccaacccagtcctaccccatctcaacccttcctcaacccaacctstctccatctcaagtcctccccatttcagccactatccgtctcaagcccttcctatgtcaacccttatcaattaaactcctcctcatctgaacccttccct

SEQ ID NO: 20046 - DNA, 201 bp, Homo sapiens
attcaaacccatccatggagttccctcaggaggaaggagcttgggttcagctcctagttgaatcaagtaactctccgccttcatctgtttaattcatttayacttagagtagtatttcttttgcagaaagggatgcatggctaaaaatgtactactgcttccattaatgaaaattaatttagcttaataagatgagtctga

SEQ ID NO: 20047 - DNA, 201 bp, Homo sapiens
agaggggatgagggtggctctggctttggcggttgggtgtgtcttttggactgggtgtggtgccctatagaaaggctggagcttgggacaggtctgtgtgracacctcgattcatcactgcatggttggtagttgaaaccatagacatgggtcagattgtcccagtgaaatggcagagaagagggcaaggacagactccaa

SEQ ID NO: 20048 - DNA, 201 bp, Homo sapiens
ggaaaatatggagggcctgggatggaggctgagagggagctggcaggaggggtgggggcagattggttgagaccattagcagggaaatgagggagaaagartttccagaagggaatggttaccaggttcaaatgtgagggaggaattcactgctggcatttgtttgagaagccctgacctttttctgttcccttgctagaa

SEQ ID NO: 20049 - DNA, 201 bp, Homo sapiens
taaatttagaaattactgttaaataacattatatagatttcgtagattacaaattttgaaaaaattgaacagcaataaaatacattttaaattcaaacaayatatggacataccttggagatattgcaggtttgatttcagaccactgcaataaagtgaatgacaataaagtaaatcacacaaatttttgtttcccagtgc

SEQ ID NO: 20050 - DNA, 201 bp, Homo sapiens
agaaattactgttaaataacattatatagatttcgtagattacaaattttgaaaaaattgaacagcaataaaatacattttaaattcaaacaacatatggrcataccttggagatattgcaggtttgatttcagaccactgcaataaagtgaatgacaataaagtaaatcacacaaatttttgtttcccagtgcatataaa

SEQ ID NO: 20051 - DNA, 201 bp, Homo sapiens
agagaacaatagattattggtttttctatatcattttgatcttgaaatcaatttagaaatattgtccatttagcctgttaacaataggttagagttataayacaggacagcctggcaagatgcaaggaacaaaggctctggcatgacatagttctgtatttgaagtctgcttctggctttgtgacactgagcaagttattt

SEQ ID NO: 20052 - DNA, 201 bp, Homo sapiens
cagattcagtgcctggcaaaggcccctttcctggctgctggacagctgtctgtgtcctcacatggtagaaggggtgagggagctctctggtgtctcttttrtaaggacactaatcccatataagagcagagtcctcatgacctaataccttctaaaggctgaacctccaaatatcacattggggattaggtttcaacatat

SEQ ID NO: 20053 - DNA, 201 bp, Homo sapiens
ggctgtgaacaaaatgctggctgatatatatggtcttctttttctctctgtattcttttttgaattctcattccagttctggttttaaatgtaccttcagyaaatagatcctctttatttcccttctagttcattacttacttcccatgccttcctacttatataatcaaaatctcatgatagttctatgttgtttttgtt

SEQ ID NO: 20054 - DNA, 201 bp, Homo sapiens
ctcagaagaagaaaggaaaatgtgagaaagtttggaatctcttagagacttgttgaatggctttgacaaaaatgctgatagtgataggaacaataaggtcyaggctgtggttgtctcaggtggagatgaggaacttgttgggaactggagcagaggtggctcttgttatgtttttgcaaagagactggtggcctattgccc

SEQ ID NO: 20055 - DNA, 201 bp, Homo sapiens
ctgatagtgataggaacaataaggtccaggctgtggttgtctcaggtggagatgaggaacttgttgggaactggagcagaggtggctcttgttatgttttygcaaagagactggtggcctattgcccctgccctagagatttgtggaactttgaacttgagagagatgatttagggtgtctggtggaggaaatttcttagc

SEQ ID NO: 20056 - DNA, 201 bp, Homo sapiens
cagtggttggcaaactatagcccttgggacaaatcaggtttaccacctgtttttgtatagcccatgaaataatggcttctatgttcttaaatggttgaggaaagaaaacaaaagatgaatgatgtttcatgacgtggaattacatggaattcaaatttcagcgtccataaacaaagcttaaccagaaccatcgtgttcatt

SEQ ID NO: 20057 - DNA, 201 bp, Homo sapiens
cctagagatttgtggaactttgaacttgagagagatgatttagggtgtctggtggaggaaatttcttagcagcaaagcattcaaaaggtgagttgggtgcygttaaaagcattctattttaaaagggaaacagagcataaaagttcagaaaattggcaacctgacaatgcagtagagaagaaaaacccattttttgaggag

SEQ ID NO: 20058 - DNA, 201 bp, Homo sapiens
ccaaatttcaggctctacttcaaacaagtgtattatccacattttaaatatggggaagctgaagctaaagaagattaaatcacttgcccaaggtcaccacmggtgagcttgaacaagtggtccgaatccaaagtttaagtgatttctacaccgcactgtctatggactttgctgtttcatgagtgagctccccaccctaag

SEQ ID NO: 20059 - DNA, 201 bp, Homo sapiens
ggccaagcctgctaggtaaggaaccctctcctggtgcaagtggagggaagcatgggctccctggggcatagcactgcccaggcagctggaagatgacctargctcaggaaggatgccagcctggacaatgggatagagctggcctgggatggtgacacggtgattccatactcaggaggctggacagctgcctctgctgag

SEQ ID NO: 20060 - DNA, 201 bp, Homo sapiens
ggtgtttcctttgcagcttgcttgctttatgaatgattttgttgaaagaatttaaaagccttttccttcctttggagaaaccataacttatttggataaaytgctccagaatgggattcccctgtcttttctgtttgtatcttttctgccttttaccaatccatgccatgatgttctgttgtgtgggaaccagtctaagac

SEQ ID NO: 20061 - DNA, 201 bp, Homo sapiens
aatggatggtcataacccttcattgactcttgagtactgtgttgggacagcttttgcagtcggaggcctggctctggtttcctttaccaagctacattttytccattgcattccaggtcttgaagaagattctgaagttacacggaaggcttggatagctgtatttcattcctgttcatatgtaaaatgtctatttggtgt

SEQ ID NO: 20062 - DNA, 201 bp, Homo sapiens
catgctagcccccggcagaataatgaatggtttcaaaggcaggatgcaggttgaaaacatcagtttctgtctcttctagtgcttttttttttttttttttaatttcaggactagccacatgtaagttactaggtttacaaaagccagccaaggctaaagggtgttgccctgctggggtgggaattgctagtggcatgactg

SEQ ID NO: 20063 - DNA, 201 bp, Homo sapiens
gatggagaacacctggttaccattcgctttataggtctcccttgtctttgaagactattattacatacttgcttgcatgaggcaatgggactgttgcctarcttgtggaagagtggcattccctatctacaaaacctctcagtatttgagacttcttaatgtgtcctggtctttagaagctgagttaggaaaaataagttg

SEQ ID NO: 20064 - DNA, 201 bp, Homo sapiens
caatgattaatgactatatttttataaaactttttgataactgatagtgccaatcttcccctccatttgtctttaaaactggctaatcttagccattatartttcatatgaattagaactaacttgtcaaaatcttcaggttttgtttggaaatgcagtggatttattgactacttttggggaaaattaacattttcacaa

SEQ ID NO: 20065 - DNA, 201 bp, Homo sapiens
ttggtcacaattcaaagacattctaacaggccactaaagtcacttccctgaccccaaaatgagtttattagcataaatggtgaaattcctggctgggtgcrgtggctcacgcctgtaatcccagtactttgggaggccaaggcgggcagatcatgaggtcaggagatcgagaccatcctgggtaacacggtgaaaccccgt

SEQ ID NO: 20066 - DNA, 201 bp, Homo sapiens
tataaaactttttgataactgatagtgccaatcttcccctccatttgtctttaaaactggctaatcttagccattataatttcatatgaattagaactaayttgtcaaaatcttcaggttttgtttggaaatgcagtggatttattgactacttttggggaaaattaacattttcacaatgttgaatcttaccaatatttc

SEQ ID NO: 20067 - DNA, 201 bp, Homo sapiens
gtggaaatgcccagcagggtaccaggtatgcaaggagagaggtctgtcctggagataaagactgggagtcatttgcatccaagtgatagttgggcacttcrtttcagtaaggccttttagggagtgagtgtggattgaaaataaaagtggggaaaggcaagtatgaaactttaggaaatgtggcttttaaagggaagtgga

SEQ ID NO: 20068 - DNA, 201 bp, Homo sapiens
cttgggaaagtacccctgccatacacaccagaaaccgctcagccaaatggtcacataggctaaggtgggggtcccagacactctttcctttgggcaatgccctacctgtttttagggtgtcatttcctaaatataaaatagctttttctggtacgatctccatctgcccaagatgttcttaggtctttttgttaggtagcc

SEQ ID NO: 20069 - DNA, 201 bp, Homo sapiens
acttgctaacatgatatcaagaaaaaagcttgcacactctccaattggtatactggctccatgccagttacatagttttgggtttttccttgtttttcatgtacaaggatacctcagagaatggttgtttggctccagaccactgcagtgaaacaaatatctcaagaaagtcacataaattctttggttttccagtgcata

SEQ ID NO: 20070 - DNA, 201 bp, Homo sapiens
ttgggaaagtacccctgccatacacaccagaaaccgctcagccaaatggtcacataggctaaggtgggggtcccagacactctttcctttgggcaatgccctacctgtttttagggtgtcatttcctaaatataaaatagctttttctggtacgatctccatctgcccaagatgttcttaggtctttttgttaggtagccc

SEQ ID NO: 20071 - DNA, 201 bp, Homo sapiens
agtggatgttgtgttagcaggtatgaaaaccacattaatctttgtttccatcagtgctcttggtacactgtcaatgagctgtaatattttgaaaggaatctttttttttttttctgagcaggtctcaacagtgggcttaaaatattcaggaaaccatgctgtaaagagatgtgctgtcacataggctttgctgttccattt

SEQ ID NO: 20072 - DNA, 201 bp, Homo sapiens
tgggaaagtacccctgccatacacaccagaaaccgctcagccaaatggtcacataggctaaggtgggggtcccagacactctttcctttgggcaatgccctacctgtttttagggtgtcatttcctaaatataaaatagctttttctggtacgatctccatctgcccaagatgttcttaggtctttttgttaggtagccca

SEQ ID NO: 20073 - DNA, 201 bp, Homo sapiens
gggaaagtacccctgccatacacaccagaaaccgctcagccaaatggtcacataggctaaggtgggggtcccagacactctttcctttgggcaatgccctacctgtttttagggtgtcatttcctaaatataaaatagctttttctggtacgatctccatctgcccaagatgttcttaggtctttttgttaggtagcccac

SEQ ID NO: 20074 - DNA, 201 bp, Homo sapiens
tcctttattgtctttttcctctaagaattccattgttgaccaggtatggtggctcacacctgtaatcccagcactttgggaggccgaggcaggcggatcaygaggtcaggagttcgagaccagcctggacagcatggtgaaaccctgtctctactaaaaatacaaaaatcagccaggtttggtggcatatgcctgtaatcc

SEQ ID NO: 20075 - DNA, 201 bp, Homo sapiens
tgaggcaagagaatcgcttgaactcaggaagcggaggttgcagtgagctgagatcgtgccattgcactccagcctggatgacagagcaagactctgtctcaaaaaaaaaaaaagaatcccattgtccctgcttactttctaacaggtgaacggggagccggctgtcattcctgcctcaaggagtattggaactgtgggagt

SEQ ID NO: 20076 - DNA, 201 bp, Homo sapiens
ccgccaccgtgcccggctaattttttgtatttttagtagagacggggtttcaccatgttagccaggatggtctcaatctcctgacctcatgatccgcccgygtaggcctcccaaagtgctgggattacaggcgtgagccgctgcacctggcctgaatttcttttaagctttttgctatatatatatatatatatatatata

SEQ ID NO: 20077 - DNA, 201 bp, Homo sapiens
tgtgcaccttacctttattacaagaaccagccaaacaatgattccttcttttttgtggttctctatctccacacctatccttgaagtttctctttatctckctctttctctttttctatttctgtcatatttttcagttctattttctatgttgcttctcgttcttttttctctttagtccttccctacttattagaaatt

SEQ ID NO: 20078 - DNA, 201 bp, Homo sapiens
cttccccaacagagactgagaactgggtctgagatagagtgaatgggaagatgaactttatcccagctcttgaaggatttacagcctagcagagctgggcytaatttcctttaggaaaggagcacattctaataaatttaatctatcagaggcagacggcagcatggatgaaaccaatgagggaatgaaactaatcctccc

SEQ ID NO: 20079 - DNA, 201 bp, Homo sapiens
ctgtgacacttgctttctttctgatgctggtgcctgtgacaggctctgaactctgctctctctctgttgccctgagctgaagttgtccctgagggattttmatcttgcagaataatttggcatttacagataatttaccaaaccatttgtttccatatagaggaagtcatgctcgctgaagaaaataaaaatgctggaaca

SEQ ID NO: 20080 - DNA, 201 bp, Homo sapiens
ggaatcactatggcagctatagccttatgaagtacatttcttaagtaataagacttgaaagttgaaattgctccttaatccatgggctacagaatggatgytgtgttatcaggcatgaaaacaacattaatttccttgtgcatgttcatgagagctcttggatgaccaagtgcattatcagtattttgaaaggaatctttt

SEQ ID NO: 20081 - DNA, 201 bp, Homo sapiens
aacagtgggcttaaaatattaaggaaaccatgctgtaaacagatgttctgtcatccaggctttgttgtttcatttatagagcacaagcagagtagatttarcataactcctaagggccctaggatttttggaatggccaatgaacattggctttaacttaaagtcaccagttgcattaacctcctaacaagagagttagcc

SEQ ID NO: 20082 - DNA, 201 bp, Homo sapiens
attggctttaacttaaagtcaccagttgcattaacctcctaacaagagagttagcctgttctttgagtctttgaagccaaacgtcgtcttctctacttacrattttctcgtctctagttatgaaagtcctagatggcagcttcttgcaatatgaagctgtttcatctacattgaaaatctgttgtttagtgtacccgtctt

SEQ ID NO: 20083 - DNA, 201 bp, Homo sapiens
tcaataatagctcaatattttcatctaattcataaactcaaaggttttggaagttcattctgtagaagattaaacattgacattattgtgggtgctattgraaactgagttaaaagtttagtactagcaataagcttatttttggagtgataatatacatacaattttgatgaaacatgatgttattgtataaacaaagtt

SEQ ID NO: 20084 - DNA, 201 bp, Homo sapiens
ataagaaaagaagtagtaggcaaatagaatgagtaaaaaagaaaaagtaacaagaaaatttagcaagttcatcaaaaagcaagaaagcagagaaaggaagygattttaaagtgaggcaagcagaatgtgtgaaagtagaagtaagtcctgacttaatagcaattgaaacaaatgtaacagattaaacttattttttaaaag

SEQ ID NO: 20085 - DNA, 201 bp, Homo sapiens
ctcatgtgacagctgctttcccttccacgctgccttggaccctggagtctagagaagcaatttgctcctcactattgcttccagaccattactcccctctyctgtcctaaaaatgccagctgtggcgtgcatgtcatcagataataccacctactacccctcgttgccaccatctacaaactcccaagtcacttgcttcat

SEQ ID NO: 20086 - DNA, 201 bp, Homo sapiens
tattcaccttcccttgaccaagaaattgggtttcttttccctcagcctgcacttactcttctattaagaccagaaaataaaataattttccgttgagtcamaaactcatcatcttgtttggtgttctgctgcctctgaacaaaagtgaatgccagccttcccttgctgggtgtcagagtctgcctcccttgaaaagaggcc

SEQ ID NO: 20087 - DNA, 201 bp, Homo sapiens
tggaaaaacctactctatgctgtcttcaaggctatctctaggtaggcctgtccctaaaccctcctccgaagttggtgtgaattcctgtgcttaaccacatrcaagatctagcaaaacacttcttcttttctaaccctaactcttcagctccagctccagcctattccctctggatcttgttctaggttgtctggtggttct

SEQ ID NO: 20088 - DNA, 201 bp, Homo sapiens
atccatgcctttaaccatgatggcacagtgcctttcattctaactctcaaagtacttctctcaacaacctattgagatgccatggtaagagcactggtgtkggggtttggagacttgggtctaattcccagggtgacctaattagtggtgtgaccttgagtaagtcacctcatcatgacttcgaaagacaagtaggaggga

SEQ ID NO: 20089 - DNA, 201 bp, Homo sapiens
taaataaatggttgtcacgagtctttggagaaggatttattattgtggccatagattggagtggtccttgaggatgttaattatgttgctgcttgttgcartttatgacatggcttctatgtggggtaattggatctaggggagctatccttttccatggaaaaaggccagtttggtctcaggtttatagccctaaggaaa

SEQ ID NO: 20090 - DNA, 201 bp, Homo sapiens
ggaaggtttcccccaaggaagcatttcccaatgtggaaaaacctactctatgctgtcttcaaggctatctctaggtaggcctgtccctaaaccctcctccraagttggtgtgaattcctgtgcttaaccacatacaagatctagcaaaacacttcttcttttctaaccctaactcttcagctccagctccagcctattccc

SEQ ID NO: 20091 - DNA, 201 bp, Homo sapiens
caggattccaatgaggaagcctgactccagagcttaggtttctgaccgtgatgctacactgccttcctaatttatgtatctagtggctgcatggtctgaattttttttttttttttactcctgatgcatcttaattaacaaaagtgaaagggtgtatctgttggtctggatgtcaaaatccatccaagggaatataaaact

SEQ ID NO: 20092 - DNA, 201 bp, Homo sapiens
aatagaagaggctgctccttgggtgagaagacaaatagacttttgagttccctttaaaggctagacacttggataactaggaagggttcttagtaaaagcraatgccttttatgagactgtgcagtttacaaagccctttgatgtctgctacctcatttcattcttttaacaagtaagttagaggacattgcagagataag

SEQ ID NO: 20093 - DNA, 201 bp, Homo sapiens
tgagtgcatgaaagtcttcaggaagagtgtagcaagaaggaagacagggcccagggctaaggaatttggactttaccctacgagaagtggggagccaatawtgtattttaagcaggggcatgaggcaactggtgaggcctgcaggactaaagggagtgccagagatgtctgacaaggttgctgccctcaatgaactaattg

SEQ ID NO: 20094 - DNA, 201 bp, Homo sapiens
gctactccctggaggcttaggcaagaggattgttgaagcccaggagtttgaggccagcctggacaactagtgtctctctgtccctatctctctgtctacaraaaaaaaaagtgcaacctctctgaatatctgaatcaatacccctttactctttgtacagcagcctctgactgaataaataagtactttttgtatagtggc

SEQ ID NO: 20095 - DNA, 201 bp, Homo sapiens
aaactcagtctcaaaaaacaaagaaaaacaaaaaaaataaagtcatagctagcaatgttttatttgagagtcaccacctaaagggtaaagcctttgagtgsatgaaagtcttcaggaagagtgtagcaagaaggaagacagggcccagggctaaggaatttggactttaccctacgagaagtggggagccaataatgtatt

SEQ ID NO: 20096 - DNA, 201 bp, Homo sapiens
agattgcagaggttcccagtccctgtctgcagttactcacatctttgctcctgaagtctagtatgtttcatttgtatttctgtagttggagttatttctcktcttacttactgttgataaactcatgtagaggcagaaatttcttggaggtgtactgtttctgcagctttgcaggtatgctttccgcatctgttgtgacta

SEQ ID NO: 20097 - DNA, 201 bp, Homo sapiens
ttgtctctactaaaaaatacaaaattagctgggcatggtggtgcatgcctgtaatcctggtcactcgggaggctgaggcaggagaattgcttgaacctggraggtggaggtttcagtgagccaagatcgtgccactgcactccagcctgggtgacagagcaagactccatctcaaaaagaaagaaaaaagaaaccatctgg

SEQ ID NO: 20098 - DNA, 201 bp, Homo sapiens
gctaacacggtgaaaccccgtctctactaaaaatataaaaaaatagccgggcgcagtggcgggcgcctgtagtcccagctactcaggaggctgaggcaggrgaatggtgtgaacccgggaggtggagcttgcagtgagccgagatagcgccactgcagtccggcctgggtgaaagagcgagactccgtctcaagaaaaaaa

SEQ ID NO: 20099 - DNA, 201 bp, Homo sapiens
ggcaggagaatggtgtgaacccgggaggtggagcttgcagtgagccgagatagcgccactgcagtccggcctgggtgaaagagcgagactccgtctcaagraaaaaagaaagaaagaaagaaagaaatgtactcttgaatctgctggacaaattcagtctgtggagtaagttgagaaacctgtctcactgcatagaagtag

SEQ ID NO: 20100 - DNA, 201 bp, Homo sapiens
ccactcttcactgccttccaccttgagccccattgtctgtccacaagaggaaacaggattttgtgcactgatgaggcagcagagtagtggagtcaattacaaaaaaaaaaaaaaaatatatatatatatatatattgtatttgactgatgagtacagctttggtttatcatctgcactggaatatctttgatgttttggga

SEQ ID NO: 20101 - DNA, 201 bp, Homo sapiens
tccaccttgagccccattgtctgtccacaagaggaaacaggattttgtgcactgatgaggcagcagagtagtggagtcaattacaaaaaaaaaaaaaaaatatatatatatatatatattgtatttgactgatgagtacagctttggtttatcatctgcactggaatatctttgatgttttgggaaatcacaacactcaaa

SEQ ID NO: 20102 - DNA, 201 bp, Homo sapiens
aattgagtcacagatttaaatgccttttaaagtgatgaaaatgaaacccaagagttgctttgttccagggcatgtgattgatactgagcaaggaaaaggcsatcctacaaccaatgctatctaaagggaccttctcttaaaatgtgtggggatcaccttgagaccactttcattaccaggaagtggcattgtagatgaaga

SEQ ID NO: 20103 - DNA, 201 bp, Homo sapiens
acggacttttcatgaggcatgcatgtgtgaacactgtaattagtatttccaagagagaaaagcaaccccctcccccgcccccgccaacaccccaacactgyacctacccggagactttgctcgtgacacatttttttttccccataggagagaatgttaaagtagggccatctcttagatgaaagtcctagaggctttggg

SEQ ID NO: 20104 - DNA, 201 bp, Homo sapiens
cagttcttagtgatttcagtatccatgtagatgacccttcctgcaccctgacctcttggttccttagccccttctgtttggtgactttgccttcttgcttyctgctgacagctcacctccatggtctgcctggacattgtcgtaactgcattactccataatctcggtttcaagcatcccactgtgtgatcaccccctctt

SEQ ID NO: 20105 - DNA, 201 bp, Homo sapiens
ttgatgccaagaaagtgctactggaaggctgctataggtttaagaacacaatgattggtcattctttttctttcctacccagattggaaattccaagtttkctctgtcatcacatctggttaatgcagacactcgaatcactgtgtgttctagtactcagaacttaaaagtcatcatatcggatatgggagactcactgac

SEQ ID NO: 20106 - DNA, 201 bp, Homo sapiens
cctcaatgaactgggtggatcagcctgacacagaggcagcagttggggagcattctaagttaagagttaaaaattgtagctcttgacagatctggtctcargctcacctgacttgctaaattagtgattcatgcagtaagatcattcagattccaaaaagggaggcatcagtatggggagagcatcttttcacctttgcac

SEQ ID NO: 20107 - DNA, 201 bp, Homo sapiens
actgggaatataagtaagaatgacaggtaaacaattaccgtaggaaatggtaaatgcaaatcctaggagtacagagaagctgtggtagcacggagtccctstgtctggggagggcttcccagggcaggggttactgaaggatctgaagatgtgaggaggtgcttgcttgggtgatgcccatccaaggaagaccaggatcag

SEQ ID NO: 20108 - DNA, 201 bp, Homo sapiens
gtgttggcttctttctgtttgtatccaggagggtgggaggccccaggagagcagacatctggggcttctttctgttgcactgccaatgcctatccacagaygaccttatgtgaaggtgctaggctgtgaattcctttgttttatttcaggaaacattgattaaacatctattttggatattcaaagacaaaaaatgaccaa

SEQ ID NO: 20109 - DNA, 201 bp, Homo sapiens
tatagaaatacttctgtgctgttgacgaatagtcagcccttagcaggcactcatatattttcttccactgcctcgctcaccctaactaacccagtacctakggcattctcaagatctagaaatggaacagttactgtgtgacatagcaggaggtctcctgttctgactggttagtgcccttgccataccagatcaatattt

SEQ ID NO: 20110 - DNA, 201 bp, Homo sapiens
gtgtatgtgtgtgtgtgtgtttgtgtgtagaaggggttcaagaagaaggaaagacaagttctaggcagaatagatggcatgggaaaacacccagaggccaragataatttggcaattgagagaattagaaaccgagattatgggtggtttttagagcgcagtaatatcatggatggaggtatggggagagattagattagc

SEQ ID NO: 20111 - DNA, 201 bp, Homo sapiens
acttacaatcatggtggaaagtgaaggagaagccagcatgtcttatgtggctgcaacaggaggaagagagagagcaaagggggaagggctacacactttcraacaaccagatttcatgagaattcactatcacaagaatagcaagggggaagtctgcccccatggtccaaccttctcccaccaggtgccctcccccaacat

SEQ ID NO: 20112 - DNA, 201 bp, Homo sapiens
tggcagggccacatctggaggcctcccattctgtgaaacaccccagcagtgtgttaattgatttattttgagtgcagtttgtttggatgtgggtagactattgatgctgtggcactttggaagctcacgtttccaagccagagatacttcatttgtgtctgaatgagaaaaatctcaagatacatgccgttccatccctga

SEQ ID NO: 20113 - DNA, 201 bp, Homo sapiens
tcagtagccccatgcgattcagagggcaggtactacttttgccatttttgcatgtaaggatataaacccaaccaggactgaggtgcaagcctcctggtgtygtttccaccctgataactcatttattctgaggcccttcggcaccatctgtagagtctggatatattcttgcctcttggaactgtagaatcatcatgaaat

SEQ ID NO: 20114 - DNA, 201 bp, Homo sapiens
cctgacaacttgctttccaggtaaaatagcatcatttttctaggctggcttcttctatgctcactagcagggctgacctcagatgtctggggcagtcttargtaccttaccagactgtggtgttctttggggggacttccaggactgggagaggatgtggcaggggccattgttctggagtctcccaatatctgtgaggtc

SEQ ID NO: 20115 - DNA, 201 bp, Homo sapiens
atggcattcatgttttccagtactagttttagatatgttcctaaacaaaacacaacaaaatggaggaaaagaaagagagatacgtactgagcctactttcktgatcaacacttctatacttatttgttttcatgtctcattccccttcatgactttgaatttcttaagggcaggaatccctttctttctgagcactaacca

SEQ ID NO: 20116 - DNA, 201 bp, Homo sapiens
cgtgctctgagcataggtggtgttcagcaagaagaaaggtgcctggagtgtgtttaggattccagaggagtgcctgggccgtattcccagaaggagagggrgttgttgcagtatggctgggtggtgagataggcctcctgcctgccccctcagtgggatggtgcttgtcagtgtgaagtaaaccctggagcacctgaggga

SEQ ID NO: 20117 - DNA, 201 bp, Homo sapiens
cctttattttaaatttttctaacaaggaaaatgttacattttctagatttccatttttttggtcttccctttctttgtcttctatcctccccacttctcayaaaacatacacaggccagaggggtcagcccctgtccgcccacatctggatgtgacccaggaaggctgacaatgccctctctcctccaggaagaatgtcca

SEQ ID NO: 20118 - DNA, 201 bp, Homo sapiens
tctttatattgtgtgatgtgggagagatggagaaggagaggtaaaagagagggtgtaaggtactggaactgctatggggggaaagggaggagggaattgayaggggacattaaaatttgaattacaggacttggtgattatctggagaagtagagaaaggaaagagaagggaggactcccaggtacttgactacagcagca

SEQ ID NO: 20119 - DNA, 201 bp, Homo sapiens
cacacagtttcttaataactgtagctttataataaaagtcatgtggtgatgtaatttttctaaatttgttctctattttcaggtttgtcttggttattttkttttcttctcagcatttatgtatacatttagcctttaaaaaacatgagggctaggagtgctgaccacctcctgggcaaaaatccacatataacttttgag

SEQ ID NO: 20120 - DNA, 201 bp, Homo sapiens
cccatctctactaaaaaaattacgaaaattagctgggtgtggtggtgcacacccgtagtcccagctactcgggaggctgaggcaggagaattgcctgaacyggggaggcagaggttgcagtgagctgagatcgcaccactgctctccagcctggtgacagagcaagactccatctcaaaaaaacaaaacaaaacaaacaaa

SEQ ID NO: 20121 - DNA, 201 bp, Homo sapiens
gcctgccacatggtgagagcaggaagcaagagagtggggagggaggtaccaggctcttaaaaattctagacagaactaatagagcaagaatggagaactcrtcatcattaggatggcaccaggcatcaagctattcatgggagatccactcccatgacccagacacctcccattaggccccaccttcaaccctagagatcc

SEQ ID NO: 20122 - DNA, 201 bp, Homo sapiens
aaaacaattctgtggtgccaggtgagatgaactctccacctcttcctgagggctttgtcttcatgcatgggacaaagcagtgtaattaacatgcccccccmccccgccttaaaacctaatattcattcatctcttactttggttattatttaaaaagaaaacatttgtcaattacttcacactgacaagcaccatcccact

SEQ ID NO: 20123 - DNA, 201 bp, Homo sapiens
cactgagggggcaggcaggaggtccatctcaccacccagctgtattgcaacaacgccctctccatctgggaatacggcccaggcactcctctggaatcctraacacactccaggcacctctcttcttactgaacaccacctatgcttggagcaccatgtgagaggacacctctggtatcaggcagcttcagatgtattcag

SEQ ID NO: 20124 - DNA, 201 bp, Homo sapiens
gatagggcctgaaggcttgaatggtcctacaagactttctcaaaagtcgtcaccctgggacctgaaacattagagctctttccagagtaagtctattctcrgccagaggtctccaacagaggctgtccatgtgtactggtttcaagttctgcttacctcccaagtgttgttttttctgaccctgacctaattcctcccagg

SEQ ID NO: 20125 - DNA, 201 bp, Homo sapiens
cagaggaatttcatttataaagttccttattgctgagcctctgtgtgttccagttatgagtcacatgtgtcaacaccgtggaaatgaaatttgtaccccctggacccatgcagattgatttgattctgggctaaatggaaatagaacctgtacaagtcaaatgtttctggagcatctgccatctacagggcacttggagga

SEQ ID NO: 20126 - DNA, 201 bp, Homo sapiens
tttacagaaacctcaggacatttttattcaaacccatccatggagttccctcaggaggaaggagcttgggttcagctcctagttgaatcaagtaactctcygccttcatctgtttaattcatttacacttagagtagtatttcttttgcagaaagggatgcatggctaaaaatgtactactgcttccattaatgaaaatta

SEQ ID NO: 20127 - DNA, 201 bp, Homo sapiens
tatttttggactctggttgactgagggtaatggaaagtgaaactgtggataaggtggggactactgtattatctaacacattgcttttcagagtgaatgtrtcatttccactctgcatatcatatgcagcactcccatttctatatatcttcaacatcacttgagatgttcagaattattaaagtgtgccaatctgatggg

SEQ ID NO: 20128 - DNA, 201 bp, Homo sapiens
aattccatgaaatatgaaattgttaccagtaagaaatataagcatagtaagtaggtcctctattcagctcagttgtcaaccaaatttatgttgctgatgcygaattttgatatagccccttacagtgctgtgattaccttaagtggatggaggaggctgaatatgaggaggggaaagggagggggagatttcagtcaaaga

SEQ ID NO: 20129 - DNA, 201 bp, Homo sapiens
atggaaagtgaaactgtggataaggtggggactactgtattatctaacacattgcttttcagagtgaatgtgtcatttccactctgcatatcatatgcagmactcccatttctatatatcttcaacatcacttgagatgttcagaattattaaagtgtgccaatctgatgggtgtgaaatggaatccaattattgcattaa

SEQ ID NO: 20130 - DNA, 201 bp, Homo sapiens
acatcaggaccctcttagggaatgccatgcccccctatgacctcctggaggatagtattgcagagaactgaggaagaggctggcatcttaaaagtcaggakcataatcactggtactggagatcctcgaaaaacctgcagagaagctgtttgctttctggaatgttgatcccagcttacaagcattacagacaagtaatta

SEQ ID NO: 20131 - DNA, 201 bp, Homo sapiens
gtggcaagtcaacagcctactctgaatgtgtttcatttttcttggaagctacatctgcatagggagataattttattttcttatggcactttcctctgcartggataccatactctttttaaaaatgctaatgtgatttaaaatgtgatgttacattctatacgattcctcgttttcattttcttttttgctcatctaata

SEQ ID NO: 20132 - DNA, 201 bp, Homo sapiens
ttctttggactggaagaaaaattataacctgtttgcttttagggtcattgtattcatctacaatagtatatggtttgttacagattccagggcattttccrtatatatattttattttttttcctactataactttaaaagacattatttcccccattatttcaattaataaacaaaggcttattgatgatttaactagaa

SEQ ID NO: 20133 - DNA, 201 bp, Homo sapiens
agggggtgttcaagagtcagtgcaggtgctgagcttggctgagtcagttgtcctctctgtgctctctttcccatccctcacatcttcccttcttagtggcwcttcagatgtccctggctttgtgaattgccttcacaggcccctgatttccatatgaactcacaggactttgctcctgctcctcctccagacctgctgctt

SEQ ID NO: 20134 - DNA, 201 bp, Homo sapiens
gtatattggtggttgatttgtggcaaagatgcaagttcaatttagagggggaaaggaaagtcttttaataaattttgctatatccactgtatattcatatwaaaaaagtgaatctacagctgggtgtggtggctcatgcctgtaatcccactttgggaggctgaggtgggcgaatcacttgaggtcaggagttcgagacca

SEQ ID NO: 20135 - DNA, 201 bp, Homo sapiens
gctcatgtcttattttaaatgcagaaggcttcatattctatattggcacttgcacatattattttaaatatagaaatgtaaggcaatagtgatattatctycattttacagatgaggaaaccaaaacttaaagaggcaaagtcacttgctcaaggtcaaatagttactaaggggagagattggccctttaattctattatc

SEQ ID NO: 20136 - DNA, 201 bp, Homo sapiens
catttgaaacagtgctctgcacatagtagattttcaacaatagtacctgctactattttatagtttattgatgaggaaagggaagcatataatgaacaaayatattctctgggttactctagcccccacaaaaaacttgccctagctgggatgaagttgttgtccttgtattttcaatctgttgctacttgtgctggatta

SEQ ID NO: 20137 - DNA, 201 bp, Homo sapiens
ctctcaggcatggaaaggcatgagagcacttccccatctttctcacccaactttcatgcccattgcccctgcttgtgggcagattttcctttttgctgccyggtctgagggataaggtgggttaaggaggagggttaaagtgagtgcttgatcttcctgctactgtattcaaaccatcaccctgttggtcacctggatccc

SEQ ID NO: 20138 - DNA, 201 bp, Homo sapiens
aggtcctatgtaaaaatgtcttctcctgaaggtggtagagttatttagaatctatgaggtgaacagctagagttcagaagttgtctaacagtctacacgtrttcagtaacatagactttatcaaaagatgcactctcctcctctctaaacctcaccagtattccttcccttccagtgttgatttgtattatccttgatgca

SEQ ID NO: 20139 - DNA, 201 bp, Homo sapiens
gacaagaagcaattgcaatacatcaccgcactaatgctctgttgaatgtattctgggagtatggaagaaggagaaggtgactgtgtttgggaaaaaaaaawcacagagaggtgatatttatttaagctggatgttgaaggtgggtaggagattgccaaggagaacatgggaaagggcattcagtcagggaaagtggaggaa

SEQ ID NO: 20140 - DNA, 201 bp, Homo sapiens
  misc_feature (1)...(201): n = A,T,C or G, or insertion/deletion polymorphism (see Tables 1-2)
gaaatttagaaacccaaaccttgcatacatatgtagcatctagagtagaggctcatccatgcttaactccaattcaccttacttccctgtatgcaagagcngtatgtgaggggacctacaggttatcctccctcagaggagccaggtttggggctggaggagcaacctaaaattaaggatgacagaattgggtaaggagaa

SEQ ID NO: 20141 - DNA, 201 bp, Homo sapiens
gaaagtgtcttacttcccctttgccatgattctaagtttcctgaggcctccccagccacgctgaactgtgagtcagttaaaactctttcccttataaattwcccagtcccgagcagttctttatagcagtatgaaatcggactaatacagtggcatgccttttaatttcttgatttatggaatacctttaaagtaatgtta

SEQ ID NO: 20142 - DNA, 201 bp, Homo sapiens
gaacctcaatatcgctctccccacctccctccctctttctccaacctttggatgcgtctctgctggcagatataaagacccaagtcttcgcggtggaattycttagatggacttgcaggggctggcgttataaagcatgtcatcgtaaccccgtcctcgtctttgtttatttttttttaaagttcttttgttttcattttc

SEQ ID NO: 20143 - DNA, 201 bp, Homo sapiens
gagggctgtgacctgggctgtgtcagtgggaccagaggaggggacagatacaaaaaatacttaggggtctttaaacttgggggatgagagggaagaatccmagatgaatcccaagtgtaggggagggtggcttttttcaccctggatgaggagcagtctggtatggagaggggatgagggtggctctggctttggcggttg

SEQ ID NO: 20144 - DNA, 201 bp, Homo sapiens
agtcccatttttaaattcagctctggctagactgcctctgcagtgtttttgaaatgggtgctaccttagaagagcaaaaaggagtagtctcagatacaatygtccagaataactagggtttaatctaaagagtgagttaccaggaaatgagagaaggagtgaggacataggcctggagaagcgaataattccagaagcaag

SEQ ID NO: 20145 - DNA, 201 bp, Homo sapiens
  misc_feature (1)...(201): n = A,T,C or G, or insertion/deletion polymorphism (see Tables 1-2)
gcaacctaaaattaaggatgacagaattgggtaaggagaagtatcgggaatgaaacacgacttggatttgtgtcactgtacaatctcttatgggaatctantcaggactctcagagtcaaccagatctatccctgcctctggttatgagcctagggtttatgtgggtcctaatgtcaactcttactgatgaagaaattgag

SEQ ID NO: 20146 - DNA, 201 bp, Homo sapiens
tgggctgttactgcaagtgtaatgagaagctagggagctataagcaaattggtctgacttacaccctagaaatttcactccactgtgtaaagaatggattrcacagaatatgtgcaggctggaggccttgtagggagctgttggagagtggaaatgcccagcagggtaccaggtatgcaaggagagaggtctgtcctggag

SEQ ID NO: 20147 - DNA, 201 bp, Homo sapiens
tggatctgtgacttgcctgaaagagttatttgagaaggtttttataaactcaaacagatcctttaaactagatatttcccagactgcccaaaaaagggccsctgtcccccaataccacacaacactatgagaaagtagaattttattgcttgggtttttcttttcctcatactttgaaagatctctttggccagctttcca

SEQ ID NO: 20148 - DNA, 201 bp, Homo sapiens
ctgtccatgtgtactggtttcaagttctgcttacctcccaagtgttgttttttctgaccctgacctaattcctcccaggccaggctggccagcaccttctkaaattgctctcaggcagctggaaggcctggctggcaggagccctgggtttttcaccctcagccccagggctctttgaaggcctactctccaagaacaaac

SEQ ID NO: 20149 - DNA, 201 bp, Homo sapiens
cttttgctcctgccctcagggagacaagacatgcttgtgttcagtggatgccttgaggaagtgttatggtccctttgagcattatggacccattgctgtgkggtataaaggcagtggcggtgttctctctgaggtagccaagaaaggcttcatagagaaaccttgtagacatagaatttcaccagggggagaaggagatca

SEQ ID NO: 20150 - DNA, 201 bp, Homo sapiens
tttcagtctctctgaatatatcttaagttgcctgataccagaggtgtcctctcacagtgtgctcccccagcatcgtgctctgagcataggtggtgttcagyaagaagaaaggtgcctggagtgtgtttaggattccagaggagtgcctgggccgtattcccagaaggagagggcgttgttgcagtatggctgggtggtgag

SEQ ID NO: 20151 - DNA, 201 bp, Homo sapiens
attactgcaactcatgaatgaccgtcagaggtttctgagcctacagggctggggcaggggtgtctcctgaccatttcaatcttctgccacagcctggaccwcacagacagctttagcatcagaagagatggccacacccagagctgggcccccagtatccacaaaggaaagttcagcttaggaagaagaaatggggagaga

SEQ ID NO: 20152 - DNA, 201 bp, Homo sapiens
cttgggtaattggatgatctacagaacgtatatgaggacttgttgggtgatgcccaagtgctatgtctttgtctgcagcactttctactttgcgtggtctrtaaaagacagctacagaatacagtgtggtctgtctttggctttgaagttggacatgctgaatattattaattattccttgcaatacagcaaaaagttctg

SEQ ID NO: 20153 - DNA, 201 bp, Homo sapiens
tgtcagggctgatcaatcaggtttgtgagcaactgacattgagggctggactctggagtagatagagtttactcaggaaagcctctcactagaggcttccygggagaatgctgtctggcctgtaggcaatagtccttgatgccattccttttccagtttggtgatacttgactctgagttttctttaaggcagctgggaca

SEQ ID NO: 20154 - DNA, 201 bp, Homo sapiens
ctaacatgccatgtctctcctgctatacagggcacaggttccctaagtgagagctccatcccctctgtctctgacaccagcaccccaagaagaagtcgtcrgcagctcccacccgtcccgccaaagccccggcccctcctttcctacagctccctgattcgacacgcgggcagcatctctccacctgctgatggaagcgag

SEQ ID NO: 20155 - DNA, 201 bp, Homo sapiens
ggctttttttttttttttgtaggcaactcttatattttggatgcaggcagcatcacctgtgaataatgataactttgttttttcctttataatccatatgscttttctttctttttctttacttattacattaaccagtacttcaagtccaatactgaatagaaagagtttcagtgggtgtcctagactgatacttcactt

SEQ ID NO: 20156 - DNA, 201 bp, Homo sapiens
cagtttatttcagggttccaaatgagaacattagtattatgctaagtaacttctcttttatatcctgctccagaagtgtaggggttggtggcagaatcccrcagtggacagaggcccagaagccaactggacagaaggtctagcaaggagagctgaccctgataaatctagtcccagctgctggtgtggttgatgatagag

SEQ ID NO: 20157 - DNA, 201 bp, Homo sapiens
gaaggaagacagggcccagggctaaggaatttggactttaccctacgagaagtggggagccaataatgtattttaagcaggggcatgaggcaactggtgargcctgcaggactaaagggagtgccagagatgtctgacaaggttgctgccctcaatgaactaattggggtaggcgagataaatgtctcttggaaagtaatg

SEQ ID NO: 20158 - DNA, 201 bp, Homo sapiens
gaaagctcttctggtggctggtggggctgtggcacctactagatcactgtgttatttccagatcctgtgtttggtgtaaatggtacctggtttgtttcctrtctttaaattacagtattcttaggagtgctgttcttttgaactgcacctgttggactcttcttaattcccgaagaatctgggccattgttttttaagctt

SEQ ID NO: 20159 - DNA, 201 bp, Homo sapiens
ttttccagctgcctccagtgggaggggatggctccctgctctgttgtctcccagtactctcctgtggtgcactccacatcccgccttgtattcgagccctytgtgggtatgttttcccttctcctcttttgaactgtaagtttttagaggctatgactgtgtctaatttatctctgagccccagaatccctgagaacaatg

SEQ ID NO: 20160 - DNA, 201 bp, Homo sapiens
  misc_feature (1)...(201): n = A,T,C or G, or insertion/deletion polymorphism (see Tables 1-2)
ttggaggtactatgagctggggaacattagacaaagcagagatcactgtaggctgaaagaggcacattataccactaatgaattaattacatgctaatgtngaacagagcctgccacatagtaagatcccaaaaaattagtgttaggattaatgctattactgctaattatagcaaatatgtattgtatttgggctatacg

SEQ ID NO: 20161 - DNA, 201 bp, Homo sapiens
taatccccttcagtctcttttcaacaggacaaccagagacattctttgcaaacttaagttgtgggactcctctgctgcaactgaccaatcgtttcccaatsacaccaagtaaaactcaaatctttatagggtatctatggccctacatgatggccctccacttccccactgcctgctaccactctgaccttttttccatgt

SEQ ID NO: 20162 - DNA, 201 bp, Homo sapiens
ataatggactgtaggggccagagtggaggcagggaaagagtctgctctcagagtaaagtaggtgagaggtaatgggggtttagactagggtgggggaagtsaaggagatgagtaatcccattcagtcggtagtttggagagagagccaataggatgagctcatggattaaatgtggcaggggtgaggatgaataaaaggga

SEQ ID NO: 20163 - DNA, 201 bp, Homo sapiens
tagtaagggaagagcccttggttggctagagttccagtgaagggctcccaggcagcctcttccttgccttgtggggtgtgccagggttgtgtgttgaagcrggggacctccctcctgcacggccatcatgttgcctttgcctttcgtaacaaatgcctggcccctggatccctcttctgtgagtgaaagagaaaaattccc

SEQ ID NO: 20164 - DNA, 201 bp, Homo sapiens
catctgtggtgtggagaaaatgaactgacgtgagtggtccctgttagaaaactcaacagttcctctggaatgcctgggcctgctctcccaagcctgccacrgaggacacagcttggggagggctcttgtgcacttggctctcccttgcttctcaattcccacttcctattgaattctcatcacctctgatactctttgccc

SEQ ID NO: 20165 - DNA, 201 bp, Homo sapiens
tttctaatatagtcacaacaaaactgagggatctgtacaaataataaacgcaagggcagagacaagcttttggaaaaatattaatagcaacaaggtatgtytatgagaaaaaccattattattccaaactttcaaaggcgccttggaaaaagggacctttgcagaagaatcggaagttcgaaaggaggagtaacttgctgg

SEQ ID NO: 20166 - DNA, 201 bp, Homo sapiens
ttattattattacatccttacgctgtatcagcgccaaacactggagtcctcaatactgtatttatttctctgggcttttggaggggtggggaagaaacggsacatttaggttgctaagtgattgtgcttgcttctaaaaataatgagattccccagtggctcgttctcctgtgttttgcttagagttagaggatgccaagg

SEQ ID NO: 20167 - DNA, 201 bp, Homo sapiens
cctcccacctgcatccccttagggcccactactttgggaaattgcaggaaaaactgggcctccccctgcttggattgaagagcctcgcctaggcagtcagmctcagtggttgccatggtgatggtgggtggttggtggggtggtgatgcagcgtttggcctgtgcagctgaggtcctcaatgcaggctgcttggagcccag

SEQ ID NO: 20168 - DNA, 201 bp, Homo sapiens
tttttttttttttttgagacggaattaagtttttaaatgatttttatatgtgttatttcatgtcctcataacaagttgttgtgcaaccatatatattatamctctcaagtcaagtattatgttatgaatgccttgtacaagtgttgagggaaccgagttggaatgtgaataactaacccagtgtggtctatcttctgccag

SEQ ID NO: 20169 - DNA, 201 bp, Homo sapiens
taaattaaaccattgtttagtagggtctgaagctagctttcccccagcagctgggatcttagggaatgtttaacgaggcctctggctccctggcctatggrttgagctcaaactcatcccgttactcctcatagggcatgcaggatcccaccagacttgggagagaagggctattttgttgatgcacttggagggatgcta

SEQ ID NO: 20170 - DNA, 201 bp, Homo sapiens
gagacagagcctgactccactatttagagtcttgttttccaccatttgtgtgttttataaatgacaactatttgaattgaatgcaaatatctcaggggatsaacagagaagaaagagaaatgcaaatgtatttgttcattttattcctaaaaataaaaagagaaacatactgtcactattaggagtaaacatttccaagag

SEQ ID NO: 20171 - DNA, 201 bp, Homo sapiens
tctccccacatccatcattactgatttacttcttcatcgaggacctgggattttgagatgtgagatcaattttaaggatgttctggctcctaggagcgacsttgacactttttatcatatccagagaaagtgtttggcgtaatgactcccacgaggcctcacttcaatgaaaactatttttctaaagttagatatggagga

SEQ ID NO: 20172 - DNA, 201 bp, Homo sapiens
tatcttcaatcagataaggaaatcatgcagaaattcctttaaacgtggaattgttaggagaaaggaaaattcctttaaacaagaaatttttaggagagagraaaactcataacaaatgttttcacccatgacataggaagaatggcataggttccttctaggtgtaagaagaaaagaggaacctgtcttccatcctgtgat

SEQ ID NO: 20173 - DNA, 201 bp, Homo sapiens
ctcacctttgatcctctgttctgaggaattcttgatagcctaggactaatctatagttctcagaggggccagttgtcttgttgcctcctgttctcgcctcygcctgcctgtctccctggctctgagtctctggtgatatgtactggctcaccgtcaggtgttgggggatggggaggcggctgtgcagctgccgccgagctg

SEQ ID NO: 20174 - DNA, 201 bp, Homo sapiens
acctttgcacatggctccagaatttccactggttcaaaagaatccccagcaaccccagtctcaggagataattgctcttaacagcgcaccacactgggcaycccagcacttatggacagcagaggaatgtaagggtgaatgcatgtttttttttctgcaaatgactgtcactcattcatcttggagcccacctgacaactt

SEQ ID NO: 20175 - DNA, 201 bp, Homo sapiens
gtcaacacaatcacagtattttatagcccacacggaccttggactctggcatgccatgtaataggctgcaaaaagtagcagctctgcttcccatctcactkggggcatggggagaggaggattgggtttagggaggaagggtacaggtgtgaagggcacaggtatgaggtgcataggtatgagagactcaagtgtgggggg

SEQ ID NO: 20176 - DNA, 201 bp, Homo sapiens
ttagaaaagccttaattcatttcatctgacagctcagagccagaagttgccaggtctactcatttgcaggttgtgttgtcaacacaatcacagtattttayagcccacacggaccttggactctggcatgccatgtaataggctgcaaaaagtagcagctctgcttcccatctcacttggggcatggggagaggaggattg

SEQ ID NO: 20177 - DNA, 201 bp, Homo sapiens
atgcgagaggtctgcagcttgaacgagaaagtacttgtgcccagtcctaccttccagggcaggcactgggcttcttggatctgctgagcaggtgtctgaawttgcatgagacgtttccagctgtgaggagtgaccaggtgagccccacactgttgtgaacacttttgttaggaaccaggacaggggatgacatggaagagg

SEQ ID NO: 20178 - DNA, 201 bp, Homo sapiens
ttcagataacctggggtagggcttgaaaatttgcatttctaataagatccctgctgatgctgatgctgctgatgggtgcgtgtgtcgggaggggaccacaytttgggaaccactgttcactagggtttcaggttcctgagtaagagcttaaagaatgaacatgcaaatggccaataagcacaggaactgatgttcatctgc

SEQ ID NO: 20179 - DNA, 201 bp, Homo sapiens
gggtcagagcaagagatatacacttgagaaacattaatttattaatggtgttttgaatcatgagatggactgatgtcccttagtcttgaagaaggcatagmcagagaagaggaccaacgacttagctctgagaaactacaacttaatgtctattagcactgcagtaggtctattactaaggccctgagaacttgatcatct

SEQ ID NO: 20180 - DNA, 201 bp, Homo sapiens
agatagaattcgtgagttgtcagtatcttctcccccacatgacttgtctttttcactttgtttatggtgctttttgtcatacagagttattaattttagtrtggtaaaatgtatctgcatttttttgatgatttttgttcatcttctctcattaaaaaattccttccacatactgagataaaaaagaagtcatttatattt

SEQ ID NO: 20181 - DNA, 201 bp, Homo sapiens
aagggcaagcctctcccacagatacagtataatactaacttccaagaacataacatgtcatatggtcacaggtataaaaacataaaatggattttcccgartgatggccaaatttatccccacagggaggcagcatcttttctacttaagaagtacctttcggaagtgcttttcaagttaatccaatcgcaaaaacattga

SEQ ID NO: 20182 - DNA, 201 bp, Homo sapiens
atagcaaaatgctatgtgtaagtttgaatgtgcatgaagataggtgggaagaaaacacatcgggccataagcacttaccacagcaggatgggaatgggggragggtgggggcaagtaactttttctatatacatctttgtatgcagttgtatacatattgcctttgtaatttaatgtacaaagacaaaataagtacctaga

SEQ ID NO: 20183 - DNA, 201 bp, Homo sapiens
tcttattctgccatctttctagtactgaatccttgaatgacttttacaaagagaataaaataggaaagcataaaatagtccctgggaaatacacacagtcytctaagacttgaaactagatgttcctaatggagaggttagtaagagtgccggacacagcacaggggaagatttgaggaaggaagtgggtgagaaacagca

SEQ ID NO: 20184 - DNA, 201 bp, Homo sapiens
gtagcatctggagtcaattcagacatagagaataataatatgtctaaaattaaagacagagatttcaaatttgagatattttccctgtaaattttagaagrttagagtttcccaaatttagatttttttttttttttaaagaactgcctttaaaccaagtttcatgccctgcttgagtaggccatgactttgtctatggca

SEQ ID NO: 20185 - DNA, 201 bp, Homo sapiens
gtttggaaacatttttgattgtcacagctgagtgggggaagtatatctggtgtctagtggctacaggccagggatgctgctgaatatcctacagtgcaagsgcatcccctatgacaaagaattatgtgactcagaaatgccaataatgctgagcttaagacacccttctctacatgtcttttcttatctgcaacatggagg

SEQ ID NO: 20186 - DNA, 201 bp, Homo sapiens
gtctagtggctacaggccagggatgctgctgaatatcctacagtgcaagggcatcccctatgacaaagaattatgtgactcagaaatgccaataatgctgmgcttaagacacccttctctacatgtcttttcttatctgcaacatggaggggttagaagaagaggttgatgtgtgtggctagattaggttattacccatct

SEQ ID NO: 20187 - DNA, 201 bp, Homo sapiens
tatcaatgggttaatggattaagaaaatatggtgtgtatacacaatgaaatactttcagccttagaaagaagaaaattgtcatttgtgacaacatgggtgwacctggagcatattatgctaagtgaaataaacaggcaccgaaatgccaatatcatatgagctcacttatatgtggaacccaagaaagttgaactcagaca

SEQ ID NO: 20188 - DNA, 201 bp, Homo sapiens
ccaggctgatctcaaactcctggctttgggtgatcctcccatctcggcttcccaaagtgctgggattacaggcgtgaactgccacatctggccttgatttrttttctaataggttcctagggcactgtggcaacaatgccttttcccctgagaggtatataaccaaggagaggacatttggggaccttctatgattgattt

SEQ ID NO: 20189 - DNA, 201 bp, Homo sapiens
atctctaccatctcaacatcattctgtgagctgggtctttcagccccagtgagctggtgactgtcttcaggttttagatgcacgcgtgcgtgtgtgtgcgsgcgcacttgaggtattgcttcttttaacacaaaaagctgaagtttcaaagcaggtggggtgtgggttaaacaccgttctaaatggcaggcctgctgttca

SEQ ID NO: 20190 - DNA, 201 bp, Homo sapiens
aaactctggagagtctgctttgaaggaaatcttcacataaaaggtcctatgtaaaaatgtcttctcctgaaggtggtagagttatttagaatctatgaggygaacagctagagttcagaagttgtctaacagtctacacgtattcagtaacatagactttatcaaaagatgcactctcctcctctctaaacctcaccagta

SEQ ID NO: 20191 - DNA, 201 bp, Homo sapiens
tagctaactgaggctggcctaccagggagctcagggttgggacattttggatagacttagccattcattgaaaaacaagtaaatggtgtaaaaccatgctmattatgcataaattatgggcaatagcataccctttgaattttgagagttttgaagggttgaaataatttttgaattagcactcagttcttgatctgactc

SEQ ID NO: 20192 - DNA, 201 bp, Homo sapiens
gcctctgcgttgctcaaaggcagaggtcactgctcacatcctggagtacatggatggtggcctacggaaagatggtgctgcctctgaccatggaccacttsgtagccttgacatcgtgcatggcagagcacttgctccgctgcatgttttgtgaagctgggtcaggttctgctatgggagtcatgagctggggagccacac

SEQ ID NO: 20193 - DNA, 201 bp, Homo sapiens
ttgactcagctttgagtgtcttggcctctctttccatcccccaacctggggcttctcttcaggcatggggtgaagggatcaaaaccctgagggccaccccsactccatgatttctttctgcactgtctgctctctgtcctgtgctttcctgatttggaatcacttccctcgctttttctcaggctgagatccctcccagct

SEQ ID NO: 20194 - DNA, 201 bp, Homo sapiens
aaaaagcaaaaggaaacaagtaaaatcaatatattttatttaatccaatgcaccaaaaatattatcatttcaacacaaaacaaaattattgagaaagtatyttacatttttttgcactaagtctttgaatgctgtgtataatttacccttccagcacatctcagtttggactggcacagtgtcaggcgctcagcagctgca

SEQ ID NO: 20195 - DNA, 201 bp, Homo sapiens
taacaaaggacattgagaaaaaaaatcctttggttgttccaagtgtacagaacatcagataaaaataacatcaattttccacagagaaaccaaatatgtcrtttaaatgcttccagaattaaacatttgatgtgtatgttgggtgaggaggcaacaggattggatagggtggtgggaagtctgagttttggtctcccctct

SEQ ID NO: 20196 - DNA, 201 bp, Homo sapiens
  misc_feature (1)...(201): n = A,T,C or G, or insertion/deletion polymorphism (see Tables 1-2)
attagaggtggtccttattttggtttgctccatactgggcagccagaaccatctagaacaccagccaggacttgctccccaagggtgctcctctgttgcgntgcctgcctctctgcccaatctctctccacacagtggaggctctgagtctttcctactttgagccctcatctccaccagcatctatgcgtagctctgctg

SEQ ID NO: 20197 - DNA, 201 bp, Homo sapiens
cctccatctcaacccctccccaacttcaacccctcccccacctcaactcctctccaacttcaacccttcccccacctcaactcctctaccattgcaactcytcccccatctcaactcctcctccatctcaacccctcccccacctcaacctctccccatctcaactcctctctcatctcagcccctcccccagctgccatc

SEQ ID NO: 20198 - DNA, 201 bp, Homo sapiens
aaagtggctaagataatgggttttgaagtcagggtgacctaggattgatcttttgctatgtcacccaccacctatgtgaccatcagggaagttacttagtycctttcagtcttgcttctcttcctgtaaaatggggtttataatagcacttgccacatgggcttattttgagaaataaggaaagtgaatctggttagcatg

SEQ ID NO: 20199 - DNA, 201 bp, Homo sapiens
ttccccatctcaactgctctctacctcaactcctcctccatctcaacccctccccaacttcaacccctcccccacctcaactcctctccaacttcaacccytcccccacctcaactcctctaccattgcaactcctcccccatctcaactcctcctccatctcaacccctcccccacctcaacctctccccatctcaactc

SEQ ID NO: 20200 - DNA, 201 bp, Homo sapiens
tttgagaaataaggaaagtgaatctggttagcatggagccttgcacattgtaagtatttaatacctaggacaaataatattataaacagcatcacctatayttttctttgtaattattctttatttgtttgatccatgtccatttttcttttttttacagctccagaatttgcaatatgaaaatagagattatttaaacaa

SEQ ID NO: 20201 - DNA, 201 bp, Homo sapiens
  misc_feature (1)...(201): n = A,T,C or G, or insertion/deletion polymorphism (see Tables 1-2)
tttaaccatctttctcttcctctttttctctcgaagcctgtagcagggagggaatgaaggcatgcagggttggcgtgtgagtgaggaagagggcttgtccncctttcccctctgtccctgcccccgcctctcctggggacctccttgcagaccctctgcagctgtgctcacatcccactactcagcctcactgctgttcta

SEQ ID NO: 20202 - DNA, 201 bp, Homo sapiens
acattgaaagaaaataaaaatgctgatttactaattaactccatgcatcttgtgtactgcccccctccccaccccccaaaacatcctaaacattcatgctscaggctgctgctccatgcctccaataaactagctcttcaaagagatctcttttgtattcttcccttttccagctgcctccagtgggaggggatggctccc

SEQ ID NO: 20203 - DNA, 201 bp, Homo sapiens
tgtcctccttctcttctcttctgcttttagctcctttaaccatctttctcttcctctttttctctcgaagcctgtagcagggagggaatgaaggcatgcasggttggcgtgtgagtgaggaagagggcttgtccccctttcccctctgtccctgcccccgcctctcctggggacctccttgcagaccctctgcagctgtgc

SEQ ID NO: 20204 - DNA, 201 bp, Homo sapiens
tctgacaacaggaaaatacagttactgtccctctgagactggaaagggattttcagatggtcttcagactggtttccaatcagagttatgactaattgctrattttccacatttccatttgtggatccttaataggacagtggaactcggggcactggaaggagaatgcccaccaaattcccatatgaagaaattcccata

SEQ ID NO: 20205 - DNA, 201 bp, Homo sapiens
cacatttccatttgtggatccttaataggacagtggaactcggggcactggaaggagaatgcccaccaaattcccatatgaagaaattcccatatgaagtmatgcaataccgcatgactacagtattctggtcatgaactttttctgaggatcctcctggatattgagggcatggtgccaggaacacttggcctctgatca

SEQ ID NO: 20206 - DNA, 201 bp, Homo sapiens
ttcttcccttctaaggcaggccttgggggaggactctcccccaagactctgcagcctggtgctcaagccggatcggcccgttctgtgcttccttttgtggyaccatcagagtctcctccctgtttggaggctcaggtgaatcagtcccctctctcccaccctgcccttgcgctgggctgcctccactctgctcccatggcc

SEQ ID NO: 20207 - DNA, 201 bp, Homo sapiens
atgagagtctgtcttcctgctagcactgctgcccttaggccaagtctcttcacaaagccatttatgccattatgtttgcccctttcctttttggctgcacyctccaagaattatcccttttaactcacataggtgctgaaactccctaaggtattccacattaattcccaacctatgcatttatgattcctgtctccttgg

SEQ ID NO: 20208 - DNA, 201 bp, Homo sapiens
gttttagcccataactcaccatggagggcccttccaggagacgtcgggcagggctttcctacagcggaaccgggaggccgccccgtgagggcagaagctcycgccaggagccagcaccaccagcagagtgtggaacccccagaggtcctagcctcctccacggggcctcccaggtgctaagtggggagatggggagagggt

SEQ ID NO: 20209 - DNA, 201 bp, Homo sapiens
ccctctacttggaaatgcctggccgtgttcgtggagcctgggaggtgcggaggagcggcgacgcggccatggcgctaggcgcgcaaaggccccgacacctyactagggcggcggcgggcccgtggcaccgctcccggcaccgaacagggcacagcactggggacacctctctgcagggacccaagacgcgcgtgcgtgtgc

SEQ ID NO: 20210 - DNA, 201 bp, Homo sapiens
ttcgcttggatcgacttcttattttgagattttgggcattgcggtttacgcaggaacctcaatatcgctctccccacctccctccctctttctccaacctytggatgcgtctctgctggcagatataaagacccaagtcttcgcggtggaatttcttagatggacttgcaggggctggcgttataaagcatgtcatcgtaa

SEQ ID NO: 20211 - DNA, 201 bp, Homo sapiens
agccctcattatcccgggctgtaacctgagagggaagggagatgagggggagaggaggaggaaagacctttgaccttgaatcaagggccgttgagtgtgtwcaagcagatgccccgaaagcaaggagagcaggggagtgaagacgtggtaagcctgtggatggctgccccagcaggccctggggacttggaactcctccca

SEQ ID NO: 20212 - DNA, 201 bp, Homo sapiens
atctctcccatacatctctccccttttagcctgttgttactaatgccatagtttgaatgtcatttttatttctcccccattccatatgattccctgggggyctctcccctgcagaaccaacaaaggacgggacatcaagaccatcaagtctctgcgggtgctccgagttctaaggccactgaaaaccatcaagcgcttgcc

SEQ ID NO: 20213 - DNA, 201 bp, Homo sapiens
aatttgggaagagcgttccagcagggctctgggaagggagcaacctgagttaaggcatgtgagccatccatggctagaatgcagaatatagaatacagttrctttaaccagaataacctggggctcatgaaaactcattactgctttcgtcaggaattttagaatcaagatctctttttatgttttttggttctttgtaat

SEQ ID NO: 20214 - DNA, 201 bp, Homo sapiens
cccatcttctctctttagccatggctggcctgcctttggagaatttgttctgggaatattcctttttctcacacggatatcgaagttcttttcatctgcckgagctaaaggtcttagtttcaaaggaaaataaccaacatcccaagaaatctataagaaagctttttcttttaagttcagacccagatggtgtcttctctc

SEQ ID NO: 20215 - DNA, 201 bp, Homo sapiens
catcttgcagcaatcagatcctacatcaccatgaactgtcacattgcgggatgcaagacctccatgactgaaagatatttattatatcaaggaccaaaacrttcttgttagcactaaattttaggatgatgagagaatgtagaccttctctgagatttctgtattgagaagcaacttgtactaatcagtttccttggtttg

SEQ ID NO: 20216 - DNA, 201 bp, Homo sapiens
cttggcttgactgggatcagcttatgtctactggatagaatcttattttagaaaaacaccttgactttgtgactcaggcatcctctctgtctgctgaggcrggggacacattttataagatgtgcttcatccatagagattccagacagtcctgagtaaccccatccatgtaaagagccagccatctgtagtcagatgtcc

SEQ ID NO: 20217 - DNA, 201 bp, Homo sapiens
tagctgcctgtcagggatgttggggattcctgcatggggacagaaggtagggtgatcatgaagtctcttccatcttccagagtctaattttaataagttakcaaaggcttggtgcagactctatgctcaaaaatgagagtgacttgaggtatgtggtttgatgtacatggatcctaggtgggtaaagcagtttgggcaggt

SEQ ID NO: 20218 - DNA, 201 bp, Homo sapiens
gtgccttcatcatcagcctcatccctacaacaatgtttatatgtacagatcaagaagtcattatctcaaactgacaggcatcagaggtttgccgaagcccraggtgcagaggttgtagttaggcttgggatcagctgtatacatcaacggaccacagcagcatgtgggagactacaggagggaatgcacagtgcctggcac

SEQ ID NO: 20219 - DNA, 201 bp, Homo sapiens
ctgtggtacttcaggtgagggtagaggatgaagcttgcagagagcaggggactatgtggaggagaggctccatttttcaggagactgggaaacattggatkgaacacatgatatgtgagctgggaggtgcagagaggccagggaggagagggagcctgagacaaaaaagggcaggcctctttccgtgggggaatggaattg

SEQ ID NO: 20220 - DNA, 201 bp, Homo sapiens
gagaggctgtccttcatcacacagtctaaaatagacacctggtcactgtgccatatcacctatgcagttgaccaccaacccccacaagaatgttggtgccytgagatcagtgatttgactgcctcgttcactccatatccccagtgctgagggcaatgctgacatatgggccctcagtaattatttgtgaatgaatattta

SEQ ID NO: 20221 - DNA, 201 bp, Homo sapiens
atctcccaaacatatcccaagtccaaacacttctccatccccactgctaccaatctcttccaagccactatcctttggaccattgcaatggcctgctaacytgtctttgcatctttgtttccctagaataagagaatgtgatctattgacacaacaggcagggacaatatgaactctttttgctggctcataaagccctat

SEQ ID NO: 20222 - DNA, 201 bp, Homo sapiens
aatggcaccactatttctccagttgtccgagccaaatattctcattatcttttatttctctccatttttcctcacttctgatcagtggtaagccctgtcaytaacatctcccaaacatatcccaagtccaaacacttctccatccccactgctaccaatctcttccaagccactatcctttggaccattgcaatggcctgc

SEQ ID NO: 20223 - DNA, 201 bp, Homo sapiens
ggctgggctttgtctgattcccagccccctccccacccctactcccttcacatgccgccctctacatagattgggttgccccaatgcttcctttcataatyaattctcattttcctttctttaagccagccactctgcccgtatccccaccaaccaggagacaccgcactgtcttcctgtagggaagtcaaggctccatga

SEQ ID NO: 20224 - DNA, 201 bp, Homo sapiens
ctttattttgctttatttttcatcatagcccttattgtttccccaacggacacacaaacacacacacatacatacaagcacagatattttgcactggagtrcaagcttcttgaaagcagggcctttgtcttaccttcagggtccaaaacagtgcctagtgtgcagttgactcacaataagtgtttgctgaaagaatgatga

SEQ ID NO: 20225 - DNA, 201 bp, Homo sapiens
tgccgccctctacatagattgggttgccccaatgcttcctttcataattaattctcattttcctttctttaagccagccactctgcccgtatccccaccarccaggagacaccgcactgtcttcctgtagggaagtcaaggctccatgaggggatttatcagttcagaagttcccagggccaaaaccctgtgtacagatag

SEQ ID NO: 20226 - DNA, 201 bp, Homo sapiens
gagaacttcctgatcaccctatttaaatagcattcccccattgtcactctctttccctctttattttgctttatttttcatcatagcccttattgtttccycaacggacacacaaacacacacacatacatacaagcacagatattttgcactggagtgcaagcttcttgaaagcagggcctttgtcttaccttcagggtc

SEQ ID NO: 20227 - DNA, 201 bp, Homo sapiens
cagcaccccctcattagaaacgaaggagcatctctaagcagatattcttcctgctgctgttcgcatcctcccacagcaaccccggctgggcttctccctckctcctctctgcatcccgctcccctgctccactctcacagagtgatcccaggccatccattgcctgagttgaacgtatctagctagggtggaggtttcggg

SEQ ID NO: 20228 - DNA, 201 bp, Homo sapiens
ggcaagaagtagtgtgtctggcttggagactctatgccagagttgggcaataggatattccccccacacctccatcgccttggttgtctcagcaggggagmacatgcttcgtgtggaaatgaatatggcttacagtaggaaggtcaaatatgtttgcagccctgagataatgaagctcatcacaatgaacctgtggacatt

SEQ ID NO: 20229 - DNA, 201 bp, Homo sapiens
gcaatcaggagaggcatgtacaggctccatccactgcactgaccgcctgctgcatctggtccctggtaccaggcctttaccttctgttactgtggactgaycacccctcaagttccatgtggagtctgttgcccatgtagagaaaaatgagcccctttgtttattctgtctccatttttttttcttacaattttctctgga

SEQ ID NO: 20230 - DNA, 201 bp, Homo sapiens
ctcatctctggaaagcagggagcagctagaagatgtgttcttataaggtgaagatgggccagattaaggggaacagcaatgaatgactttaaaatgtgtcrgttatccaagagatcctccctgccacctcccagagcagtgggtacttcttaggagcttcctttattgtatcttgagctccaaatttgtaggactagatag

SEQ ID NO: 20231 - DNA, 201 bp, Homo sapiens
tttacacttttaaaaataaaatttaaaatatctacatcaaaacctgtttcctttatatgtttctaatgctgattttataccagtattgtacctaaggacayatttggatttacaatcagaaaaaatatcttcaggagcaataatgatgcagaattttcccagaaagcttttgataaaaacagataggatacttaaaatgat

SEQ ID NO: 20232 - DNA, 201 bp, Homo sapiens
catcattataatctccttattttcaccctcaactttgttgtccctctgctgctttgttataccttgtctggcaagacttcagccctgctaaatcccacttkcccctattcttcatgtacatatgggcaggtgaccatagctatagaaaaagtcacaaccacgccgattgacctcactgtgaattgatgactgccacctcca

SEQ ID NO: 20233 - DNA, 201 bp, Homo sapiens
ggtgaaggtcctctgctagggatattaggggcattttacctgtgggaaatgtttactggtgtggacgagaatggagaattaggatgcaccacttggcttcyggaaaccagacagagcactcaaaagaaattaaggagtgggcctaaaaagttaaaggaactgcctctcctttctgctaactttggattgtttttgcatgga

SEQ ID NO: 20234 - DNA, 201 bp, Homo sapiens
tcacttgcttcattccaggaagaatgggttagccctgggtttactgcctctcttccccacgtcttcagctgctggcagttcttagtgatttcagtatccaygtagatgacccttcctgcaccctgacctcttggttccttagccccttctgtttggtgactttgccttcttgcttcctgctgacagctcacctccatggtc

SEQ ID NO: 20235 - DNA, 201 bp, Homo sapiens
aacttctaacagctttctatacttccactgtgaaaaaggctgggtgcagaacaacctgcataatcatatgccttaccatttctctttttatcttaccttcrtgtctttttatcatataattttaccaccattctataaggacctccctccaggcctggagagctttctgttcctcaatatgcatccctgagaatggatgga

SEQ ID NO: 20236 - DNA, 201 bp, Homo sapiens
tctcttctggggcttcctcatccttagcaagtatatgtttttggtgtttggggcataggaggctggatataaggatcatgactaataagaaaggacttacrtaagaaaaaataggaatggataagagaaagatattcatagaggtgaagccaaccagcagagatccagtgagaattggtaacagtgactcagaaaaatggt

SEQ ID NO: 20237 - DNA, 201 bp, Homo sapiens
gatttccgactacactttaagtgcaaacatggctatccatgaagaaacacagaagaagcactgttaaaaagcaaagtgcctgagtgctagttatatttgtstcactaatataccctgtgacctcagagagaaaaccactccgatctcagaacctctatttcctcatctttgaaatgagaagaatgccacctgcccttccta

SEQ ID NO: 20238 - DNA, 201 bp, Homo sapiens
tcccctggggatgtggaactcacaataagtgctgtgctgaaactggcttgtcccagctcttgagtgtcctctctgtatgtctcttctagactccatgttcrgtgatatcaagatggtagcttgaaattggccatggagagagtatttataccccagaaatttgcaaatgctacacattggggcttttcccccgaagttaaa

SEQ ID NO: 20239 - DNA, 201 bp, Homo sapiens
tttgtggtgtctccgtcctttgagtacaccattatggccatgatcgccttgaatactgttgtgctgatgatgaaggtgagaggagagaggcacaagagccractgagccccagcgatggttccctcccagggcaagtgggaagacaccccaacatcccagcccatcactgctttacctacttttccatcattgaatccttt

SEQ ID NO: 20240 - DNA, 201 bp, Homo sapiens
gtgaagactacgtctttggggggaacccagagtgatcaaagagataaggaaagtttgcccttttcaattaataaggacaaaagggacttaaggataaaacrtgttctttaagataggtcactgtggttgtggatgagacttcctgggtgtatagctctctccctccatataatactgctcagcaaaccttcatgggagaaa

SEQ ID NO: 20241 - DNA, 201 bp, Homo sapiens
ccaaaggaagcagtgactgcacattaatcttggaggcaaaaaaagtggacgaagtcctgcttcatgcaaagaagacccatttaccactgagccagacaggycatccagtgcccctgttctgtggaagagaacgaaggattaaaattaaatttagccgtcaagtagcccattaactgtggatttaggaggccagctgaaaag

SEQ ID NO: 20242 - DNA, 201 bp, Homo sapiens
gctatagctgtgagactactgactcccaaggggcctggcctctggccatcagaagtctctgagccaacctaacatctcgctgtcttgtttatcctcttcckgtgtcttcctcacttcacttggtattcagaactcctccttaggagagcagccaagggaagctactctccttcctggggatcccaggcaaagccatctctg

SEQ ID NO: 20243 - DNA, 201 bp, Homo sapiens
acagcgttttgagtccaggatccagtcacacgcaaaacaaatgaatttgttaagacttatccagctgtctgtaactgcaaggggcatggcagtgggaggarggagggagacagtactgtcttattttctcagaaccagcacttcccatcctttgggaatcagggcccagatgagtctggaactgacctcagtgttggttca

SEQ ID NO: 20244 - DNA, 201 bp, Homo sapiens
tggaaagacatgcatgaaggtgtccatgccatcctctgaggctgttacatctcttggatttagacatccaaaaacatgagactgaagggagaaaaggagayaggtcttcctgtagggtctggggtgaggggtggaaatgggtaaaggaggctgaggaatgcctcccctcagactgtggactcttctatacccccccaggag

SEQ ID NO: 20245 - DNA, 201 bp, Homo sapiens
gaagttggctttcagaaacagagtctgtagacatgcagtgtttccagtgtgttaccgtggtcacagctactgaaggtgaaatgtacataacaagtacttaygtagcacatacttattgtgtgcaaggtactgatctaagagctttatgcatataaactaacttaattttcacaacagcccagtggagcagaatggtattat

SEQ ID NO: 20246 - DNA, 201 bp, Homo sapiens
aaggaaatgaacaaatggcaggtgtgcaggccacgtcgtgctgctcaaattagccatgttgctaaggaaacaagtcaaccattcaaaggaaggagcattgrgtaaaggagataaatcaataagtgaacctatttttatcatttccctaatgattgtcttgaaactgctagactagaaagagagttggagcaacacaggtcc

SEQ ID NO: 20247 - DNA, 201 bp, Homo sapiens
tgaaaaggcttctgttgaattttgaaaaagatcatgcagaagatgataagcatggtttcacaaaatgtaatataattctgcaattctttgcctaaaggctytcagtggtttgctgttttctgcagcagaatacaagatccctcctgacctgaccacatgcagcctgccctccagctatactggactacttgtggttccttg

SEQ ID NO: 20248 - DNA, 201 bp, Homo sapiens
atgaacacatgctcatttgaacactcagaaaatggttagaggagtaaagaagaaagtgaaaataaccctgctaccgagagaagactcatcatccttccagyaagacagaattttttcttgttctctcccttctctttttttttgtttttgttttttttgagacggagtcttgctgtgttgcccaggctggaatgcagtcgc

SEQ ID NO: 20249 - DNA, 201 bp, Homo sapiens
cacgatgacacgggctggtgcatttgcattcagatcctctgttcactagaaatggaagggaccttggaggtccttgagtccagcttctttccagagtcccygcaaggggcagtaacttgccactgactacacactaggttattccaggaccagacctctcactcctagtccagcgctccttccaccacaccatgctgccca

SEQ ID NO: 20250 - DNA, 201 bp, Homo sapiens
gttcctatagcaccagtatttcatggcctgcatcttaggaataccactctcaacgctctcaacttctgttgtcttttgtcagtgacttgtatgcgtgttgycagttctctttctggatccatcgcccaagcatgttttcaggaaagggtatggattccttggccaccattgctgctgggttcccatctttaatttgcagga

SEQ ID NO: 20251 - DNA, 201 bp, Homo sapiens
ttaggctggctcagggctcctttcctttttgtttcatttactctaatatgcggtttaatttctaatccatggccaaaggcctcaggtgcctgatgtgtcargcagctttgggctatgatcttcctgttctcaggcaacaccaggccttaggactgaggggcagaaattagctggaggtggtgcgttggtgactcaatggct

SEQ ID NO: 20252 - DNA, 201 bp, Homo sapiens
ttgctgggggacaagctaatgacagaccccatggggattcacacggaaaagaagagattacaaacactgtgtctgtgctgcgtggcagccagggaagaagraagggcaggcacaggcccattttcttccctcctctttcctaagggacttctgatacgagaggaagaggtggggagtagaggggagaggatgaaggatgct

SEQ ID NO: 20253 - DNA, 201 bp, Homo sapiens
cacctgcacccacagcagtccctgctgacagctcttccttcccacctcatctccaggtgtcacctcccattttcccctctgcacaggaggaatgacaggtrctggagcatgacacagtgcctcagggctgaggctgcacaacttctcagctctcggtgctgacaggagggaagtgggtgctgaggtgtcagtcagctggct

SEQ ID NO: 20254 - DNA, 201 bp, Homo sapiens
tgaatgatttaatttttttatttctaatagaatgttgctaatgtataggaatgttagtttttattcgttgatgttatatccagcaatcgtgtaaaagtttrttagttaaaatcatgttggtagatttttttttagattatataggtagaaaactgtattaactacaaacaagtgttattgtatttgtttctttctaattca

SEQ ID NO: 20255 - DNA, 201 bp, Homo sapiens
gacctctgacctcctaaactttagtgttctttggcctataagttgagggtgtgcatggtttagaaagcgcatttatgtacattgcttcatcttgtcctcawaatgccatagaaaagaccttgctagcctcattttacagatgaagaaaccgaggatcagagagggcacatgaattgctagcaggcactagatccaggactt

SEQ ID NO: 20256 - DNA, 201 bp, Homo sapiens
cattcactcagggtgatacagggaaagaaattatggcaaggtgctttctaagtcagaccgttctcctgggcctggagctctcatttgaaggcagttaaackcgtgcattcttgtgcttgtgcatgagtgtatgtggaagagggaggtggggtgaaaatccccaggtatgttttcaaagcagaggtggatatggcataaatg

SEQ ID NO: 20257 - DNA, 201 bp, Homo sapiens
cttccaggaaaatgttgggtaatgacagtaatagaaggctgtcttattttgttccttatttaaagtttaacaatgaagacagatgttccttataatgttayggtgaatactctttataaaggaagtaaagaatgattgttaaactaatgtcaataatagctcaatattttcatctaattcataaactcaaaggttttggaa

SEQ ID NO: 20258 - DNA, 201 bp, Homo sapiens
gggagatctaatccctaattgggcagctgccttctagcaacaaccttgccctgtgggaaggagagcatcaattttggaggacagtaatgatctcttcattrtctatgtgagtataaattgtcagatgcataggagatatataataaatgttttcttctaattattagtaacatccattgagtcaagaaatatttgctatgt

SEQ ID NO: 20259 - DNA, 201 bp, Homo sapiens
atttttaaagtcaaatgtcacatattaaaatattagagaatactctgtaagaaatgttgtcttataacactgattctcagacttatgcctacatcagaatygtctggaaagcttaaaacgagattgttgggccccactccctgtgtttctaattcagataacctggggtagggcttgaaaatttgcatttctaataagatc

SEQ ID NO: 20260 - DNA, 201 bp, Homo sapiens
ctgcaacctggcttaattctgttaaattagaaagggctagttcctcgctctgcagctccataacctgagagagacgtaggtggctctgatgattccacaagggtgcctgtcacttacattccctgcagtgttgaactaattaaaccagcagtgcttcacccagtgctgcaaagaagcaactgcacaaatgcagcaccaccg

SEQ ID NO: 20261 - DNA, 201 bp, Homo sapiens
caacctggcttaattctgttaaattagaaagggctagttcctcgctctgcagctccataacctgagagagacgtaggtggctctgatgattccacaagggwgcctgtcacttacattccctgcagtgttgaactaattaaaccagcagtgcttcacccagtgctgcaaagaagcaactgcacaaatgcagcaccaccgtgg

SEQ ID NO: 20262 - DNA, 201 bp, Homo sapiens
aacctggcttaattctgttaaattagaaagggctagttcctcgctctgcagctccataacctgagagagacgtaggtggctctgatgattccacaagggtrcctgtcacttacattccctgcagtgttgaactaattaaaccagcagtgcttcacccagtgctgcaaagaagcaactgcacaaatgcagcaccaccgtggg

SEQ ID NO: 20263 - DNA, 201 bp, Homo sapiens
acctggcttaattctgttaaattagaaagggctagttcctcgctctgcagctccataacctgagagagacgtaggtggctctgatgattccacaagggtgyctgtcacttacattccctgcagtgttgaactaattaaaccagcagtgcttcacccagtgctgcaaagaagcaactgcacaaatgcagcaccaccgtgggg

SEQ ID NO: 20264 - DNA, 201 bp, Homo sapiens
ctggcttaattctgttaaattagaaagggctagttcctcgctctgcagctccataacctgagagagacgtaggtggctctgatgattccacaagggtgccwgtcacttacattccctgcagtgttgaactaattaaaccagcagtgcttcacccagtgctgcaaagaagcaactgcacaaatgcagcaccaccgtggggct

SEQ ID NO: 20265 - DNA, 201 bp, Homo sapiens
tggcttaattctgttaaattagaaagggctagttcctcgctctgcagctccataacctgagagagacgtaggtggctctgatgattccacaagggtgcctrtcacttacattccctgcagtgttgaactaattaaaccagcagtgcttcacccagtgctgcaaagaagcaactgcacaaatgcagcaccaccgtggggcta

SEQ ID NO: 20266 - DNA, 201 bp, Homo sapiens
tgagcttgacaacatttgatcagaagaaaaaactgggaataaatgtgctctactctgtgcaatcagctttctatctgtccatctatcctcctttcattgartgggtcccatgtgtaaggcctagcggtgagcagtaggagggacagcagtagagttaaatagggaagagatggaagatcactgggaatgtggtttcacttt

SEQ ID NO: 20267 - DNA, 201 bp, Homo sapiens
atctatcctcctttcattgaatgggtcccatgtgtaaggcctagcggtgagcagtaggagggacagcagtagagttaaatagggaagagatggaagatcaytgggaatgtggtttcactttgccctaatgcagcagctgttgacacactacatgctggtgtaactagccattgaactgttgttgccacctctcttgatcaa

SEQ ID NO: 20268 - DNA, 201 bp, Homo sapiens
tggaagatcactgggaatgtggtttcactttgccctaatgcagcagctgttgacacactacatgctggtgtaactagccattgaactgttgttgccacctstcttgatcaagctttgaagataagcatgagaaacaattagtgtatttcatattttttttatttttgttgtcatgcttatttttgtcctcttcaagatagc

SEQ ID NO: 20269 - DNA, 201 bp, Homo sapiens
ggtagtcagccagctgaggctatttataaaatgtccatgttggcctggatatcactactggttaacatttgtcaaactctaaactctgtagtctagtaaarcagaggatcaggagccagtttcagagggaaaaccaacctttccatttactaatttcttttctatccttagcctgcacaaagaaggttgagaagtcagaat

SEQ ID NO: 20270 - DNA, 201 bp, Homo sapiens
ctgtagtctagtaaaacagaggatcaggagccagtttcagagggaaaaccaacctttccatttactaatttcttttctatccttagcctgcacaaagaagrttgagaagtcagaattttagttatgaactgtgtgcaactacaacaaatagagtcagtagtaaataaatggttgtcacgagtctttggagaaggatttatt

SEQ ID NO: 20271 - DNA, 201 bp, Homo sapiens
tttcagagggaaaaccaacctttccatttactaatttcttttctatccttagcctgcacaaagaaggttgagaagtcagaattttagttatgaactgtgtrcaactacaacaaatagagtcagtagtaaataaatggttgtcacgagtctttggagaaggatttattattgtggccatagattggagtggtccttgaggat

SEQ ID NO: 20272 - DNA, 201 bp, Homo sapiens
caactcggagcgcaacaaagtgggtacacaggggccatgtgccagcctctgtagtgctctggtgctcaccccatcccagcactggaggtgaaccgagatgrtagcaaggtttctggggaatgagcaagggttggaaattgtccactcctgttcctcagggcgaagtatgaaccattcccagacaagccccttcttagccca

SEQ ID NO: 20273 - DNA, 201 bp, Homo sapiens
taggtggttcagtaattcccccatatcatgctgctaatagttagttggtggggtcaggattccaatgaggaagcctgactccagagcttaggtttctgacygtgatgctacactgccttcctaatttatgtatctagtggctgcatggtctgaattttttttttttttttactcctgatgcatcttaattaacaaaagtga

SEQ ID NO: 20274 - DNA, 201 bp, Homo sapiens
ggtggcttataaacaacagaaatttatttctcaacattctggagactgggaagtccatgatcaaagcagattcagtgcctggcaaaggcccctttcctggytgctggacagctgtctgtgtcctcacatggtagaaggggtgagggagctctctggtgtctcttttgtaaggacactaatcccatataagagcagagtcct

SEQ ID NO: 20275 - DNA, 201 bp, Homo sapiens
caggggatggggatccttgcccttctttttcgtctgtgcatttgacctctacccttttcttcctttctcactgagatgtctttcaattttttttttttttkgcctgctgtttcttttttctctttcacacagaggttggtcctgatgaacatgccagtagctgaggacatgacggtccacttcacctccacacttatggct

SEQ ID NO: 20276 - DNA, 201 bp, Homo sapiens
ggcttaattctgttaaattagaaagggctagttcctcgctctgcagctccataacctgagagagacgtaggtggctctgatgattccacaagggtgcctgtcacttacattccctgcagtgttgaactaattaaaccagcagtgcttcacccagtgctgcaaagaagcaactgcacaaatgcagcaccaccgtggggctag

SEQ ID NO: 20277 - DNA, 201 bp, Homo sapiens
  misc_feature (1)...(201): n = A,T,C or G, or insertion/deletion polymorphism (see Tables 1-2)
cctcagtatttgtgagaattgtgattcatctctcagcccaggattcacaagtcagagcagttcaccctcatttacctagcttgcagccgtcccagcaagancatgccttttgctgaaccaccagcttggtgcctaaggaataactatcagatctgtatgaaaacattcatagactctgttttactccttactacagcccta

SEQ ID NO: 20278 - DNA, 201 bp, Homo sapiens
agttttgtccaagtgaccccagttgccatctttacttgcccagccctgccctttttcccattcaccgtcctcctcttctgagcatggaacagagcctgccwtggtagatctaggggatttgaatttgtgctaataaccatgactttcttgcagagggcgtgcatcgacttcgccatcagcgccaaacctctcacccgctac

SEQ ID NO: 20279 - DNA, 201 bp, Homo sapiens
agcaagatcatgccttttgctgaaccaccagcttggtgcctaaggaataactatcagatctgtatgaaaacattcatagactctgttttactccttactayagccctatctctagtcatggcattttgacccataataggagaccccctcaacagaaacgatcagcggagaaaaggcagggctgctaatgcaaacctttag

SEQ ID NO: 20280 - DNA, 201 bp, Homo sapiens
ttagacccacaatagatgcccaacaaatgcaagatgagtgagaggtgaaaagcagggttctgtgcaaacctgtccatggagctgggcagggcgggaggtayggaaatcatgagcccagcttacgccttatcgtccatgttcactcatactttgcccagggtgtgtttactgctcctgagcccaggtagcaggtgtaaaaat

SEQ ID NO: 20281 - DNA, 201 bp, Homo sapiens
acattttcttgaatctaagatgccattgattatatactctatcaaaaattgaataattctgttattaaatttaagcattattaaatgttgggggaaaagcyactgctttctatgcattatgtattcatatattctgagttacaaaaccttccactgtaaagaaaggtatattgtagaattgaggaaatagaaaatgaagga

SEQ ID NO: 20282 - DNA, 201 bp, Homo sapiens
gaagctttgtgaatgattcatggcccatatgctggggcagcatgatgtggtgtatgggtgtgtggcagcagcacctcattacaaaggtcaagcttctcccragcttggtgcaggggctgtgcaggccacctccaggggcagagcacgttgcacctgatctttctctcatgttctctcaaagagagagtgttggagcttctt

SEQ ID NO: 20283 - DNA, 201 bp, Homo sapiens
tctgggatgttcttcccacattgtttcctctgacctactccagcttcactttttagctcatctgccacttccacagtgaagcttccttccctgacctttcrcttatcataattgagacctatttaatgtatgtctctttcattaagtatcgcaaggacagccatgatcaccatcttctctactgtaatgccagggcctgct

SEQ ID NO: 20284 - DNA, 201 bp, Homo sapiens
atgggtgtgtggcagcagcacctcattacaaaggtcaagcttctcccaagcttggtgcaggggctgtgcaggccacctccaggggcagagcacgttgcacstgatctttctctcatgttctctcaaagagagagtgttggagcttcttccagaaaagcaaggttctctatgggtgtatgacttccagaccagtgattctgg

SEQ ID NO: 20285 - DNA, 201 bp, Homo sapiens
cattcattcatttatttttgagacagagtctttctctgctgcccagactggagtgcagtggcatgatcgtgattcactgcagcctctatctcctggggttrtgattctcccacctcagcctcccaagtagcagggactacagacacatgccaccatgcccagcttatttttatttattttcatagagattcgtagagatag

SEQ ID NO: 20286 - DNA, 201 bp, Homo sapiens
aattgattttcttcctcttccagcttctggcagccccaggcattccttggcttatagccacgtcactgtaatctctgcctctgtgatcatattgcctcttyttcaatgtctgtgcagttttataaggccacttgtcattggatttagggtcattctgataagccaggatgatctcttatttgaacatccttaacttaataa

SEQ ID NO: 20287 - DNA, 201 bp, Homo sapiens
ctcagagtaatcctttgtcatacctcaggtattttatcttataagtacgtctatggatatcttcgctttgggagatttttgaactgcttgagaaaaggtamcttgaaaatgcaaggttatggcattgataagagtagaatgatgataatggaataaatgtggttctctcttgacttgtaatgttattacatttgatgataa

SEQ ID NO: 20288 - DNA, 201 bp, Homo sapiens; identical to SEQ ID NO: 3461

SEQ ID NO: 20289 - DNA, 201 bp, Homo sapiens
aaaaggattttctggaggttagttttctaaaagaaaattctactacattttaaatatgaattagtatatgaagatatagtttttacatagtattacagaastatattgggtaatgttgcaaatgtccctaaaataaataatatgtgctgtattagaagaggcctgtatgagaatctgaatcatttagaaatgttatgattc

SEQ ID NO: 20290 - DNA, 201 bp, Homo sapiens
gcagtgagccatggtcatgccattgcactccagcctgggtgagagagcgagacgaccttgtttcaaaaaaaaaaaaaaaaaaaaaaaaaaaaaaaaaaagygcccagctcttcccaaagtctggaaaagcaggcttcctggcccctaggggctatgtcaaatctgtgttccacagtggatggcaaggcttcattttatcct

SEQ ID NO: 20291 - DNA, 201 bp, Homo sapiens
gtgagccatggtcatgccattgcactccagcctgggtgagagagcgagacgaccttgtttcaaaaaaaaaaaaaaaaaaaaaaaaaaaaaaaaaaagcgcycagctcttcccaaagtctggaaaagcaggcttcctggcccctaggggctatgtcaaatctgtgttccacagtggatggcaaggcttcattttatccttat

SEQ ID NO: 20292 - DNA, 201 bp, Homo sapiens
taaggatctatttctcaggatctctggtattttgacttggcctaaaagaaggtcagatgttagttcttcctgtatatggtgacaccaaatcaccacatatrgtcatggctgtcttatagagtcttatacttacacagtcttgactggctgagatttatgccctaagatacatcactgtgaacaactcatggagttcctggc

SEQ ID NO: 20293 - DNA, 201 bp, Homo sapiens
gctgcagtgagccatggtcatgccattgcactccagcctgggtgagagagcgagacgaccttgtttcaaaaaaaaaaaaaaaaaaaaaaaaaaaaaaaaakagcgcccagctcttcccaaagtctggaaaagcaggcttcctggcccctaggggctatgtcaaatctgtgttccacagtggatggcaaggcttcattttat

SEQ ID NO: 20294 - DNA, 201 bp, Homo sapiens
tatgaagatatagtttttacatagtattacagaactatattgggtaatgttgcaaatgtccctaaaataaataatatgtgctgtattagaagaggcctgtwtgagaatctgaatcatttagaaatgttatgattctatctagaagaaaagtgttgtataagtcactacagaagaacaacaaaaaaagaaaagtattgtaat

SEQ ID NO: 20295 - DNA, 201 bp, Homo sapiens
gggtgtaaggtactggaactgctatggggggaaagggaggagggaattgacaggggacattaaaatttgaattacaggacttggtgattatctggagaagkagagaaaggaaagagaagggaggactcccaggtacttgactacagcagcagggtagagtaagatggagaattctggaagaaaaatggatttgagatgggt

SEQ ID NO: 20296 - DNA, 201 bp, Homo sapiens
tcacattttatgagacattttacaaggttgaagaagtacttctggaggagtatacggctgttctggtgtggggtctgggaactaatggctgagaggaggtrgagaaactggtctgtttgactgcatgagagaagacttccagtagatgttaatctctctgcaaataagggttgctacatggttgttgaagaagcagattca

SEQ ID NO: 20297 - DNA, 201 bp, Homo sapiens
gatgtcatttgtcatagacatgctagcccccggcagaataatgaatggtttcaaaggcaggatgcaggttgaaaacatcagtttctgtctcttctagtgcttttttttttttttttttaatttcaggactagccacatgtaagttactaggtttacaaaagccagccaaggctaaagggtgttgccctgctggggtgggaa

SEQ ID NO: 20298 - DNA, 201 bp, Homo sapiens
tttactgatgaaacaagaaaaatctgtcatttttttttttttttttttactggagagcagccaggaacttaccaaataaatagaaaataaatggtaaaatrtgtggcccaattgagtcccaattaaagtgagaccagtgcatcctagtgtgtggaattgtccttagattttaacattagagtcaatttttgaacctgatag

SEQ ID NO: 20299 - DNA, 201 bp, Homo sapiens
ccaaaagcaaaatactctctggaaagtggatttggccatttcagtgtgatccctttctttgggtaaggggaacaaggcctgcccactctgctcctgcctgrgccacccttcctcgttctgtctcctccgctctccccatcctcctaccccagagcctgtttgcactctcccccttgtccatcctgctccacctcatccttt

SEQ ID NO: 20300 - DNA, 201 bp, Homo sapiens
acctgttcacttcttttggccattttttaattaggttgcttgttttattatttagttgtagatgatttttaaattttttgctattatagataatgcttcartgaacaacattgtatgtgaaaatattgccctcactttgggtctatacttataataatttcctaaagctactaaatcaaagagagtgaacatcttcaccat

SEQ ID NO: 20301 - DNA, 201 bp, Homo sapiens
catccatgttgctgcatatatctgtagttcatttctctttatttctgcctagtattcagttgtatggatgatcacaatttgtttattcaccaatcgagggwcatttcagttgttttcagtttggggcaattatgaatgtagctgtgataaataactattcattgctgggtcaaatggtaagtatatgtataactctgtaag

SEQ ID NO: 20302 - DNA, 201 bp, Homo sapiens
aagtcaggaggaggcagcctgggcctggtggggcacttctctgatgtcaacagggtctgcccaccctgccatctttagtgtggcttcctgcatcgccgatygaccaagtggcagacctgagggcaaaaggaagcctgatattggagtcagccccctttggaagaactttccctacagcccacctagtaacttctgatgata

SEQ ID NO: 20303 - DNA, 201 bp, Homo sapiens
ataatgtggctagaacaaaactcctgatcctcttctgatcctgtctggcccctcatttttccttatctcagtaaatggcaccactatttctccagttgtcygagccaaatattctcattatcttttatttctctccatttttcctcacttctgatcagtggtaagccctgtcaataacatctcccaaacatatcccaagtc

SEQ ID NO: 20304 - DNA, 201 bp, Homo sapiens
ttgcttcatccctctcccattttcaaataaatacaatgttacagatgcattttgtatgctcattctttgttccttgctccggaagtcatcactcctctgarattgatatttcattaccatgtgcatttttgtaattttactacatgtgcatttatgaaaaagcatgtatatgaattttttgagttttaaagttttatttac

SEQ ID NO: 20305 - DNA, 201 bp, Homo sapiens
tttgttttgcaagacctctcaaagctttgctgcaacctacttttctagcctcaattcaacgattcctctgccttagcctggccacacggctcactgttccyggatttcccaggtaatcacttctttggctagaaataaccaacccccacagccacttccacccactgctgtatttgactggggaactctgactcatccttc

SEQ ID NO: 20306 - DNA, 201 bp, Homo sapiens
tagcatctgacattcatgggtgagaagcctaaccctgtaagaaaccacttattagcattgcgaatttggataagttactctgagcctgcttcctcctctgyaaaatgggatagcaatagctctctcatatacaaaaccctagcccagggtctggcatggagtagcccttagctcttattagctgcctatatccttcgataa

SEQ ID NO: 20307 - DNA, 201 bp, Homo sapiens
agaagaggtgagatttgaacagggctttgaaaggtagctggaacttatataagcccaggggtgtcatagagtgggttttgggggagaagttttaggaatarcaggatgatccccaactttgaggcaggccctaatttatttgtgggataaaaacgatattgaatatgagagtggtgggaacatcattggtttagttaggtc

SEQ ID NO: 20308 - DNA, 201 bp, Homo sapiens
tgatttcttaaataaaaactacacgtatgacagtatcttttctctattcctaatagaaaacatagcacaaaagtgaggtcacagaggaaaaatttggagtwtgatttagtgcttagttgcttgagccttattcttctgtaggagctttggaatgacactataacacttactgtgactgccaacacacaaaaaccctctcta

SEQ ID NO: 20309 - DNA, 201 bp, Homo sapiens
gcaataagcatgcgcagtatggaattttgtgccacatggcttcatggcagagttttttggtggctaacttaccaggcttttgcatgaaacataataaaacrccaggaggcttaaatactgggaaatgacatttcatcagaaaatgaatgacctttctaggaacttacaaacaagtgagaccccaatcatttcactttgatt

SEQ ID NO: 20310 - DNA, 201 bp, Homo sapiens
gggaagtgatttgagaatattcctgaagcatttttcgcaggatgtccctggagtcaaatctgactcagtttctggcttcttgcctccatctctcccatacrtctctccccttttagcctgttgttactaatgccatagtttgaatgtcatttttatttctcccccattccatatgattccctgggggcctctcccctgcag

SEQ ID NO: 20311 - DNA, 201 bp, Homo sapiens
tgttctgtccccatagagttctgcagcactctgtagatgtgacagaggaagaccgaggcccaagccgcagcaaccgcatggagatgtctatcttttatgtrgtctactttgtggtcttccccttcttctttgtcaatatctttgtggctctcatcatcatcaccttccaggagcaaggggataagatgatggaggagtgca

SEQ ID NO: 20312 - DNA, 201 bp, Homo sapiens
gtcaatatctttgtggctctcatcatcatcaccttccaggagcaaggggataagatgatggaggagtgcagcctggagaagaatgaggtaatgacaattgrtctaaagtggggagcagcagaggctccagaaaggattcttgggccagcaatgtaagaaaggaggactgcattttcttaacttgattaagaattatagaga

SEQ ID NO: 20313 - DNA, 201 bp, Homo sapiens
ccccagaagagacagaaggagaagacaccacatgtcgatgtgggagccacgcagcagccacctgtatgtgtgtaccagtttgcgtgtttgtgagtggttaygtgtgggcgtgggacaatgtgtcattgtccttgccatagacaaagtggcactgggtgtgcatgtcagtgtgtggcttggtgtgtgtgtgtgtgttccgtt

SEQ ID NO: 20314 - DNA, 201 bp, Homo sapiens
cattttgtatgctcattctttgttccttgctccggaagtcatcactcctctgagattgatatttcattaccatgtgcatttttgtaattttactacatgtrcatttatgaaaaagcatgtatatgaattttttgagttttaaagttttatttacgtgatacatagaatgtgtccttttgcagcaaaatgaacatttgtttt

SEQ ID NO: 20315 - DNA, 201 bp, Homo sapiens
tgaaggtggagctggcaggacttgttaatgggttgaatgtggggtaggagagatgggaagatcaaggagggctcttcagctacattaatctgttaatagcrgtgccatctaccaagataggggagccgagagaaggggcaggatggttgagcaaggtcaagagttgagctggaggcatgttaaattggagtggcctaattg

SEQ ID NO: 20316 - DNA, 201 bp, Homo sapiens
ttgtgtctccacccaaatctcatcttgaattgtaatctccacagtccccacatgtcaagggggagatcaggtggaggtaattgaatcatgggggtggtttmccccatgctgttctcatgatagtgagtgagttctcacgagatctgatggttttataaggggctcttccccattggctcagcacttctccttcctgctgcc

SEQ ID NO: 20317 - DNA, 201 bp, Homo sapiens
  misc_feature (1)...(201): n = A,T,C or G, or insertion/deletion polymorphism (see Tables 1-2)
gctcccccccccgaccccaagcagagttagacacctatagaattccaggcaccgatgaaaagacctttaaaattaatcgcacataacttctcattgaaggngcaggtgagaaggctgaggcgcagagaaggaggtgggcgtggggcacccttctgaggaccccacctcagccgctcataccccagccacactgtcctcctt

SEQ ID NO: 20318 - DNA, 201 bp, Homo sapiens
cactgtaattgtgactggtattgtagatactgtaagtgttactgtaattgtaattggtatccaggatcactcatgctctggaataaactggtccccccccygcctcaaacaaccccatctggactgccctgttcttatgtccttgcatgagtctgggatcctgtaatataggtgatgcttggaattggatactagtatctg

SEQ ID NO: 20319 - DNA, 201 bp, Homo sapiens
tctctggcagcgctgagatcaacgcaaaattacagtgtcccactctggccccaaatccaaactgtcctatgtctgcatcctcctccagtaccaaggccagwtccctgcctcatatctccttgccttgaccctcacctctaaaactgaaatgttatcccaaagtggcaataagcatgcgcagtatggaattttgtgccacat

SEQ ID NO: 20320 - DNA, 201 bp, Homo sapiens
atctagtataatctagtgtaaaaagctacatgatttatgtcatcacccatcttgttcattatagtatcctcagtgcctaaaacagtgcctggcacctggargggactcaaagatacttctctaatgatttgaatgaattttgtgctatggattatggtactgtctgaaaggagcgacatacacttaataatttctgaaagc

SEQ ID NO: 20321 - DNA, 201 bp, Homo sapiens
ggagatgacagctccctgtgtgttattgctcctgaagaccttccagtgggacaagatatggaggtggaagacagtgatattgatggttctgaccctgtgcmggcctaggctagtgtgtgtgtttgtgtcttcgcttttaacaaaagattttaaaaagtaaaaaagtaaaaagtaagaataaaaaaagcttatagaataagg

SEQ ID NO: 20322 - DNA, 201 bp, Homo sapiens
tttaatcttaaattcagtagacccataaattaaaaatactggatctcagtagccagagggtcattctgtcttagagcccctggacacagtccccctaatayggaccaggcctcatctgaatgttccatgccccctcagctgcgaattcccatgttttctgggccagttatctgacctcttcctgcgagggcagtgcagcag

SEQ ID NO: 20323 - DNA, 201 bp, Homo sapiens
aatgaaatggtgggatctagtttaatttttatcaagagaccttcctgaagccaagggccctggaaatggctgagtttccctgtggcttggagcagagggaraaagtggaaatgatacctgtgttaagtaacatcaagcacccaggtccactggcatgtctgttaataaaaaaattttttaatgttttcattcatgtatcgt

SEQ ID NO: 20324 - DNA, 201 bp, Homo sapiens
ctcccctcttgttttcagagccctttctggtgcttgccactctttaaagaatacaaatctctcatcagcaagccctgtagaaggggcaaaggggtgatgcrctttagctcatcaccactgggcacgttctctttaatcctctcttaaattcacctgctttggctgatctgcatacagtgggagtggtgtcagatcaacaca

SEQ ID NO: 20325 - DNA, 201 bp, Homo sapiens
actctttaaagaatacaaatctctcatcagcaagccctgtagaaggggcaaaggggtgatgcactttagctcatcaccactgggcacgttctctttaatcytctcttaaattcacctgctttggctgatctgcatacagtgggagtggtgtcagatcaacacactggccttttcccaaagcaaagcgggatcccagcctgg

SEQ ID NO: 20326 - DNA, 201 bp, Homo sapiens
ggtcagctgcctccatcctggccccccagagcatctgcctccccagcaccctgggctgcagttgcagagggccttctttttaatgtttttctaataatcayttttttcaaaccctaaaacaacactttgttattgcatgatagttgcaaaaatataaaaataatttttaagaataactcatttctaccccctcactccccc

SEQ ID NO: 20327 - DNA, 201 bp, Homo sapiens
ctcttcttgctttagattgttgacttgctagatgtcatcaagtacaaagagattagtcacagatgtattttgatggtggtggtcgtggtgggatttacctmcttggtttcagtgaatgttctggatgatacaagtaggggtaaatgagctgatctctgtttcataaggatgttaatgtttgttagttcgctcattcattca

SEQ ID NO: 20328 - DNA, 201 bp, Homo sapiens
tgcctccccagcaccctgggctgcagttgcagagggccttctttttaatgtttttctaataatcacttttttcaaaccctaaaacaacactttgttattgcatgatagttgcaaaaatataaaaataatttttaagaataactcatttctaccccctcactccccccacaggttatcatcactattattaataacattttt

SEQ ID NO: 20329 - DNA, 201 bp, Homo sapiens
gaggagagtttttatttccccatcccccactgagagctgttgatggtgtgctgggcgctagaatgccccctcttctcctcttcctcctcctctcactgtgrctggcattgcctctctaggtcacagtgggcagtatctttgaagtggtctgggcaatcttcagacctggtacgtcttttggaatcagtgtcttgcgagccc

SEQ ID NO: 20330 - DNA, 201 bp, Homo sapiens
gaataacattccaggtgaagctggtctgtcaggcaagggcaagcatctgaaaagcgtacaggagcaaggcaggtgtgagttattagcagccaacagttacrtagcagctgggggatgagacatgggccagaatgccacagagcctgccacgtccttactggtgacagccgcgcagggaggaaggcaggagtagggtgggag

SEQ ID NO: 20331 - DNA, 201 bp, Homo sapiens
tctcccttgccctgtgcactcctgagtcacagacagcctgcaagggtcccttagcacccttgcttcccacctacacatgggcaggcccagcacagacatcyaggaagggccaggctgtgcttttgcctgtgtctcataaagcacagtcctcttctcactggtgcttctgctcctcatccccacaggagaagacagaacctt

SEQ ID NO: 20332 - DNA, 201 bp, Homo sapiens
ctctaatgggtagaggacaggaatgctgctaaggcacacacaggagagcccccaccaaacagaactgtctctccacaggtgctggcagtgctgcagtggargaagccctgcctaggccagccctgatctaaccagcaggtgctgctgacagcctctggagcaggtgttccccagagaccctttgcttctgaaaggaccatg

SEQ ID NO: 20333 - DNA, 201 bp, Homo sapiens
agtttttgttgccaaggaatgttggggtgctggggggtttggccactggctaagccatagagtgaataaaccctgttaatctggagctttactggtgaacsatcagagctagccagccttacagaaggactgatttgtaatcacaaataaacacagagctagctatacaaatatcattgcaattcacttttcagctcatag

SEQ ID NO: 20334 - DNA, 201 bp, Homo sapiens
caaggaggagaactttgctcattatctgaataagtgtttgtctggtagcagctttaacagagactctgggctgggttcgataattgtgagtgttgattacrggggctgcttttggtctcccagcggttctttgaaaaaccattaatttgatcattttgggtggagagtttaagggaaccaattgcagttggctgcattgtg

SEQ ID NO: 20335 - DNA, 201 bp, Homo sapiens
actaggcttaatacctgggtgatgaaataatctgtacaacaaacccctctgacatgaatttacctatataacaaacctgcacatgtacccttgaacttaawataaaagttaagctgttgttaatggatgaatcaactatacagtgatagcttccatgactgataagaggctatattctgtggactggaatatttgaatggg

SEQ ID NO: 20336 - DNA, 201 bp, Homo sapiens
ttttaggatgggatcacaatatttttgatatccattttgaaaaagttactggtgaatgtgagtcactaaaaataaggaagtaattgaagaaagagaagaaygtgatactcatggaaacaagggattcgatggaggagagaaagaagaggaattgattcccagggcgatgaacggaagtctaggatgacagaagcctagaga

SEQ ID NO: 20337 - DNA, 201 bp, Homo sapiens
aataaaactaatgtattccccaatgtgtgttattattttcaaaagagctcatggttttgccaaaactatatacagtcatgtgccacataatgacatttcastcaatgactgatgtatatgcaacagtggtcccacaggatttagtggagctgaaaaattcctgtggcttagtgatgtcatagtcatcttaacatcatagtg

SEQ ID NO: 20338 - DNA, 201 bp, Homo sapiens
tggttaacagctattcactttctgtctcattgagattttgctttatgttcctctatgagcatggtgaggcataacatccatctcgcagttgatgaaaaacyaccattctctttatgaagttcctctcattttgtggtatctacagagaatgctttgggttctgagatccatgagactagggaatgtggcttccatctttgc

SEQ ID NO: 20339 - DNA, 201 bp, Homo sapiens
gatttaatgttccagtctgctactaagctccgaagtgtacatattcacttagatatcccttaggtgtcttaagcttaggatgccccaaacagaattcattstttaacttcttttcctcatcactaaacacactctctattctttctatattctctggttttcttttactctttctgtgattcttttatcacatttgttatc

SEQ ID NO: 20340 - DNA, 201 bp, Homo sapiens
atatacacacacacacacgacatatattgtgtatgtgtgtgtatatatatgaatttacagtatatataagtgtaaagtgtcatttcaaatcattgaaaacraatcattcagtgaattgtgtgactggctagttacttggcaggacaaaaattgagttggagccccatcttatatcttatatcaaaataaattgcaggtgga

SEQ ID NO: 20341 - DNA, 201 bp, Homo sapiens
agttgcaaatgttttggagaactttggttccatttactgacatgaataatagaagaagaaaaaagctcttattctgagagaaaggtttgtttaattttagrcttagaaagtttgaagttcaagaggcctggacaagtagataggatcatccaatatctgtgtcttaagaaaagagggaggaaagatatgatacactatcag

SEQ ID NO: 20342 - DNA, 201 bp, Homo sapiens
tatatctgcttctctctgcaggaagagaggaggaggaaaagaggaggaggcacagctgatggctgctacccaaggccttgctccgaaacatcatgggtgaytgggagtctaagaatattaattggagacagtgggaacaggggtaatttcacgtacccagtagggacatgctgtgctaagagcgtgtgagaaaatagcgtg

SEQ ID NO: 20343 - DNA, 201 bp, Homo sapiens
cttgcagaataatttggcatttacagataatttaccaaaccatttgtttccatatagaggaagtcatgctcgctgaagaaaataaaaatgctggaacatcmgccttagaaggtaaggaaatgttctgatgccttattccagttgcatttgcccctcttaggcgatggcaatctctgttattcaaaaggagagaaagaaatg

SEQ ID NO: 20344 - DNA, 201 bp, Homo sapiens
cattgtgcttgagaacccattgcaagccaggctgtcttcctgctccgtttctcctccctttcctccctcccacccgccctttcttatagctcagctttacycttttcaatgaatttcactgtagcccaagcgacagtgtgtgctgtgtcactcttaccaccatggtatagaatgtaaaatccccattattgggcactcgtt

SEQ ID NO: 20345 - DNA, 201 bp, Homo sapiens
actcttttcaatgaatttcactgtagcccaagcgacagtgtgtgctgtgtcactcttaccaccatggtatagaatgtaaaatccccattattgggcactcrttagaactataaggctcttctccccagcaaagtgtcccagagctgtgcgaggcttatacaaaagaaggaagcattgagaagtgcagaatgtgaaagccaa

SEQ ID NO: 20346 - DNA, 201 bp, Homo sapiens
cagcggaaccgggaggccgccccgtgagggcagaagctcccgccaggagccagcaccaccagcagagtgtggaacccccagaggtcctagcctcctccacrgggcctcccaggtgctaagtggggagatggggagagggttctgccctctacttggaaatgcctggccgtgttcgtggagcctgggaggtgcggaggagcg

SEQ ID NO: 20347 - DNA, 201 bp, Homo sapiens
cccaggggtgtcatagagtgggttttgggggagaagttttaggaataacaggatgatccccaactttgaggcaggccctaatttatttgtgggataaaaasgatattgaatatgagagtggtgggaacatcattggtttagttaggtctggttagatcatggaggacctcacagcagagggaattaaggcaggagagttac

SEQ ID NO: 20348 - DNA, 201 bp, Homo sapiens
tctcttaatccaaagctcacgtgctttgtcctacactctgctgcccctcggaaaatgcacagagcaaaggtcctattagaagaaggcaaactcgggccagrgctcctgggcagccagggggcagataaggacataatgccagggagctccatgtaaacacgtgaaagagggaaatgggccacaaggtatcctttcacaaac

SEQ ID NO: 20349 - DNA, 201 bp, Homo sapiens
tgtaaatagtgctgcaatgaacatatgtatgcctgtgtttttatcgtagaacaatttatattcctttgggtatatatacagattgctccttcaggccaggytctaggggaaatatgacaatgacttgatcaggtttgctaggtcaaatggtagttctgttttaaattctttgagaaatctccaaactgctttccacagtgg

SEQ ID NO: 20350 - DNA, 201 bp, Homo sapiens
atgagctggccctgaagtacctgaatatcgccttcaccatggtgttttccctggaatgtgtcctgaaggtcatcgcttttggctttttggtatgttgctgmatccttcccagcactgggcttgtctctttctgttgggtgccttcccagtctttgttgaaggggaggtggttactgctattccagaaatcacccacctaga

SEQ ID NO: 20351 - DNA, 201 bp, Homo sapiens
ctgatggagggagagagagtttgtctgcctcttcctcccatttccctttgtatctttattccacttcctttgctcctgtcagtagaaaggggaacaggcawtgtctttgccaaactgcccctataacattagacagttttgtcttgtctacagccataccaccatgaatgtgcctgatcttgtctgatcttggaagctaag

SEQ ID NO: 20352 - DNA, 201 bp, Homo sapiens
atgactgtccctcattacctctggatttgacattgcttttcaggagtggccggagtggatacccttcgatgagtccactctctccccaggatatattccarttggcttgtatggaccccgccgatgacggacagttccaagaacggcagtctctggtgaatgcatgagttatatgacctcaaaactacttccttggtttcc

SEQ ID NO: 20353 - DNA, 201 bp, Homo sapiens
gagaagatgctttgtgttcagagaccaggcacaaatgtttttggtttcacaaaaccaaaagtggatgctaaggaccatccactgtcttgcctgcctgcctrtttacaaataaaaatcatgcaaactgcacagacacaatgcgggttgatagagttgtgtgtttatgggcacggccatcttggaggctgtgtccctctctgg

SEQ ID NO: 20354 - DNA, 201 bp, Homo sapiens
ttaggaatgtaattaaggaaaagggtggaaatcgaatctagattacaatgatttatttaaaaaaaaaaaaaaaaggacctggggatgctatttattcacaygaaacatgggatttagggctaagaatccaacccaagtttttcaggtgtggcagatgtattccatttgcagaagtatccaccctctcctgggagtgatgat

SEQ ID NO: 20355 - DNA, 201 bp, Homo sapiens
tcgaatgctccctggcccggaccacaggatattttgcagtctcattcttccttacttctccctcttaggcacacctctggcccgagccagtatcaaaagtkcaaaggtagacggggtctcttatttccggcacaaggaaaggcttctgcgcatctccattcgccacatggttaaatcccaggtgttttactggattgtgct

SEQ ID NO: 20356 - DNA, 201 bp, Homo sapiens
tacataaatccacatgtaaatgactcccacatttatagattcagccttcatctctcctctgagctcctgaggctgaaatccagctgttcccttgacatctyaactcaggtgtctaatgagagtcttcaactgaacaggtccaaggaacttttgacttatgccatcctccagtctattcctcctcatgtcttcctttcccca

SEQ ID NO: 20357 - DNA, 201 bp, Homo sapiens
caaacaatgaatgttggtgaaaatgtagagagaaggaaattcttatgtattgttggtagaatgtaaattgatacagccattatggaaaatagtatggcggktctttaaaagctaaaaacaggactaccatatgatccagtagtcccacttctgggtatatatccaaaggagatgaatcaatattttgaagagatatccaca

SEQ ID NO: 20358 - DNA, 201 bp, Homo sapiens
gtcagaacttgaaaccacctttattccttctggctcagtgttttttctcttattattcaatataactcaattccctcataaccatgaagcattgtgttttygtgacttatggttcattgacttccaaacatcattttgtctgaaatatttcatatacacaaaagaatatatatatattacatatggtttgttccatatatg

SEQ ID NO: 20359 - DNA, 201 bp, Homo sapiens
tatatttccctatgcaatatatcgctaaatgttatatgaattgtaaaatacagtgtatgtttttatagaggttggttcattcacttcactttcgctgctgwgcagaattctacacagcagaagtgtaagtgtattgcaagttatcccctctccacttctagaattttgctaatgcaagtgacattgctatgaagattctgg

SEQ ID NO: 20360 - DNA, 201 bp, Homo sapiens
cagccaacatcatactgaatgggcaaaagctggaagcattcctcttgagaactgatacaagacaaggatgcccactctcaccacttctactgaacatactrctggaagtcctacctggaataatcaggtaagagaaagaaatgaaaggtattcaaataggaaaagaagtcaaactatctctctttgctaacaataacaatt

SEQ ID NO: 20361 - DNA, 201 bp, Homo sapiens
gcactcatggacataaagatggcaacaatagacactgggtactactggaggtggtagagggttgaaaaactgttgggcactatagtcactacctgggcaasaggatcattcatatcccacacttcagcatcacacaatatactcatgtaacaaatctgcacatgtaccctctgaatctaaaataaaagttgaaataaagaa

SEQ ID NO: 20362 - DNA, 201 bp, Homo sapiens
catcagagctagaccctgtctctaataaataaattaataaataagaatctagaccttcctctctctgtgtagattaaaattaatttgagaatatctttgcraattcaggcgagacaaatgtttcttggacagaatacaatataaaaagcataaacaatgaaatcaaaacaattaataagttgggctttgtcaaaataaaca

SEQ ID NO: 20363 - DNA, 201 bp, Homo sapiens
tcccatcccattttaattgcatccctggaaaggacagcgagtggaaaggccaggctagtccttctgtgtattgagtcacgtttggtgcgttagcccacgcygagcctctaaacttccttccgctcacttcgagtctctcctcaggagctccccctgctccattttccctcatattttggctcttctttcccatctccacca

SEQ ID NO: 20364 - DNA, 201 bp, Homo sapiens
agtccttctgtgtattgagtcacgtttggtgcgttagcccacgccgagcctctaaacttccttccgctcacttcgagtctctcctcaggagctccccctgstccattttccctcatattttggctcttctttcccatctccaccatcccatttctgtgagctttgggccttctccttggttccacttgaccgtcccaaagc

SEQ ID NO: 20365 - DNA, 201 bp, Homo sapiens
tttggaggtggaatgaatatataaaataaaggccttgataataggttatctgtattatgatacattctcagaaaagtcagtaatataacagctacttggarcacctactataccttgcacattctatcatttaatcctcacaacaaccttttgagataggtatgatcattattcctaattttatgaatgaggaaactaaga

SEQ ID NO: 20366 - DNA, 201 bp, Homo sapiens
gagatttcctcctcccacgtgagggtgtggtcttgactactcctggctccacacaggctgtcccttagggcagggggcaggagctcaagaagctggaggayagaatttctcccctgagaacaggaaagagaggaggcacgaggaaaccacagtctgtctgctttaccctgatggacttctgttcagggagtttgggtgaat

SEQ ID NO: 20367 - DNA, 201 bp, Homo sapiens
ttagttacatctcctcaaaagatgtaacagcagagaaagagtggaaagatgaagtctatttatcctattaccaatcagtagttggtttgaaaaggctcaayggagttaggaggagatttttggcacatctgtaaccttcagtcacttatgacttgtgtgacttttgttgatagttgaaagtcagactgtattttatagggc

SEQ ID NO: 20368 - DNA, 201 bp, Homo sapiens
ttaatcattatactttaacattctggattccaccaacttcaaggttaaaaaccgaaacaggaaacatattccagttccttcattatctcccttacattaaktgtcatgcttttcttcccctgtgtctactcaaacaaataaatgagatctcaatattgagaagagaaagaaaaaagaccagtcattccctgagctcctaaa

SEQ ID NO: 20369 - DNA, 201 bp, Homo sapiens
gacactttttatcatatccagagaaagtgtttggcgtaatgactcccacgaggcctcacttcaatgaaaactatttttctaaagttagatatggaggatamatctaaaaccttagtgagaattttctgagtctcaggtgattttggatttagaattggaaacacaacatgcttttaaaaccttttttttttagaggattgc

SEQ ID NO: 20370 - DNA, 201 bp, Homo sapiens
ctgagcccgtaagatggggattccccacacctgcaatgtggcagtcaccttgccctgggactagagcagcccatcttgcccttcgaatgctccctggcccrgaccacaggatattttgcagtctcattcttccttacttctccctcttaggcacacctctggcccgagccagtatcaaaagtgcaaaggtagacggggtct

SEQ ID NO: 20371 - DNA, 201 bp, Homo sapiens
ccctttggcctttggaactctctcccaaagtctacattgtctgactcaggcctgccaggaaggccctttctggaaacttctggacagttggagagccacayacccatgacggaaggctggttcacttttattgagtttggtgagcctcaacctagcccagggggcctcaaggaacacagaaaataacatcttaatttctat

SEQ ID NO: 20372 - DNA, 201 bp, Homo sapiens; identical to SEQ ID NO: 3469

SEQ ID NO: 20373 - DNA, 201 bp, Homo sapiens
acgaggggggtggatgagaaaggggtgaggttgttcaaagggtacaacattttagttagacaggaggaatgtgttttagagatctgttgcacagcatgttrctatagttaataatagcagattgcgtatttcaaaattgcgaaaacagtagattttaaatgttctcaccacaaataggtatatgaggtgatggatatgtta

SEQ ID NO: 20374 - DNA, 201 bp, Homo sapiens
atctctgttcttcctaatgcttgtttctcagctctacttccaggattggttcatctattttttctcactcttttgctttgatcccttggtatctcctccaktgttccaagtaattcatttccctcccgcagcataggcagggtggccgagaaaaagccctgcagttagttgagctgccttcctttgatagcaatccagtga

SEQ ID NO: 20375 - DNA, 201 bp, Homo sapiens
gccatactcccttggggtgctgtcaccaggaccagtcttgagcccagttcagccctccttgtttagtagcatatgtctcagaacatgatatgcacggccasttccacccactgctttcacttccggccccttttcttaggagttttggtctcataatggctctagaagcagaggaactgaaggctagagtgggcaaaagta

SEQ ID NO: 20376 - DNA, 201 bp, Homo sapiens
gttgagtaaaaaacaataggaactggatgagatttataacatattatgacttatatgttaagttaaaaacatacctaccaaacttttcctatttgatttgratatttgaatatttaagtttgtatgttaaatatgtcagagatggtacccatgctaggcagggggttgaagggggaaaaagccctgtagcatctggagtca

SEQ ID NO: 20377 - DNA, 201 bp, Homo sapiens
tcaagtgccatgctgaattcatgtttacagcttcttggcttgggctcttgaaatctagaagtctttgggactgaaagcgaagaatttgtcttggttcaaaygctgtctgctcaatcccattattgccttccagcacgtgcccttggacactctcgtatcttgttgtctggttgtagagcagattttcacatgctgggagac

SEQ ID NO: 20378 - DNA, 201 bp, Homo sapiens
aatggataggatttagagggctagcttctgttttggcctttattgacaacctaagtctccttaaatcctttctggaacaagtcaagggataaagcataaayaactttaatactgctgaactctatgaccttcaggaaggtgtttaccttctctggggctgtgtttgcttctctgaaaaatgggagaaatggttccccaggc

SEQ ID NO: 20379 - DNA, 201 bp, Homo sapiens
aaaggtagcagcactgcaggcacaagaaaccctgtccttccttctggctttctgtagaggaggtccacattgcccatcaaagtgtagtcaacccccatcayagagcctaggaatcaacacttcattggagagggaattctcccacccactttcagttgcattttaattttagcctctcttcaagttgtaaatagtctcata

SEQ ID NO: 20380 - DNA, 201 bp, Homo sapiens
ggcctttattgacaacctaagtctccttaaatcctttctggaacaagtcaagggataaagcataaacaactttaatactgctgaactctatgaccttcagkaaggtgtttaccttctctggggctgtgtttgcttctctgaaaaatgggagaaatggttccccaggctcgtaagaacactgaaaatatagaaacattgaag

SEQ ID NO: 20381 - DNA, 201 bp, Homo sapiens
ctggcagcgctgagatcaacgcaaaattacagtgtcccactctggccccaaatccaaactgtcctatgtctgcatcctcctccagtaccaaggccagttcsctgcctcatatctccttgccttgaccctcacctctaaaactgaaatgttatcccaaagtggcaataagcatgcgcagtatggaattttgtgccacatggc

SEQ ID NO: 20382 - DNA, 201 bp, Homo sapiens
ccagaccctgttctaagcacttgggatatggcagtgagccaaacagtcaaccagctcaccaaagctcttctcttgtaaagctctctagttggctaaggcarcgataaacaaaataataaatgagtaacttataagacaatgataaggtggtaaatatgatgggaaaactgatcaagttaggggtatgggatatagaatgtg

SEQ ID NO: 20383 - DNA, 201 bp, Homo sapiens
ctatgtctgcatcctcctccagtaccaaggccagttccctgcctcatatctccttgccttgaccctcacctctaaaactgaaatgttatcccaaagtggcrataagcatgcgcagtatggaattttgtgccacatggcttcatggcagagttttttggtggctaacttaccaggcttttgcatgaaacataataaaacgcc

SEQ ID NO: 20384 - DNA, 201 bp, Homo sapiens
ttatggggccttgtaagggctatgggcttcactctgagtgacacaagaaccatgggagggttttgagcagaggactgacgtgctggccgcattgagaataraccatagaaggataaggctggaagcagagggactagtagtgccgccatctagggaggagataatggtgagaacaggtgttttcctaagccttgagctgtc

SEQ ID NO: 20385 - DNA, 201 bp, Homo sapiens
tcctcctccagtaccaaggccagttccctgcctcatatctccttgccttgaccctcacctctaaaactgaaatgttatcccaaagtggcaataagcatgcrcagtatggaattttgtgccacatggcttcatggcagagttttttggtggctaacttaccaggcttttgcatgaaacataataaaacgccaggaggcttaa

SEQ ID NO: 20386 - DNA, 201 bp, Homo sapiens
aggaaggagcccgcccagccttggccaccccacacaggtcaggtggcagggtatgctgctcgctggggctctgcttttcaaatacttgcagaattccaagscttccctttcttccagttggcaaagccagctctctcctccttctaagaaaaaagacgcactgcgacgtcaaagtgtgcttcctggcccttccctttacaa

SEQ ID NO: 20387 - DNA, 201 bp, Homo sapiens
taactttctgacttggagatattgtgactagatcccagcatagaacttcggctatgtgacagcctcctgcagtcaggcagtctggctgccttgggcctgcyggctgccttcccaactgtgttgccacctggagctgctgctggagtgtcccagccttgctgtgtctgcagccttttccagaccctttctgaaatgtctctt

SEQ ID NO: 20388 - DNA, 201 bp, Homo sapiens
gcagcaccacacaccttccatctgtcctggggggtccccagatctgctcaccccaaagcccagacactgtgcacagcaaaagtgacttgactgtctggctragataattaaagttgctatgaggtattttaacaagttcctaatttttaaatgatgccctccaaacacgtgctataaaatgacttaaaaaccctttatgtc

SEQ ID NO: 20389 - DNA, 201 bp, Homo sapiens
cccctgagaacaggaaagagaggaggcacgaggaaaccacagtctgtctgctttaccctgatggacttctgttcagggagtttgggtgaattccacatttkgatcacaatagttgtcgcctgcctttcttttccctcatagctttcaagacccctttcatgtccctctgtctccaggaaagatgatttatttttttcttgg

SEQ ID NO: 20390 - DNA, 201 bp, Homo sapiens
gacttgtgagaataggtcctgatacccaaaatgtggttggggaaggagggtgcatgtgaaagcctccttttcatctgaagagtggaggggttgaccttggmtccaggcagtgctgtgtctgggagttcatcattactcagtctctgtggataaagatctctgagtgttccctcttttgaatgttcacagtgattacattct

SEQ ID NO: 20391 - DNA, 201 bp, Homo sapiens
ctggctgactacaaatctggggttcccacaaccatcaccccactccccactggttcagtaatttgttagaatgactcacagaactttggcaaaaccatackgtattataaaggatacaactcaggaacagcccaatggaagaggtatatagggcagggtatggtggtggggagcacagagcttcatgtcctctctgggaac

SEQ ID NO: 20392 - DNA, 201 bp, Homo sapiens
ggaataggttaggacttaatggtgcataaactcagagccagcagtcattcttccatccctggtcttggcatttggaagatgagatccactatgttgtaagstctaaggggcaggaaatacaagatgatgtatttatgtaaatataatgtactatgttgtaatcatatgtgcatgcaggaatgaatgactgaataagtgaag

SEQ ID NO: 20393 - DNA, 201 bp, Homo sapiens
gcccgactttctccatcctattggcctggacttcattttagctcctgcataaatgtttccttttggatgggatttgggtctgttggatgatacatgtggayatatataaatatatgcatgtggatatatgtgtgttcaatctcatagattctacattaatgacatacagaccttctaagatgtgactcaatggatagaaac

SEQ ID NO: 20394 - DNA, 201 bp, Homo sapiens
ccctcccagctcactgatgtgtttaccaacccagatgcctcctgaaccccaacatgctgaaccccaacatttagcatgcccatcattacataggcatgctygattaaaccatcggccattggcaattaaactaatctctagtgcccctcctccctagaagtgggagtagggggaggctgaaagttctagcctccagtcctg

SEQ ID NO: 20395 - DNA, 201 bp, Homo sapiens
gctggggtgggaattgctagtggcatgactgtccctcattacctctggatttgacattgcttttcaggagtggccggagtggatacccttcgatgagtccmctctctccccaggatatattccagttggcttgtatggaccccgccgatgacggacagttccaagaacggcagtctctggtgaatgcatgagttatatgac

SEQ ID NO: 20396 - DNA, 201 bp, Homo sapiens
atggtgacaggtaccatggaactaaaagaccagattaggtgtaggaggaactatgtacaggcagaatgacttcaaaagagcttgcgttctacgttatgctyggaccttgctgcatgggtcccctttgctgcactagagcagtggaggataattattcttgcatatcagcccaaaagcacagtatccagcagctctctgggt

SEQ ID NO: 20397 - DNA, 201 bp, Homo sapiens
tgctggaacatccgccttagaaggtaaggaaatgttctgatgccttattccagttgcatttgcccctcttaggcgatggcaatctctgttattcaaaaggrgagaaagaaatgaaagatggtgttctgggattggaaatgagagtctttctgtcataaaatccctcatgctttaaaatgaagggaattgagtcacagattt

SEQ ID NO: 20398 - DNA, 201 bp, Homo sapiens
aaggggaacaggcaatgtctttgccaaactgcccctataacattagacagttttgtcttgtctacagccataccaccatgaatgtgcctgatcttgtctgrtcttggaagctaagcagggttgggtctgctaaatacttgggtgggagaaaatttcatcaatgtctttggctcagcagttaatttgcaaattttaacttca

SEQ ID NO: 20399 - DNA, 201 bp, Homo sapiens
gccatcctacaaccaatgctatctaaagggaccttctcttaaaatgtgtggggatcaccttgagaccactttcattaccaggaagtggcattgtagatgawgagccaggacagatggatacggagtgcctgtttacctcctgcatttagataggctctagcatggcttccagagctcttgtgttgcaggaaggtgctggtg

SEQ ID NO: 20400 - DNA, 201 bp, Homo sapiens
atttgcaaattttaacttcaacatggcctgcaagggtttgggaggggggaatgtcaggacagtgtttgcagaccaaattccacttaagggctgaaaccttrgatagccaggtttatgctgggtcttagagaatcccatgactagtagcagagaccccataaaagatggagacgcagtggatggggtagcagaacccaaaac

SEQ ID NO: 20401 - DNA, 201 bp, Homo sapiens
acatatacatacaactgagaccttaaagctgcaagtctctcttttgaaagccattcttgaggaggctgaattgtccactggacgtgagaagcaatgagatrgaaccaagtcccacaagcttggctgtgtgtttatttccaggagccagaggttagtgaattaaaaagcgtgcagccctctaaccatggcatctaccttcct

SEQ ID NO: 20402 - DNA, 201 bp, Homo sapiens
tcctccttgcggctgtcagcccaccgcctgaactctgattcaggtgaggaggtcttcagtgtccagctctttcatcaggcagtgggctcctgccctgatgsacttactctccaaggactgtagataaccagaaaagaattcagagacaagggctgaagaaagtgaaggatgctccttaccaaagggaattcctgtatctga

SEQ ID NO: 20403 - DNA, 201 bp, Homo sapiens
agggacatccctggagccctttctcctcctctcctttcatccccaactaaacacaaatggtgccattttcacatgcctcatgatttctgaagatttcaacrtgttcctcttgcagttagcaacaagacggatggggaagccagtcccttgaaggaggcagagatcagagaggatgaggaggaggtggagaagaagaagcag

SEQ ID NO: 20404 - DNA, 201 bp, Homo sapiens
gtgtatgtgggagtgaggagtaagggcatgggcgtggtggggagtgggccagctcagccatgcccactgcccgcaggatccggagggcctgccactacatygtgaacctgcgctactttgagatgtgcatcctcctggtgattgcagccagcagcatcgccctggcggcagaggaccccgtcctgaccaactcggagcgca

SEQ ID NO: 20405 - DNA, 201 bp, Homo sapiens
tcctggagactccagttgatttgaagccctttccagaaatgcaacatgcagggtgatgccaaagaatgcccccgctggaaatctgctccccagtcgccccsagcagagctcctgagcgccttgcagctccagctcacgtgacctgagtggcagaacgggggaagcaggagtagggagcgtcaggagggagaagtcagaggc

SEQ ID NO: 20406 - DNA, 201 bp, Homo sapiens
caggatgtccctggagtcaaatctgactcagtttctggcttcttgcctccatctctcccatacatctctccccttttagcctgttgttactaatgccatartttgaatgtcatttttatttctcccccattccatatgattccctgggggcctctcccctgcagaaccaacaaaggacgggacatcaagaccatcaagtct

SEQ ID NO: 20407 - DNA, 201 bp, Homo sapiens
ggattagtctcagggttcaaatatccagaatatcaaggtttctcttaggaatagttaactgagtaaaagaaaacctgcttgttattctattttgggatttyccccccctataaaaatagaactgtatttaaaagttaaatctagactgggcatggtggctcatgccttcattcccagagctttgggaggccaaggtgggag

SEQ ID NO: 20408 - DNA, 201 bp, Homo sapiens
tggatattcaaagacaaaaaatgaccaacttatttctcaattaaaatggcaaatgcaatatagtgttatcattgctatggggagtggttgggaaatataakgtattataggggcacaggggcacataggagggtgcctatattagtctgttttcacactgctataaagacatactgagaatgggtaatttatgaagaaaag

SEQ ID NO: 20409 - DNA, 201 bp, Homo sapiens
tcaggaaacattgattaaacatctattttggatattcaaagacaaaaaatgaccaacttatttctcaattaaaatggcaaatgcaatatagtgttatcatkgctatggggagtggttgggaaatataaggtattataggggcacaggggcacataggagggtgcctatattagtctgttttcacactgctataaagacata

SEQ ID NO: 20410 - DNA, 201 bp, Homo sapiens
tgcctatgatcctactcaggaagctgaggtggaaggatcgcttgagcctgggaggtcgaggctgcagtgagccatggtcatgccattgcactccagcctgrgtgagagagcgagacgaccttgtttcaaaaaaaaaaaaaaaaaaaaaaaaaaaaaaaaaaagcgcccagctcttcccaaagtctggaaaagcaggcttcc

SEQ ID NO: 20411 - DNA, 201 bp, Homo sapiens
tttcaaagtggtttcatggtcatttcctcattttggccaggtcccttcattctcttgcatttaatcctctccgaagtctttttctgatttctctggccatygcattcctcctcactctcaggttgggatgggtttttgtgttgatttgttcttttcaggatacatatagctttaattgattttgtagtgataaatgaacac

SEQ ID NO: 20412 - DNA, 201 bp, Homo sapiens
tctagactttagggccttgggtagcaccagccatcaagacctcatgaattctcagccacccagatacctggccagtcactgggagtttgactcatcagcayctgggccaagagccattccgctgcctggagcatcttccggtggtgttggctacaccttcctgagctagcctgtgtccccacaaacctcacatatctgccc

SEQ ID NO: 20413 - DNA, 201 bp, Homo sapiens
gagagagcacttcctgttcctctcaggcatggaaaggcatgagagcacttccccatctttctcacccaactttcatgcccattgcccctgcttgtgggcakattttcctttttgctgcctggtctgagggataaggtgggttaaggaggagggttaaagtgagtgcttgatcttcctgctactgtattcaaaccatcaccc

SEQ ID NO: 20414 - DNA, 201 bp, Homo sapiens
gctgggggataggtgggggatcagaattgccaagggtgtcctcatgaggaggcctccatccagcctcaacaagccttaaacacctcattcaggtgccgtarcaagccttaaacacctctgggtagggtttgaatctgtaaatgaatcagaggtaaatgaatcttaaaacctactggccttaagaattggaaggccccttgc

SEQ ID NO: 20415 - DNA, 201 bp, Homo sapiens
ctgggggataggtgggggatcagaattgccaagggtgtcctcatgaggaggcctccatccagcctcaacaagccttaaacacctcattcaggtgccgtagsaagccttaaacacctctgggtagggtttgaatctgtaaatgaatcagaggtaaatgaatcttaaaacctactggccttaagaattggaaggccccttgct

SEQ ID NO: 20416 - DNA, 201 bp, Homo sapiens
ctcagcctcctggctgggtggcagcaggtgcctatgtttcacttggagctctaggtcctcattctttcccctgctccccaacctttgcctcttgcctgggkgctgagaagacagctttcatttttctggctgtaagatcctagtggtgactgtcctatctgtcttttgttctgccctagaaggtagtaatagtatgggtag

SEQ ID NO: 20417 - DNA, 201 bp, Homo sapiens
tggatgacttgttctcatcatcctcttccaagagtatgactggatttcctagtctgcaggaaacccgttataggcatttaattgcccagtgatgtgtgggktatgctgtacattgtatccttttcctaaaatgtgggtgtggtcagaggaatcataccttggctttgaggtagaaacaccatccaactggtgtgactcagg

SEQ ID NO: 20418 - DNA, 201 bp, Homo sapiens
atcacctcaaatacttatcatttatttgtggtaagaacatttgctatctactctcagtaattgtcaaatatacaatacattgatattaattagtcaccatsctatataatagacctccagaatttatcctgtttaactgcaatttttaccatttggctaacatctctccatttccccttcccactccagcacctggtaacc

SEQ ID NO: 20419 - DNA, 201 bp, Homo sapiens
gaactgatgaacaacttcagtgaagtttcaggatacaaaatccatataaaattcagtagcatttctatacatcagtagtgttcaaactgagagccaaatcragaacacaatcccctttacaatggccacaaaaaataaatacctagcaatacatctgccaaggagatgaaagatctctaccaacaagaaaaactataaaac

SEQ ID NO: 20420 - DNA, 201 bp, Homo sapiens
tctcaggtgctcctagagattctggctgatggcaggtttttcctccccagaaaaagggaaaggtcttgttccatcctcaaaagcagaagagacttacaaagctcattgctgttttgtgccaccagtggtagaaatatcaccagtgtagcagaagaattccagtgcttgaagctattttaaaaggaaagggcagaaagaagc

SEQ ID NO: 20421 - DNA, 201 bp, Homo sapiens
ggagtgccacaggtgaggcctggcaggagattatgctgtcatgccttggggagaagggctgtgagcctgacaccaccgcaccatcagggcagaacgagaaygaacgctgcggcaccgatctggcctacgtgtactttgtctccttcatcttcttctgctccttcttggtgagcaacattgtgcttttgccttgctatgtgg

SEQ ID NO: 20422 - DNA, 201 bp, Homo sapiens
gtggcagtcaccttgccctgggactagagcagcccatcttgcccttcgaatgctccctggcccggaccacaggatattttgcagtctcattcttccttacytctccctcttaggcacacctctggcccgagccagtatcaaaagtgcaaaggtagacggggtctcttatttccggcacaaggaaaggcttctgcgcatctc

SEQ ID NO: 20423 - DNA, 201 bp, Homo sapiens
gattcctcttgattgtggcccatagaagaggctctggtatcaagccagtcaccaaggacttctgtatcctcctttcccctctctttccttctgtgacaggrttttccctttgtgggctggtctcatcatccagtcctcacctcagattatttgggctcagtcccaagagaactttccaataatctttttctgccaatggtt

SEQ ID NO: 20424 - DNA, 201 bp, Homo sapiens
tatctcatgactgtttccagctttcattctttaggtaaacagatcattgttgatgaatcaacaagatagcataacgttatacctttgggtaccataaagcyttcacttcctttcttaaggaggctcaatgatcaggagttttgatcattgaaatcctgggcaggaagttctcagggcaatggagacctcaaatagaccaga

SEQ ID NO: 20425 - DNA, 201 bp, Homo sapiens
tgctttgtaattcacagtgtaattcattctagttagttagagtttggttggctttctttataaggtgggtgaggaagactaacaaaagtaatgtgagccartgtcttcaaaaggggggctgaaaccagttgcaaaaaatgtcagtctatagccactcccaacccacctacttcccaatctcactaaggcaaaatgaaagga

SEQ ID NO: 20426 - DNA, 201 bp, Homo sapiens
atcaacaagatagcataacgttatacctttgggtaccataaagccttcacttcctttcttaaggaggctcaatgatcaggagttttgatcattgaaatccygggcaggaagttctcagggcaatggagacctcaaatagaccagaagaagagcttataggtcagctccagattagactgccactgggtgtgagtgagggtc

SEQ ID NO: 20427 - DNA, 201 bp, Homo sapiens
aagaccagtgtgatcgctctcttcacatgcacacactcatgtatgtgtgtatatgcacatgtacacacacacacacacacacacacacacacacaggtccmccttagtctgtatagttaatcagagggacctctcctttctctatagaatgcagaaatatttttaacccagcaaaagaattctggcttcttttcactggag

SEQ ID NO: 20428 - DNA, 201 bp, Homo sapiens
agaattctggcttcttttcactggagatggagaagcctcattttagcaaaagagcctcatcgtcccatatgtaatgtatggagtatgatcctagtgatccyaccctcccagctcctggatggtctggtcagaatgactatgaaagctataggacagaaggggtgagaaacaaggaattagggcaagaggtgagagtaggta

SEQ ID NO: 20429 - DNA, 201 bp, Homo sapiens
aattgggattagtagaacagaaaggcagaaccatgggacgcaggtgtatttttgcattttccatagtttcatagagaagacatgctgttttacgttttctrccctgaaaacatctagaggttgggacagactagaagctcaatatgagaaactcatgaaaagaacactaggcagtaagtcacagacatggaagctccatgt

SEQ ID NO: 20430 - DNA, 201 bp, Homo sapiens
tatgtgaggccaagcctgctaggtaaggaaccctctcctggtgcaagtggagggaagcatgggctccctggggcatagcactgcccaggcagctggaagaygacctaggctcaggaaggatgccagcctggacaatgggatagagctggcctgggatggtgacacggtgattccatactcaggaggctggacagctgcctc

SEQ ID NO: 20431 - DNA, 201 bp, Homo sapiens
ttacaattctgtaaagcagagacctggtatgggcctccccaggctaaaattaaggtgtgggcagactgtgttcctttctggaggctctcagggagaacgtrtttcctgctccttctggctgttggcagaagtcaagtcttgtggctgtagggtcgcagtttccttcccttgctggctgtaacctaagggctctttcatgct

SEQ ID NO: 20432 - DNA, 201 bp, Homo sapiens
tcctctccgggagtgccagtctccaggaacctccacatgttcagctatccagaagctctccgaaccctgtccttttggattgttatggagtcttcattacwtaggcatgattgattaagccattggtcattggtgatcaacttaaccttcagcccctcacccctccccaggggttgtgggggtagggctgaaagttccaac

SEQ ID NO: 20433 - DNA, 201 bp, Homo sapiens
acgtctttggggggaacccagagtgatcaaagagataaggaaagtttgcccttttcaattaataaggacaaaagggacttaaggataaaacatgttctttmagataggtcactgtggttgtggatgagacttcctgggtgtatagctctctccctccatataatactgctcagcaaaccttcatgggagaaaggatgttgt

SEQ ID NO: 20434 - DNA, 201 bp, Homo sapiens
tatcctcagtatcgtcaccatcactaggtgggcatgcaagccccctgaggacagatcaggggatctatgcactctgcatcctcagatcctggcaccatggsggccctcaatatacattggatgaatgggtgactgatagcacagacctgttccagagagtgggtaacaaagcttagaggttcctcactctctcccattatc

SEQ ID NO: 20435 - DNA, 201 bp, Homo sapiens
tgtttgtgagtggttacgtgtgggcgtgggacaatgtgtcattgtccttgccatagacaaagtggcactgggtgtgcatgtcagtgtgtggcttggtgtgygtgtgtgtgttccgttcacatgatctgtggatatgccctctgcacctctcaacatttgcttatatcagcgtgtgtctacctttgtgaactgtgtgttttt

SEQ ID NO: 20436 - DNA, 201 bp, Homo sapiens
aattagaaacccagtggatcgaaggttaaaatggtcaaacaagggataagttatgtgcctgtattatccatgttaattttattttccccacagcaaactcygtagtcattggaattctttccttcttcttccctctttttacccagaaaaatgcccccatgttccagcgcatggagccttcatctctgcctcaggagatca

SEQ ID NO: 20437 - DNA, 201 bp, Homo sapiens
gtgcgcccacaggcacaggctcagggaggaggtaacttcccctccgcccagcgagccctctcccatgtgctctcctgcacttgtcatgttcatgatttccygctgccccatgaatgctcctctaggcccctgggctgaaatgctcgatcgcagttttgagtatgagctgctggtggtctctgcacttagccttctctggct

SEQ ID NO: 20438 - DNA, 201 bp, Homo sapiens
ttactgcagttgtgtaaattatcagtgatagtagcttggactagcaggatagagatggagacagatggtcagatgtgagaaatttggtagataagactggrtaggatttggtgattgatttgctacttggactaaaggggaaggaggaagcaaaggattctgggtgaagcctttgggtgcatgttggtacatttcctgaca

SEQ ID NO: 20439 - DNA, 201 bp, Homo sapiens; identical to SEQ ID NO: 3466

SEQ ID NO: 20440 - DNA, 201 bp, Homo sapiens
acctcaggtgatctgcctgcagcagcctcccaaagtgctgggattacaggtgtgagccactgcgcctggccagagccaagttttttaagggatggcttcaygtctgagttttggcctttcacactgacttgctatggctggtagcaaggtgatgaggctcttttaatcttcatagatatccagataatacagcttggatca

SEQ ID NO: 20441 - DNA, 201 bp, Homo sapiens; identical to SEQ ID NO: 3468

SEQ ID NO: 20442 - DNA, 201 bp, Homo sapiens
gaggtcatatttgcagcctgggtcaggggaaagggtacatgggcttaatagaggtacttgctcagatgctctctctctgttgcttgattcactctttcccytagtcatggccctgtccaaacccagtgaatcttatccttcttgtccacagggaatttgccaaagagagagagagagtggagaaccgaagggctttcatga

SEQ ID NO: 20443 - DNA, 201 bp, Homo sapiens
agccgagagaaggggcaggatggttgagcaaggtcaagagttgagctggaggcatgttaaattggagtggcctaattgatgtctatgagatagcccagttmgagatgtcataagaagtaagtagctggacatctgagtctggagctgggtcagagcaagagatatacacttgagaaacattaatttattaatggtgttttg

SEQ ID NO: 20444 - DNA, 201 bp, Homo sapiens
tctgctctctcctgctgcttctcagtgtttggacaaaaacacctgccagttggagtatggtgctgtgtatagcaaaggagaaagcttgcaaaaggctctcrggagtgtgtgtgaggagctcgttgaggtccatgtgcaagagggaaaggattatgcaccacttagcatagagctagtgctctggtcacatgacaaagaaag

SEQ ID NO: 20445 - DNA, 201 bp, Homo sapiens
ttgcggcctgtagaatgtgctgactcttctgtagaatgagctatagtgaggaggctctctttcatttctgctctggttttagaggcaactatgtagatcaygagaaaaacaagatggaggtgaagggccgggaatggaagcgccatgaattccactacgacaacattatctgggccctgctgaccctcttcaccgtctcca

SEQ ID NO: 20446 - DNA, 201 bp, Homo sapiens
tgtgttataatccccagtgcaacagagttgagaggtgggacccttaagaggtgattaggtcatgacagctctgccctcgtgaatggattaatgccattatwgtgggagtgggttcttgataaaaggatgaattcatcccactttcccatgctctgttgcataggctttgccattacacccttctgccatgagatgatgcag

SEQ ID NO: 20447 - DNA, 201 bp, Homo sapiens
taaggtggtggacagaactgtacagcctcaggcttctcaaccaaagatccaggtccattctgctgtctgcctccagtagatgtttgacacgaactccatartctcaatttcaacctcatacttcatggtttctttgtctcttccctgggttttccccatggcgataagagatcagaaaatgtgctctctctttgtgtctga

SEQ ID NO: 20448 - DNA, 201 bp, Homo sapiens
gtctatccagagccccactgtttctcatgagctatactttaccactctcgccaaggccaccatcatctggatacaacctggaagatctccctgcttccacmcttaatccccttcagtctcttttcaacaggacaaccagagacattctttgcaaacttaagttgtgggactcctctgctgcaactgaccaatcgtttccca

SEQ ID NO: 20449 - DNA, 201 bp, Homo sapiens
cgggggcactgcctagtggaattttgagaagagggccactgtcctccagaccccagaatggtagatccattggcagcttgcactgtgcacctggaaaagcygcagacactcaacaccagcccatgaaagcagccaggaggaaggctgtacttcacaaagccacaggggtggggctgcccaagaccatgggaacctaccttt

SEQ ID NO: 20450 - DNA, 201 bp, Homo sapiens
acctggaaccggaagaggttagataaagggaggttagacgggggtttgttggcctatcctaccagaaatcaagctacatcgtcattctgggggccttataragatgacataccccattcttcatagtctaatttacactgattatagtggagtcaaatgaagagaaactggtggcagtgtgcaggagttgctcctagttca

SEQ ID NO: 20451 - DNA, 201 bp, Homo sapiens
taattgtgagtgttgattacgggggctgcttttggtctcccagcggttctttgaaaaaccattaatttgatcattttgggtggagagtttaagggaaccamttgcagttggctgcattgtgtttgcctggctcccttttgagtgttttgagacttggggaaataaaaaagtaaaagaaactactaccaacaaagatgcctt

SEQ ID NO: 20452 - DNA, 201 bp, Homo sapiens
gatactgagcaaggaaaaggccatcctacaaccaatgctatctaaagggaccttctcttaaaatgtgtggggatcaccttgagaccactttcattaccagkaagtggcattgtagatgaagagccaggacagatggatacggagtgcctgtttacctcctgcatttagataggctctagcatggcttccagagctcttgtg

SEQ ID NO: 20453 - DNA, 201 bp, Homo sapiens
aagaaacacagaagaagcactgttaaaaagcaaagtgcctgagtgctagttatatttgtctcactaatataccctgtgacctcagagagaaaaccactccratctcagaacctctatttcctcatctttgaaatgagaagaatgccacctgcccttcctatcccacaagggctattgtgaggcgtacacaaggtctcattc

SEQ ID NO: 20454 - DNA, 201 bp, Homo sapiens
atgtagctggcgttttagcacccttctccccctccttcattcccgtgcagataataaatgtttattgttgttctattgtggccccaagtgagctgtggacrtggtggggaagcagcaggctgaccccggagggtttgctaatcagagagagtgtaaaacctgtttcagaatctgtcatttacatggggcagcaaatgacag

SEQ ID NO: 20455 - DNA, 201 bp, Homo sapiens
ttgtatcttttgccttattttttgactatttgaaatgcagtatctcaaagtattttgtcatacttggcattttagatgttcgtccattccagggactcagygcactgaggcagggaagacagtggtccagttggtgggctccctgtgtcctgcagggctgtggggggatggcagtgctcccagcttggaatccccccacac

SEQ ID NO: 20456 - DNA, 201 bp, Homo sapiens
gaacatgggatatttttcaatccctgcctctaggatccatgagaagaataaatgagttgaaagaatgccaaaggcctggcctagtgtctggctcatgtagraattcaatgatgctagttgtgaggctgggttggagtatacttctgcagtgctctgagagtctcttgtgttttattccaaggatagaataaaataatccat

SEQ ID NO: 20457 - DNA, 201 bp, Homo sapiens
gatggacttctgttcagggagtttgggtgaattccacatttggatcacaatagttgtcgcctgcctttcttttccctcatagctttcaagacccctttcawgtccctctgtctccaggaaagatgatttatttttttcttggcccaaggctcccccaggggccccaagtccaaacactttctttgctgttccttcaggagt

SEQ ID NO: 20458 - DNA, 201 bp, Homo sapiens
tgtatgatttaaatctgaaagatgtgaaaggagaagagaaatcttaaaggaggaaaaaaaaagaagtggacttgaaatgttttatgaaagctttgcatccrgtaagtcaattagaagagtggtgtaggttgtcctgggacagccccgagcttaggaaacccccgtgtttaataagagcacgtaagcaagcctgtccaaagt

SEQ ID NO: 20459 - DNA, 201 bp, Homo sapiens
ggagaagagaaatcttaaaggaggaaaaaaaaagaagtggacttgaaatgttttatgaaagctttgcatccagtaagtcaattagaagagtggtgtaggtygtcctgggacagccccgagcttaggaaacccccgtgtttaataagagcacgtaagcaagcctgtccaaagtttgccgtggagagtgacatttactgtccc

SEQ ID NO: 20460 - DNA, 201 bp, Homo sapiens
ccctgtctcaccagtctgttcattctgtcaacatcccttgcaagatactaccttaagtctaaggtagtatcttaaggtagtatcttaggtagacttaaggyagtatctcccctttccatctattctttatctagatgggcctaattccaaagtctaaaagctgcagtgtcccctggagcctctcctgtaccttccagcagc

SEQ ID NO: 20461 - DNA, 201 bp, Homo sapiens
tgcagtgtcccctggagcctctcctgtaccttccagcagcggtgggctccctgaccctcatactttctggctgctcttgtgttactctgccttgcgtttgrgccacatgtggatctgctgtataccttctactagactagattgtaggttccctaagacagggactccttccttcattgtgcccaatgcagtaggggctca

SEQ ID NO: 20462 - DNA, 201 bp, Homo sapiens
aaaagtgttcaaaactcctgtgtggtaacacatagggcaggtattgcttgatgcttacataacaaaactggatgccaggacagcattagtaggtcaattarttaatgacattcattcaagaacagaaatgagattacatattagactctgtatgcatatctgtatcaaaaaatgcatgagaaagtatgacactataattgg

SEQ ID NO: 20463 - DNA, 201 bp, Homo sapiens
ggctcaggtcgtggaccactggtttgcctcagagtttaagcagatgtcttcatgcatttacgttgaaaggcaggtactgtgtttggatcccagaaacaatrtttctgaccctgtgtaattttttttagtcaaatatgtttctgcattatcacacaaaatacttttgttttcttttgttggtttttctgaaagaaaatttaa

SEQ ID NO: 20464 - DNA, 201 bp, Homo sapiens
accactggtttgcctcagagtttaagcagatgtcttcatgcatttacgttgaaaggcaggtactgtgtttggatcccagaaacaatatttctgaccctgtrtaattttttttagtcaaatatgtttctgcattatcacacaaaatacttttgttttcttttgttggtttttctgaaagaaaatttaagtgatctcaaatat

SEQ ID NO: 20465 - DNA, 201 bp, Homo sapiens
tcggaaatgttttgcttatggaatgagcctcctcctccgcatatttttggaaggtcctgaccagaggtcaagagtgaggtgggttgagtgcagtggggtgkggggaggcaggtgtgagcctgggcaaccccggaacccactcagatccttcagacagatccagagagagaggctgtcagctctttgttcataaacacaggc

SEQ ID NO: 20466 - DNA, 201 bp, Homo sapiens
aagtcttctttattgaaactcaaaaggtaaaatgattctgtcttggagacccctccttacaatgaggatgtaatcagaggtaccacatccagagcccttaragtttgagtagcaggtaggctgaggtatgaccctgtgatggtgaaaatcatgttaaggtcgaggccacagagggtgctcaggtgtattttaaagtatcct

SEQ ID NO: 20467 - DNA, 201 bp, Homo sapiens
ttcattttctaagtgatgccagaaaccaccaatttttaaatgaaatctcccaatttaattctactttgaaaaaaatgatcaactaagtaaaaatgtctctrtgagctcagcctggacgtcaggcgatagtctgtggatctgattgaaagtttcacctttatcacggtttgtccatgtatacaccttgatgtggcccaaatt

SEQ ID NO: 20468 - DNA, 201 bp, Homo sapiens
gcatctcagtggattggacttgtccttgtattttgatggacagacagaagtttgaaaaccagtacattcacagcagcattcacagcagagtcctgttgttkcctagtgtgtaggcttgaaggaatctctcccttcctttttggcagtgtgatgtttggccatgagatgaagaactcataaacctaagatgagttcttgatc

SEQ ID NO: 20469 - DNA, 201 bp, Homo sapiens
cggagtcctttcgcccaccataacagtgtcagcagtgtctggaagccttttgtctgctcagaattcacgtgatgaaagcggaaccaggccagggaagcccsggcagccactcttgggaggcgcctcctccccaaacgcaccttcgatgggtggatgtgtgggattgagagagagaaggggaagagaagcacacaggacagt

SEQ ID NO: 20470 - DNA, 201 bp, Homo sapiens
ctctatgcagtccacgggcacactgagttctcatttgcccggttggaacagctgatggttagttctcagcgtgatcaccgtggtcagatgggcgccccatrtggtgccttgtgggagaaaagttccaggttttctttagctacttccacaggtacacagaggtgtgctggccatggggtttgtgtctctgcatgttcttcc

SEQ ID NO: 20471 - DNA, 201 bp, Homo sapiens
cagtggtgtgatgtcggcccacggcagcctctgcctcctaggctcaagcgatcctcccacctcagcctcctgcatagctgggaccacaggcatatgccacrtgcccagctaatttttttaaaatgtgtttttttctagagacagggtctcccagtattgctcaggctagtcttgaactcctgggctgaagtgaaccaccgc

SEQ ID NO: 20472 - DNA, 201 bp, Homo sapiens
gaaaactcattgaaaggaaatacactaattcacaaaggttatctctaagtagtaagattatgggtgattttttttcttcttgagctgttatgtgttatttrtgtatttcctataatgaaaattctgagatcaaaacaatgattttctttgtgcaattggaaagtcaaaatagaaacagcaaaactaaagttatctttgatt

SEQ ID NO: 20473 - DNA, 201 bp, Homo sapiens
aaaggaaatacactaattcacaaaggttatctctaagtagtaagattatgggtgattttttttcttcttgagctgttatgtgttatttgtgtatttcctayaatgaaaattctgagatcaaaacaatgattttctttgtgcaattggaaagtcaaaatagaaacagcaaaactaaagttatctttgattccttaatgttgc

SEQ ID NO: 20474 - DNA, 201 bp, Homo sapiens
gtcctggcaccccagccagttgtgtagctggccccgctgtccaagcacaagccacatgcaagggctgagagaaagcttccctgccccctccctccatcacrtcccccatgatactaatgtgggctcccttacctccgcagtacggagtggacgtcacggcccgagatgcccacgggaacacagctctggcctacgcccggc

SEQ ID NO: 20475 - DNA, 201 bp, Homo sapiens
ccccactttgtcccatgatacagctgctctgttgagcatgtgtgtcccacagagtgcggagtgtctgaggtgcatcatctcagttcgtcctgcagcgatcytgtacacagacgcactgctgaggccagaaagcttaggacacttgtgcgagagcggtgagctgggcccgtccgacctcacctctggccctctgtcgccgtg

SEQ ID NO: 20476 - DNA, 201 bp, Homo sapiens
tgcattcctggctggcagatagaggaccacccagctgtgcttgatggggtctagaagcattgaaactggtttgccgttatgatgtccatgaggttggagtmctttcttagttaaaaaatctgaagacccaacaacacacagcacccccacgctgaaccctcccgagaatgattgagctcttccaaataaagggcgattttg

SEQ ID NO: 20477 - DNA, 201 bp, Homo sapiens
cctagagggtggtgtgaactcatgtgatgtgaacgattacttatagttaccgtgaaaattaatggtgggttttatagttggaatgctttttctacacttayttgatttttgtctatctgtttagagaagtgttttttctgttgttgttgttttttaaacttgagatggagtctggctctgtcacccaggctggagtgcagt

SEQ ID NO: 20478 - DNA, 201 bp, Homo sapiens
tgtcagaatttgagactaagagtattgagtgataattcatttctcacctctctggaagaaggtgtaataagcatagaaaatacagaattttctatatactsatataacacatattttcttgtgtgtatgtgtatatgtgttgtgtgtgcatagtgaacaaaggcagaagaaacatttaggcttgaattttttgagctaagt

SEQ ID NO: 20479 - DNA, 201 bp, Homo sapiens
tttatggagggctttggcgctctgttaagcacttgagtattatctcagtgaaccctcgcaacagtatcatgaagctagaactgtttttaaagatgtggacrtggggaccctgagtgactgaatgacaggcccccagtgtgcaactcggaggagagtggaggcactctgatttcgaggcttattccctgaccaagagaaagt

SEQ ID NO: 20480 - DNA, 201 bp, Homo sapiens
aaaccatggcttatgacccttaccctgagcatcagtgacaggggaaccaagagtcgtgtgaggtcccagggtgcacagtggacatttcagtgtgaagggcrggtcgggtgccccagcttccacgctttccagcctggattgtggcatcttggatgtgaggccacagaccaagctcacagggatgagagatggtccgtgtgg

SEQ ID NO: 20481 - DNA, 201 bp, Homo sapiens
tgtggcatcttggatgtgaggccacagaccaagctcacagggatgagagatggtccgtgtgggtcagccggctcaacagaccttctcccaggaggctgatkagatttgctgagcattacaacctgatgggcaggatttgttttaatcatgtaacacaatcacaaaattagtagtggcaccatgctatcgctgcccctttcc

SEQ ID NO: 20482 - DNA, 201 bp, Homo sapiens
actctgaagcagcccagcagcatgtacagcacttgctttcctttgagaggccctccattgttcccgccctgccaacttccacgccagcctccttttgcaartccacctgccgttctgggcttgccctggggaaggccctggagctggattcccacaccctgccgagtttgtgcgtttctgtgaatctgatgagtgggttgt

SEQ ID NO: 20483 - DNA, 201 bp, Homo sapiens
ggggggaccaatacctagtggactgtctgtgtctgtcacccctgtgcctgggaggggtgacccttggcttcacagactgtgctcccttcaccttgccccayggaccctcccccaaccaatttcttagtctgctcttgtggcgaaaattcagcaacagtaaggagtgagttaattctgattgctctttctgtggtaatcttc

SEQ ID NO: 20484 - DNA, 201 bp, Homo sapiens
ggaagcctctggacttcctcctcagagacgggagatcttgtctctctcaatcctgagttagtctccactttatagctgttacttcagttgtagggcactgrgtagccctggagttgagttgttcaatgcatgaccttgtttatgtcgctatttgagtttttactgagaaaaaggccttctgtgaatccaaatgtgactatt

SEQ ID NO: 20485 - DNA, 201 bp, Homo sapiens
tctctcctctgggcttctctgaagacacacacaggtttttcctgctgctctctggctgccccctgtgtcatcctcctttaccagcagacctcagacgatasatgtggcccagaactcagctctctcctgtcctccctgcactcctcttgaaataggcctgaccattcctctagactcagaagatacccaaattcacatccc

SEQ ID NO: 20486 - DNA, 201 bp, Homo sapiens
tgagtaccagtccacgtccctgcggttggggacccctgttttaatatacatctccacccaaactgcagtaagacaaatagctgtctactcttacatctcakgaaaaaaaaatggctgtgaatttaacctacggattttgttttttcttgcagtttctgacttgtaccttttcataaaatatccctattcaacattttcact

SEQ ID NO: 20487 - DNA, 201 bp, Homo sapiens
gtctttgtagcgctagagatgggtcctcagctggccatgatagagaaggatgggcagaggcgggtgtttgagacttggaggggacagtgggggcacagcasccaggcagaggcatgtgtcagggcagagtgagaatgctaggatcctggcccccatcctcccacttgccacacagtcaagaaaatgacaggtgtacgggaa

SEQ ID NO: 20488 - DNA, 201 bp, Homo sapiens
ttgcagggttggtttaagattgccatgaccacatattaatagttgcactgagaaacaggcgtaaacagaggttgtcccgggaaaggcagaatgaatgtcayccaccctggggaaggtggctcgtgtcactaccctttgctacagctgttgtttctcactgattcattctcgggaatcgcttgttgtctgttggtacaaaat

SEQ ID NO: 20489 - DNA, 201 bp, Homo sapiens
tctcccatttaacaggtgcaatgcagtagtttttagtatctcacagatacctgcaaccatcaccacagtcaatctcagaacattttcatcgtctcaaaaargaaactctgttcttgaattggtggtcagaatatgtacttttttctttgtaaggctttataaacatatttcagtaatcaaggtcctcatctcaatggaaga

SEQ ID NO: 20490 - DNA, 201 bp, Homo sapiens
tgaatgtgcgggatggtgccggcccatcccggctcagcgccgcgcagctcgggaccccagtccctccgtcagagccggtttagatgtggagtaatgaggcrctcgcttttttaatttggcatggcttttttctcttagcctctcccctcccatacttaacgccgtcgacagtagtcgtctgtcccggtgcccggtaattga

SEQ ID NO: 20491 - DNA, 201 bp, Homo sapiens
ccaggtgggattctgaattcagttgttaaagggctgctttgtgtgcacatagaaaaggaaacagatgtatttgaacagaggtagtttattaaagagaatgratagacatcaaatagatggccctttatcgttttcagttgtcaaaaatacgtgtgagttgggtaccatatagccctcagcagagtatttgacaagattttt

SEQ ID NO: 20492 - DNA, 201 bp, Homo sapiens
tgcttcctgtggtgggagaaggtgagggagaggagatgctctcatcctgagtgtcctggacgagatgggccagaccattctacccacactcccatttgccrgacctcagccacctcccccagccagccccaggggtgttgggggcatctttcgagtctcactgcccacgctgtgggagctgagactggatgctgttctgga

SEQ ID NO: 20493 - DNA, 201 bp, Homo sapiens
gagacatgccggtctctgccctgtggaactggtggccgtgtgttcacgtgacttgagagctccatctgccctgtctggtcttccccgaagagtgatccccrcctggagaggcttagagcccaggaagctgaagcgaggagaggctgtgtgactccggccgttgtggtgggtgctcatctgcgtcagttacatcttgtgcag

SEQ ID NO: 20494 - DNA, 201 bp, Homo sapiens
gtgtagggctcgtacactacgcttcagctcgtggttccgtggcttcccagtgctgcacgggatcgcagtgaggccgcttgtttgaggggagacctggttcytgcctctggcttctcatccatatcaccggagtgcttttgaaaatgcatcttttcccaagccccattcccagagcttctgaatcaaaatctgtattttttg

SEQ ID NO: 20495 - DNA, 201 bp, Homo sapiens
cttgttcagtgtttccttgtaattttgcggaaaaaagtctgcttagtgttgaaccagacattctgcagcctttaaaagagaatggaaatggagagattgtratgtgttcattggtgacttttgacacggatgctaacctgtaagatgtgcagatatatcatgtgcaaactgttaagatgctgtcaacattttgaatgactt

SEQ ID NO: 20496 - DNA, 201 bp, Homo sapiens
cttcagctcgtggttccgtggcttcccagtgctgcacgggatcgcagtgaggccgcttgtttgaggggagacctggttcctgcctctggcttctcatccayatcaccggagtgcttttgaaaatgcatcttttcccaagccccattcccagagcttctgaatcaaaatctgtattttttgaagccactagttctaaaaagc

SEQ ID NO: 20497 - DNA, 201 bp, Homo sapiens
tctatcatctgctaaaaattcttctttgaaccttaggaggagcatgttcctgttctctccacacagaagaagggaaattgggtccaaaaatctattcactstttacataatgagcgtaaatggtcactgcaatgccaccgaagtgtaaacacggattaaacacggattaaatcttgagatttgctaggtgttgacctaata

SEQ ID NO: 20498 - DNA, 201 bp, Homo sapiens
accacacgtgggcacagctgggagcagggcacccccaggaacccacggacctgccacaggatgcagccagggtgacctaaggcatgtgggcgtgcaaagaygacgggcgtggcttttcaactggagacatgccggtctctgccctgtggaactggtggccgtgtgttcacgtgacttgagagctccatctgccctgtctgg

SEQ ID NO: 20499 - DNA, 201 bp, Homo sapiens
tcaggtgcacctgaggagccttggggccactctggggctcccaccacacgtgggcacagctgggagcagggcacccccaggaacccacggacctgccacasgatgcagccagggtgacctaaggcatgtgggcgtgcaaagatgacgggcgtggcttttcaactggagacatgccggtctctgccctgtggaactggtggc

SEQ ID NO: 20500 - DNA, 201 bp, Homo sapiens
gctcagatgggttctctttcacactgaatcactgctcttgtttgtatgaggcaggcatgggcgccagactcaagcccagatcttaactcaggtggtcttgkttcagtcccacatccccacttcatagctctaaccttgggttcttgatgtgtcttctctgtacctcagtttccccacctataaactggggtgatgacaccc

SEQ ID NO: 20501 - DNA, 201 bp, Homo sapiens
ggtgagagcagattgtcaccatttcagagaaatttgaaccaatcagaaagagagctcaggagtactggggtgactgagatgagcacatgtggcttcttgargaccttccaacccccaagttattcttagaaagctgcacacaagccaggcagctgtaggctggcgttgaaaagtttttagctttagctaattacattgtgg

SEQ ID NO: 20502 - DNA, 201 bp, Homo sapiens
tcttttaagtgctttggatgttataaaaaatacactgtgccattaatgctcgtgcagggctcccggccggcctaggccctctgcacttgagattcctctgkcagcatctgtttagaactgggcactcctggttctggtcaagtttatcctgaccagttcatttcatggcagttctggtcatttttgagaaaatctagtttg

SEQ ID NO: 20503 - DNA, 201 bp, Homo sapiens
cagttgttaaagggctgctttgtgtgcacatagaaaaggaaacagatgtatttgaacagaggtagtttattaaagagaatgaatagacatcaaatagatgkccctttatcgttttcagttgtcaaaaatacgtgtgagttgggtaccatatagccctcagcagagtatttgacaagatttttccttggtttcctcataggc

SEQ ID NO: 20504 - DNA, 201 bp, Homo sapiens
ccaccctgttcaccatctttttcattgatgtggatggatatatgggagtatatgctcagaacggtcaagcataactaaggcgatagtgaagagtaacaacrcataggcttagaacacagagacatagagtggtggcctggaatagagagcctagcggtagacctaccacgcccctgtggaagcctgtcgtgtggacggcat

SEQ ID NO: 20505 - DNA, 201 bp, Homo sapiens
cccctgtggaagcctgtcgtgtggacggcatagctaatgtgtgtgttctgagtgtcttcgaaatagcggtgtacactcataaaaacaaccgctggataacrgaagagagtttatgatataatgcacctactgtaggctcagcattgcacaagtcaccacaggggaggcgagcactggtggttgccctgggcacaggcatgc

SEQ ID NO: 20506 - DNA, 201 bp, Homo sapiens
tcggtgttgggggaacggcctgtttctgtagcttgggatgaacttcttccctgcatctgtgaacaagcttgtactcagcctgtaggttaacaagctggggycagaaggctgtactgcactggacccaaaacctgccctaggaagatgcttgcaacaaaacttgttatcaccttggtttataacagtgagatggaaacggga

SEQ ID NO: 20507 - DNA, 201 bp, Homo sapiens
ggtgggcagcctgtaccctccacgcccctaaggtgcacacacaggggcgggcgccagattccctttaaggacaggccttgttctcactttcacaggcacgygtcttcttgcatttgttgtgtgtttccaaccgaggtctgtggttttttcttatgcacaacctggtgggaactgaccgttgccacttagatacacgttcat

SEQ ID NO: 20508 - DNA, 201 bp, Homo sapiens
gggaactgaccgttgccacttagatacacgttcattatcccacccacgtgttgaccgctgtgtaaatgagtgaataaatcagtagcgtttctgcacatttratggagcagctggcaccacccagtgttccattcagcaccggtgagtttgaaggaagtttgacaagtgaccgtgaccacgttggacgcctgatgtttcagg

SEQ ID NO: 20509 - DNA, 201 bp, Homo sapiens
tcagcaccggtgagtttgaaggaagtttgacaagtgaccgtgaccacgttggacgcctgatgtttcaggtccacttgctgagtgagtgggatggtatgtgygtgcgaggcaatagtggatacccaggctgagacacgggctctgtccaagcagcaaatgggggcccctttccttaaagggtcttactgctgaggtggtaac

SEQ ID NO: 20510 - DNA, 201 bp, Homo sapiens
ggtcagtagaatccattaaactcagctgatgaatctggaatgggatggggctccccggctggttcgccgaggagtcttcctgggcctgtctgcagagatgyggggagaaagtgggtttggtgtagaacccggggtgtaacggggtgaggagagggcaactatttgggaaagcttccagctaggagctgtggccttcaagaa

SEQ ID NO: 20511 - DNA, 201 bp, Homo sapiens
gggtgaggagagggcaactatttgggaaagcttccagctaggagctgtggccttcaagaaagagacctgtccggctgtggtgaccgggaaggtgagggtgwcctcactcttctccctcccactggtctccagtggcccctccttggccaaatccaaccagaggccaaaagccctgagagcccacgatgccagtcacacagt

SEQ ID NO: 20512 - DNA, 201 bp, Homo sapiens
caaatccaaccagaggccaaaagccctgagagcccacgatgccagtcacacagttggctcccaggaccaagacaaaaccaacagaagccgtagagtgttcrtgcctttcacagcacctcctacaagcccctgaagcccgtgccatgccactctgttggtggtccacaaacacaggaaacgaagctctagagggcaggggta

SEQ ID NO: 20513 - DNA, 201 bp, Homo sapiens
ggatccttttctcagatattttgttttcctgggtattttccctcttctgggttcttagtgcccgtcccccgtagctccgtcacacagtcctgttgctgctrccttggggcccaggcgtgtcttttgtcccccagtgcctggcacggtgccctccaggagtactcctgggattggtggcaggtcatgcagtcattgctcacc

SEQ ID NO: 20514 - DNA, 201 bp, Homo sapiens; identical to SEQ ID NO: 3583

SEQ ID NO: 20515 - DNA, 201 bp, Homo sapiens
cagaggaaggtggcagagccggaagtggcagaatccagtgcacgggcgggatgccgagtgtgtcgccaaactccaccactttagtcgggggcgtggtggtkgctgcgctatctgcttcccactcactggcatcctagccgtgtggggtgtgtgctcacctgcagccaccctcacctgcttgaaccagatttacctagaggg

SEQ ID NO: 20516 - DNA, 201 bp, Homo sapiens
cacgaaagctaagcacacactcttgttttcctcactcacatccatgttcatcctctttcctgtgctgacggtttgcaaagctgggagagaatgagggcggrgcctcgggaagtgaatggcagagcaggtggcatagacacctcagccgtctgcccacagggtatgggcaaggtttgttttggtgactttttcttccagtct

SEQ ID NO: 20517 - DNA, 201 bp, Homo sapiens
caccacacccaactaatttttatgtttttagtagagatagggtttcaccacgttggccaggccggtctcaaactcctgacctcaggtgatctacccgcctyggcctcccaaagtgctgggattacaggcatgagccactgtgcccggccctgttttatttatttatttatttagctcgggtttcaatattttaaaaaattt

SEQ ID NO: 20518 - DNA, 201 bp, Homo sapiens
caggcttctcgtgcgcaccagcgagcacccgggccaagcgtggaggctctgcgggctgggggtccggcccacaccatcagcctctgtgcagccgttgcttyttccgttgaccaaagccatgaccttacctttatgcagtcgtgttcagagagagatgaagcctcaaaggcaaagtcagactgacactcctgggagcatgac

SEQ ID NO: 20519 - DNA, 201 bp, Homo sapiens
atgcaccaagagtttctctggcttgagtgattggccaggcacctcacgttagcgtctgcagccttgaatcgggaggcaggttgggcgcaggcttctcgtgygcaccagcgagcacccgggccaagcgtggaggctctgcgggctgggggtccggcccacaccatcagcctctgtgcagccgttgctttttccgttgaccaa

SEQ ID NO: 20520 - DNA, 201 bp, Homo sapiens
tgggaccagcatccagttcagtggccagcacagactcatctgtcgtgagggtcgttagaaattgtagcccccatttattggtctcttctgcctgtgatatgtgcttgagtggttgcctgtttcgggggctgtcagtgtttgagtggctgcctgtttcgggggctgtcagtgtttgagtggctgcctgtttcgggggctgtc

SEQ ID NO: 20521 - DNA, 201 bp, Homo sapiens
aaggtgcagtgttttagttcttgtgtctgtcattacagatgtgctttacctgctcccattcacaccttagaacagagaggctcctgtgtataaaggtatcygtaaagcctcatgccctgcatttcacatctagcaatatcataagtagagcatcttcaccaaattctgtctgtatcatcttgagtacacagatgtgtcata

SEQ ID NO: 20522 - DNA, 201 bp, Homo sapiens
gggaccagcatccagttcagtggccagcacagactcatctgtcgtgagggtcgttagaaattgtagcccccatttattggtctcttctgcctgtgatatgtgcttgagtggttgcctgtttcgggggctgtcagtgtttgagtggctgcctgtttcgggggctgtcagtgtttgagtggctgcctgtttcgggggctgtca

SEQ ID NO: 20523 - DNA, 201 bp, Homo sapiens
accagcatccagttcagtggccagcacagactcatctgtcgtgagggtcgttagaaattgtagcccccatttattggtctcttctgcctgtgatatgtgcbtgagtggttgcctgtttcgggggctgtcagtgtttgagtggctgcctgtttcgggggctgtcagtgtttgagtggctgcctgtttcgggggctgtcagtg

SEQ ID NO: 20524 - DNA, 201 bp, Homo sapiens
ttgaaggctgaggatgaaaccaccaagagactgctttacagccccccagagcgccccagccctgccacacacagcggcccctgtgaggactgaggtggacrtctggctgcccgctctcttgtctgtgtcccgttcatctcccagaccccgccacaagacagtgctgaaaggcagtcagaagctttgtggttatttgcttaa

SEQ ID NO: 20525 - DNA, 201 bp, Homo sapiens
catccagttcagtggccagcacagactcatctgtcgtgagggtcgttagaaattgtagcccccatttattggtctcttctgcctgtgatatgtgcttgagkggttgcctgtttcgggggctgtcagtgtttgagtggctgcctgtttcgggggctgtcagtgtttgagtggctgcctgtttcgggggctgtcagtgtttga

SEQ ID NO: 20526 - DNA, 201 bp, Homo sapiens
tgtcaggtgctcttgctacttcggggccttggaattcctcatgtgagtgaaaccggggctttgacgtttgcagcaccagcaaagccgtctcagtaaacccktccacgcacatcctctctccctcgcggtacagcagtgtttccggggctgcacggcagcgccctggcccgttgttctttattgttgtccccattgcactta

SEQ ID NO: 20527 - DNA, 201 bp, Homo sapiens
tcagtgtttgagtggctgcctgtttcgggggctgtcagtgtttgagtggctgcctgtttcgggggctgtcagtgtttgagtggctgcctgtttcgggggcbgtcagtgtgtgagtggttgcctgtttcgggggctgtcagtgtgtgagtggctgcctgtttcgggggctgtcagtgtttgagtggctgcctgtttcggggg

SEQ ID NO: 20528 - DNA, 201 bp, Homo sapiens
attagagatgctttttgggctggaaaaccagtagaagctagttggagtgtgagtgccaagtgaaactttttccagctttgttcttcatttgtaagcagagrgacatcattggagttttagagcaggaaggagatggaccctgagctccacttggggagatggatctggccagaccattttgaacatactggaatagaggca

SEQ ID NO: 20529 - DNA, 201 bp, Homo sapiens
gagtggctgcctgtttcgggggctgtcagtgtttgagtggctgcctgtttcgggggctgtcagtgtttgagtggctgcctgtttcgggggctgtcagtgtktgagtggttgcctgtttcgggggctgtcagtgtgtgagtggctgcctgtttcgggggctgtcagtgtttgagtggctgcctgtttcgggggctgtcagtg

SEQ ID NO: 20530 - DNA, 201 bp, Homo sapiens
ttctacctttgtagctttttagtttttttctaagacaaagtctctctcttgcccaggctgcagtgcaacggtgtgatctcagctcactgcaacctctgccygcccagctcaagtgatcctctcacctccacctcccaaatacctgggactgcaggcccacgccatcacacctagctaatttttgtatttttgtagagatgg

SEQ ID NO: 20531 - DNA, 201 bp, Homo sapiens
ggagatgggcagggtttgtacagggaaggggccgaaggaatcactgtgagcaaagggagtggcttgaggagagcttctctgggtggttgtaggattagagrtgctttttgggctggaaaaccagtagaagctagttggagtgtgagtgccaagtgaaactttttccagctttgttcttcatttgtaagcagagagacatca

SEQ ID NO: 20532 - DNA, 201 bp, Homo sapiens
gcctgtttcgggggctgtcagtgtttgagtggctgcctgtttcgggggctgtcagtgtttgagtggctgcctgtttcgggggctgtcagtgtgtgagtggytgcctgtttcgggggctgtcagtgtgtgagtggctgcctgtttcgggggctgtcagtgtttgagtggctgcctgtttcgggggctgtcagtgtttgagtg

SEQ ID NO: 20533 - DNA, 201 bp, Homo sapiens
accttagggtcaggcagctgcgaccgatctgtctggttcctcaccctgggggtgcccgccgttgggaggtgctgtggttccagggtgggcgctggtccctkcccacggagctcgcctagcacctgttcacaggtgtgcctgggccagatgcatgtctgacagggacatcaggtttggggagactgaaaaccatttttgaaa

SEQ ID NO: 20534 - DNA, 201 bp, Homo sapiens
tgagtggctgcctgtttcgggggctgtcagtgtttgagtggctgcctgtttcgggggctgtcagtgtgtgagtggttgcctgtttcgggggctgtcagtgtgtgagtggctgcctgtttcgggggctgtcagtgtttgagtggctgcctgtttcgggggctgtcagtgtttgagtggctgcctgttttggggctgtcatga

SEQ ID NO: 20535 - DNA, 201 bp, Homo sapiens
gtcacagctgcccagcgacctggttccaccttagggtcaggcagctgcgaccgatctgtctggttcctcaccctgggggtgcccgccgttgggaggtgctrtggttccagggtgggcgctggtcccttcccacggagctcgcctagcacctgttcacaggtgtgcctgggccagatgcatgtctgacagggacatcaggtt

SEQ ID NO: 20536 - DNA, 201 bp, Homo sapiens
gagtggctgcctgtttcgggggctgtcagtgtttgagtggctgcctgtttcgggggctgtcagtgtgtgagtggttgcctgtttcgggggctgtcagtgtgtgagtggctgcctgtttcgggggctgtcagtgtttgagtggctgcctgtttcgggggctgtcagtgtttgagtggctgcctgttttggggctgtcatgaa

SEQ ID NO: 20537 - DNA, 201 bp, Homo sapiens
aaatggaatcgcagctcattgagagaaggttggatgtggacaggcgcatgttgggacattagagtggaggatcagctggagatgtgaggatggagccctgrcgagtcccagtatgtccctgcagatggaggaagaacccacagggctgggagggaggtagaggcggaagccagtgtgagagttggaagagagtgtcttaac

SEQ ID NO: 20538 - DNA, 201 bp, Homo sapiens
gttggccaggccggtctcaaactcctgacctcaggtgatctacccgccttggcctcccaaagtgctgggattacaggcatgagccactgtgcccggccctrttttatttatttatttatttagctcgggtttcaatattttaaaaaatttgaagccaggtgcggtggctaatgcttgtaatctcagcgcttcgggaggccg

SEQ ID NO: 20539 - DNA, 201 bp, Homo sapiens
gcgcacttattcagaaagtaaaggctaatagtaggaatcatcagtacctgctgctgcaaacccagaaacactgtgtctacacggggctgtcagggtgaccratggaaattgggccgttcctgccctggagtttctccctgcgcaggtgctcgctgtgctctttttgctgaagaacagccactttgttctgcaccagatggc

SEQ ID NO: 20540 - DNA, 201 bp, Homo sapiens
aatcggaggaatctggaaagttacagaagcagggacggtgactggagaatcccttatctttttgtgtatattttgggttctgaggattaccaggagatgtrtggatgacagagcccgtcgctaggctcttatgtcacagatgggctgctgtgctgcgtggtcattgagaccaatggaaggaaattgagatgtgactgggca

SEQ ID NO: 20541 - DNA, 201 bp, Homo sapiens
atgtattttacacacaaagtacagggatacagattgaaatgttcagcagcaaggtatgagaggtccgcatctcatgcacgagggtgtttttctcggcctcwgcagccctcagatgttcccacgctctgttagacacatgcggcctgggcttcaggaagtagagatgcccgggggttatattttcagatgttctagctgagc

SEQ ID NO: 20542 - DNA, 201 bp, Homo sapiens
atttaagatatctcaccgcatttgccgctgagcacacatgttgagcgtcgaggacaggttcaattatgtggccactgtgttcaggttcccggattgatccrggggaggctctaagctttgaggagatctggcggttagtttccatcttggcataaaagcattaattatctaaagatcttttcatctgcaggaaaataggca

SEQ ID NO: 20543 - DNA, 201 bp, Homo sapiens
atgctaagataggccaactggagtcatttccaggattacttcccattctagaatttttggtatatgttggtagtcatatcacatggatgacttttttcatrcacgtttatgtgctgtaggttgaaccccactgtgaaattgccactattcaaacatatttgaccatatttgtgcctccagcacagcagcgagtacaagtag

SEQ ID NO: 20544 - DNA, 201 bp, Homo sapiens
gaatttttggtatatgttggtagtcatatcacatggatgacttttttcatacacgtttatgtgctgtaggttgaaccccactgtgaaattgccactattcmaacatatttgaccatatttgtgcctccagcacagcagcgagtacaagtagcacatgtgcctgtctccaagcaggaacatctcctcctggctgtggtcaga

SEQ ID NO: 20545 - DNA, 201 bp, Homo sapiens
taatatgactggagaagtattttatgtctcaagaattattatgcatttcttatttctctgtcctttaattttgaagggtcagtataaaaatactttattcrgtatattctagctcattctccacatacaattatattccaatatttgtagggtttattctctccaagcagcatgatcaatcagaaaattggacagttttaa

SEQ ID NO: 20546 - DNA, 201 bp, Homo sapiens
gggaaggttaaaacttgttggctttggaggtttactgataggtcgttctgagtaggacaaatgttttcctttccgtgctttaaaagtctcatcttagaccrggcacagtgactcatgcctgtaatcccagcactttgggaggctgaggcaggtggatcttgaggtcaggagttcaacaccagcctggccaacatggtgaaa

SEQ ID NO: 20547 - DNA, 201 bp, Homo sapiens
ctttggaaaaatgttctttttacctctgattttctcttgtaatgtcttcttgaattgtgagtcggggaaaaaagtaaaagattcgctacagattcagactkgcaaaaaaacgcttagaatcttgctgtccgtaaaactgaaacatccagcctcacaaatgtccacatttctctctcatctgtgaaggcccgttgagactgc

SEQ ID NO: 20548 - DNA, 201 bp, Homo sapiens
ggcaggagaatagcttgaacccggaaggtggaggttgcagtgagccgagatcgtgccagtgaactccagcctgggcaacaagagcgagactctgtctcagwaaataaataaataaataaataaataaataaataaataaagtctcatcttatggagcaaaagattctaaagagaaaggctggtcctgaatttcatccagct

SEQ ID NO: 20549 - DNA, 201 bp, Homo sapiens
gtcttgagaccattcctgagtttagaccttcccaggggagatcagtgaccacagatgtgcctcggtgaatttcacaaacccagcttagcgtgacccaagtytccagctttaccgaactttgtcattgttattaaaaagatgattttagtgtgctgattagaaactgggatccacattcaacataagcacaaactttttttc

SEQ ID NO: 20550 - DNA, 201 bp, Homo sapiens
tttaggcaaagggaggctctccaggaagatccttaaaagctgccctgtgatccttctgctctcatcctgctggccagagcttgtgtacctggccatgttcrgctgatgcgggggtggggggacgggaggaggctctggcaaatgtcatgtttattctggttgtcatttgcccacctaagaaccaggaatgctattactgcg

SEQ ID NO: 20551 - DNA, 201 bp, Homo sapiens
cagaaattcccgctcttggagttttacacttgtaacatctgcttagcaaattttgaaaaattgaagatgaagagtaataaagtgtggacaaagctctgcasggagcttgttagaaatgctgatttgaggccgggcgtggtggctcatgcctatattcccagcacttgggaggccgaggccagcggatcacgaggtcaggag

SEQ ID NO: 20552 - DNA, 201 bp, Homo sapiens
tgcagggcctttatccttggggcacctttctgggactttatctggctgtgtgcagacagacaggaaagtgtcccctgcccccaatttttgggatgaccacyaaaaaatgaacacacccactcagggagcgtttgtgggatcactgaagtcaaataatttacacccaggagaaagcccttcgctgtggatgtgttcatgcct

SEQ ID NO: 20553 - DNA, 201 bp, Homo sapiens
agttgtttccagttcttggcttttacaaatagaggtgctgtgaacattcacgtgcaagtcttcatatgggcacgtgctttcatttctcttgggtagatacstaggagtggagtggctgggagatgtgctgggtatataattaacttttatgtaaactgcctgctgttttccaaattggttgattttactctcccgccggca

SEQ ID NO: 20554 - DNA, 201 bp, Homo sapiens
accttattgattgagacagggtctcactctgttgcttaggctagagtgcagtggcacgatcatggctctctgtagcctcgacctcctaggttcaggtgatmcccccaccatagcctcctgaatagctgggactacaggtgtgcaccatcatgcctggccaatttttattttattttattttttgcgtttttttgtagagac

SEQ ID NO: 20555 - DNA, 201 bp, Homo sapiens
agagacgaggtctcgctctgttgtcaggctggttttgaactcttttgcccaaaccatctgcctatcttagcgtcccgaagtgctggaattaccgtagtgakctgccgctcctggcctactttaaacatctataatttgtgttcgttgtaggattattcacggtagaaacagggtggaaaaaaatgcccacagcctagcatt

SEQ ID NO: 20556 - DNA, 201 bp, Homo sapiens
cttggattaaatgcagtacgataacacatcgattatttttataagctaactaataaaaattcacagagcgttttctgcatgcaacagaatatgtgggtaayaggacattgggtctgtgacaaggtctgagctagaaggaccgtatggcccatgaagcacagtgtatgcaagtgctgttgtaatttagtaaaccgccactag

SEQ ID NO: 20557 - DNA, 201 bp, Homo sapiens
tagcaatatcataagtagagcatcttcaccaaattctgtctgtatcatcttgagtacacagatgtgtcataactagccacacttctttggacatgtaagtygcttctcagttttcactattctcagcaatgcagtgaggatattttcatgataacctcattaggctctttgtgatgttgtcctggatctgtcaaaaattgg

SEQ ID NO: 20558 - DNA, 201 bp, Homo sapiens
cggtcgcttcagcccctccccgttgcccatgtttattccttttctgcctttcctcattgtccatctggactggggatcttggtcacgtagatccatgtttyccaggcacctaaagcacatcccccccactttggtgatcgtaaaaatctgttattccatgtttgaaatatcaggatttcagaactcagtcactgacaggtc

SEQ ID NO: 20559 - DNA, 201 bp, Homo sapiens
aggatattttcatgataacctcattaggctctttgtgatgttgtcctggatctgtcaaaaattggtctgtcagaaatttgtttttaacaataatagctatwttgttgcattaactccagaaagttttaccaatttaccctctaaggagaatagacctccttccccatcccccccacattcaggactttgcatctgaggggg

SEQ ID NO: 20560 - DNA, 201 bp, Homo sapiens
aggagaatagacctccttccccatcccccccacattcaggactttgcatctgagggggaacctggccacgtggttggcattcctgagccatgccaggctgmtggagcgcacaaattctttcaccccagcaagcccggctccatccaccatctgtgcactcaggccccctccccctcccccgccccctcccctcccactggc

SEQ ID NO: 20561 - DNA, 201 bp, Homo sapiens
tgagtatgtggatgtgtgtgaatgtgtgaatgtgtatgtgtgggtgtgaatgtgtgtgtaaaggtgattgtgagtgtgtgaatgcgtgtgtgaatgcgtgwgtgactgtgtgaatgtgtgaggtgtgaatgtgtgtgtgaatggatgtgtgtgtgaatgcgtatgtgtgaatgtgaatgcgtgtgtgaatgtgtgtgtgag

SEQ ID NO: 20562 - DNA, 201 bp, Homo sapiens
aagcagacaccagcccttagggagcagcccaggatgcttttttcctccaaatgcctctcacctattcccagatactcgctggagttggagcacacatgtcwgcagatgtaaaacgacctgctcccccaggtgaatggattctcgccagggccaatacttatccgcaggggtgtgtgccaggcagcccaggtcagcctccct

SEQ ID NO: 20563 - DNA, 201 bp, Homo sapiens
tatgtggatgtgtgtgaatgtgtgaatgtgtatgtgtgggtgtgaatgtgtgtgtaaaggtgattgtgagtgtgtgaatgcgtgtgtgaatgcgtgtgtgwctgtgtgaatgtgtgaggtgtgaatgtgtgtgtgaatggatgtgtgtgtgaatgcgtatgtgtgaatgtgaatgcgtgtgtgaatgtgtgtgtgagtatg

SEQ ID NO: 20564 - DNA, 201 bp, Homo sapiens
agagagtaatggtgagcaaatccttgtagaattaaaatgggatgaagagacccttatgaagggagaaagcaggtgaagatggtggggataggggcgggacrtgcacccccttcactttccatgccgggcagtataaaaagtgagaagaaacacttcagggctggtgtgtaaacttcatgttggataaatacgtgacttctg

SEQ ID NO: 20565 - DNA, 201 bp, Homo sapiens
cagagcatccagagaagaagctggggctcggcctggtctacctggctgggaagaaccgtgctggattgagctctgcagcaagggctgtggctggccggggktgtttccccggcctctccccagcctggagctgtggcgcaggtgcctgattacagtgcttgggagagcagtgagggcaggtggggggttgacctcactctc

SEQ ID NO: 20566 - DNA, 201 bp, Homo sapiens
cgcctccagagtagctgggattataggcgtgccccaccatgcacagctaatttttgtatttttagtagagacggtgttttgccatgttggccaggctggtytcgaacttctgtcctcaagtgatccgcccacctcagcctcccaaagtgctgggattacagacgtgaggacctggcctatttgttgattttcacactgcaa

SEQ ID NO: 20567 - DNA, 201 bp, Homo sapiens
gattttcttggagactttaaaaaactagtttgttgtatttgctttgtcaatctctatgtaagtaatatatgtgtatttttgtgccaagccatttgagatgscctgcaggccccatggtgcttcagcctccagcactgctccctgtgtttctcagaccgaggcccctcctgtaaaaggctctgaatctcgctttcacctgtg

SEQ ID NO: 20568 - DNA, 201 bp, Homo sapiens
attttcttgttgagaagcttctaaacaagggaacttagagcaatcaatgcccccggagaccgatgcacatatcaggaccttggtatcagctagaaaacatycatttgtttaaggggaagaaacaggcacgacattttgcacattaaaatggattatttcatcaataggttaatagaaagccgggctgcaagttcacttcct

SEQ ID NO: 20569 - DNA, 201 bp, Homo sapiens
atgtggatgtgtgtgaatgtgtgaatgtgtatgtgtgggtgtgaatgtgtgtgtaaaggtgattgtgagtgtgtgaatgcgtgtgtgaatgcgtgtgtgastgtgtgaatgtgtgaggtgtgaatgtgtgtgtgaatggatgtgtgtgtgaatgcgtatgtgtgaatgtgaatgcgtgtgtgaatgtgtgtgtgagtatgt

SEQ ID NO: 20570 - DNA, 201 bp, Homo sapiens
tggatgtgtgtgaatgtgtgaatgtgtatgtgtgggtgtgaatgtgtgtgtaaaggtgattgtgagtgtgtgaatgcgtgtgtgaatgcgtgtgtgactgwgtgaatgtgtgaggtgtgaatgtgtgtgtgaatggatgtgtgtgtgaatgcgtatgtgtgaatgtgaatgcgtgtgtgaatgtgtgtgtgagtatgtgtg

SEQ ID NO: 20571 - DNA, 201 bp, Homo sapiens
ggatgtgtgtgaatgtgtgaatgtgtatgtgtgggtgtgaatgtgtgtgtaaaggtgattgtgagtgtgtgaatgcgtgtgtgaatgcgtgtgtgactgtstgaatgtgtgaggtgtgaatgtgtgtgtgaatggatgtgtgtgtgaatgcgtatgtgtgaatgtgaatgcgtgtgtgaatgtgtgtgtgagtatgtgtgt

SEQ ID NO: 20572 - DNA, 201 bp, Homo sapiens
cttgtgaacgtgactctgcaaaaacatgttagaggaagcaaaggagaggatggacgtgaaatccgtcctatgcatgctcacctgacatgcaacagggaggktcatctgccagggcgtcacggtcattccacgagagctgggtggtgacgctccccaagttcccactcctggagaggtaggcagcgagggacactggcgttg

SEQ ID NO: 20573 - DNA, 201 bp, Homo sapiens
atcacccgagcagtttacactgtacccaacgtgtagtcttttatccctcgccaccgcccaccctttcacctgagtcccaaagtccattgtatcactcttaygcctttgcatcctcatagcttagctcccacttatgagtcagagcataccatgtttggttttccattcctgagttacttcacttagaataatggtctccaa

SEQ ID NO: 20574 - DNA, 201 bp, Homo sapiens
gtgaatgcgtgtgtgactgtgtgaatgtgtgaggtgtgaatgtgtgtgtgaatggatgtgtgtgtgaatgcgtatgtgtgaatgtgaatgcgtgtgtgaakgtgtgtgtgagtatgtgtgtgaatgtgtgtgtgtgtggtgatggtcattgtccacattggtggtcttgtcactcacttcttgatctgttgctgcatcagc

SEQ ID NO: 20575 - DNA, 201 bp, Homo sapiens
cccactcctggagaggtaggcagcgagggacactggcgttgcagggcccctgggacaggctccactcctcccttcttgctctggaggtgacacagtctagkgatctagtgaggaatgggacctggggccagcgtgcttggacaagacgaagcctcatcaaagttgaaccttagggttcatcaagcagggagggcttccaca

SEQ ID NO: 20576 - DNA, 201 bp, Homo sapiens
gatttcagtagttttttggggaacaagtggtttttggttacatggatcagttctttagcgctgatttctgaggttttggtgcacccatcacccgagcagtktacactgtacccaacgtgtagtcttttatccctcgccaccgcccaccctttcacctgagtcccaaagtccattgtatcactcttacgcctttgcatcctc

SEQ ID NO: 20577 - DNA, 201 bp, Homo sapiens
atgtgtgaggtgtgaatgtgtgtgtgaatggatgtgtgtgtgaatgcgtatgtgtgaatgtgaatgcgtgtgtgaatgtgtgtgtgagtatgtgtgtgaatgtgtgtgtgtgtggtgatggtcattgtccacattggtggtcttgtcactcacttcttgatctgttgctgcatcagcagaatgctgggcagatggctgcat

SEQ ID NO: 20578 - DNA, 201 bp, Homo sapiens
tgtgtgaggtgtgaatgtgtgtgtgaatggatgtgtgtgtgaatgcgtatgtgtgaatgtgaatgcgtgtgtgaatgtgtgtgtgagtatgtgtgtgaatgtgtgtgtgtgtggtgatggtcattgtccacattggtggtcttgtcactcacttcttgatctgttgctgcatcagcagaatgctgggcagatggctgcatc

SEQ ID NO: 20579 - DNA, 201 bp, Homo sapiens
tgtacagaacacatgtatctgtatttacgtgactgagcacaggcgatttccccgagtctcaccttggtgtgtgccagtgcatgcgcgtgcgcgcgcgcacrcacacacacacacacacatacctcctctcagagaatgttgatgtggcaattcatgtttgacagctgggttaacccataaatagatcccaaaatataaatt

SEQ ID NO: 20580 - DNA, 201 bp, Homo sapiens
gttgagagtccatgatcaaggcactggcaggtttggcttcttcccattctgtgcctcacctggtcttttccgtgtgtgtggtcttcagtgtttttccgttstcaggaggacaccagtcttgttggatgagggtcccacccttaagctgccatattaccatgattgcctccttaaagaccttatctccagcgacagtcacca

SEQ ID NO: 20581 - DNA, 201 bp, Homo sapiens
ggcattctctcccaggcccactgactgttctgcctacccagattagagctcagaaagttccatttaatttgcagactaaagtgagaagagatcagtctcgytgtctacactggagctgacagtcagtttgtaccacatctgaaattatacttgtgggatttcatgtccattgagattcgcgtatgtgtttttaaacatgta

SEQ ID NO: 20582 - DNA, 201 bp, Homo sapiens
gctcaggtttctcgcgtatgttttgtgttgtctctacaaagaaatccagtgtagttagaagcacttgagattcatttctgcaacataactcatcccaggcrcctagtcatcaccctgggtcattttctggccaccagaacttggtgcacacgccgaacctacaaccacagcctcagctgtagtgttcgaaatggagaattt

SEQ ID NO: 20583 - DNA, 201 bp, Homo sapiens
cttgagatcatgcctcactgtggactgctgtgttgtgatgcagtcagcttggaggggaagccaggccccaggaacaagggagaaatgcttaagtgttggaraggagagcgacagcacaaacttcttacacagtaaactcagcgaagtgttaaaggtgggccagaaccaatttcacagtcaggcaagggctgaaagtagaag

SEQ ID NO: 20584 - DNA, 201 bp, Homo sapiens
cccacaagccccatctatggatagttgtgagggggacagaatcttccacttgcagggtctccatcatttttttctgtcctgggttgactccagggcacccrgaacaggtgtcatccctcttccatcagacagaagttccctgtgctcagagtccccagtgagcagtccctggcattgggctctctctgtggtgcctgctgg

SEQ ID NO: 20585 - DNA, 201 bp, Homo sapiens
tctattcacatctctttcattcaccctgataaaagccttgctcacatctgggtgagtcttcagggtgatcaagcatctcagaagactaagggggaaaataytgcaagatggtggtgcccatcagcaacgtcaggtgctccagaaagaggggggtcagtgagaaagaagactaagcacagcccatggcccctggctgttcct

SEQ ID NO: 20586 - DNA, 201 bp, Homo sapiens
acaggacctagctattctttatgagcagaaagctcaataactaaaacgatcagaagcactttgtgtctataccatcatacatgagtattccagcctgaccrtgcttccctggcaggagagccaaggttaaatcttcagtctgtcagccaatcccagagggaatcttttggactcttgtggcttctgggtccacatttattt

SEQ ID NO: 20587 - DNA, 201 bp, Homo sapiens
gcacttaacttcatccctctcaggcgcacaccagcactgtctatcactaatactggcagttctagggtgaggtggacagttgctcttagtcagaaactcamtttgctgttttccactagattcccagatagagaaggacagttgtttcaggcaagcttaagaccctgtaacatttcttgccctttttgatttgaactccca

SEQ ID NO: 20588 - DNA, 201 bp, Homo sapiens
atttctttctcattcttcttaccaagtagacatgtggctactgcccagaaggttacccatttaccttctccaggttaccatggtccatgcgtattcacagrtgatccagaactctcctctttgctcatttctggcagagtccgtctcagctgatgagttaaaatgtgacatttcctccctccccccgccccatgcatgatg

SEQ ID NO: 20589 - DNA, 201 bp, Homo sapiens
gcagcactttggtaaatgtcaaaaagttggagaggctgagtgggttgcgtggcccgtctgtgcctgtgggctcctctcccgcccacgcggctgtgcctctyactcagaaccctgcctctcttgtgtttgtcccaaggctttactttcccccccacatacattcagtggcattatttgttacatttttaaaaatacatattt

SEQ ID NO: 20590 - DNA, 201 bp, Homo sapiens
aggcccggagagcaagaggcttgcagaggacaaaggtggaaaggcagtgctagcaggtggcacgcacacaggtgtgagggcctggagagcaggcagggccrccctggggctgtgggaccagcggggcctgaagccaggtggaggggcaggagacagtgcagaggtctgagtccgtgccaggaggctgggatcagccacagg

SEQ ID NO: 20591 - DNA, 201 bp, Homo sapiens
gtgcctgtgggctcctctcccgcccacgcggctgtgcctcttactcagaaccctgcctctcttgtgtttgtcccaaggctttactttcccccccacatacrttcagtggcattatttgttacatttttaaaaatacatattttatttatttcacaaacaatgttactggcataatgttaccacactataggatataatggt

SEQ ID NO: 20592 - DNA, 201 bp, Homo sapiens
ttcagcattggaggacaatatattggaagtaaatcccatgtggaaagagctatttttctatcagtgggatgcacctcctccctctggtccagcccactcgkcatgtgttgcccgagctgccatgtgatcaccaggacaaatgatgactactatcatggggtctcatttatgataagaaatggcatgtggtgggtgtggaaa

SEQ ID NO: 20593 - DNA, 201 bp, Homo sapiens
gaagtgatcataatgacagccacggttgggaaggccctgataacctgtaggaattcgggaattccgattcatccggcataggaatgtctgtgtttaaagtyggtcttgagcagacgtggataattcacactccttaattttttatgtttgtttttaggcctggggatttctctcccccctcttagaaatgtattaagcttc

SEQ ID NO: 20594 - DNA, 201 bp, Homo sapiens
cattcccattttgtgagcatttaagccgtttactgttgattgtccatttcttcaggtatcttcttacatcatcttgcttctttactcagcataaagcctcrtagtagattctcaggtcccaggggtgcacatgcctgtgtttttaccttacttccccaggggccctccagagggtgcccatccacggagtgcggcgcctgc

SEQ ID NO: 20595 - DNA, 201 bp, Homo sapiens
ttggtgtctgacacacccatccccaccgcaaccgcggggtgtcatcagctgggcccatctccttcccggtgtctgccccccgccccattcctccctgaagktctctgggctgtctctgcagcacttgcccgtgggagacaaagcgtctctcagtcctagtgctgtctcagaagcctggggttccgcaagactggcctggaa

SEQ ID NO: 20596 - DNA, 201 bp, Homo sapiens
gagttcagctggcgacatgctggacttaaacaccagctaggcttcaggaaatgttgaggatgcaggtggatgtgaatttgttattcaggggtgaggtcacrgctggagatacatatgagcttcattaacctgtgtatgatattcaaagccataagacaggggcgatcacagcaaatagcaaagaaaagaggcctaaccata

SEQ ID NO: 20597 - DNA, 201 bp, Homo sapiens
ggattttatacctcctagttctttgaggacagtttgccacgttcagcaggattttccagaccttttatttctaaggaatacaaactagaagggcctggttyctgtaggtgacaaagctggggggaacgtggaggacagggatgactggagagagctggcgagtgcagcctgctgggatgccagctctcacctgggaaggtc

SEQ ID NO: 20598 - DNA, 201 bp, Homo sapiens
agacttcttctgaaactcctccaatgagtaggttccatgaccgtctttctctccttcccggggcctgtgtttgtttcgaatgcctccccttggagtcagtyagcgtgctcctttgtctcctgtattttcctataaattagtgggtgtttggaggcttgtttaggtttttagcttttgtttggtttggttggactcctttct

SEQ ID NO: 20599 - DNA, 201 bp, Homo sapiens
agccagcatgagaccctcgcttccagcctgtgcctttagcccagccttgctgttctagatggtgttggcagcctttttcacgtacagagttgcattgctcstccgtcttccgcgtgcctgtgggcagcttttgttcctttggattacttttgtttctttaaaactccttggcaccatctaattttttaaaaatgagcctaa

SEQ ID NO: 20600 - DNA, 201 bp, Homo sapiens
tgatgataataggattgtattttcttgttgagaagcttctaaacaagggaacttagagcaatcaatgcccccggagaccgatgcacatatcaggaccttgrtatcagctagaaaacatccatttgtttaaggggaagaaacaggcacgacattttgcacattaaaatggattatttcatcaataggttaatagaaagccgg

SEQ ID NO: 20601 - DNA, 201 bp, Homo sapiens
gaacatttcctgaaccatcctcctggtttcttcccttcccctcactgaataaaatccgtaatagcacctgccgcttgagtgtttgtctctgcaggacgccrtgttcagggctgggtgccctttgtgtcattttgttatcctggtcactgccagacagaggtggtaggaccctcatttgtcaggtcaggagcctgcagcctg

SEQ ID NO: 20602 - DNA, 201 bp, Homo sapiens
caccatctaattttttaaaaatgagcctaatactgttcacgttttagcacctggcaaatgtattgatactttacgagcattcacatgcgtttaagagtgcycttagcagttcgcgttctatatagaactgtttacacctctcaggattcttactctaacaaacaggtatagacaacatcctagttgcatctcaccgcggcc

SEQ ID NO: 20603 - DNA, 201 bp, Homo sapiens
gattccaggcagcagcatccgacataacccaaggtgttattgatgataataggattgtattttcttgttgagaagcttctaaacaagggaacttagagcartcaatgcccccggagaccgatgcacatatcaggaccttggtatcagctagaaaacatccatttgtttaaggggaagaaacaggcacgacattttgcacat

SEQ ID NO: 20604 - DNA, 201 bp, Homo sapiens
ctggtctgaagatctgtgtgtggctgtgatccgtgcgtggctgtgacccgtgcgtggctttggcccgtgcgtggctccggcccgtgtgtggcggttgcccrtgtgtggctgtgacatgtggaggcgaacttccacggcagaagtgccatgcttccgtaagctcttccgactggttggtaggcgcttttatcggcacatgag

SEQ ID NO: 20605 - DNA, 201 bp, Homo sapiens
ctcaggaggacaccagtcttgttggatgagggtcccacccttaagctgccatattaccatgattgcctccttaaagaccttatctccagcgacagtcaccwtggggtgtgagcctctgcagaggaatttgggggatactgcgcagtccgtacagcatccctccctccctggtggtttctgaggatttgtcactgatgtagt

SEQ ID NO: 20606 - DNA, 201 bp, Homo sapiens
tcttactctaacaaacaggtatagacaacatcctagttgcatctcaccgcggcctaacatccccgggagcatggggattagtggagtgagtgggaggactygccctgcgcaggtggagggtgatgagaggctggggacgttttcggatgaccacaggtgtgaagctgtcttcagtggtgggggaaccacctgggccttggg

SEQ ID NO: 20607 - DNA, 201 bp, Homo sapiens
ccatttggcacagtgtctccgtagcccctcaaagtgattccaggcagcagcatccgacataacccaaggtgttattgatgataataggattgtattttctygttgagaagcttctaaacaagggaacttagagcaatcaatgcccccggagaccgatgcacatatcaggaccttggtatcagctagaaaacatccatttgt

SEQ ID NO: 20608 - DNA, 201 bp, Homo sapiens
gatgcgcgcttttggggtcatcaggcggttgcaaaggtgggagcagccgtgctccccagaatgctgacagcacagagcactggtctgaagatctgtgtgtrgctgtgatccgtgcgtggctgtgacccgtgcgtggctttggcccgtgcgtggctccggcccgtgtgtggcggttgcccatgtgtggctgtgacatgtgga

SEQ ID NO: 20609 - DNA, 201 bp, Homo sapiens
caggagcttctagtgatgctggaggcggccactgctgtctttcagctgtgaggagccaggagggcgatcccagctttctcctggttaattttaccgtcttytaaaaaggaagttcacaagatttcttgaaagaactctagttggagttgtagagctaatgtttttttctctggtccctgccacctgctggaaggagcctgc

SEQ ID NO: 20610 - DNA, 201 bp, Homo sapiens
gtccttctgcagactttgaggttgaatctgttgcatgtctgtgcacagttgttctgatttaattagtgcgtgaatatactttatcctaatcatgacctgtrgctggtatacgtagatggctgggttatgtagatggctgggagggttaaggtggtgagggccttcctgtcttcaggggagagcttctggtggctgtcagca

SEQ ID NO: 20611 - DNA, 201 bp, Homo sapiens
ggatatactccttgtgttttcttctaagagttttctgatggtttcttttacgtttaggtctttgattttgagttactttctgtatatggtgtaagatgggrtaattgtcaattttttaaaaggaaaatgaaattctattaatattgttgtacaagttggttttcccctccacggcatgtttggctgtcttcatatcagcat

SEQ ID NO: 20612 - DNA, 201 bp, Homo sapiens
gttgggagtccaagatgagggagccagtgagggcaggctccggtgagggctctcttcctggcttacacacggctgccttctcgctgtggcctctcatggtggagagagagagagaaaggctggtctcttcctcttcctgtaaggacactgatcccatcatgctcctcacggccatgacctcatctaaacctgatcacctcc

SEQ ID NO: 20613 - DNA, 201 bp, Homo sapiens
gtattcctgaaagtagaacaggaattttactaaaaattttaattaaaataaagacccggaaagttttagtctattgctagtccccctgaagtccccgagartcgccttttattccaaaggcctgagaccagagggaggctgccagtggtgggcagtggctgggtggcaccaaacatcagctcggagcctcctggttccatt

SEQ ID NO: 20614 - DNA, 201 bp, Homo sapiens
tgggagtccaagatgagggagccagtgagggcaggctccggtgagggctctcttcctggcttacacacggctgccttctcgctgtggcctctcatggtggagagagagagagaaaggctggtctcttcctcttcctgtaaggacactgatcccatcatgctcctcacggccatgacctcatctaaacctgatcacctccca

SEQ ID NO: 20615 - DNA, 201 bp, Homo sapiens
aactcttcagtgaacagatgtcttcttgggccgattgttggatattgctcaccagctagttattaaattctagaaaaactaattctttgtgcagattctargtaaaatgtctctgttgcaaaataggatttttcaattaagaaaagctttaaaatatatcatgtgttcctccttagtctgcagaatctgaatgtcacctta

SEQ ID NO: 20616 - DNA, 201 bp, Homo sapiens
tatgtcggtgcctcttttgaaactggagatattgatatgatcttaagcaaatgtctccaatacgagaaaaagaggactgatttataaagtggaggactgayacataatgtggaggactgatacataatgtggaggactgatacataatgtggaggactgatacataatgtggaggactgatttataaagtagaggactgac

SEQ ID NO: 20617 - DNA, 201 bp, Homo sapiens
tcaatcacaaaatgcattggattctactcagactgtcggagaatatgcttgctcctctcctaggctctggaggaagaacctcagccactatgtgtgtgtgtgtgtgtgtgtgtgtgtgtgtgtgtgtgtgtgtgtgcatgcttgtacgcctgtgcacagagggtgggaagagggcttgcacctaagtcctagggtcctgtt

SEQ ID NO: 20618 - DNA, 201 bp, Homo sapiens
caatcacaaaatgcattggattctactcagactgtcggagaatatgcttgctcctctcctaggctctggaggaagaacctcagccactatgtgtgtgtgtgtgtgtgtgtgtgtgtgtgtgtgtgtgtgtgtgtgcatgcttgtacgcctgtgcacagagggtgggaagagggcttgcacctaagtcctagggtcctgttc

SEQ ID NO: 20619 - DNA, 201 bp, Homo sapiens
gtcggagaatatgcttgctcctctcctaggctctggaggaagaacctcagccactatgtgtgtgtgtgtgtgtgtgtgtgtgtgtgtgtgtgtgtgtgtgygcatgcttgtacgcctgtgcacagagggtgggaagagggcttgcacctaagtcctagggtcctgttctctgcacagttctctgcataggtttccgcacgc

SEQ ID NO: 20620 - DNA, 201 bp, Homo sapiens
actgtttgtgtgctttgtattttcactttcattttttgcagctggacttcagagcaagacctaggaagcaaagtgcagttcagacagtgggtcccgggggagggggcagttgtcagagagcccggagttaggtgtttgaagcctagtgagcagagacccatcctgagcataagggccagggccagggacttggccttggcc

SEQ ID NO: 20621 - DNA, 201 bp, Homo sapiens
gaaggcgtatggcatggaggcagaatagagcatttcatctccgtacttgtctaaagcaagtggcttccagggttgctcattttcacccacaataggaagtrggaggttgaggtttgctgtccgtgtttgcctctcaggtgtctgaagagatgaagggagaggagaggtctcccatcactggtactttttaggttcctctga

SEQ ID NO: 20622 - DNA, 201 bp, Homo sapiens
caaacactgaagtgttaacttacactgtgagcattcaaatcttcaaattcaatcatactttttgctgtgtgtgtgggatttcagaaaaatgactattgtastagacaagcaaaagaccaaatgtggaccgacaggctataacagaatcactcctcggaaagctaggtgtgtcctcaaatatctccacacttgccaacaggc

SEQ ID NO: 20623 - DNA, 201 bp, Homo sapiens
ttatatgtaaaagaagcacattcactatttttaatatcatgaattattagaaaagtttgtttatccatccattaaaatttagaaaccatttggaattattygaagcaaagatacgggttcatgttttacctgataaatgttttataatttcatcttcattcataaatgaagattgtgtgtgcacaggtattttgtagttct

SEQ ID NO: 20624 - DNA, 201 bp, Homo sapiens
attcaaatcttcaaattcaatcatactttttgctgtgtgtgtgggatttcagaaaaatgactattgtagtagacaagcaaaagaccaaatgtggaccgacrggctataacagaatcactcctcggaaagctaggtgtgtcctcaaatatctccacacttgccaacaggcacagtcaggagggtctgaagatacacgctcca

SEQ ID NO: 20625 - DNA, 201 bp, Homo sapiens
ttagggttcactgttggagtgtgttctgtgaatctggacaaatgtataatgagctgtatccaccactgcggtgtataggatcataagaaacagtttcactrccctaaaaatcctgtggtccacctcttcatttcccccaccgcctgaaatcacagatctttttactgcctctatagtttttcctttgccaggatgccatag

SEQ ID NO: 20626 - DNA, 201 bp, Homo sapiens
aggcacagtcaggagggtctgaagatacacgctccactgaagggctgtggctttagcaggggaaaaatggaaagttcgattttcagtaacttttgaagtcrttggatagagcatgtgttaccgaccacagacttggacctggaactccccactggcatctagctgagtgtcgtgaactgggacaaactgatctttctgggg

SEQ ID NO: 20627 - DNA, 201 bp, Homo sapiens
aagctgaggcaggagaatcgcttgaacctgggaggcggaggttgcagtgagattgcgccattgcactccagcctgggcaacagatctagactctgtctccaaaaaaaaaaaaaaaaaaggttgttttgtttggtaaacagaaaaggagccatcttaagataatgcatctttatttaacagttatgaatagaatctctcaag

SEQ ID NO: 20628 - DNA, 201 bp, Homo sapiens
gctcccagtatgtaacttaacttatatataacttaacattctgtttatgttaaaaattcaggcacaggactacacccagggactactgcagaaacgttttytaaatagcgccaacgctgaggggtcttcgattggtggcacccgtgttccacggtacagctaggccttctgtgagatccctttccccttaatacagaaatc

SEQ ID NO: 20629 - DNA, 201 bp, Homo sapiens
tagcaagccaacttggaatcagactgagagaaccataactcacttagccacccttcatgactggatggtcctcattagcacactgctaaatatgcttcagyttactagagctcagggcccggatcagaaatattctgctataaatattaagccaattaggaaaatgtacaaatgagaagtacgttaacactgcctttaaaa

SEQ ID NO: 20630 - DNA, 201 bp, Homo sapiens
gtggcagttctagaactgaacaagaggggcttcctggtcgtggaccccgacgggtgggcatgcggtagatacccagcacatccgagggaaggatggatggytattgatttcccttcaggccatgccaatatgtttgtcaagcaacagatgcaattcaagtgctactgtgatccaggtgtggctcgctgtttaggtaaagaa

SEQ ID NO: 20631 - DNA, 201 bp, Homo sapiens
tacttgaagctaggagttcaagaccagcctgggcaaaataacaagaccgtatctttaaaaaaaaaaaaaattctattgtatttctttctgtacactagcartggacaatcaaaataaaattaaggacagttccatttacaaatagcatcaaaaagagtaatatacttagaaataaattacctgtacactgaaaactacaaa

SEQ ID NO: 20632 - DNA, 201 bp, Homo sapiens
cactgcagccaaattcctgccctgcggacggcccacaggggagcgagagcaggtggaaggtggtgcctatgtccaggggagcaagtgagcctgaatcagckatcatcaccaccagatactgggagtccctgggagagatcaggcacttgacaagccctgcctcttggaatccgcacagcaaaccaatgccattctttcctt

SEQ ID NO: 20633 - DNA, 201 bp, Homo sapiens
tcctgctgaggagcatggaaagagccctccaaaaattaaacccacactgctgcagagggacccaggatcagctcccaccagctgattgctggtatcctttwaacagcacgtgaaaagacctggaagagcctcgcacccttcctcggagaattctttgggggtgtggaaggaatgaactgagaaagaggaatatgttttcat

SEQ ID NO: 20634 - DNA, 201 bp, Homo sapiens
acactgctgcagagggacccaggatcagctcccaccagctgattgctggtatcctttaaacagcacgtgaaaagacctggaagagcctcgcacccttcctsggagaattctttgggggtgtggaaggaatgaactgagaaagaggaatatgttttcattctaaattgccaaactatacctttctaaacacataaaatgaaa

SEQ ID NO: 20635 - DNA, 201 bp, Homo sapiens
taaggaaaaatcactacgcttttaaaggagaaaaacttgtaagagtgagacactctgagcaagttcagaaacatcgttaaaaattataatgaaaaatactrtgtctacctgtcatatttgctataatgctaaatcaggtgggcaggacaagtcttcagtatctacagaaatgcctagtattgagctagcccatttgagaaa

SEQ ID NO: 20636 - DNA, 201 bp, Homo sapiens
aatgtggggaaataccaggagtggacaagccaccttccccaaacatgaaagagcccagttttgctaaggagctgttgaaaaactggaaatagaacagcgcygtggtaagatttgcctttgaggtcgccctgtggtgtgttaggggcatttaggggacagtcagggagactcatttggaagttgctttggtcaccagctgtg

SEQ ID NO: 20637 - DNA, 201 bp, Homo sapiens
caagtcggaaatcaaggtgttgacggggttggtccttctgcagactttgaggttgaatctgttgcatgtctgtgcacagttgttctgatttaattagtgcrtgaatatactttatcctaatcatgacctgtggctggtatacgtagatggctgggttatgtagatggctgggagggttaaggtggtgagggccttcctgtc

SEQ ID NO: 20638 - DNA, 201 bp, Homo sapiens
cccagacactaagaagagaaggcacaggacaggccaccatccatcccctgctgtcccaaaactgacaagtctcgtacctctgacagtaaaactccccgtargactacaagacgtgggtcttggagctgcagttggcctcaaatgcaggttcacgaactgaccagagccagctgctgcagaggctgagctcattcgcagtct

SEQ ID NO: 20639 - DNA, 201 bp, Homo sapiens
ttgtgtgctttgtattttcactttcattttttgcagctggacttcagagcaagacctaggaagcaaagtgcagttcagacagtgggtcccgggggaggggscagttgtcagagagcccggagttaggtgtttgaagcctagtgagcagagacccatcctgagcataagggccagggccagggacttggccttggccttcag

SEQ ID NO: 20640 - DNA, 201 bp, Homo sapiens
ggcagaggtttggagctgggttgtgggtgagggatgcagagaggcttaacccagagaatggaggaaaaggagaccaggagagttcagagaggtgaagagtkaggagagagcagtggccaaagtggagagagttgagtttcagaaagccagctgcagaatgcagtgcctgacagagtgtgatgggccccatctctctctgct

SEQ ID NO: 20641 - DNA, 201 bp, Homo sapiens
gagtcctcccattcatggtgcttcagcatctcacttagtcagttgacccagctgtgaaatggatctgccttttcttgattatcttcttctgggaatgcctytcatagctgaaatgtgtctgtagcttgggcctaagaaggtgggtgacactgaacacaaggcagagagttcattgtcacaggactgagcacagctgagcgg

SEQ ID NO: 20642 - DNA, 201 bp, Homo sapiens
gcatggtgtgtgagactgctttcccttcctgcagtcaactcgccaaggtgcctccccagccccagcagtccggcttctctcctttccgctgccccatgctttctggtggcctggcagactcaggactatctctgagtccttcacaaaaccctcctccacatgccttcttttgtgaaaaccctcagtcctctttaagagcag

SEQ ID NO: 20643 - DNA, 201 bp, Homo sapiens
catggtgtgtgagactgctttcccttcctgcagtcaactcgccaaggtgcctccccagccccagcagtccggcttctctcctttccgctgccccatgctttctggtggcctggcagactcaggactatctctgagtccttcacaaaaccctcctccacatgccttcttttgtgaaaaccctcagtcctctttaagagcagg

SEQ ID NO: 20644 - DNA, 201 bp, Homo sapiens
atggtgtgtgagactgctttcccttcctgcagtcaactcgccaaggtgcctccccagccccagcagtccggcttctctcctttccgctgccccatgctttctggtggcctggcagactcaggactatctctgagtccttcacaaaaccctcctccacatgccttcttttgtgaaaaccctcagtcctctttaagagcaggg

SEQ ID NO: 20645 - DNA, 201 bp, Homo sapiens
gaattgtccactgtggggggcggctgaggaagccaaggggtctgggcctgtaggggaagtgggagaggagagaggaaaggacaaagatgaaggtggaaagrgggaaggtgacagtggcctctcaatatgcggaggggcttgaaaacaggagggctgtgcactagaggatgcactggcgcagaactgagacatttctggaag

SEQ ID NO: 20646 - DNA, 201 bp, Homo sapiens
tagggaaacttaggcacagagagacttttggtggctctataggcagtaaagggcaaaatggaaagcaaacctggcctcttgtacctctgagccccgaattytgccctctgcccatgtgagcatggtctgtgagcaaaccttcctgtggataggtttggaggattcgaaggacatccctggaggggctgtgcccaggtaggg

SEQ ID NO: 20647 - DNA, 201 bp, Homo sapiens
tttatagaattgaacacgaaaaccagagttgtatatctaaggaaaacatggtgtgactggcccgggatccaaattatttgcagcgcctgtcgtctttgttractcttctcagttctctttttctttccttctctctgtttctttcagttttggtttttctttttgaagacggaatcaaagggaaattattttcattttctt

SEQ ID NO: 20648 - DNA, 201 bp, Homo sapiens
gtgcccagttccatgagaaggagttgttacatttcttcttcctaaagcagtgatcggtgcttctgccctggtggagaaggcttgagcagtccccggctagyggctgttgccacctacaagcccccgcctccattaggaagccatttatttatggggcctaggtaggggcaggaggttcctttcaagaaaacaacagattgc

SEQ ID NO: 20649 - DNA, 201 bp, Homo sapiens
aaaacattcaacttaattttcataggaaaaagtcctcttatttaaattcttatttagtcagtgtgtataatgtttaatcaaatgatgtcattatagttactattattaaaactcccatttcatcgatttgtgtgatatttaagtgatgtgataatagttagaaggaagcgtatggaagaaagtgtggcaacaacactgctg

SEQ ID NO: 20650 - DNA, 201 bp, Homo sapiens
gacatctttgggagccatttcccttctaccacattattctgacctctgtagatactgtggcccatgtcatcaaacccccatgacagtcacagccctgcctrtttctttccatccagacaggtggtgcctgtgggtacatctcagcgtagggtgcagacagagttgtctgttggaaggaaaaccacatcgaatcgggaaggg

SEQ ID NO: 20651 - DNA, 201 bp, Homo sapiens
gctcagtggagaaaatggccggggtgcgtgtctgaaccgcgctgcatttggacggacactttgtgtgtcacatgttagtagctgcagtgtgtcctccaccygactgagagtctgtgtatcaagataggggtaaatcctttctgaccacttgcagacagaagtcacgcctcgtggtccaaagccaccaagtcattacttttc

SEQ ID NO: 20652 - DNA, 201 bp, Homo sapiens
actggcagaagagagtgagcgtagcaactgggaggtggcctgatggcctgcgcctgttgccgttgatgagacccaaagtctggaacgaatctggttccatrtagagttcatgctcaccccgaagtccttctttggcactggagaacaaagaagagtttgcacagaagaaaagggaggttgtttaaccagaaaggccctctg

SEQ ID NO: 20653 - DNA, 201 bp, Homo sapiens
gatagaaatattcagaagcagacataattatttcaattacttctctctggtttttgagacgcacactcaagagtcacaaattagaaaataatattcacatrtttcttctaattggtaacagattagaggcattttatctttttaaataatttccaaatgtgccccaaagagactgtgaagggagggaacagaggcatggaa

SEQ ID NO: 20654 - DNA, 201 bp, Homo sapiens
aaacctggctggggccagagtacccgggcacatcctcgctctcctgggccgcctggggcctgcacctgccgggggatctgccagcccccatacctgcggcygggcacatttaactgtgacttgcagaagtaataagcctaatatggttgactttatttaattaataatgatcctcttctgttcctctgcgctcataaaaca

SEQ ID NO: 20655 - DNA, 201 bp, Homo sapiens
aggcgcctgtagtcccagctactcgggaggctgaggcaggagaatggcgtgaacctgggaggtggagcttgcagtgaaccgagattgcgccactgcaccamccgagactccgtctcaaaaaaaaaaaaaaaaagaaaagtcaagagtcttcacaatgaatgttgacagtaatacaaggtcagctttttgtttgctttttaa

SEQ ID NO: 20656 - DNA, 201 bp, Homo sapiens
tgaaatgtgaagtaagtgtcacctttgggtggagacaccaaagacagagacaagacatgcagtgccctcagctgcataaattttgcttttaaaatattttygtggagtaaaattagtgtttagtctcatgtgaatttcatcagtgtgtctatggtgagcatttaaaatacggttttattggaggtgtggttcgtactttat

SEQ ID NO: 20657 - DNA, 201 bp, Homo sapiens
ctgcaggttggcaaaaacactcataatattgatcagaagtcaggcgggatatttattttgtctttgccccactagcataaatccttgtccactgcctcctsctccccgcatgcgggatttacagtggccagcttcttaaaagcattcagtaattaaggaataaatatccattggcctttgtgggctgtgctccgtccctcc

SEQ ID NO: 20658 - DNA, 201 bp, Homo sapiens
acacagacgcaaattcttcttttggccttttcgcactggaagagagagggggttccaataaaaatgagcacattagacttgacctggagtgcactttcggraaggggtgttgctcagtgttttgtagacgtgctcagaaagccacatttgtgagatttgaaggctgaggatgaaaccaccaagagactgctttacagcccc

SEQ ID NO: 20659 - DNA, 201 bp, Homo sapiens
tgaggcaggagaatcgcttgaacccaggaagtggaggttgcagtgagccaagattgtgccactgcactccaccctgggtggcacagcgacattccatctcraaaaaaaaaaaggaaaacgaaagaaaagctctctctccccacaaccctgacttgcacattttcttctgtaaacataaatgcttctctccatcccccgttc

SEQ ID NO: 20660 - DNA, 201 bp, Homo sapiens
aaagccaccatggtagctcctcctaattggatcttgggggactcggaacagggtttagcctgagaatgtgacttgtgagaaccccagatgagagtagttasacttttctggaaggcttatttaaaaccccagaacattcttgcattggaattgagttgcattgctctctgggatgggcagtgggctcttggaagaggtaag

SEQ ID NO: 20661 - DNA, 201 bp, Homo sapiens
aagtagaattgcggcctccgagtgaccatttgagtctgtgtgctttgacatcatggcttcttagggcaaatgcctctagacggaatagtctcatcgagaakaagccattgtcagcgtgtcccttggtcatatgtgacttgcgtatggagacgctagtgagaaagatgaaggatgctatccagagtatgtgtcagctcaggc

SEQ ID NO: 20662 - DNA, 201 bp, Homo sapiens
ggactggattctgtttcctcataatgtaggctagcaaaagggcaggaaaaccgcagccctgcagcctgttctgaaacctcaggtctgtgttcccttaagtcctcagacagggactttgcatggagggatctccagccagatatgttattctctgcaggaatcagttaaccttttggtagcatttcggggtcagagcctcca

SEQ ID NO: 20663 - DNA, 201 bp, Homo sapiens
ggtgaggggaaagcagggaagctttcccaagagaaagtgaagccctcctcaggtgaaaggggaggggtgctcaggtgacaggagcagtgaagtgttcttgyggcaagttcatggacctgctgggcctgttagctgccagcaaagttgtgtgcgaggatttggaaggagacagtttgttcctaaaatgtttggagttgggcc

SEQ ID NO: 20664 - DNA, 201 bp, Homo sapiens
tggaagagggaagtcccgtagctttgcctggcgtggaagagtgttgaggagcctcacgtgcagattgaagaattgccgggtgagccttcaccttcaggggrtggcagaaacatttctgctccaggatcatcaactttctctgcgagacagcttgatgagttgagaagaagtgacaggttcatctttcccttctttgtttaa

SEQ ID NO: 20665 - DNA, 201 bp, Homo sapiens
ctacagtcgaatggccaactatcggaacacgagcgagattcctctggttctggtgggaacccagggtgagtgatgttcgtgtgcagattgttttgaaaggrttctaacagttacatattttcagtatggaggagtttaaaaaatgctttaaagaaggaaaaattgcctactgaacgctcacttttttgggaaaaattatgg

SEQ ID NO: 20666 - DNA, 201 bp, Homo sapiens
ccaaatccagtctccagctcctggtctcaagtgatcctcctgtctcagccttccaaagtgtgatgggattataggcgttagccaccactcccagcagcccracttttaaaggattctctctcagtctatcgcttgatttgcttaacaccagccatttaatatgaaaatgtttaggtgggggagggaatatcttaattatca

SEQ ID NO: 20667 - DNA, 201 bp, Homo sapiens
ctgctttaacatcaaaaggttttcttcattgttgtgttattgaatgaactgaacagcagatttatttgctttagcaaatgcggctgcctgtgatggtggcrtaggtgttgagtgtgagcacacgagcatggcaggagctcgcgggaacgggccaacgccccactgccccagtcagccctctgtggcctcagagggtagctg

SEQ ID NO: 20668 - DNA, 201 bp, Homo sapiens
gacttctccctcattctgagtcaaatctaggctgttgggagcccgtgaccgccctgcttcctgtggtgggagaaggtgagggagaggagatgctctcatcytgagtgtcctggacgagatgggccagaccattctacccacactcccatttgccagacctcagccacctcccccagccagccccaggggtgttgggggcat

SEQ ID NO: 20669 - DNA, 201 bp, Homo sapiens
cattaagatgaaactttaaaaatataggactgtagaaagattttgtgccaaattaaacatatactgaaacaaataagttgttttttgaaaacccagggagstatcacacgattgttaatattttagtggaattcctcctaaacgtctttctgtacttttttttttgagacaaagtcttgctctgttgcccaggctggagtg

SEQ ID NO: 20670 - DNA, 201 bp, Homo sapiens
tgccctgcacggagctgtccctgggccagcacctgctgcgggccaccgccgacgaggacctgcggacggccatcctgctgctggcacacggctcccgggaygaggtgaacgagacctgcggggagggagacggccgcacggcgctgcatctggcctgccgcaaggggaatgtggtcctggcgcagctcctgatctgggtag

SEQ ID NO: 20671 - DNA, 201 bp, Homo sapiens
aaacattcaacttaattttcataggaaaaagtcctcttatttaaattcttatttagtcagtgtgtataatgtttaatcaaatgatgtcattatagttactattattaaaactcccatttcatcgatttgtgtgatatttaagtgatgtgataatagttagaaggaagcgtatggaagaaagtgtggcaacaacactgctga

SEQ ID NO: 20672 - DNA, 201 bp, Homo sapiens
aacattcaacttaattttcataggaaaaagtcctcttatttaaattcttatttagtcagtgtgtataatgtttaatcaaatgatgtcattatagttactattattaaaactcccatttcatcgatttgtgtgatatttaagtgatgtgataatagttagaaggaagcgtatggaagaaagtgtggcaacaacactgctgac

SEQ ID NO: 20673 - DNA, 201 bp, Homo sapiens
aactggaaggctttctcctttaaggaccagtgtgattctaggctgttgaatgatatcttcagatacccgtttgtcctgttgctctgcctcctccgtgagctgtgctcacgggtggccaggtgtttgacactagtatccagagacaaactcagacatgcgccctgggctctactcctggaacctgggagaaagggctgccgt

SEQ ID NO: 20674 - DNA, 201 bp, Homo sapiens
actggaaggctttctcctttaaggaccagtgtgattctaggctgttgaatgatatcttcagatacccgtttgtcctgttgctctgcctcctccgtgagctgtgctcacgggtggccaggtgtttgacactagtatccagagacaaactcagacatgcgccctgggctctactcctggaacctgggagaaagggctgccgta

SEQ ID NO: 20675 - DNA, 201 bp, Homo sapiens
gtgaaaccccgtctctactaaaaatacaaagaaattagccgggcgtggtggtgggcacctgtagtcccagctactcgggaggctgacacaggagaatggcrtgaacccaggaggaggagcttgcagtgagtggagatggcaccactgcactccagcctgggcaacagagcgagactccatctcaaaaaaaaaaaaaaagtg

SEQ ID NO: 20676 - DNA, 201 bp, Homo sapiens
gctactcgggaggctgacacaggagaatggcgtgaacccaggaggaggagcttgcagtgagtggagatggcaccactgcactccagcctgggcaacagagygagactccatctcaaaaaaaaaaaaaaagtgaacacttacttagcgtatgcaccacatggtgtaaccacccacccgtctagttccaaaacaatttcatca

SEQ ID NO: 20677 - DNA, 201 bp, Homo sapiens
cctcatttctttctacagctgaatgatatttcattgtatggagggaccacattttgtttattcattcatctgttgatgggcgtttgtgtccatcttttggytacagggaaccatgcagctatgaacgtgcgtgtacagggatttgcttgagttgccattttcacctctttggagtatatccttaggagctgagtggttgct

SEQ ID NO: 20678 - DNA, 201 bp, Homo sapiens
ctgaggcgggagaattgcttgaacccgagaggtggaggttgcagtgaaccgagattgtaccactgcactcagcctgggtgacagagtgagactccgtctcaaaaaaaaaaaaaaaatgcacatttgcatcagtgatttcattctgccagtgttaaatgaaaattgttacagggaagttagttctcaggatccattggggat

SEQ ID NO: 20679 - DNA, 201 bp, Homo sapiens
agataattggaggaagcagtggtcattttagtgtttgtgtagccaggagagcacggccaggactcactctgagttggggtagccagaattcagagcatctrgagagagagagagagaggctcacctcttaggaaagggtttgggaatgagtaggaagttattttcctttttttttttgagatggtatctcgttctgtcgcc

SEQ ID NO: 20680 - DNA, 201 bp, Homo sapiens
aattcagcctaatttagttcctcagaaagctataaaatgatgtcttcacatgcctcccgattagactgtttccccctttttccttaacaaataagtcctcktagccttcactgggggcaggacaattttgaggatgtgatttcctcacgaaagtacctcccacacgccagccagaagagtggtgcaaatccatccgcatgg

SEQ ID NO: 20681 - DNA, 201 bp, Homo sapiens
ctccaccctctcctgcgtgagtctgttgccatgttttcctcagctgaaagggtttggagaccctggggagtccacacacaccccctatttcggagtttgargctaaaagcacatggtcacccccaggtgtggggagcgcaccggctgtcccttccccccacccccggcccagctccagccaagtgtcctatagccctcact

SEQ ID NO: 20682 - DNA, 201 bp, Homo sapiens
ttacattcctattgaagcatgtgtcacaatgcttgaaggagtgaaagagaaggataaagtggttgtgcagagaggccctgcctgtgccacccaggagctaygtctgagaagccacgcccacttaggggctgcctgtggacccctggggcttctgctgaggcaggttcccaccagaggcaggcagaaagctgccggcaggga

SEQ ID NO: 20683 - DNA, 201 bp, Homo sapiens
cacacgcctgtagtcccaagctactcaggaggaaggagggaggatcacttgagcccaagagttcaaggccacaaggagctatgatagcatcactgcactcyggcctttttttttttttttttttaaagttttaattcagcctaatttagttcctcagaaagctataaaatgatgtcttcacatgcctcccgattagactgt

SEQ ID NO: 20684 - DNA, 201 bp, Homo sapiens
gggctgtggttatagttgctgtccatcactctaggtgctttcacctaggcagagcaaccgaagtgcactttgcagggagctaagaggctcggctgctaacrgcagacgggtttgggtgggactggagtgagctcaagattctgtgcaggcctcacttggatcagctgctcctgtccttaggggtcaggacaggacttcgtc

SEQ ID NO: 20685 - DNA, 201 bp, Homo sapiens
ggccgaggctggggtaattatactgagataatgatggtatctgctgtgtagcctcttcaaggtaggtggtttataagtgtgggaaaaaaaattaaatactrtggggtttttaaatggctttaaaattttacatgtataagaataaaattctctgcagccactctttgctaaatattctctggacaattatttaagacattt

SEQ ID NO: 20686 - DNA, 201 bp, Homo sapiens
aaggatccaccctgaaacttcagggtttaagaaaatgatcatttgactgtttcttataacactgtggctgagacctgtggacagagcccagcagggctgayttatctgtcagagcttcccaaggcaccaggtgctgctaggctttctcgagaattaaacccagtggagatagtgttattcccactgatgctgttagctaaa

SEQ ID NO: 20687 - DNA, 201 bp, Homo sapiens
atccgctgtggtgttgattgttccttgttggtgatagccctagaactgtgtttcccatcgttgatacttgcattcacgtttgctagttctctcttctcctrtgaagacatgaacgtagctgctcctttaattacatttagctagttttaattcagagatggctattggccctttgttttcttaccatcttttattgtgttc

SEQ ID NO: 20688 - DNA, 201 bp, Homo sapiens
tgagccacaaaagggccaggtaacttggtaaagatcatgcaggtcataaattgcctcactgagctgggaacccaggcagtcagcttcggcgctccccaccyctgttaggcaacctatgaacatttaccaagaacacagactcatctgcaaggaagcctcagtaacttgatgaggagcagctagaagactcgagggagaaaa

SEQ ID NO: 20689 - DNA, 201 bp, Homo sapiens
gggtgaaatggtttgcagggaggcagcatagcagcggggtaacaagtataaacccttggtttgtacctcgaatcttgcgcctgtttcttccccttactgcygtttgggttatctattgctgggtaatgagcccaaattatagtggcttaaaacagtaccattttggccaggtatggtggctcacgcctgtaatcccagcac

SEQ ID NO: 20690 - DNA, 201 bp, Homo sapiens
ttgtttggaatggtgaaaatgttttgaatctgtttctggtgtgatcgttaggtccaagatttcacgtgacgttgtgtgccgggtgttgtggtcaacacacrggaatgctcctttattctctgtacggcctttgggtgcatcatttgagtggatgttcatttgcttgagacgattgtcagagggaatcttgtgtgccctttg

SEQ ID NO: 20691 - DNA, 201 bp, Homo sapiens
gattgcagccaaaagacaattctactctttgctccactgtagaaaaggttccttgggcttaaagcaagatgtgcctgcctggaatcctgatattttggttrtaggtcattaaaatcagtctttctgatatgtcagtaaattaggtggtaggaattagatcaacatttgccatttccaagtaacataagaagaataatttga

SEQ ID NO: 20692 - DNA, 201 bp, Homo sapiens
tctaggagaaaactatttgtagaagtcttgaaaattcaactcataaataaatgcccttattcttgatattatagacatttcttctgtaaagtatggcacayctataaactaaaaatgcacatctggaaaatccgtaaggcagaaattccagcctcccctatccacagccatcagaggagtccctcacacacctgtcgccag

SEQ ID NO: 20693 - DNA, 201 bp, Homo sapiens
caaaagatactcaagttctaatccctggaattgacgaatattatattttgtgtccaaaatataaagggtctttgcagatgtggttaagaatcttgaatacmttctgattgggccctgaaagcaattgcatgtatccttataatagggagggagaagggtccacgtggagcagaggagtttgaagatgctgcctggatgttg

SEQ ID NO: 20694 - DNA, 201 bp, Homo sapiens
ccttttccggtccaatggcagacacagggctgggtgactccgtatgctccagccccagtatctccagcaccaccagccccaagctcgacccgcccccctcycctcacgccaacagaaagaagcaccgaaggaagaaaagcactagcaacttcaaagccgacggcctgtccggcactgctgaaggtaagggttccgcggtgc

SEQ ID NO: 20695 - DNA, 201 bp, Homo sapiens
gataacagaacctgccaggataggccactcatttttgtttttgtttctgttttttttgttttgttttgttttaatgtgtgtgtgtgtgtgtgtgcgtgtgygtgtgtgtgtgtgtgtgtgtgcatttttttttttttttttttttttgaggcggagtctcgctctgtcgcccaggctggagtgcagtggtgtgatctcggc

SEQ ID NO: 20696 - DNA, 201 bp, Homo sapiens
catgggggtgaatccttcatgaatgtctagcaccatccccttggcgatgagtgaattcttgctctgatagttcatgagaggtctgttttgttttgtttttrattttcctttacacaacagtatacagtattaggtgccaagagacctggttgtttaaaagagcctgcccccacccccaccccccaccacttctctcttgct

SEQ ID NO: 20697 - DNA, 201 bp, Homo sapiens
gccactcagcatggtggcccagggctgtgtgtttggtgcacagtgggacgtcttagtcccactacctcagccagactcctggcaaagtctttattttttawgataatttatttttagattttattcaaaatgaaaacccatttaaaaagcacatgagaaatgagttctttattcactcatctaaatatttagggctgtgga

SEQ ID NO: 20698 - DNA, 201 bp, Homo sapiens
acagttctacatggctggggaggcctcacagtcatggcggaaggtgaatgaggagcaaagttacatctaacatgggggcaggcaagagagcttgctcaggsgaactcccgtttataaaaccatcagatcttgtgagacttattttctaccacagaacagaataggggaacccacccccaagattcagtaacctcccactgg

SEQ ID NO: 20699 - DNA, 201 bp, Homo sapiens
aaaggtcacctaaaatagttataacttagtgacaaaaataaatcctcccttcagaaggccaagtcatgttcaaggtggtagcaagctgtgtataggtagcracagggcccctttgagcattacacgtgcaccttgggaggaagagagtggagagcgggctctgcctgtatattcttggagatggtgcattcagcactgtcg

SEQ ID NO: 20700 - DNA, 201 bp, Homo sapiens
gataattgaatcatgagggtggtttcccccatactgttctgatggtagtgaataagcctcctgagagctggtggtttcataaggggaaaccccttttgctyggctctcgtctctctcttgcctgccgccatgtaagatgtgcctttcaccttctgccatgattgtgaggcctccccagccacttggaactgtgagtccatt

SEQ ID NO: 20701 - DNA, 201 bp, Homo sapiens
gccaagtcatgttcaaggtggtagcaagctgtgtataggtagcaacagggcccctttgagcattacacgtgcaccttgggaggaagagagtggagagcggrctctgcctgtatattcttggagatggtgcattcagcactgtcgttccctgcagttaggttttggagagtgtaaattttagcctgtcttcaaatgctttga

SEQ ID NO: 20702 - DNA, 201 bp, Homo sapiens
tcatgagggtggtttcccccatactgttctgatggtagtgaataagcctcctgagagctggtggtttcataaggggaaaccccttttgctcggctctcgtytctctcttgcctgccgccatgtaagatgtgcctttcaccttctgccatgattgtgaggcctccccagccacttggaactgtgagtccattaaacctcttt

SEQ ID NO: 20703 - DNA, 201 bp, Homo sapiens
agttaggttttggagagtgtaaattttagcctgtcttcaaatgctttgagtttctcgtcttcctgagtagcgtgttcggagctttctctgctgcgggtggyggtgccacagaggaacacaggggcctgtgttgtggcatctgttcaatcggggagacaggatcagggtttttttgttggttttgacattcttgagccaatg

SEQ ID NO: 20704 - DNA, 201 bp, Homo sapiens
ggtttcccccatactgttctgatggtagtgaataagcctcctgagagctggtggtttcataaggggaaaccccttttgctcggctctcgtctctctcttgyctgccgccatgtaagatgtgcctttcaccttctgccatgattgtgaggcctccccagccacttggaactgtgagtccattaaacctctttttgtttataa

SEQ ID NO: 20705 - DNA, 201 bp, Homo sapiens
tggtttcttccagcatccccgagatgaagatgaaaaactgttgcatagcaggtggatcttgctagaagctctccagccatgtgattagtttatttgctcatttttttttttccttttaatataaatatatcagaattcaggctggtttcagaacctggcatcaggaatggaatttaaaaaaaaaattggttcagatgtatc

SEQ ID NO: 20706 - DNA, 201 bp, Homo sapiens
cctcgtcagggaacacactcttgttgatagcaacagcatgcaatctctgttacagcctctaagttggaacagagaaggctttcgtagaggacatttggtgkaaatgaaacacatccaagctgtcccacgttaactgtcacctctgtcacccacatgcactacctatgtttagcagggcagcctctgcctgtgatttgcagg

SEQ ID NO: 20707 - DNA, 201 bp, Homo sapiens
accattgaaatctactccctcgtcagggaacacactcttgttgatagcaacagcatgcaatctctgttacagcctctaagttggaacagagaaggctttcstagaggacatttggtggaaatgaaacacatccaagctgtcccacgttaactgtcacctctgtcacccacatgcactacctatgtttagcagggcagcctc

SEQ ID NO: 20708 - DNA, 201 bp, Homo sapiens
aatcaaataattgcaggaagattctgctattcagccgttcttttttgagtaatcttaaataattaaaggaagaacaacatgccaaatgatggttcaattarcatgtataaaaataaatatttaccaagactgcattatttgccaaaacggagatgtgcaattatttaatattgttgatggggcccataaaacaaatagtac

SEQ ID NO: 20709 - DNA, 201 bp, Homo sapiens
ttattctcatttgtggaatttctcaaaaatacagcaactgactgagattccaaacagctcacaattaaagacagtacaatgttttgctttacagagaagtrgcagtagtacagattctgtttttttgtaataaatgtttctgacattttaatagtgaagtaaattaatcaaataattgcaggaagattctgctattcagcc

SEQ ID NO: 20710 - DNA, 201 bp, Homo sapiens
taactttgtataaattcaaattgaacataatccagactatatagcaatctttaatgaattccatcatcaacattaccacataaaggaagttaagttgggcrtataaaatcgtaattcagtaaatttttctttagttagtaagcagattagtattcattgctaagatgcattttatcaacggttttggtagcgttagttaaa

SEQ ID NO: 20711 - DNA, 201 bp, Homo sapiens
actgtctgcccatgttgggagtgtgaggcttatacccagggctgcttcctgggtgatcttgggggattttcatttttctggtacaggactggagagtttaygagatacaccatgacggtacagcatttaatttagtatcaccacttcgggagaatgtgtatcttaattgctaaaatctctaactttgtataaattcaaatt

SEQ ID NO: 20712 - DNA, 201 bp, Homo sapiens
ctttcatggattatcacagtcagtgctaggataattaagctcaaagtggcagattccaatgcttcaggaatgtctgacccctgtaccgagatggtgtggtragcaggaagatggggtcccaaaagatactcaagttctaatccctggaattgacgaatattatattttgtgtccaaaatataaagggtctttgcagatgtg

SEQ ID NO: 20713 - DNA, 201 bp, Homo sapiens
tgagtgcatgtccgttgagcagcttcccaccctgattgcagctgttcctttttaaacagaacctgcagaagtggatacaccaagaacatggatgcattgcrtgtcacatgtatacattgtctgtttctccacatatacaccataacagaaatgacacagaagagcacctcctcggtttgccaactagcttttgtatagcag

SEQ ID NO: 20714 - DNA, 201 bp, Homo sapiens
gctgtcgtagatcctttgacgagcgtccccaaggagacctcagacacaggttcctgccttgcagggtcctgaccccgaccctcccgttgctcacagtgtgwgtgcatgtccgttgagcagcttcccaccctgattgcagctgttcctttttaaacagaacctgcagaagtggatacaccaagaacatggatgcattgcgtg

SEQ ID NO: 20715 - DNA, 201 bp, Homo sapiens
cactgtatttaatgggccgggatttgtgtaagtgatctccatggagacgcaggtggtgagcctgagatgctacactttagagcaggagtcatccactcccrgatggcagcctggtaccagtctgtggcctgttaggaaccgggccacacagcaagaggtgagcggcgagtgagtgagcattactgcctgagcgctgcctcc

SEQ ID NO: 20716 - DNA, 201 bp, Homo sapiens
ctatgaggtgtggggctttgccagaagtgccagggaggctgtaaaatgtgttttggaggcaacctcaggctggttcttctggggacctcggtgttgggggracggcctgtttctgtagcttgggatgaacttcttccctgcatctgtgaacaagcttgtactcagcctgtaggttaacaagctggggccagaaggctgtac

SEQ ID NO: 20717 - DNA, 201 bp, Homo sapiens
cattgaaactgtgctggtgaacttctgctaagtcctacatttgaaagtcatcagcggattatgtctgatccagtttgcagcgggctcttttccggctgcgwtgaaatggatttctttattctatttaagactccacttccttcctcggcacagaactgacaggctgtggcagccacagcctcctccgatgctcctctcctc

SEQ ID NO: 20718 - DNA, 201 bp, Homo sapiens
taatgaagatgaggtcctggctcccttgtctaatgaagaatgtgggggagcctttagcagaaggctctgaaatcccgaggaaggacgcagtggaggcaccrctggacaggagctgccttccctggtccttgcagccaggctcctgcagcctgggaaggtggggcttcctcatctcaggtccagaatcctctgaaagttctc

SEQ ID NO: 20719 - DNA, 201 bp, Homo sapiens
cttccctggtccttgcagccaggctcctgcagcctgggaaggtggggcttcctcatctcaggtccagaatcctctgaaagttctcttccttgaccatagtscttgggccctgttcccttgttggtgttgtttgctgaggtagaatgctaagataggccaactggagtcatttccaggattacttcccattctagaattttt

SEQ ID NO: 20720 - DNA, 201 bp, Homo sapiens
cctgttcccttgttggtgttgtttgctgaggtagaatgctaagataggccaactggagtcatttccaggattacttcccattctagaatttttggtatatrttggtagtcatatcacatggatgacttttttcatacacgtttatgtgctgtaggttgaaccccactgtgaaattgccactattcaaacatatttgaccat

SEQ ID NO: 20721 - DNA, 201 bp, Homo sapiens
gggactcctgtgagaatgctgatgggtgccgcctcctcacctgtgtgtcgcaggtgtaggcgatacctgggaagccgttgtacggggctggcatttgctasttttataagatgtcacaagcatgacccaggagcacaccccatgagagtcacagtggtaccagcacctgctggctgctctctgcactgatgacagctgtta

SEQ ID NO: 20722 - DNA, 201 bp, Homo sapiens
atttttggtatatgttggtagtcatatcacatggatgacttttttcatacacgtttatgtgctgtaggttgaaccccactgtgaaattgccactattcaamcatatttgaccatatttgtgcctccagcacagcagcgagtacaagtagcacatgtgcctgtctccaagcaggaacatctcctcctggctgtggtcagatt

SEQ ID NO: 20723 - DNA, 201 bp, Homo sapiens
agctgtgtgtaggacaggacttcgtaacacccggcttgtgcgtgtgtgcggtaccataacgtagcgtgttgtagggcgtcgagcagctgggccgggggccrccagccaggcggggctctgggttccagtgttagaggtacatggtgttactgtaaggagaagttgccaagctccttggtgaccctttcaaaggcaagagta

SEQ ID NO: 20724 - DNA, 201 bp, Homo sapiens
aaccatttttgaaaatgaagttatgctgatgtcatttaatggtacgtcatcataattggcagcagagaaggttgcacatcactcatggcagatccattacmtgggccatgggccaagctgtgcaccaggtgctgggaggataccggtgggcgaaccagacctgcaggaaaatacatggaaatggggacaaaacaggcattt

SEQ ID NO: 20725 - DNA, 201 bp, Homo sapiens
gccatgtgattagtttatttgctcatttttttttttccttttaatataaatatatcagaattcaggctggtttcagaacctggcatcaggaatggaatttwaaaaaaaaattggttcagatgtatcattcctccaattggcatatataaaaagaatagtgtggctcttgcctggtaatactggcactttgggaagccaagg

SEQ ID NO: 20726 - DNA, 201 bp, Homo sapiens
tctcgttatttttggaatgattgcagggttggtttaagattgccatgaccacatattaatagttgcactgagaaacaggcgtaaacagaggttgtcccggraaaggcagaatgaatgtcacccaccctggggaaggtggctcgtgtcactaccctttgctacagctgttgtttctcactgattcattctcgggaatcgctt

SEQ ID NO: 20727 - DNA, 201 bp, Homo sapiens
gacaatgctgtcagtcatcgtgagacagagtagcatggaactgaaaaatgtgtagcaggttttcaaacctcttacttgcccaaagcttagtcaaaattatkagatttcctctgaactttgttcttctcgttatttttggaatgattgcagggttggtttaagattgccatgaccacatattaatagttgcactgagaaaca

SEQ ID NO: 20728 - DNA, 201 bp, Homo sapiens
cccttggtcctagcacctctgcattatgcaccctggcaggacatcagccggctggctctgccaccccgcattagtgtccatgcaccttggtggagaagtcrctctgagcagctctgatttcagaggcctcacttgggaaatgagggtgcggtgttgcttcttggtttcctaaggctgctggcaggtagggctttacaaaga

SEQ ID NO: 20729 - DNA, 201 bp, Homo sapiens
cttcccgcccctggaggggaggaagacgagcatggtctgggcgcccagtgctcctgtccccatctcacacatgtgtggaacaagccactcacaccctgacrtgctcccctctccctctcaccacgactctttcttggtcctgcctttctcacttttccctctcagccttcttcatagcctcttcctcttccatggaggaca

SEQ ID NO: 20730 - DNA, 201 bp, Homo sapiens
atggagtgtccagcctcacccagcccctcgcctggcccttctcccttcctcatggccgctagggcaagccctcacttctccaggacagatggcctttcccygctccaccgtccactctgcttcccgcccctggaggggaggaagacgagcatggtctgggcgcccagtgctcctgtccccatctcacacatgtgtggaaca

SEQ ID NO: 20731 - DNA, 201 bp, Homo sapiens
acacttggcacagaatcttcttccaggcagcctcctgggccgccagtggtgtggagctggccgagaaaggagcctgcttcccagcatggcctcacattgtsatcagtgtcactcaggaccttgcccgctgccccagctcagagcttgaacctctccctcttggaatctggcaggagtccccaaaggaccacccaggctcag

SEQ ID NO: 20732 - DNA, 201 bp, Homo sapiens
taccatgttgtacttcagaagggccatgctggctgcagaatggaggctgttggagggcaggagcccaggcaggaggtggtcggtagagcagcattcccagrgagagcctggtgggctctcagagttgggggctgcaggaatggaaaggagaagacatatctggaggctttcggaaagtagaatagataggaccgatggaca

SEQ ID NO: 20733 - DNA, 201 bp, Homo sapiens
acttacaagtgaaaaatccagtgcctaagactttctggtgaaatgttgccgctcgggaatttcagttggaaacataaagccattcattaagctaacgcggrtgtacgtgaggtttattcaagagataaattgctggtgtgttggtgtttagaacatcaactctgtcggatatttcatgtgaccgaggtctgagcatcagaa

SEQ ID NO: 20734 - DNA, 201 bp, Homo sapiens
gacagtctcttgcagcaatagcaatagtgagagtatcagcattgtcatgcactggcttcccaagcctcagttcccacagggtgacaccagcacacacagtractcatgttgtaagaggaaccccaagcttaggaaaccccatgtgtttaataagagcacgtaagcaagcctgtccaaagtttgctgtggagagcgacattt

SEQ ID NO: 20735 - DNA, 201 bp, Homo sapiens
ggtcagcaagagcgagagtctccgaagttagacaggcatccggagaaaggtggatgtggaaagtgaggttgacttctgggcgcatgtgtggaatatccagkcccttagaggctcgggtcgagtggtggaggatgaggcccctctgccatagggagagcctgtcttaatcacgccacgcaggtggaacagactctatgcaga

SEQ ID NO: 20736 - DNA, 201 bp, Homo sapiens
cacccctcacccccgatacactttttagaaatgcatttgtgaggatcctatccatctctgtatcgcacctggctgtcatcacttgatagtagcctggggamttggggaatccccactgcagtatgttgagcttcagttactggttttactattccatgatgtggctatatccacagttacttaaccagggtgtggtttgtt

SEQ ID NO: 20737 - DNA, 201 bp, Homo sapiens
tctgcaagagtagtcgataacagaaagaagtgttttccaaattaattggtaatgctgttcactgatggtattaagacacaattagttaccactgactgagygcttgctgggtgtcaggcccacgctagtgcgttcctcgcatcatctgtccacgggtaatgtttgtctgcagcatgttggggtggtgtttgggtgcacaat

SEQ ID NO: 20738 - DNA, 201 bp, Homo sapiens
cccactggcatctagctgagtgtcgtgaactgggacaaactgatctttctggggtgagagtgacacagggaggcttgtctgcaccatcttcagtgaccttyggatgtgaaaatggcccattggaggcattttgacttggcctttacgtgagttatggtgtctgactttgtgtcctcctctttttcagatgccttcgtgaac

SEQ ID NO: 20739 - DNA, 201 bp, Homo sapiens
gcttctgtcatgagtcaccaagctttggtatccatcatttttgaaatgtgactatttaccctgtgaccaagtattggcatgaaattaaaatttttgtcttktacgaaccttaccctttcggtgaaattatgtagagcttcaaattggcacgtgtaaaaagtggtccatcgcagccaccctttccagccgctcccctctacc

SEQ ID NO: 20740 - DNA, 201 bp, Homo sapiens
tctggttaatacaatggggaagaattaaaacctttggcataacaaagcttttggtcagttctataagcaaatgccattcacagcctcctgagtgatacctktttctaggcactgcttggtttctgggtgccctagacagggagtatcccaccggttacactctctgtcactcgccatcatcctgaggatgctgtttccata

SEQ ID NO: 20741 - DNA, 201 bp, Homo sapiens
catgagtcaccaagctttggtatccatcatttttgaaatgtgactatttaccctgtgaccaagtattggcatgaaattaaaatttttgtcttttacgaacyttaccctttcggtgaaattatgtagagcttcaaattggcacgtgtaaaaagtggtccatcgcagccaccctttccagccgctcccctctaccgtaggatg

SEQ ID NO: 20742 - DNA, 201 bp, Homo sapiens
ggtgtgctaactatggggtgggaagagagaaaagaagggcacaagaaagaaaaaacaatccgtagtgagtaaaatgctgaaggctttattacattagtacrttacataaactcatgcatttattcaaaaaatatctataggccaggtgcagtggctcacgcctgtaaccccagcactttgggaggccaaaatgggtgaatc

SEQ ID NO: 20743 - DNA, 201 bp, Homo sapiens
tgtcatcgtcatagtggggacacactgagaggttactttctaccaaactgtttcctaattgcactccctgcattgtcttattcagtcccgactttcccaaygcctcgcagcccgatgatacagagacggggcagcagtggagagctcggctcaaagtgcgaagttgtttagatttccacgttacacaaacacacaagcttc

SEQ ID NO: 20744 - DNA, 201 bp, Homo sapiens
tttttgaaatgtgactatttaccctgtgaccaagtattggcatgaaattaaaatttttgtcttttacgaaccttaccctttcggtgaaattatgtagagcytcaaattggcacgtgtaaaaagtggtccatcgcagccaccctttccagccgctcccctctaccgtaggatggaaggaaggggcaagtctaactttgaaac

SEQ ID NO: 20745 - DNA, 201 bp, Homo sapiens
ctgttcattctgtcaacatcccttgcaagatactaccttaagtctaaggtagtatcttaaggtagtatcttaggtagacttaaggcagtatctcccctttycatctattctttatctagatgggcctaattccaaagtctaaaagctgcagtgtcccctggagcctctcctgtaccttccagcagcggtgggctccctgac

SEQ ID NO: 20746 - DNA, 201 bp, Homo sapiens
accttaccctttcggtgaaattatgtagagcttcaaattggcacgtgtaaaaagtggtccatcgcagccaccctttccagccgctcccctctaccgtaggwtggaaggaaggggcaagtctaactttgaaacaaccaggttctttgtcgtgaaatatgtggcatttgtgtgtatggttatgtatctgtgtatgtatgtata

SEQ ID NO: 20747 - DNA, 201 bp, Homo sapiens
ggacagacaacctcgtcttgcaggatcatttaccttttatattatgacctagccacttctcatggctctaccacaccatcttcccgagagagcctgtgccygccccacagtcccggctgaaatggcaaatgcggtgtaggactgtggtgcacactgcccatgacgggctacttggacggctcatgcccacctctgactagt

SEQ ID NO: 20748 - DNA, 201 bp, Homo sapiens
aaacactacagcaggcaagaagagttaacctgtcgtaagtcaggaacacgttggggttgattagggagctgaccgttggccagctcatgctttgggaaccrgagggccagcctggctgcctgctttgcgggcttaagacctgcctctggaagggtaagggcctgcccgtccagataagtgctgctcacctgcattaaacaa

SEQ ID NO: 20749 - DNA, 201 bp, Homo sapiens
tacttgcagttagcactgtagctactagttcagttatgtggtttatccctgggtgatttggcaatgactattaaagtcaatcggagcggaatcaaatagtygtgggattttaatgtctaccaaaaaatgagagttagcaaattggaactggaaaatctggacgcatccttcaccgtcatcccttttcatttaattgacgtt

SEQ ID NO: 20750 - DNA, 201 bp, Homo sapiens
atgtgtatcagcttgtcagttcggatgaggttgcctatgaggtgagatgtgaggacagagaatcactccagcagttcccggggagaacatactgacacagygaagggttcaggagccgcaggttcgtactcattctttggctggggtgtgggaatattaaaaagaaattgaatacttgcagttagcactgtagctactagt

SEQ ID NO: 20751 - DNA, 201 bp, Homo sapiens
taactaggttttaggggtttaagaagggagccgtcagctgtgtgtaggacaggacttcgtaacacccggcttgtgcgtgtgtgcggtaccataacgtagcrtgttgtagggcgtcgagcagctgggccgggggccgccagccaggcggggctctgggttccagtgttagaggtacatggtgttactgtaaggagaagttgc

SEQ ID NO: 20752 - DNA, 201 bp, Homo sapiens
tggtccattccatcttgtgcagaagattcattctgacagtggaatataattagaaatgcgtcgttcagcctgcccccacccccaaacacacaaacacacayagattcaagaccatggggaagtagaacacagcagatcttcctccaaagagaccgccgcacactggagtcacctattcgtgcggccagttaggacagcagg

SEQ ID NO: 20753 - DNA, 201 bp, Homo sapiens
acagtgcatggctggagaacagcaggatgttggtatctgttgcacatgtttcagcctgtttctacaaatctgcctttttcttctaacatatgggttaactrccatttctctttgctaattttacaataatatctttgcattttcccctaataaaaaaattaaattttagaaacatttaaaatgcagttaagctttttggtt

SEQ ID NO: 20754 - DNA, 201 bp, Homo sapiens
aacctgcgtttccctgtttgttctgccatggggcatgaggcagcgcctggctgaccttggacttgcaggcagcctctgtgcatcccctggcccctggcctygttgttagatggtgcatttcgttttctggagagagagagagagctggaccactgtggccgttgtcagaattccactttcgtcatcaaggattcattttct

SEQ ID NO: 20755 - DNA, 201 bp, Homo sapiens
ataatagcataatccccatttcacagacagaatgaatgctcagagaagttgagccacttactcaatgtcactcagcctgggagtggtaaactaacacttaygcattgtatggaactgcccacgagtcacgtttgttctatgagaaggcagaaaatacctggggaggtcttgcccaggggtgtgtatgtcttaattgataaa

SEQ ID NO: 20756 - DNA, 201 bp, Homo sapiens
tattgcccttcccgtgatcacttatgcatataaatatcattatgcttttgcttaactggggcaaaaatcatgtgcattatttcagtgtctgcttttaaaartagatggtagtattttattttcagttaggtgaagcagaaaaatgtatccagcaaagtcttcattaaaaagcttaagatggctagaactaaatatacattg

SEQ ID NO: 20757 - DNA, 201 bp, Homo sapiens
ctgaatagtaccaggatgtacagccattaaaatggccaatttgaataccctttagagataagtgaaagcataaaacataaaactgtgtataataattggarcatgaaaatatgtatacatgtggctttaaattggatgaataggaacgcagtaacaagtgaactggggtaggtttaaagcagaacttcaattttttttttt

SEQ ID NO: 20758 - DNA, 201 bp, Homo sapiens
ctcccagagtgctgggattacaggcgtgagccactgcgcctggcaggagattgtatttctgtgttctcaagtgatgctgatgctgctaatccaggagccayactttgagatcccctttctaggcacatggagtcacttagggcttctttcctttcccgcctcacaaatagatgactctttgattcgtaccagcccctttaa

SEQ ID NO: 20759 - DNA, 201 bp, Homo sapiens
cttttgtgtgctttgtcaccgcggcactggcagggtgtcttaagcctattgaagccgtccaggaaatgtgcgttgaatgaatggcacaggcttggcaatgytgttaccaggagattctcagaacaatcccgcagtttccgttacttcctgttaagacagccgctgccactcgggtgctgtgatgggcacggaacagtagtc

SEQ ID NO: 20760 - DNA, 201 bp, Homo sapiens
tcccttgcggaggcagctcctcagggccgcgggtaaatgttgggcctgtagctggggatgttcaggaagagcctgtggattgggcaggtgctcactgtccrtcagttgtgtcactggttgctttgacagtggctgtggtgttttgtgttttggttaatttctcccaggtataaaagatagctatatactcacttcattact

SEQ ID NO: 20761 - DNA, 201 bp, Homo sapiens
ccaatggaagtattgaatgagcttgtttttggccatccagccagtgcttggttatgtttgtgtttaggcctcctgtctattttagcctcttagtatttgcraaatgccaaatagagtgatttgatgatgcttaacggttgtccgtttctgtttcagggaattgtgggtaacttggccagcggcaagtctgccctggtgcac

SEQ ID NO: 20762 - DNA, 201 bp, Homo sapiens
gatggagctccttcagttttacccaagtcaaggtgcgcttttggttggggcttccctgggttaaaggtcaccacccttcctgcccggtggcagccactcgycgtccgcagcacgtcagcagtgcatcggagataattgactcaggaccttgtcaaataaagctgttcattatttcccaaatactgacctttcgtccaaagg

SEQ ID NO: 20763 - DNA, 201 bp, Homo sapiens
tgtaggggtcaataggagaaagcttgcctgttcactgagaaatgcatacagatgccagaaaatggcatgatttggagaaatgagcaaaggccacattttgycagggctctgtccctgggttttgacggcttttatttgctcctttgtgtcggaatatgaattttagccacggccagctggtgacaccttttagagaatctt

SEQ ID NO: 20764 - DNA, 201 bp, Homo sapiens
agactgagacgatggagctccttcagttttacccaagtcaaggtgcgcttttggttggggcttccctgggttaaaggtcaccacccttcctgcccggtggyagccactcgtcgtccgcagcacgtcagcagtgcatcggagataattgactcaggaccttgtcaaataaagctgttcattatttcccaaatactgaccttt

SEQ ID NO: 20765 - DNA, 201 bp, Homo sapiens
aattgagaagctttaggtatagagtgttgtgggtttgggatataatttactgtgttgtcacctgggtgtgtggagactatcaaagggatgtgttgtcctckgggagtgctggaggctgacaaagctgatgatggcccagcctcacctgtggttacttacccacacaaaggtgagggcactcccacagtggtgggagtggtt

SEQ ID NO: 20766 - DNA, 201 bp, Homo sapiens
gaggattacaggcatgagccactgcacctggctgcaaacttttgtttttttgtttgtgaaatggagtttcactcttgttacccaggctggagtgcaatggygcaatcttggctcactgcatcctccaccctccacaaggttcaagcaattctcctatctcagcctcccttttgtgggtttcgggcccacaaaacctggacc

SEQ ID NO: 20767 - DNA, 201 bp, Homo sapiens
ttttcatactagtgaaatttcagctgctaacaagaatcacgtctgatgcagacacaaagcccagtggctgccccaactccctggccacctcctactgtccragaaaacactgaaatatagcagtcccaaaggactcagaagtcagcattgaaagcttctgtttttgttttgttttgtttagacagagtctcgctctgtcac

SEQ ID NO: 20768 - DNA, 201 bp, Homo sapiens
agggtcaggcagctgcgaccgatctgtctggttcctcaccctgggggtgcccgccgttgggaggtgctgtggttccagggtgggcgctggtcccttcccayggagctcgcctagcacctgttcacaggtgtgcctgggccagatgcatgtctgacagggacatcaggtttggggagactgaaaaccatttttgaaaatgaa

SEQ ID NO: 20769 - DNA, 201 bp, Homo sapiens
aagcccagctccaggtccaggaaaccagattatagcagaccactgtgcccctggccagggaaccgcctgctctggtctggaagccccggggccatgctcgmtgtgttagtcaatgctcttttggttgcatgagatagttgaccaacttaggttagctaaaatagaaaggcagggagggggtgggccagtggtgaattatta

SEQ ID NO: 20770 - DNA, 201 bp, Homo sapiens
agtcaggagggtctgaagatacacgctccactgaagggctgtggctttagcaggggaaaaatggaaagttcgattttcagtaacttttgaagtcattggayagagcatgtgttaccgaccacagacttggacctggaactccccactggcatctagctgagtgtcgtgaactgggacaaactgatctttctggggtgagag

SEQ ID NO: 20771 - DNA, 201 bp, Homo sapiens
gagcgatcaactgggcagctactttgaatgaaaggcattttgctgtgtatctgcctgtccagatagttccttggattctccctgcgcttcttaatgtctgkgccctgttcttctgatttaattagtgcgtgagtatcctttatgtcataatcctgacccgtggctgggatatgtagactgctgggaggggtgagggtgagg

SEQ ID NO: 20772 - DNA, 201 bp, Homo sapiens
aaatgtttactttctggccttttacacaggcagttcgccagccccctaccctacagtatggaaaaaaggcatagaacagtcaaatcacgtaggatttcttrgtttctccatgcaggctcatcgaatagcaaccatcctttcttagtttcttgaaacaagtaccttatttacattcagagaattatatgtggacaaacagct

SEQ ID NO: 20773 - DNA, 201 bp, Homo sapiens
tgccaacaggcacagtcaggagggtctgaagatacacgctccactgaagggctgtggctttagcaggggaaaaatggaaagttcgattttcagtaactttygaagtcattggatagagcatgtgttaccgaccacagacttggacctggaactccccactggcatctagctgagtgtcgtgaactgggacaaactgatctt

SEQ ID NO: 20774 - DNA, 201 bp, Homo sapiens
gatggacagttgccgagtgtcctgcgtgccgactgactaaggagtttttgtctctgtcaccctgtcccctgtggttttatgaagacgttagttatgaatcygtgtttaggatgagaagatgtaaacagtgaggaggataagtgagaagctagcaagagtctggatggtgatggcgggggagcgctggtggaggagtcgggg

SEQ ID NO: 20775 - DNA, 201 bp, Homo sapiens
gaggtcaagactgcagtgagccatgatcatactactgcactccagcctgggtgactgagggagaccctgtctcaaaaaaaaaaaaaaaaaaaagaaagaamagaaatcaccattgataatgtggcatgaatagacttcatgacagacattactccagagatttttatgatgctttattaattaaagtatcatcttcaaagc

SEQ ID NO: 20776 - DNA, 201 bp, Homo sapiens; identical to SEQ ID NO: 3587

SEQ ID NO: 20777 - DNA, 201 bp, Homo sapiens
gttgttggatttaaattttatggatacagcctgatgtagacaaactaattgtggggctgaggtacagcaaactcttttgcctaacatcttgccactgttcyttcccgaaattttagttttttgactgtctccggcaaattgttaaagttgtcaggaaatttttgttttatttttgcaatgaagtcttaccgaagtttcagt

SEQ ID NO: 20778 - DNA, 201 bp, Homo sapiens
gaacacagccctgatgtaaacaatgtgcttgttttctggaagaatgccaaaccagtgtttataccagcattgctgatgccgttgcagctgttgaggctgaygagaacgtgagatgttaattaagagtgttggactcccttttactccaatggaagtattgaatgagcttgtttttggccatccagccagtgcttggttatg

SEQ ID NO: 20779 - DNA, 201 bp, Homo sapiens
cctggcttagggatttatctgcagggactgtccccagtaggtctatgagagcccaccacagcagcagccctctggatggggatttgggtcttggttttgcyagcactcccagtggacagtcatgcctggacttgtcttctccaccttccacttgtcctaacagctgtcgggaccatcatccaccaggggccagctgtccag

SEQ ID NO: 20780 - DNA, 201 bp, Homo sapiens
aaatgtgctaaatgtaagtttgtaaaatttaggaataacttgttagaaaggtgaagaagctctggattgaaaggtatgtgctgaggtcaggagtccagctygctctcctttgaggagatggccttgttttttctttctctctctctctttttttttttattatattttaagttctagggttacaggtgcacaacatgtagg

SEQ ID NO: 20781 - DNA, 201 bp, Homo sapiens
ggtatacatgtgccatgttggcttgctgcacccatcaactcgtcatttacattaggtaattctcctaatgccatccctcccaagccccccgccccccgccyggccccagtgtgtgatgttccccgccctgtgtccatgtcttctcatttttcacctcccacctatgagtgagaacacatggtgtgtttggttttctgtcct

SEQ ID NO: 20782 - DNA, 201 bp, Homo sapiens
gctagagcgatcaactgggcagctactttgaatgaaaggcattttgctgtgtatctgcctgtccagatagttccttggattctccctgcgcttcttaatgkctgtgccctgttcttctgatttaattagtgcgtgagtatcctttatgtcataatcctgacccgtggctgggatatgtagactgctgggaggggtgagggt

SEQ ID NO: 20783 - DNA, 201 bp, Homo sapiens
actttcattgggcccctttgtgttttctagttcagatgtggcttctctagctttttcttgctgctaaatggtcttaaaggtttgagatcagtgtctcagamtttagcctgcgtcaggatcacctcaggtcacgttttaactgagggtgggttaaaatgcagatcactgtgccgggcgcgggtggctcatgcctgtaatccc

SEQ ID NO: 20784 - DNA, 201 bp, Homo sapiens
tttgagacagagtctcgctctgtcacccaggctggagtccagtggtgtatctcggctcactgcaacctccgcctcctgggttcaggcgattctcctgcctyagcctcctgagtagctgggactacaggcgtgtgccaccacgccttgttatttttttgtagttttagtagagatgggatttcaccgtgttagccaggatgg

SEQ ID NO: 20785 - DNA, 201 bp, Homo sapiens
gacttttgtcaccaggaaaagtatttgtttttaaacttaggaaatgaagtacaatgagtgggaggtgccctgaggtgggaaggccctgtggtcactgtgcsgtctctctcattggtgtctgacacacccatccccaccgcaaccgcggggtgtcatcagctgggcccatctccttcccggtgtctgccccccgccccattc

SEQ ID NO: 20786 - DNA, 201 bp, Homo sapiens
tggtaatggggatggctggtaaaggctgtgccggccctgcctccctcccagaagggcgaccctccagccccatgtccaggctctcccatcttcccagctcsggccacacataggcagcagctgcccccatgctctgtcccagagacggaacacactggtcactgggagattagcctccctcattcattttcccgatagaat

SEQ ID NO: 20787 - DNA, 201 bp, Homo sapiens
attttaacaaaaccgttctttaagaggaaaatggagactagagcctagaaagtttcacgtatgtaattacaaatcatttttcctagagaaattttaccccmaaagtgttctgaggctgtgggtgcatttacctgtttattgcggattaacagagccattgaatctatcccaatggaaccaccatcacacactttcacctgt

SEQ ID NO: 20788 - DNA, 201 bp, Homo sapiens
agtgtaatacgaaaaaaaatcatgcaaatcaattaccagtatctggtgtttgaaattgtaagatgctgaaaagaactgttaattatactctgtatctgccrggggaatgtaaactgactttaggattcgaagagaccttgctgatgagagaaggaatcactgctccttttagaggcaatgaaagttgggcctggagtcctt

SEQ ID NO: 20789 - DNA, 201 bp, Homo sapiens
tgtaactcaatagtaatggaatggatggggcagggctgggggtggggaatcctggcagctgagcttaaaaaaaaaaaaagctcagtttcttttttaggaarctggtgccgacatccctgtgcagctgctcaaacgcccccgtgtgcacacatgacttagattggggggatccaggtcacctgtgaccctgagggggtccat

SEQ ID NO: 20790 - DNA, 201 bp, Homo sapiens
tactcatgaactgactcttcctagactccatagaaaggatagaacattcatttgcatttgaagtttcatacaacagtcgtttccataacatatttgacttrtcttaggaagtttctcgcatcttcccttagtttctacaaatgaaaatgtctgcaaagctctcaaagcatgcatcctagtcctatttaattctgacatctg

SEQ ID NO: 20791 - DNA, 201 bp, Homo sapiens
tacgaatgtaaagtcagtgtggccatccagctgaatagtaactctgaagctgggagtaaaatcagatttcagtgtaattgataatcaaagccccttattgstatttttcaaaaacaaagtagcaatactttagcactcacccaggcaattatgatttttggctaatttacttttggtttttgcaatttcaagatacctaga

SEQ ID NO: 20792 - DNA, 201 bp, Homo sapiens
gccagtatcacagagtgaagttctgcacacacacagaacttgaatgtatatgttgcctgtgtacctgccttttcttttttttatttacattagaatttctrtttggctctttttcccttgtagggcatgctgttgaagcgaagtggcaaatcgttgaataaagagtggaaaaagaaatatgtcaccctgtgtgacaatggc

SEQ ID NO: 20793 - DNA, 201 bp, Homo sapiens
gagacgaaaaagatgaggccacggctgccccttctgtttcttccctgcgcactttggggtgaagtgatggggtgttgttggctcaggttgtaggagagatraggagcctccgcccagctcaaatcttcctttttgttccttagagcctgcgttttttgaggtttattatgtaaagccgtgccccttttcctgttggatggt

SEQ ID NO: 20794 - DNA, 201 bp, Homo sapiens
aaatcatctcatcacccttgacttcagccatctagttcctaaccctaaatcagcacctgttaagttggaaattttaccagaaatagtctcagccttgacargcatatgcatatttattttgttttgttttgtttgtttgtttgttttttaaataacgagatggagtctcgctctgtcgcccaggctggagtgcagtggcac

SEQ ID NO: 20795 - DNA, 201 bp, Homo sapiens
atgaggaatagtaatcctttttaagttgtgaagttctttaacctcagaaagggtggctttgtctcatggactttgatattttttgcatagtccttgtaggktgagcctggccagacactggctccaagaggatgtgaggaattcaggctccgagcagatcaggggcatccctaaaggttgggttctggaatcgggtgagtt

SEQ ID NO: 20796 - DNA, 201 bp, Homo sapiens
aagtacactccacagggtgggagcagccggagcataggggctcaagaacccagtaacagaattttctggggtttaaatatcctctagaggtttcccattgkccatttggtgtacaccccatgcaaatgaagtcatggcccccagtcagtctgatttgttgcagaaagcaaccaatccaaggtggaagtgaggttacaaagg

SEQ ID NO: 20797 - DNA, 201 bp, Homo sapiens
ttaatattcaaggtcatggccatcctcaatgcagccttcatattttcataatgaatagttattgtgaaggagctgatttttggaggagtggtttgtctgcwgttgcacacatctgtgataacatggggtgggtggttctgattcctgttttgaggtggtgatttatgatgcctgtgtacttccctgtggtgcccaggcctg

SEQ ID NO: 20798 - DNA, 201 bp, Homo sapiens
gtaatatacttagaaataaattacctgtacactgaaaactacaaagcatcatcgaaagaaattaaagaagacctaagtaaatgaaaagacatcatgttcayggattggaatatggcagtactcttcaaatcgatgtacagagtcggcaaaatcactttcagaatctcagctgcctgtttttttcccagaaatttgacagct

SEQ ID NO: 20799 - DNA, 201 bp, Homo sapiens
tctctcttcactccccctctcctagaatgagctgataaagatgtacgtgagtggtccacagtgtggttttatgcatggattgtttatttgcatcccagcaygttttgtatacagcaggggtccccagtcaggctgcacaggaggtgagcagcttgcaagtgagcattactccccgagctccgcctcctgtcggatcagcag

SEQ ID NO: 20800 - DNA, 201 bp, Homo sapiens
gattgtaaaaccttcagtgagtacgttggatgttgtgaaatttgccaaagagaagaaagatgatttttaaaggatataaaatatggaaataaaaaccactsacaacactgccacccgggggcaatgattgttaaggctcgggtgtgtgtgtgtgtgtatgtgtgcgcgcgcgcgcacacgtgcacctgccgtgtttgaaaa

SEQ ID NO: 20801 - DNA, 201 bp, Homo sapiens
ttatgattacaaatgtcaagggtcggaattactttgatgccaggcaagggaaaaccaccaccatcagcccaagcgcacataagggaggcgggggcatcggrcgtgtgatgcaaagcaggtcacaatccagcgatcttggtataatagggggacattttttttcacttaagtgcaagccaaatgggtcaagtaatcgcaagc

SEQ ID NO: 20802 - DNA, 201 bp, Homo sapiens
acatacctccttagccttgagggcaaatggttccctgagacttgctgatgggccttcctggagacactggtgggtgacacgggacccagtagaaccaggartgaggatttgcagcagtgcgaacttctcagccttagcttctcaggtaatacacagcatctgctctgcccagcacctcggaggggtggagagcgtgaattc

SEQ ID NO: 20803 - DNA, 201 bp, Homo sapiens
gtccctctgtcagtagctatgaaaggcattcctggggatactaaatagtgactgcatatccaattgtccctcacaatttctttcatttttctcagttatastaagtttctgtttggtgttcaaggtcatgtatgaattttcaattaaaagacagcattcttcatttactttgggtttattttaagattaacatgtgtacac

SEQ ID NO: 20804 - DNA, 201 bp, Homo sapiens
ccatgtgtggctgtgacatgtggaggcgaacttccacggcagaagtgccatgcttccgtaagctcttccgactggttggtaggcgcttttatcggcacatragcaccttacagacaaatatctgaagtacacttcaaaggaggcaaagaaaaagcaaaactgccagttccttgagcatggctgtgtgtcgttggtgctctg

SEQ ID NO: 20805 - DNA, 201 bp, Homo sapiens
tgtgtggctgtgatccgtgcgtggctgtgacccgtgcgtggctttggcccgtgcgtggctccggcccgtgtgtggcggttgcccatgtgtggctgtgacaygtggaggcgaacttccacggcagaagtgccatgcttccgtaagctcttccgactggttggtaggcgcttttatcggcacatgagcaccttacagacaaat

SEQ ID NO: 20806 - DNA, 201 bp, Homo sapiens
agatgcgcgcttttggggtcatcaggcggttgcaaaggtgggagcagccgtgctccccagaatgctgacagcacagagcactggtctgaagatctgtgtgyggctgtgatccgtgcgtggctgtgacccgtgcgtggctttggcccgtgcgtggctccggcccgtgtgtggcggttgcccatgtgtggctgtgacatgtgg

SEQ ID NO: 20807 - DNA, 201 bp, Homo sapiens
ggtttcgccatgttggccaggctggtcttgaactcctgacctcaggtgatctgcgcgcctcggcctcctaaagtgttgggattacaggcgtgagccaccaygcctggcccagacacttctgagaacgagctacatcctctgtgccactggattctggctggtccaggaacacaggtgtgcacacatccggatgtgcatcca

SEQ ID NO: 20808 - DNA, 201 bp, Homo sapiens
ggctgaggtgggcggatcatctgaggtcaggaattcaagaccagcctggccaacatggtgaaaccccgcctctactaaaaatacaaaaatttggccaggcrtggtggctcacacttgtaatcccagcactttaggaggccgaggcgggcggatcatggggtcaggagatcgagaccatcctggctatcatggtgaaacccc

SEQ ID NO: 20809 - DNA, 201 bp, Homo sapiens
agatgatttttaaaggatataaaatatggaaataaaaaccactgacaacactgccacccgggggcaatgattgttaaggctcgggtgtgtgtgtgtgtgtrtgtgtgcgcgcgcgcgcacacgtgcacctgccgtgtttgaaaaaaatggactgtcatgcattgtgagactttatagcatactctttcacatacacgtgga

SEQ ID NO: 20810 - DNA, 201 bp, Homo sapiens
tgaaacttttcccaccctgtggttattgatttttgcacggcatttccttgagcaaacagaacagcttttggacccagtctccaattagacatttggttggrtttttatccctctgtatttgatttagatgagtgcttccgtgcatggttttctttactgaaagctgtgtctctgtccttcctaatttcccgaggatccatc

SEQ ID NO: 20811 - DNA, 201 bp, Homo sapiens
gtgcttccgtgcatggttttctttactgaaagctgtgtctctgtccttcctaatttcccgaggatccatctctggaagtgagactgtgtgtccacatcctkcagaatgttaaggctttgaatccttggtgttgactggccttccaggagacctgtcctaattcagcgttctccagcagctgccctttttctgcacctggcc

SEQ ID NO: 20812 - DNA, 201 bp, Homo sapiens
ctgaaagctgtgtctctgtccttcctaatttcccgaggatccatctctggaagtgagactgtgtgtccacatccttcagaatgttaaggctttgaatcctyggtgttgactggccttccaggagacctgtcctaattcagcgttctccagcagctgccctttttctgcacctggccacactgggtatattcattttgaaaa

SEQ ID NO: 20813 - DNA, 201 bp, Homo sapiens
tattgtgaatagtgccacagtgaacacacaactaactgcgtgtgtctttatatagacacaatagaacaattatattccttcaggtgtgtaccaagtaatgycacctacagttttgatgttttagtaaagtagaaaaggaaacttcagaaatcagcccataagtctgcagaagtacttggggaattctctccgcagttcgca

SEQ ID NO: 20814 - DNA, 201 bp, Homo sapiens
gctccatttcatgtgctactggctggctgtgagatctgaaaaggactgggcccagactctgtgtgtgtgtgtgtgtgtgtgtgtgcgtgctcttaaatcartgtaaattaggctatatacagctgccaataatctgcaaaagatgacagtttcatatgattccaatggcttaaactaacaaattcatgaatgattgaccca

SEQ ID NO: 20815 - DNA, 201 bp, Homo sapiens
aatgtcagctcacaaaataatgtttttacatccttcctccaacatcatcaaccgcattagctcaccaccactcctcctctccgcttctcccccaacctgtkttatcggtgtcaggaaaggggagcgatcagtctctcaggaggtacccatattgatcataatatagcctttcttaggcgtagcagtccagcaatcagggtt

SEQ ID NO: 20816 - DNA, 201 bp, Homo sapiens
cctgagatcttttcaggttgcagaactgagtcattgctctgagacccgttccccaggacaactctctctgtgtcacccatggcatcacaggcaccctgggscatgggccctcccgagctgtgcaggttagcttgtgtgccagaaggacctgaggaccagaaaagctgaaagccagcaccacgctgagatcgtggcacacct

SEQ ID NO: 20817 - DNA, 201 bp, Homo sapiens
agaggggcgcaatggggctttgttgtataattgtatagcaagcaagagccaatgtcattttcaaatgcaatccttttaatgccagtctccttggaactgamatttttgatgcaggtacgtagttccctatggaaggggcttaatccaggaatggatttgaatcactagagcctgaagagatggcatgaccttccacgtaat

SEQ ID NO: 20818 - DNA, 201 bp, Homo sapiens
gtttcaccatgttggccaggctggtcttgaactcctgacctcaagaaatccgcctgcctcggcctcccaaaatgctgggattacaggtttgagccaccgcrcctggccttcttttgaatatttttaatccatagttgattgaatctgcacattcagaatccacagataacaaaaggcaactttatatcactgtgtcaggct

SEQ ID NO: 20819 - DNA, 201 bp, Homo sapiens
gggtttcaccaatattggccatggttggccaggctggcctcaaactcctgacctcaggtgatctgcccacctcggcctcccaaagttctgggattacaggmgtgagccaccgtgcccggcctggttaatgcagtttttttagtttgttctttctttttctctttgtctctcctctctctttctttcactcgctttgtcacc

SEQ ID NO: 20820 - DNA, 201 bp, Homo sapiens
ttttgtgattaaaataacttgtttgtaaaaatacaggaaactgtaagacagcaagtaaaaatcacctataatcccacctcctagtaataacacatatatayacacacacatttttttctttctttgtttcttttttttttttgagacggagtctcactgtatcgcccaggctggaatgcagtggtgggatctccgcccact

SEQ ID NO: 20821 - DNA, 201 bp, Homo sapiens
aacttgagcttcaggaataagaggagaccacccactaggagctgggagtggactcagctgttctgggactttcctcaggatcctggtttaggagagacagrcagagccaaggtttgagtctaaggatctctctgaagccctttttcttttatgtcctctctcttccggcctctggaccacattatctcatttaatcttcac

SEQ ID NO: 20822 - DNA, 201 bp, Homo sapiens
tacaggcccacatctgagaatgatggtcttgctgagtgtgaggtaggcctgcctccttgttcccgactctcaggtccctgctgggatgcgccattgcctgygctgggtgctggggcaatggagagggtaagggtgcacccgcccactgccctcagggagcttactgtcagtctaggaggctgcacaaaggatctcatgcag

SEQ ID NO: 20823 - DNA, 201 bp, Homo sapiens
ctgcagactccggcatgggcctgcctagtgtgtctgtcctctgcatttctattgatagcaccagatcccctgcggcccgtggactcctccccactgacccyaacctcattgcatgcttggaggacaggacaagggccaggagacaggatccttccggtccttcatgtctgagatgaggagatagagcaacaaagaacttct

SEQ ID NO: 20824 - DNA, 201 bp, Homo sapiens
ctgagaaatttccaacatcctgtcgtgcacccctagcagagggagatcttttcctccttgttttataaaagaagaaaccgagcctgggagaagggcaggcrtcagccccaggagctctcaggaagacggggctggaattccaggtggaggcagcagcctgcacctggacggggcttagtacagagcctgcagcgcccttag

SEQ ID NO: 20825 - DNA, 201 bp, Homo sapiens
tgtgggtagttgggccctttcccaggcatcctgccacctccttggcagcatctccttggaaccttacagaagccttaggaaagaattgctcccctcttctsccctccccctccttcccctcccgccgcttccctcccctcccccgcccatcctccaggctggagtgcagccttccctccctcgctctatcccccaggctgg

SEQ ID NO: 20826 - DNA, 201 bp, Homo sapiens
acagagtttcactcttgttgcccagtctggagtgcaatggcgcaatcttggctcactgcaacctctgcctcccgggttcaagcaattcttctgcctcagcytcccaagtagctgggattacaggcatgcaccaccatgctcggctaatttttgtatttttagtagagttggggcttcaccatttggtcaggctggtctcaa

SEQ ID NO: 20827 - DNA, 201 bp, Homo sapiens
ctcctccccagccaccctccgtctcccggacttcctccttgaacgtggaacctcaacggctggcctggccgccttgcctgcctggggcaccagccccccaktgctgtgtggctgataccaaagtcttcttttccctcctggtcaccagctcctgtactctctggctcagtgaatgaccccactgggccacgacaactaaag

SEQ ID NO: 20828 - DNA, 201 bp, Homo sapiens
gtggattttgagaaaaaaattgcctttcatggattatcacagtcagtgctaggataattaagctcaaagtggcagattccaatgcttcaggaatgtctgayccctgtaccgagatggtgtggtgagcaggaagatggggtcccaaaagatactcaagttctaatccctggaattgacgaatattatattttgtgtccaaaa

SEQ ID NO: 20829 - DNA, 201 bp, Homo sapiens
gatctgagtgattggcgcctgcattcactcgcccattcattcacctcctgtgcttgtcaccaggctacaaaaacgaagccaccacccctctctggtgccaraatgtcagtttggggaaagctggagctcccttctgagagccaaatttatttttttttatggaagagattcccctgtaaattctgggaaagtttgagagaa

SEQ ID NO: 20830 - DNA, 201 bp, Homo sapiens
atgttataaaaaatacactgtgccattaatgctcgtgcagggctcccggccggcctaggccctctgcacttgagattcctctggcagcatctgtttagaastgggcactcctggttctggtcaagtttatcctgaccagttcatttcatggcagttctggtcatttttgagaaaatctagtttgcactttcattgggcccc

SEQ ID NO: 20831 - DNA, 201 bp, Homo sapiens
aactgactttctaatactgtgttttggctgacatcttagtgtgtgagctttttgtcataattgggtaaaatatctaagccacacgcctatttaatagatgsttttaaaacagaaatattggaggattttacaaagtgtatgaggaaaaatagcattaaagcccgggtgtgtgcgtgacattgccacacattgcctcttagg

SEQ ID NO: 20832 - DNA, 201 bp, Homo sapiens
tagagatggggtttcaccatgttgcccaggctggtctcaaactcttgagctcaggcaatccacccaccttggcctcccaaagtgttaggattataggcatkagccactgcgcccggccccatcaacagctttgagccatttctcatcgtagctcggggcacagatccaggtcctcttggcctttgcaagagcacagtgcag

SEQ ID NO: 20833 - DNA, 201 bp, Homo sapiens
ctttctctccccagggcctgcccttctttgtccttgcactgacagccagcacttatctcaggcctgctggagcccgtgcctgtcagtcctccccctggccvgggccgaggggtggtcagaccagcccgcattgtgctgaaggcccacaatcagcccagctgtccggggccatgatgaattagcggtgggagttaacataga

SEQ ID NO: 20834 - DNA, 201 bp, Homo sapiens
tgaagaattttttttatctcctttctctccccagggcctgcccttctttgtccttgcactgacagccagcacttatctcaggcctgctggagcccgtgccygtcagtcctccccctggccagggccgaggggtggtcagaccagcccgcattgtgctgaaggcccacaatcagcccagctgtccggggccatgatgaatta

SEQ ID NO: 20835 - DNA, 201 bp, Homo sapiens
actgaagagatcatttctatttcagtaccgtctgtagatcctgaaacgggcgcctttctgtgcttgtttgccacgacagtggctctcgtacacgacgcctracgtgtatctcatgtgaaggtgcagcccaagccaagctccctggggctccgttttccgtttcttgaccaaggatggcagaatccccaggaagtgctcctg

SEQ ID NO: 20836 - DNA, 201 bp, Homo sapiens
aagtgcaataaattgtggtttgtttattttagtttttaaccttttagactactttgtgatcggcaggagattgtgtgtgtgtgtgtgtgtgtgtgtgtgtstaggttgcagagtgaggatctggtcagtgattgacacttgttttcaaagtgttcaccatgaattttttttcttaaataccatttttctcagtgagctttg

SEQ ID NO: 20837 - DNA, 201 bp, Homo sapiens
gagtatgacttggatgtacaaactcctaatccctaaggataggaaaagacctagaagatttgaggattttaattcaggaaagtccaccaaaaggataaacmgctaggagcccactagtaagccaggatggtgtggtgcggatcttggatgaggttagctgagtttgaaaactggagaaggcatggatgagagcaatgctga

SEQ ID NO: 20838 - DNA, 201 bp, Homo sapiens
tctcctactttggtggggtgttactgctggggcatgggaacagcggatgagctgggtcagggggatgggggtctagggcttggggagacctcctgtagatrcaggcagtgtctttggttgcgttgtcttgctacagagagcctgatgtatttgtaagaagactaagaaggttttggatgatggtgatcaggtgcttgttcc

SEQ ID NO: 20839 - DNA, 201 bp, Homo sapiens
gagtggacagattttacaccagcacctttcatctcaggggtgcttgtgaattgattgcacccctcctgtggcgtggaggcggtgcctggttaaagtggggmtcagatgccccttggttgcatttaatgtgtgtgcataatcagagggcaaggacagcagtaaataatttatgtcagctggagcccttggccctggtaatga

SEQ ID NO: 20840 - DNA, 201 bp, Homo sapiens
gagcttctgaaatgagcgttaggtgaccctgacctgctgaaggcccctgttcacctgaccaggtgagagatggctcggaagtgagggagaggggagagggrtgcaggttgtgggcctgtaatccttattgatatcagccaccctcaacctgagatgtaaattggaatcacctgtggctctcaagctggcattcagacgggc

SEQ ID NO: 20841 - DNA, 201 bp, Homo sapiens
ctcagcacgtgcttctcagtgcgctgtgtcctcatttgctgtttcccctgaagtttgacgagtatggtatattctggtcaccaggcaggtggtgcttgggkaatatctcctctccgtgtgctggaagcattgcctgattttaatgaggtgactcactgcagctggttttaagaactttgttgcaggtattggttgactgca

SEQ ID NO: 20842 - DNA, 201 bp, Homo sapiens
ttagagttattgcacgggactccccctcaagaaaagaatatcttaagtgagtctggggttgcagttggtccttaggatgtgaagcttagctgtgctttccwcggtcagcagggtctgtcatggggctgaccttcccaatccatgcctttacctgaagctggtgcccatcagcctgggtcacagggtgtcttgcatctgttt

SEQ ID NO: 20843 - DNA, 201 bp, Homo sapiens
gcaaccctgggcctcaggttccccagtggcaaaggtaggataggggctttggtcgcctctgtgctatgagtctttgtccagtttgtcagtcaccatattcrttttactctccagtcttttctataaaagtgtttgggggccagaagttgttaacctggttcactagaagctaatgcattgattatttttgtgtgtgttgta

SEQ ID NO: 20844 - DNA, 201 bp, Homo sapiens
attgtggggtttagggatagattatctctgtccaaggtaatggagtcctcttctattcctcgttggctaaggagttttaatcatgcttctttctcttattrattttttttctttcttctggttgagaaattggacattctacttattttcttgcagaggtttaccacatggacttaatttacttaccaacatgtgaagtga

SEQ ID NO: 20845 - DNA, 201 bp, Homo sapiens
ccccaggaggagaccatgtattacactggccaggtcgggcagccccatctcagccaggttgtgatgctggggccggggcgggcaggcatcagcatcatccrctctccacacctccgaccccatccaccccctccccagctttgtcctctcctctgcctctgggctcagctctggcttctgggagctacctgcctgtttccc

SEQ ID NO: 20846 - DNA, 201 bp, Homo sapiens
ccgttcactgcagtccttcagccttttcatatttgtagttgggaagcaaaatcttctcccaaacctcacctgctgttggggtccaagagaaggaattctartcatgcatttgaccatttgagttgtcagttcagctaagagatcctcctctttttagaccttggggatggggataaaaccctagtttatctgctatccccc

SEQ ID NO: 20847 - DNA, 201 bp, Homo sapiens
aagaagccattgtcagcgtgtcccttggtcatatgtgacttgcgtatggagacgctagtgagaaagatgaaggatgctatccagagtatgtgtcagctcasgctgccaaaataaagtattacacttgggtggcttaagtgcgggacattcacgtctcacagttctggaggctggaagtctggagtcagggtgcccgcaggg

SEQ ID NO: 20848 - DNA, 201 bp, Homo sapiens
atgaagaaggaaaaaaatggccagcagcataggagtgctccccagtgttgctggggagtttcgctgctgctcagcccctgttcagggtcttctggaagctsccagcagcctcctgagacagacaggttggagcaccacagctgcctgcggctggcacacagagtcgtaatttttcttggttttaaaaaccaatccagatct

SEQ ID NO: 20849 - DNA, 201 bp, Homo sapiens
gagcacacatcactcaattttagggacccactcatataaaaagcatctctgatgtacgtgatctaatacaaatgaccctggaggatacatacataatcatratgacttacctataagtctctcctcaaggacctcgaagagctgccacaatgtcttcatgctgatccttgccatcttaatgaaattaggagataactgttt

SEQ ID NO: 20850 - DNA, 201 bp, Homo sapiens
tataaggaaaacaacaaaacaagcaaacatgtttataggtctgcagagaagaagagttcttgtaaacagtgttgaatattcatggttcccaagatcggccrtttccccggcctttcaccggtgagaagtaaggcatctgctctggccagtggcttgcgttccattggtcacccttggcattgcttcacatatgtttgcggc

SEQ ID NO: 20851 - DNA, 201 bp, Homo sapiens
ccaatcatgtgtgagacgctgaattcccaccagtctcctctgaaagggccacattcaagggcctgaaacccccagggagcagaacccacaagccccatctmtggatagttgtgagggggacagaatcttccacttgcagggtctccatcatttttttctgtcctgggttgactccagggcacccagaacaggtgtcatccc

SEQ ID NO: 20852 - DNA, 201 bp, Homo sapiens
gctattgctggttacttgccatttataaaacaaaggatgtctccccagtgagtcaaatgtgacctaagctacttggtcttttgttgactcttcaggtgtgyccagagtaagcattgcctattcccaggtgagtaagccgtatttacttaacagtggtgaaagccagtgactatcaaggtcaaccctatctctgcacatcag

SEQ ID NO: 20853 - DNA, 201 bp, Homo sapiens
ttagtggagtggccgtcacatggcctgagacacaatgtcctcgctcttgatcacagacctatggttgtgctgggtctgccactagggtctaagatgtcacrtaggatgtttgtaaaagtcagatggaggttagctttacaactgctttgtcagaaatatgggtaacatacaaataatcctatcaggaaaaattgtatatcc

SEQ ID NO: 20854 - DNA, 201 bp, Homo sapiens
tgtttttacatccttcctccaacatcatcaaccgcattagctcaccaccactcctcctctccgcttctcccccaacctgttttatcggtgtcaggaaaggrgagcgatcagtctctcaggaggtacccatattgatcataatatagcctttcttaggcgtagcagtccagcaatcagggttcaatggtttcctctggaagg

SEQ ID NO: 20855 - DNA, 201 bp, Homo sapiens
gtgactttttcttccagtcttgtgtacattatcgtctctcacaggacttgagcttggagggagctggagtggccgcttgctgagtctttctccctggagcycgtgggcagctggttacctcgcgctggggcgaccctgacttaggacctcctgccgtttctctgggtgactgctctgtagtcgtgagtcgtctctttaatg

SEQ ID NO: 20856 - DNA, 201 bp, Homo sapiens
agaggggagtgctttttttaaaattcttttctttttttttttttttttttaagacggaatcttgctctgtcgcccaggctggagtgcagtggtgtgatctyagctcactgcagcctttgcctcccaggttcaagtgattcgcctgcctcagcctcctgagtagcggggactacaggcatgcaccaccacacccaactaatt

SEQ ID NO: 20857 - DNA, 201 bp, Homo sapiens
ctgagggcttcctccaaagactcttctctcccctcccactccagcccgtatcggtccctttcaaggacagggtgggtctcagtgccgacaccccaagcggrgctaaccagccagggcctcaggcccgacctccactcagcacgtgcatcacagcactttcctgcagcccccagaatatgcccagggcacagtggctgtcag

SEQ ID NO: 20858 - DNA, 201 bp, Homo sapiens
caggggtttgagtgtgaatgctggtgtccagaggggtcaggggccctgcagccccctctagaagctgtgacttgggaagcaccctcgtgtccatttggacycgtctcaggtgacttgatgtgtgtgatccccccatctctgttctgtggctctctatgggcctggggaaggggtcccaggcatcctcttgaagccatgtgg

SEQ ID NO: 20859 - DNA, 201 bp, Homo sapiens
ggagcctgaggcaggagaatcgcatgaacccgggaggcggaggttgcagcgagccaagatcgcaccactgcactccagcctgggtggcagagcgagactcygtctcaaaaaaaaaaaaaaaaaaaaggaaagaaagagcaggagtgcagagactccaggtcagacttaggaggcctttcaccttaaaggttaaaatcccca

SEQ ID NO: 20860 - DNA, 201 bp, Homo sapiens
acaaacttagatagtggttgagctagcaagtaactagtgagaggaactttagctctatatgcaggagatcagagcacagggagctggccccctggctgacmttccttgtgggctacccacgccttgcaactgaagagcggtaattaaatatatattcatagaagagtggtaaaatctgctttgtccgtggaaatgagctaa

SEQ ID NO: 20861 - DNA, 201 bp, Homo sapiens
tgaggcaggagaatcgcatgaacccgggaggcggaggttgcagcgagccaagatcgcaccactgcactccagcctgggtggcagagcgagactccgtctcaaaaaaaaaaaaaaaaaaaaggaaagaaagagcaggagtgcagagactccaggtcagacttaggaggcctttcaccttaaaggttaaaatccccacacgtg

SEQ ID NO: 20862 - DNA, 201 bp, Homo sapiens
gaggcaggagaatcgcatgaacccgggaggcggaggttgcagcgagccaagatcgcaccactgcactccagcctgggtggcagagcgagactccgtctcaaaaaaaaaaaaaaaaaaaaggaaagaaagagcaggagtgcagagactccaggtcagacttaggaggcctttcaccttaaaggttaaaatccccacacgtga

SEQ ID NO: 20863 - DNA, 201 bp, Homo sapiens
gttgtgtacacagcagggagggtatttggtaggcaggttgctggtggtagtagcactaggtagcataggttaattgtgtaaaatggcttttttttttcttytttctttcttttttttttttttttgagacggagttttgctcttgttgcccaggctggagtgcaatggtgcgatctcagctcaccgcaacctccgcctccc

SEQ ID NO: 20864 - DNA, 201 bp, Homo sapiens
aataattggagcatgaaaatatgtatacatgtggctttaaattggatgaataggaacgcagtaacaagtgaactggggtaggtttaaagcagaacttcaatttttttttttttttttttgagacggggtctcgctctgtcacccaggctggagtgcagtggtgcgatcttggctcactgcaagctctgcctcccgggttca

SEQ ID NO: 20865 - DNA, 201 bp, Homo sapiens
ttttgcaagcataaaccccaggtgtactaacaacagtcatatggctgtaacaggtacaagcagactgtattcataggtcagaaatatataaatgcatgtcmctgtggttgctaattatgggcactcagctgtataacacctgaaatacagtgacgaacaacttcagtcttttgacaagactgatcaaaagctgtgatggag

SEQ ID NO: 20866 - DNA, 201 bp, Homo sapiens
atccccctccacaaaggccagtgctaaacaaggccagagccaggaaggacacgcggggccatggattgagtgagggcagtgtgtgcgtgtgtggatttctstggtggctttgcaatggcaaatatttattttgagggatggtggtgggaggaccaagtttatactcactttgtttagtaggggaagtggctaatgtgagaa

SEQ ID NO: 20867 - DNA, 201 bp, Homo sapiens
tggtctttgaaagggaattcactctgtatgtttggcctaaactgtgttatggccttcatagttacgtattagcattattcagtttttgttgtttgtagcarttatgctgaagacacaaaagaagaaaaaaagctaagtgttgccaactcaaggagtaattttctttgttccagcgctgtgtcctgggagctgcccatcccc

SEQ ID NO: 20868 - DNA, 201 bp, Homo sapiens
ggctgctcaggtggaagggatctctcagccacaaagagggctgcatatccacccagccagaaaggagtggggaaagggtgagtggggtggcacgtcctcaygtcccaggctgcaggcgcattgtgaggaagggcctgggagagccagtctaggtgaggtcagtaagccgtgcttggaagctgggctagagggaccaagagt

SEQ ID NO: 20869 - DNA, 201 bp, Homo sapiens
gtctttaacctctttgctgggacgtcttagacttttggagagcattttgatatttcagactatgatcaactagaaactaagagaaaggatgttacccaccracctgcagtttcatttgtaaccatttaaagaaatttctgcctatgatttatgtgcagctttgtcactaaaaagagagtctgtctttcagaaagatgaagt

SEQ ID NO: 20870 - DNA, 201 bp, Homo sapiens
acactgctataaataaacacctgagactgggtaatttataaagaaaagaggttttgttgtctcactgttccacaagctgtacaggaaatgtgatgctggcrtctgcttggcttccgggggggtgcctcgggaaacttaccatcatggcagaaggcagagggggagccggcacttcacatggctggcggtggtggtgggggc

SEQ ID NO: 20871 - DNA, 201 bp, Homo sapiens
aagtgctgggatgacaggtgtgagcccacctggccctaaaagccctttctaaaggcctccaaacatcctagtgcgtaaggactagatccttacttcctagwgatgtaaggactagaggaaggaggctagtcctaggagcagactagccccacctccccagcgggggagccagcaggtaggctgctgggcaaggacttcact

SEQ ID NO: 20872 - DNA, 201 bp, Homo sapiens
ctgtgagccgggatcgcgtatctgctcctgttctgacgagactgctcctgctggaagttcagcctggtgaacctgatttgggaggggatggtgtgattggyggggaacagcattgtgttaattttagcttcaacaatcaagcctgggtctctgagtgtccatgtagtacttgaagtttgggtttggaattggtgggattga

SEQ ID NO: 20873 - DNA, 201 bp, Homo sapiens
cctggccttctggaagctctgtgcttctgaggggctgagggggatttgggggtcccttttcatagtgtgggctgtctttcccaagatgcagtgatgacccrtcagaggcagggttggtattgtccgtggggtccagtccctctatcttccagggcttttctggtcacaagagaccatggccagaagtgggtatcgtgcttg

SEQ ID NO: 20874 - DNA, 201 bp, Homo sapiens
tttttgtctatctgtttagagaagtgttttttctgttgttgttgttttttaaacttgagatggagtctggctctgtcacccaggctggagtgcagtggtgygatctctgctcactgtaacctctgcctcccaggttcctgggttcaagcaattctccttcctcagcctcttgagtaactgggattacagacatccacaacc

SEQ ID NO: 20875 - DNA, 201 bp, Homo sapiens
cttgctttcagaaagcgtgcagtttatatagcattttcgcttaacaccctcccccaaacaaccaccacccagcaaccttaacaccaatcaaagagcctcartaccctgtatggcctgctttccatgggacaggctgggggtttagatgttcctcatagataaggaatgaatctctgggttggccactcccggattccttag

SEQ ID NO: 20876 - DNA, 201 bp, Homo sapiens
tgcgagagcggtgagctgggcccgtccgacctcacctctggccctctgtcgccgtgtgagattgcggagcccctgttattcatacttcccataggccgtgygtgcaaagcatcccaagcttgtttccgccacccaaggcaagagggtttgagaaggccccaaagaacctaaagtattctgttctctgtaaagcagctgact

SEQ ID NO: 20877 - DNA, 201 bp, Homo sapiens
actgatttcaggtgtgtggataatacaatgatggcggcaagaaagaaagaatgcttttctgttggttgttggaacacatttaaattgccacatggagaaarcacagtgtcttgatttggtggagtggatttagtcttgacaacaatacttcggttagtaaggtgattctgcctagttatctacatccctgagctctgtcta

SEQ ID NO: 20878 - DNA, 201 bp, Homo sapiens
gcctgcgcggcgctggcttttgctcctctggtgccaatgcagctcgttgacagctccaagatatttggatatctcactcttccggctatttcagctgccaractagaatcccaaccttctgagagtctgttctcttttggatttgttcatagatgtctattctctcctgatctggttcatgaacactctggaagccaagtt

SEQ ID NO: 20879 - DNA, 201 bp, Homo sapiens
cggtgagcctgcgcggcgctggcttttgctcctctggtgccaatgcagctcgttgacagctccaagatatttggatatctcactcttccggctatttcagytgccaaactagaatcccaaccttctgagagtctgttctcttttggatttgttcatagatgtctattctctcctgatctggttcatgaacactctggaagc

SEQ ID NO: 20880 - DNA, 201 bp, Homo sapiens
tcccaggaaggagatatacacacacacacacacacacacgtgtgtgtgtatatatatacgtggagatatatatatatatatatatatatatatatatatattttttttttttttttttttagacagagtcttgctctgaagcccaggatggagcgcagtggcgtgatcatggttcacaacagccatgggcttaagcagtct

SEQ ID NO: 20881 - DNA, 201 bp, Homo sapiens
cccaggaaggagatatacacacacacacacacacacacgtgtgtgtgtatatatatacgtggagatatatatatatatatatatatatatatatatatatwttttttttttttttttttagacagagtcttgctctgaagcccaggatggagcgcagtggcgtgatcatggttcacaacagccatgggcttaagcagtctt

SEQ ID NO: 20882 - DNA, 201 bp, Homo sapiens
caggaaggagatatacacacacacacacacacacacgtgtgtgtgtatatatatacgtggagatatatatatatatatatatatatatatatatatatttwttttttttttttttttagacagagtcttgctctgaagcccaggatggagcgcagtggcgtgatcatggttcacaacagccatgggcttaagcagtcttcc

SEQ ID NO: 20883 - DNA, 201 bp, Homo sapiens
gcatgccaccgcacccagctaatttttgtgtttttagtagagagagggtttcaccatgttggccaggatggtctccatctcttgacctcttgatccacccscctcggtctgggattacaggcatgagccaccacacctgtggtttttttattttattattttattatttttattttttaaaccatttatatttttattttt

SEQ ID NO: 20884 - DNA, 201 bp, Homo sapiens
ccagcacctgctggctgctctctgcactgatgacagctgttagggaatcacattcgagactttaactagattggtccagagtgcttcactcttcttctttaaaaaaaaaaaaaaaaacagtaaacgttcttttttagagcagttttaggtcacggcaaagttgagcagaaggacacccacagcctccgccattgtccccca

SEQ ID NO: 20885 - DNA, 201 bp, Homo sapiens
tttaatacaaggaaagatcaaataataaatgataaatgacattgtagggggtccccttgcagcgcatgctctctgcatcccagtggatgccgtctgggccrgccctggaaccagctgtgctgtgagtgaagcccacactggctatgcccatccagaacattcggtgtctttagagtgttctcttgctgtctgggaggattg

SEQ ID NO: 20886 - DNA, 201 bp, Homo sapiens
aatgttgggattatgggcctgagccactgggcttggcttaggaaggctttttgaataattatcttcctcactcttctttccacccactctccattcaaccytgatgaaccctgctggacttcattacatttctgctcacttgacatgcagattgcagatcaggtgggcgggagctgataacattctcacttggcctcagtt

SEQ ID NO: 20887 - DNA, 201 bp, Homo sapiens
gtgttaactgatacacatgtgttagggcagagtccgttgactcaagtataatttaatacaaggaaagatcaaataataaatgataaatgacattgtagggkgtccccttgcagcgcatgctctctgcatcccagtggatgccgtctgggccggccctggaaccagctgtgctgtgagtgaagcccacactggctatgccca

SEQ ID NO: 20888 - DNA, 201 bp, Homo sapiens
aatggaaaggagaagacatatctggaggctttcggaaagtagaatagataggaccgatggacaggttgattcgatgtggaggatgaaggagaaagaagagtttttttttttttttataaatgagggacacttgtgctgaaggtatgtatttgggaatcatacagaaatagccattgaagacatgagagagtgtgagatcca

SEQ ID NO: 20889 - DNA, 201 bp, Homo sapiens
ccatcggtagactccacaaggtaggaactttggaagatgcctggctcccgacacgtttgccaacagttaggcaactggaagtgatcataatgacagccacrgttgggaaggccctgataacctgtaggaattcgggaattccgattcatccggcataggaatgtctgtgtttaaagttggtcttgagcagacgtggataat

SEQ ID NO: 20890 - DNA, 201 bp, Homo sapiens
agcacacacaggctcctacatacgtgtacctttggtttgcctgtattctgaactgaaggcattaaggatgaaaggattggagcacctaccttttgtaggakgattctcttgtactgtctggtccttgttggaacttgtctatttaggctcttcctagttcttccctctaatgcagaacagttgcctcggtgagttcagggc

SEQ ID NO: 20891 - DNA, 201 bp, Homo sapiens
tggatcccttgaccccaggagttctataccagcctgggcaacatagtgaggccccatctgtacaacaaataaacagattagccaggcatggtggtgtgcayctgtggtcccagctactctggaggctgaggtagaaggatcacctgagcctagggaggttgaggctgcagtgaactgtgatctcgccactgcactccagtg

SEQ ID NO: 20892 - DNA, 201 bp, Homo sapiens
actgcgacctccacctccccagttcaagcgattattctgcctcagcctcctgagtagctgggattacaagcaggcaccgtgatgcctggctaatttttggttttttttttttagtagagacggggttttaccattttggccaggctggtctcaaactcctgacctcaagtgatcatcccacctcagcctgtaaaagtacta

SEQ ID NO: 20893 - DNA, 201 bp, Homo sapiens
gagtgatgatgatgctgcactaaaggatcagtaactcactggccagcaggcccatcccccggctctcagttgcttgttcaccttccccgttccctgcccaycagccagtttccaggtagtgtttgactccacagtgagttaagtgagctgccagagagcagtcactgtccaccgaggcttccctgtagttctctgattgct

SEQ ID NO: 20894 - DNA, 201 bp, Homo sapiens
ctgcgacctccacctccccagttcaagcgattattctgcctcagcctcctgagtagctgggattacaagcaggcaccgtgatgcctggctaatttttggttttttttttttagtagagacggggttttaccattttggccaggctggtctcaaactcctgacctcaagtgatcatcccacctcagcctgtaaaagtactag

SEQ ID NO: 20895 - DNA, 201 bp, Homo sapiens
gcctcggtcccttgcatccagcatgtgagtttatttggcagttcttctaaaattacgttggctgagcacggtggcttgtgcctgtaaccccagtgctttgrgaggctgaggtgggagggtgacttgagactaggagttggataccagcctgggcaacctagcaagacctcatctctaaaaaaattaataaatgaaatggaa

SEQ ID NO: 20896 - DNA, 201 bp, Homo sapiens
gtttctggagtgagcagaagcccgggcccccttatgcctgtacgctcagagctcagcctctgcagccacgacttctccatgctgcggggatgctaggcctraagggttgccacctgctgggcatggagtgtccagcctcacccagcccctcgcctggcccttctcccttcctcatggccgctagggcaagccctcacttct

SEQ ID NO: 20897 - DNA, 201 bp, Homo sapiens
gctatacagacttatttaatagaaaaatgacccaaagactccatggagaatatctgtggactattcagtaggcctttttaatgtatcggtacagagcagakctggccaaagccacccctcctcagtgatgagcagcaccaactaagaactaatgcaggtaggccgggcacagtggctcacacctataatcccagcactttg

SEQ ID NO: 20898 - DNA, 201 bp, Homo sapiens
gattttcaatgtgtttccctttggttattccccactcccatgcctgtcctctcttaaaatctctgttgttggtactgtttgtttttggctgttggaactgytgtgatcccccaccacaagcagattaaaaggtataccacattaagaagactccttattgttccaaagcaatggtcctatgtctttaaacaataatattac

SEQ ID NO: 20899 - DNA, 201 bp, Homo sapiens
tcccaagcttctggactaccgtgatgtgggcacttctttttttgttttgagacggagtctcgctctgtcgcccaggctggagtgcagcggcgcaatctcgrctcactgcaggctccgccccgggttcacgccattctcctgcctcagcctcccgagtagctgggactacaggcgcccaccacctcgcctggctaatttttt

SEQ ID NO: 20900 - DNA, 201 bp, Homo sapiens
ctgactgggttcactagctagcctcacgcatcctccctgccgggctgctgtgggctgctgtcctggtcccacatctcctttttgcgcgctttcatgattcytcagacagtctccataggttgcctcaagactctggaagaatgaggttgcatatgcactgtgacttgtatccaggaatattatcctactcaggctggtcag

SEQ ID NO: 20901 - DNA, 201 bp, Homo sapiens
ctcaggcgaaggtttggggacaagactaagctcagctcccagtaactggccctccccttgcctcaatcccttctggaacaacacaggctgtgccagcctgmacagggcagtgcagaatcaggaaaacctggctggggccagagtacccgggcacatcctcgctctcctgggccgcctggggcctgcacctgccgggggatc

SEQ ID NO: 20902 - DNA, 201 bp, Homo sapiens
actcctgacctcaggtgatccacctgcctcggcctcccaaagagctggggattccaggcttgagccactgtgcccggccaggccttttccacttaaacatrtaatatgtccactaaaattttccatgtcttagaatattttcatgtacttaacagcatttaaaagaaaataagtataaatagataaaatttcgacactctc

SEQ ID NO: 20903 - DNA, 201 bp, Homo sapiens
ggcccctttgtgttttctagttcagatgtggcttctctagctttttcttgctgctaaatggtcttaaaggtttgagatcagtgtctcagactttagcctgygtcaggatcacctcaggtcacgttttaactgagggtgggttaaaatgcagatcactgtgccgggcgcgggtggctcatgcctgtaatcccaacactttgg

SEQ ID NO: 20904 - DNA, 201 bp, Homo sapiens
attattgcattagtctatttggcttagagttaattgcttaggcaaggtatttccattagcacagggaagcaagatggctggagtcttattttaaagcacayacaggctcctacatacgtgtacctttggtttgcctgtattctgaactgaaggcattaaggatgaaaggattggagcacctaccttttgtaggatgattct

SEQ ID NO: 20905 - DNA, 201 bp, Homo sapiens
agaaatggagcgctcctccagaaagttcggcaactcacaaaagaccccttaatttctatagcgggcaattcagtccacaaaggaaggaaatcaatgagcgtttacgctctttctttgaggaacctttttttaaagaaaaaaacatttactggcgctttgcatgttttgggtacaagcagtggtagaaacataaaacattaa

SEQ ID NO: 20906 - DNA, 201 bp, Homo sapiens
gttcgccaagctgggtactgttggaagcactttgcttgcatttgtgcagcgattccagcaacaaccctgtgcggtagattattgtcccataaatctataagattgattgattggttatctgtaggagacatctacgtatacgtatttatagagcaatgaagaaataagcccaaggctatcccatgagttaggggcttcagg

SEQ ID NO: 20907 - DNA, 201 bp, Homo sapiens
ttcgccaagctgggtactgttggaagcactttgcttgcatttgtgcagcgattccagcaacaaccctgtgcggtagattattgtcccataaatctataagattgattgattggttatctgtaggagacatctacgtatacgtatttatagagcaatgaagaaataagcccaaggctatcccatgagttaggggcttcaggg

SEQ ID NO: 20908 - DNA, 201 bp, Homo sapiens
cttatatgactggataaaatccaaatactcagctagagagagtggagccgctgtgttgagacaggcactccccctcagcctccccttgtcttcccgggctygtggggtcacctccagcaaacccaatttgaaaaccggtgatcaagtgttgacaactcctgtcacagctgagaaacttaggccttgttcaaggtcacatgg

SEQ ID NO: 20909 - DNA, 201 bp, Homo sapiens
tcgccaagctgggtactgttggaagcactttgcttgcatttgtgcagcgattccagcaacaaccctgtgcggtagattattgtcccataaatctataagattgattgattggttatctgtaggagacatctacgtatacgtatttatagagcaatgaagaaataagcccaaggctatcccatgagttaggggcttcagggc

SEQ ID NO: 20910 - DNA, 201 bp, Homo sapiens
gggattacagccgcatgccactatgcctggctaatttttgtatttttagtagagacggggtttcgccatgttggccaggctggtcccgaactcctgacctmaggtgatccacctgcctcggcctcccaaagtgctgggattacaggcatgagtcaccatgcctggccacttaaaattttggggggtatcgagaagaaagaa

SEQ ID NO: 20911 - DNA, 201 bp, Homo sapiens
cgccaagctgggtactgttggaagcactttgcttgcatttgtgcagcgattccagcaacaaccctgtgcggtagattattgtcccataaatctataagattgattgattggttatctgtaggagacatctacgtatacgtatttatagagcaatgaagaaataagcccaaggctatcccatgagttaggggcttcagggct

SEQ ID NO: 20912 - DNA, 201 bp, Homo sapiens
caggccttcatcaatcagaaggcagtggcagcgacagcaagacaggcgggtcaggcccccagatgagatttgtgaggctgcggcatcgattctgaccacayattctggaaaaattatcatcctacaccaccttctgaagcagtcaaggtttgggttattacctggaccagcacccggcttttacataggaccttctcctgg

SEQ ID NO: 20913 - DNA, 201 bp, Homo sapiens
agagagtggagccgctgtgttgagacaggcactccccctcagcctccccttgtcttcccgggctcgtggggtcacctccagcaaacccaatttgaaaaccrgtgatcaagtgttgacaactcctgtcacagctgagaaacttaggccttgttcaaggtcacatggagaaagaatattgcatggagtagaccccgctcctcc

SEQ ID NO: 20914 - DNA, 201 bp, Homo sapiens
actagagacggggtttcaccatgtttaccgggatggtctcgatctcctgaccttgtgatctgccggcctcggcctcccaaagtgctggggttacagatgtragccactgtgcccggcccagaaccacattcttgagctgagctcccgagggtacctggtgatgtagaaggaagttggcttaactgggggcgctgcagcagc

SEQ ID NO: 20915 - DNA, 201 bp, Homo sapiens
tccttgcctgccttccttctcctctcttgcccccaggcgcatccctgatcgttgctgccattctagaccagtctttcccacatttgagtggtgtggaacctttttttttttttttttgagacagagtttcactcttgttgcccagtctggagtgcaatggcgcaatcttggctcactgcaacctctgcctcccgggttcaa

SEQ ID NO: 20916 - DNA, 201 bp, Homo sapiens
atagatataaaagttatatttattaaacatttaaattaataccattaatttactgtgcatttaatgttaaggatgatgatgttttgctgaaacaaaatgayggccatccgtgccaggggttagggatgacggttgcagggcaggctcctttggtgtcagctgcctcgtgactgtatcacgtggtgaccccagtctcttcct

SEQ ID NO: 20917 - DNA, 201 bp, Homo sapiens
ctccaggaagatccttaaaagctgccctgtgatccttctgctctcatcctgctggccagagcttgtgtacctggccatgttcagctgatgcgggggtgggrggacgggaggaggctctggcaaatgtcatgtttattctggttgtcatttgcccacctaagaaccaggaatgctattactgcgaaagaaggaaataacaga

SEQ ID NO: 20918 - DNA, 201 bp, Homo sapiens
gcctcaaaaacactacatatcagccagacacgatggttcacgcctgtactcctagtgctttgggaggctaaggtgggaggatcacttgaggcaaggagttygagaccagcctggccaacatagggagaccattgtctctacaaaaaaatttttaaatagccaggtgcatggttcacacctgtagttccagctactcaggag

SEQ ID NO: 20919 - DNA, 201 bp, Homo sapiens
tctggccagaccattttgaacatactggaatagaggcaaagcagggaggaggccagccagggtcggcttggccgggaagggagacaggagcccaggactgytccagacaaaagggaaaggaagcgccccctccaagagtccactcagcagcatagcaggcaggggagagatcaaaagtctgtctgcggcctctctggaagc

SEQ ID NO: 20920 - DNA, 201 bp, Homo sapiens
caaagggaaaaggcagagtttgacaattcaggagaaagaggcgataccaagcacgcatttgctaaatgtgtggtctgtgtcagcccggtgccaaaccctcmcatgcgctgtcttttcattctgcaaccctagtagttggtgcccctgtgggccccacttaaaggggaggaattgaggagcctgaagggtcaagtcatttgt

SEQ ID NO: 20921 - DNA, 201 bp, Homo sapiens
gcctgtagtcccaagctactcaggaggaaggagggaggatcacttgagcccaagagttcaaggccacaaggagctatgatagcatcactgcactccggcctttttttttttttttttttaaagttttaattcagcctaatttagttcctcagaaagctataaaatgatgtcttcacatgcctcccgattagactgtttccc

SEQ ID NO: 20922 - DNA, 201 bp, Homo sapiens
ttgaatctgcacattcagaatccacagataacaaaaggcaactttatatcactgtgtcaggctagtagtaatagtcacagcagcagcagcagcagcagcavtattttttggtagagactgggtctccctctgttgcccaggctagttttgaattcctggcctcaagcaatctgcctaacctcgccttcccaatgtgctagg

SEQ ID NO: 20923 - DNA, 201 bp, Homo sapiens
acttcagctgggtggtggccctgggatgtcactttccttcccacttaattgctttggatttctctttcctttctcgtcatcccccaaaagtgtctttgccttttttttttttttttagccctgagccccaagctcagtccttacatagattgtttaggagaccagtaatccctagttcctttgacttgcagctcagcctca

SEQ ID NO: 20924 - DNA, 201 bp, Homo sapiens
cttcagctgggtggtggccctgggatgtcactttccttcccacttaattgctttggatttctctttcctttctcgtcatcccccaaaagtgtctttgccttttttttttttttttagccctgagccccaagctcagtccttacatagattgtttaggagaccagtaatccctagttcctttgacttgcagctcagcctcac

SEQ ID NO: 20925 - DNA, 201 bp, Homo sapiens
caggatgatggggtccctgcacttccatgctgtgtaggttgagagaaggaggtatgggcacaggaggaagtgatggtagatttccactgtagttattccctttttttttttttttttttttaagacagtcttactctgtcccccaggctggagtgcagtggcacgatctcagctcactgcaacctctgggttcaagtgatt

SEQ ID NO: 20926 - DNA, 201 bp, Homo sapiens
aggatgatggggtccctgcacttccatgctgtgtaggttgagagaaggaggtatgggcacaggaggaagtgatggtagatttccactgtagttattccctttttttttttttttttttttaagacagtcttactctgtcccccaggctggagtgcagtggcacgatctcagctcactgcaacctctgggttcaagtgattc

SEQ ID NO: 20927 - DNA, 201 bp, Homo sapiens
ggatgatggggtccctgcacttccatgctgtgtaggttgagagaaggaggtatgggcacaggaggaagtgatggtagatttccactgtagttattccctttttttttttttttttttttaagacagtcttactctgtcccccaggctggagtgcagtggcacgatctcagctcactgcaacctctgggttcaagtgattct

SEQ ID NO: 20928 - DNA, 201 bp, Homo sapiens
caaactcaagctaatggagttagttggatttctaaggaaaacgctgtcctgaagttgaagctactgggtgtaagactaaaactgaggctcaaaaaaaaaaaaaaaaaaaaaaaacacctcagttaattcatctttctttctcaagatgctattattaaatgaaaccaaaacccagttgagataacagatagaaaactcaac

SEQ ID NO: 20929 - DNA, 201 bp, Homo sapiens
aaactcaagctaatggagttagttggatttctaaggaaaacgctgtcctgaagttgaagctactgggtgtaagactaaaactgaggctcaaaaaaaaaaaaaaaaaaaaaaaacacctcagttaattcatctttctttctcaagatgctattattaaatgaaaccaaaacccagttgagataacagatagaaaactcaacc

SEQ ID NO: 20930 - DNA, 201 bp, Homo sapiens
aactcaagctaatggagttagttggatttctaaggaaaacgctgtcctgaagttgaagctactgggtgtaagactaaaactgaggctcaaaaaaaaaaaaaaaaaaaaaaaacacctcagttaattcatctttctttctcaagatgctattattaaatgaaaccaaaacccagttgagataacagatagaaaactcaacca

SEQ ID NO: 20931 - DNA, 201 bp, Homo sapiens
acaatgcagtaatgatagaaataaggtgcacaataaatgtaatgcatttgaatcatcatgaaaccatccccctgcctcccttcagtgggaaaattgtcttycacgaaaccggtccctgatgccaagaaggttagggaccactgcagtaaaggaccccttctttgactggcttcattcagtcagcatgatgatttttagggt

SEQ ID NO: 20932 - DNA, 201 bp, Homo sapiens
gcctgtaatctgagctcctcgggaagctgaggcaggagaatcgcttgaacctgggaggcggaggttgcagtgagattgcgccattgcactccagcctgggyaacagatctagactctgtctccaaaaaaaaaaaaaaaaaaggttgttttgtttggtaaacagaaaaggagccatcttaagataatgcatctttatttaac

SEQ ID NO: 20933 - DNA, 201 bp, Homo sapiens
gccttgtgaagcctcctctccatgtaggaacggggggcattttggttagctgggttaggcttgctgaattttaacatgacatgcttgcttttcctgtgttsgtgtgtcgcttctctcccttgggcccccgcccctaacttttccacctgatctctgacttctccatctttctaacccctgaacaacaactagagataagtt

SEQ ID NO: 20934 - DNA, 201 bp, Homo sapiens
gatcagtgtctcagactttagcctgcgtcaggatcacctcaggtcacgttttaactgagggtgggttaaaatgcagatcactgtgccgggcgcgggtggckcatgcctgtaatcccaacactttgggaggctgaggcgggcagattgcttgaagtcaggagttagagaccagcatggccaacatggtgaaaccccgtctct

SEQ ID NO: 20935 - DNA, 201 bp, Homo sapiens
aattttaacatgacatgcttgcttttcctgtgttcgtgtgtcgcttctctcccttgggcccccgcccctaacttttccacctgatctctgacttctccatctttctaacccctgaacaacaactagagataagttcaaggtcactgctggaactgacctttgggtgcttgggccacccttaggccttgagaggcacaggct

SEQ ID NO: 20936 - DNA, 201 bp, Homo sapiens
aatcccagctatttgggaggttgaggcaggagaatcccttgaacccaggaggcagaggtcgcagcgaactgagatcgcgccactgcactccagcctgggcrgcagagcaagactccgtctcagaaaaaaaaaaaaaaaaaaaaaaaagaaatgcagatcactgggctccacccccagaagttctgattcagtgggtggcgg

SEQ ID NO: 20937 - DNA, 201 bp, Homo sapiens
cacctggtggcctgtgcactttgctgtgacgtgggctgcacgtctctccccagcatgggctcaaggtgctcaggaaccaaaccccggtgtctcatccaggmctggacacgtggtgagagctccatggagcttaactgcatgagggaggcgggatggactctggcttgtagggcacagtctgtgtagcaacaaggaacatac

SEQ ID NO: 20938 - DNA, 201 bp, Homo sapiens
tggagttagttggatttctaaggaaaacgctgtcctgaagttgaagctactgggtgtaagactaaaactgaggctcaaaaaaaaaaaaaaaaaaaaaaaacacctcagttaattcatctttctttctcaagatgctattattaaatgaaaccaaaacccagttgagataacagatagaaaactcaaccaaataatgaatga

SEQ ID NO: 20939 - DNA, 201 bp, Homo sapiens
aaaatcagacagaagacccacttctttactgatgtaaagacaacaaaaagatctgtgatgattcctaagtaggtattttcctcaaaagaaatcattcaagaaaaaaaaaaaaagattgctatgagaatagcagctcgtggctgtgctcagtgcctgtaactgcctttgtaaatacacgaattcctcacataggactgcaac

SEQ ID NO: 20940 - DNA, 201 bp, Homo sapiens
gtattgtgaacacatgcataggaccatacatacatcatacacacacacatacacacacacttaaacatacacatacacatgcacatgtacacacacatacmcacacacagctatgggcacaacttcatttcaacttgtagattgtgaagtaaaggcattggaactttgtggcttgcaaatctaaattacctccttccatct

SEQ ID NO: 20941 - DNA, 201 bp, Homo sapiens
gcgatttatgttcattaagtgcttgtcaaaactgaaaaattttctaatcaacagcaatctagctgcagccccctcgatggctgggagggccgcctctgccrcatcggctatttgcctgttacaactctaggctaaaaatccgctgatgattacattaggctaagctgcgaagtaaatgaaccatgtcttatttaggtgcca

SEQ ID NO: 20942 - DNA, 201 bp, Homo sapiens
tgactaccatatacatgcctcccccatttaaaaaaaaaaaaggtgggggaagagaaggaggaaaaagcagaaaatgtcatgcgtttgcagaggacaggttccccccccacccccacccccgcctgtgctacaaagtgaaaaatggctttgcaggtcaaccctaatgacttatcatgtcagaattgctacctcaagtgggaa

SEQ ID NO: 20943 - DNA, 201 bp, Homo sapiens
gagagcacgtgtttggcccggcgcagtggctcatgcctgtaatcccagcactttgagaggctgaggcaggcagatcccctgagcccaagagttcaagaccyatctaggcaacatggtgaaaccctgtctttacaaaaaatgcaaaaatttagctgggcatagtggcgagtgcctgtggtcccaggggagactgaggtggga

SEQ ID NO: 20944 - DNA, 201 bp, Homo sapiens
tccgtggcttcccagtgctgcacgggatcgcagtgaggccgcttgtttgaggggagacctggttcctgcctctggcttctcatccatatcaccggagtgcttttgaaaatgcatcttttcccaagccccattcccagagcttctgaatcaaaatctgtattttttgaagccactagttctaaaaagctccacaggaaattc

SEQ ID NO: 20945 - DNA, 201 bp, Homo sapiens
gatctggacaatgaaagtttcgcttccttggccccttccagctgcggttgctgcgttgcacagtaattcagtaagaatccttcccaaagaaaggaaagccrgtttctggtttgcaagagggtcactgcagccaacccagagcagtgcctgatcctcagggtgctttccacacagcttctcagagcatccgcctggcggcac

SEQ ID NO: 20946 - DNA, 201 bp, Homo sapiens
ctagcttcaaattaggaataggtagtacagtataaaaagatttgtcaatttgagaccaacctgggcaacatggagagaccctatctctactaaaaaaaaawttcatttaattagctgggcctagtggtgtgcgtctatagtcccagctacccaagaggcacatatatttgaagatttgtcaaatatatgtgctgcttctcc

SEQ ID NO: 20947 - DNA, 201 bp, Homo sapiens
tgttagaataacattggtcaaatctttttcatttcctccctcacttccttttgtagattttataaacacatgcaaaaaggcaaagacctaaaggacttaattttttttttttttttttttttttgacacagagtttcactcgtcacccaggctggagtgcagtggcacgatcttggctcactctgaggttcaagtaattct

SEQ ID NO: 20948 - DNA, 201 bp, Homo sapiens
ggctctcatttctctgtttccaggctgctgatttattttcttgcttcatccctttggtccggccaagactcacctggggcaccaggtggcatgtgcgtggrcagtgtggagtcatatcttagccacagttgatcagcactttctcccttctcagcgctgttggccagtgatggtaaaaagcctgcagagtggcttgtccat

SEQ ID NO: 20949 - DNA, 201 bp, Homo sapiens
cagacatggattttattcgaaggatgtgggggtggctttgagcatagaggcgttgggatggactgaaccatgggcccaggggacaggcacaggctgcctgkgtatttagggcactgcttgggttgcctggagagtggtttattggcccagattctgccacttcttggccaggggaggcctttcatggacagcctcatcaga

SEQ ID NO: 20950 - DNA, 201 bp, Homo sapiens
gcgtcatgggtatcattttgtgcatctgcccttgttcagtgtttccttgtaattttgcggaaaaaagtctgcttagtgttgaaccagacattctgcagccyttaaaagagaatggaaatggagagattgtgatgtgttcattggtgacttttgacacggatgctaacctgtaagatgtgcagatatatcatgtgcaaactg

SEQ ID NO: 20951 - DNA, 201 bp, Homo sapiens
ttacacatctcacccaattcaggtaagcttacagcaaatgcactaacaaatcaagttcaacagcaacaggtggtccaggctcgaggataatgttggactcytaggttaagtggagacagtaactatcacattacagattaaggtttagaaacctgatcacttctgtggctgatcatttcctttaaactttcagttccgcaa

SEQ ID NO: 20952 - DNA, 201 bp, Homo sapiens
tagggatgtttagtttgaaactttaatttaaaaagtgagtgcagtgagtctgtctttgtagcgctagagatgggtcctcagctggccatgatagagaaggrtgggcagaggcgggtgtttgagacttggaggggacagtgggggcacagcagccaggcagaggcatgtgtcagggcagagtgagaatgctaggatcctggc

SEQ ID NO: 20953 - DNA, 201 bp, Homo sapiens
tcatgggtatcattttgtgcatctgcccttgttcagtgtttccttgtaattttgcggaaaaaagtctgcttagtgttgaaccagacattctgcagcctttraaagagaatggaaatggagagattgtgatgtgttcattggtgacttttgacacggatgctaacctgtaagatgtgcagatatatcatgtgcaaactgtta

SEQ ID NO: 20954 - DNA, 201 bp, Homo sapiens
gcagagcctatcccgtgtccagtaaagcagacagcattccagtgttatctggaattatttacaaacgcagtgtccacaatacgatgaatcacaacttacartttagttagattaagcgaattataatttttaatagtcagtgaatattttcacctgcctagatggggagcaaggctctgaatcctctcttgccccagcccc

SEQ ID NO: 20955 - DNA, 201 bp, Homo sapiens
ttgcaggttatgtgacaagaatcatatcatttggtgtgtgtgtatgtgtttatttatgagacagggtctcactctgttgcccagggtggagtacagtgccrcaatcgtagctcaccataacctcaaactcctgggctcaagcaatcctcccacctcagcctcccaggtagctaggactacaggcgcacaccaccacacctg

SEQ ID NO: 20956 - DNA, 201 bp, Homo sapiens
ctgggtgaggcaagcatggcatgagcagattggtttttgtaaagtgcctgatgtgcagtcaaatacaggaaggccccttctttcatacatgcacgttgagytccctaaacccaaaatccaaaatccgaagggctccattgagcattgccttttagcgtcatgtcggcactcaaaaattttcagatttcagaacatttcgga

SEQ ID NO: 20957 - DNA, 201 bp, Homo sapiens
tcaaatatccagtctgtgcccacatttccagttgtctcatgattaccataacttttcccttcagtttgcctgttggaatcaggatcaaatactgtgtgcaygttgcagttggtggagacttcttctgaaactcctccaatgagtaggttccatgaccgtctttctctccttcccggggcctgtgtttgtttcgaatgcctc

SEQ ID NO: 20958 - DNA, 201 bp, Homo sapiens
tttggtttagtagactccgtttaaaattgactaattagttttagatcattgtgaactctctggattaaatgtacatggtgcattgcggtggaagctgttayggatgctccagtgatcccatcttctgcgtgtggaagcatttcaggaagccttctgtgttctcttgacatgacattgaccacttcctggatttctgatgtc

SEQ ID NO: 20959 - DNA, 201 bp, Homo sapiens
tggggatctaggctttgctcacctgtgctgcatggtgattgttgtgaattttgaaagggactgcttcccatcggtgcctgagtcaaggcctaggacttgayggatggtgcctggcagggtcagctgcttggtgcaggttcctgtgcccatgtcatggtacgtgctgtccgctaagctccctcccagcccttagtggtcctc

SEQ ID NO: 20960 - DNA, 201 bp, Homo sapiens
gccagggtgtgggattgtgcccggcttccccatccttccagtggggatgacgacaggcatttgctgagttccatgggactgtggaaagggctgtgtcactrtagacgctccatcggaaatgctgatgtgtattcttaccacgggcgtccgtgggccaccattgtctcctggcatctggctgtccttggaacccagcaacac

SEQ ID NO: 20961 - DNA, 201 bp, Homo sapiens
cacatggatgagttgctccctcctataaagtaggaaaacatgcttaccgctggagaggatgcctaacaacagctcctgctgcccagcgaggaagggacccygtgtccaagagaaaacctgatggcaggtaacacatcacccctctcttttagggacctcatccctttcttttagggaactcattggcttgtcttggaccca

SEQ ID NO: 20962 - DNA, 201 bp, Homo sapiens
gttagaataacattggtcaaatctttttcatttcctccctcacttccttttgtagattttataaacacatgcaaaaaggcaaagacctaaaggacttaattttttttttttttttttttttttgacacagagtttcactcgtcacccaggctggagtgcagtggcacgatcttggctcactctgaggttcaagtaattctc

SEQ ID NO: 20963 - DNA, 201 bp, Homo sapiens
ttagaataacattggtcaaatctttttcatttcctccctcacttccttttgtagattttataaacacatgcaaaaaggcaaagacctaaaggacttaattttttttttttttttttttttttgacacagagtttcactcgtcacccaggctggagtgcagtggcacgatcttggctcactctgaggttcaagtaattctcc

SEQ ID NO: 20964 - DNA, 201 bp, Homo sapiens
tagaataacattggtcaaatctttttcatttcctccctcacttccttttgtagattttataaacacatgcaaaaaggcaaagacctaaaggacttaattttttttttttttttttttttttgacacagagtttcactcgtcacccaggctggagtgcagtggcacgatcttggctcactctgaggttcaagtaattctcct

SEQ ID NO: 20965 - DNA, 201 bp, Homo sapiens
agaataacattggtcaaatctttttcatttcctccctcacttccttttgtagattttataaacacatgcaaaaaggcaaagacctaaaggacttaattttttttttttttttttttttttgacacagagtttcactcgtcacccaggctggagtgcagtggcacgatcttggctcactctgaggttcaagtaattctcctg

SEQ ID NO: 20966 - DNA, 201 bp, Homo sapiens
gaataacattggtcaaatctttttcatttcctccctcacttccttttgtagattttataaacacatgcaaaaaggcaaagacctaaaggacttaattttttttttttttttttttttttgacacagagtttcactcgtcacccaggctggagtgcagtggcacgatcttggctcactctgaggttcaagtaattctcctgc

SEQ ID NO: 20967 - DNA, 201 bp, Homo sapiens
cagcctgtttctacaaatctgcctttttcttctaacatatgggttaactaccatttctctttgctaattttacaataatatctttgcattttcccctaataaaaaaattaaattttagaaacatttaaaatgcagttaagctttttggtttctaaaaaactcagtcctacacaaagctcttagattcgggagtgggtacct

SEQ ID NO: 20968 - DNA, 201 bp, Homo sapiens
ctcctgtgagactctaatgccgccgctgatatgacaggaggcggggctcaggaggtggtgtgagcttatggggagcagctgtaaatacagatgaagcttcbctttgcttgctcacacgctgctcacctccagctgtgtggccctgttcccagccagccacggatgagtaccagtccacgtccctgcggttggggacccctg

SEQ ID NO: 20969 - DNA, 201 bp, Homo sapiens
cgtttttatttcccattcttgaagctgagctctggggctcaagcacttccagcaaagcagtttgactttctagcaagaggatgtggttgcattttcctttytcccttaaaagaaaaaaaaaatgcgtcgttcctagatgatggttttttttgacagcacgatgcctacctttgcgatttgagattttaggccccttcttgg

SEQ ID NO: 20970 - DNA, 201 bp, Homo sapiens
cagggtgggagctgaagtgtaacaggcatgtcggctccagcgacacacagcttggacatccttacacaccgttggtgggagcagcacagaacttcggctcmgcagcatgtatccagagccccacgaatgctcatgttcatgagcctgtgtctcaaaagctgccccaaagtcataatcctaattactgaaaacacacagaag

SEQ ID NO: 20971 - DNA, 201 bp, Homo sapiens
tgttatcaataatgataccacttttcatttctgtagaactttaacagaaatatttttgcatgtatagtctcattgtgtggcttcaccaaccctgtgagggwgggtgggtagcttcctcatcctcattttatggaggagcgggtggaggttcagggagggataatgacctccttaacatttgactgaggtggtttgaagtct

SEQ ID NO: 20972 - DNA, 201 bp, Homo sapiens
acactgccaaataggtaaattaaggtgtgggtggaagtcagcaggggcagggggccgatacatacgtgcttagcattttcctctctcttttcttttgtctktcttttcctttttttccatatagatgcatgcttcttatgaacatgttttaaagcattttgtatctttaatcaacatgtagaaaatgaacagccaaccctt

SEQ ID NO: 20973 - DNA, 201 bp, Homo sapiens
tttcagagcgcgtggaggtgggtctgggttgtaaaatctcttaacgatggactaaacatattttagttgaaaggcccaccaaggctcccaaataaaaacasatccgtaatcctgtttgtaggcatgggatacaggtgattttgccctcagtcttgttttaaaacactagcttgtcagaagagaacagttttttttccccaa

SEQ ID NO: 20974 - DNA, 201 bp, Homo sapiens
aataagttatgagtgtccttgggcctgtctgccggaatgatagctaagaatacattcctggcccatcagtctcaagcaggctgcttgatatttatgcggayggaatgttattttattccccctctagtcatgcttgtcagctctccgagtgaaaagtgaaactgcttctttgactcatacttcacgttccgaagctcggag

SEQ ID NO: 20975 - DNA, 201 bp, Homo sapiens
aaaacagatccgtaatcctgtttgtaggcatgggatacaggtgattttgccctcagtcttgttttaaaacactagcttgtcagaagagaacagtttttttyccccaatttttgttttgtacattgagaggtttattcccccctcccttcacccccaaatcactagagtttaaggaagcattgctgattgttccagatttat

SEQ ID NO: 20976 - DNA, 201 bp, Homo sapiens
ggcacttggcaggagaaccctgccctgcacttcttaagggcatttccacagggagattccaggaccccttagtagtatctcagccccagtgtttgggggasctgggaagatgggtcagggttccccactttgtcccatgatacagctgctctgttgagcatgtgtgtcccacagagtgcggagtgtctgaggtgcatcatc

SEQ ID NO: 20977 - DNA, 201 bp, Homo sapiens
ttgaatgaaaggtggcaggtttgcagtcccctccttaaaaataacactcagttggcttttagttgcttccaggtgagctctcgtaccttgccggcacccgrgacctccacaatgcgggcgttccttgtgagtccagcttactcatgcttctcagttgtggtgcaggtgctctttgagatgccgccttctctgcctgttgct

SEQ ID NO: 20978 - DNA, 201 bp, Homo sapiens
gaatgaaaggtggcaggtttgcagtcccctccttaaaaataacactcagttggcttttagttgcttccaggtgagctctcgtaccttgccggcacccgggrcctccacaatgcgggcgttccttgtgagtccagcttactcatgcttctcagttgtggtgcaggtgctctttgagatgccgccttctctgcctgttgctca

SEQ ID NO: 20979 - DNA, 201 bp, Homo sapiens
gcaggtttgcagtcccctccttaaaaataacactcagttggcttttagttgcttccaggtgagctctcgtaccttgccggcacccgggacctccacaatgmgggcgttccttgtgagtccagcttactcatgcttctcagttgtggtgcaggtgctctttgagatgccgccttctctgcctgttgctcaccctgcgaggct

SEQ ID NO: 20980 - DNA, 201 bp, Homo sapiens
ccttaaaaataacactcagttggcttttagttgcttccaggtgagctctcgtaccttgccggcacccgggacctccacaatgcgggcgttccttgtgagtscagcttactcatgcttctcagttgtggtgcaggtgctctttgagatgccgccttctctgcctgttgctcaccctgcgaggctcggtctctgttggtgtca

SEQ ID NO: 20981 - DNA, 201 bp, Homo sapiens
caatacagtaatgggatgttatttgcagggcctgtgtggtatgagaggagcgtggctgtgctgtttctgcgcattctgctttgtaagtgctcactctgcatttttttttttttttttgccttttccggtccaatggcagacacagggctgggtgactccgtatgctccagccccagtatctccagcaccaccagccccaag

SEQ ID NO: 20982 - DNA, 201 bp, Homo sapiens
aatacagtaatgggatgttatttgcagggcctgtgtggtatgagaggagcgtggctgtgctgtttctgcgcattctgctttgtaagtgctcactctgcatttttttttttttttttgccttttccggtccaatggcagacacagggctgggtgactccgtatgctccagccccagtatctccagcaccaccagccccaagc

SEQ ID NO: 20983 - DNA, 201 bp, Homo sapiens
aaggggacatctctcttgaaatttttttggacttacggacatttaattcagatgcagtgaacccagtttttctgttcattttaagattgatatgctttttytttttttggatgacagaagtgtatttgtggggtttttttgttgttgtttttgtttttttttttttgggatatgatctcactgtgttgtccgggctagtct

SEQ ID NO: 20984 - DNA, 201 bp, Homo sapiens
tcagttggttttctgcagaagccatgatatactgtaggcatggttaccagaacacccctaagagagctgaccagaatttctaagttcatgttccatgcgtmcacacacacacacacacacacacggtgttattttttttctttctgaatttcatgaaaataaaatattttctaccagaatacacatttagtgatgcctctt

SEQ ID NO: 20985 - DNA, 201 bp, Homo sapiens
tgtggctgagacctgtggacagagcccagcagggctgacttatctgtcagagcttcccaaggcaccaggtgctgctaggctttctcgagaattaaacccartggagatagtgttattcccactgatgctgttagctaaagtgagtctcgggcagcccagggtcagtgtgggaggatttatttatacagggacaccagtgcc

SEQ ID NO: 20986 - DNA, 201 bp, Homo sapiens
cagttggttttctgcagaagccatgatatactgtaggcatggttaccagaacacccctaagagagctgaccagaatttctaagttcatgttccatgcgtacacacacacacacacacacacacggtgttattttttttctttctgaatttcatgaaaataaaatattttctaccagaatacacatttagtgatgcctcttt

SEQ ID NO: 20987 - DNA, 201 bp, Homo sapiens
ctagggtataaacctaggagtggaattgctgggtcatatggtaactctgttcaacttttcaaggaaccaccaaattctttttttttttcctttatttcttaaaaaaaaaaaaaaatagatgcgcagattgtgcaggtttgttacataggtatacatatgccatggtggtttgcggcacctattgacccatttctaagttcc

SEQ ID NO: 20988 - DNA, 201 bp, Homo sapiens
ctccttttcaattgtttggaatagtttcaaaaggaatgataccagccctttgtatttctggtagaattcagctgtgaatctggtcctgggctttttattgwtatttatttatttatttatttatttatttattggttggtaggctattaattactgcctcagtttcagaatttgttatttgtctattcagggatttgactt

SEQ ID NO: 20989 - DNA, 201 bp, Homo sapiens
tcagttggcttttagttgcttccaggtgagctctcgtaccttgccggcacccgggacctccacaatgcgggcgttccttgtgagtccagcttactcatgcytctcagttgtggtgcaggtgctctttgagatgccgccttctctgcctgttgctcaccctgcgaggctcggtctctgttggtgtcactcatgaccagcctt

SEQ ID NO: 20990 - DNA, 201 bp, Homo sapiens
gtttgatttttctctcttcttctttattagtttagctaatggtctatctattttgttaatttttttcaaaaaaacagctactggattcattgatttttttyccccccaaaaaaccagctactggattcattgattttttttttttttttttggagggttttcctgtctctactctatcaattcttctctgatcttagttat

SEQ ID NO: 20991 - DNA, 201 bp, Homo sapiens
ccatggccagaagtgggtatcgtgcttgtgtctggggcctggggagggaaggaaaacaaataccaccccctgcagaagagatcgttaatggattctttgartaaccagccagatagcttgtttgtgtgcgaggttgggacattttccgtaaagagcagactaaatataggctcgagggtggggaccagggcccgagagggg

SEQ ID NO: 20992 - DNA, 201 bp, Homo sapiens
tttttctctcttcttctttattagtttagctaatggtctatctattttgttaatttttttcaaaaaaacagctactggattcattgatttttttccccccmaaaaaaccagctactggattcattgattttttttttttttttttggagggttttcctgtctctactctatcaattcttctctgatcttagttatttcttg

SEQ ID NO: 20993 - DNA, 201 bp, Homo sapiens
tttgccgttatgatgtccatgaggttggagtcctttcttagttaaaaaatctgaagacccaacaacacacagcacccccacgctgaaccctcccgagaatsattgagctcttccaaataaagggcgattttgtagcttttcaagttttaacagtttgataactcccaggctcctgttgagatgctttgtgatgaggttgtg

SEQ ID NO: 20994 - DNA, 201 bp, Homo sapiens
gttattttgtgttcgttcgtttgttctgttttgttttttgaaacaagagtctcactctgttgcccaggctggagtgtggtggcatgatctcggctcactgmagcctccacctccaaagttcaagtgattctcctgcttcagcctcccgagtagatggggttaaaggtgcccaccaccacgcccagctaatttttgtgtttt

SEQ ID NO: 20995 - DNA, 201 bp, Homo sapiens
aaaacagaaatgctgtactccttccctgtctcaggcccaggagcattattattattttttttaaatctcttgtggcacttttctactttctcctccacagkacagctgcttgttgagaggcagtatatgtcatgtctaagaagagtcctcaagtgaagtctggtgcagcttctttctagctgtgtgctttcaggaaagcct

SEQ ID NO: 20996 - DNA, 201 bp, Homo sapiens
cccctccctccatcacatcccccatgatactaatgtgggctcccttacctccgcagtacggagtggacgtcacggcccgagatgcccacgggaacacagckctggcctacgcccggcaggcctccagccaggagtgcatcgacgtgctgctgcagtacggctgccccgacgagcgcttcgtgctcatggccacccctaacc

SEQ ID NO: 20997 - DNA, 201 bp, Homo sapiens
atcagccacgggtgccacgtggctctggaggggcttggcgcctacgttagtcagctcgggctgccacgacaaaataccacagactgggaggcccaaacgtrttttctcacagttctggaggttgagagtccatgatcaaggcactggcaggtttggcttcttcccattctgtgcctcacctggtcttttccgtgtgtgtgg

SEQ ID NO: 20998 - DNA, 201 bp, Homo sapiens; identical to SEQ ID NO: 3585

SEQ ID NO: 20999 - DNA, 201 bp, Homo sapiens
gctggggagggaaggaagacggctcatgaggaaggccaggtttttggttgggagagacttgagcttgatgagtgtttggacaatactggccctgatgaggsagcgattgcagggacggggtgatgccgatgaagaggctggccacaaggcagaggggaggctgaaagttgtgtgaagatggctgagtgggaaagacaagca

SEQ ID NO: 21000 - DNA, 201 bp, Homo sapiens
cgggggcggtggccttgggttgaatggcccactcaccaccctgtgacctggccagggtgtgggattgtgcccggcttccccatccttccagtggggatgaygacaggcatttgctgagttccatgggactgtggaaagggctgtgtcactgtagacgctccatcggaaatgctgatgtgtattcttaccacgggcgtccgt

SEQ ID NO: 21001 - DNA, 201 bp, Homo sapiens
atggaaacactggcaaacttggagtcttctgcaaaactgtatcaagcaaaagtgaaacagtagttgctgtgtgacaagttagtattttgtccatgacatgyagcaatcagtagaaatagataaaggatgggatattggaaaatcccctggagatgagaaacggtgggtgacatctgatgagaggaggaggattcagggagc

SEQ ID NO: 21002 - DNA, 201 bp, Homo sapiens
agatgtgctttacctgctcccattcacaccttagaacagagaggctcctgtgtataaaggtatctgtaaagcctcatgccctgcatttcacatctagcaayatcataagtagagcatcttcaccaaattctgtctgtatcatcttgagtacacagatgtgtcataactagccacacttctttggacatgtaagtcgcttct

SEQ ID NO: 21003 - DNA, 201 bp, Homo sapiens
actcctgacctcaggtgatcagctcacctcggcttcccaaagtgctgggattacatgcatgagccactgcgcccagccagtggggttaatttttgtgatcrttgtctggctgttgattattacttgattctcctgctgtgtgtcttctctctttctgagagccacaaaacaccacgtccccttgcctgagtctctagctag

SEQ ID NO: 21004 - DNA, 201 bp, Homo sapiens
tggactgcgagacccagagtaagtgtgtgcggtggtagcaggggctggcgctgtgtagctggagaccacatggtcccactaggcccgggttgcaggggacycacatctgtcctgtttggcagataagagttaactgcttttaggaaattgagatattttgtttggattttaccttaacagagtgccttccacacaagcctc

SEQ ID NO: 21005 - DNA, 201 bp, Homo sapiens
gtcatggtgctgttacttggtgagaaagcattatttaaataccccagatgaggagttaggcactttctccagttttgcaatgctcttttgtttaccttttaaaaaaaaaaaaaaaaaaaaaacgagacaaggtctcactctgtcacctgggctggagtgcagtggtgccatcatagcccactataccttgaactcctgggt

SEQ ID NO: 21006 - DNA, 201 bp, Homo sapiens
attcctgttccccagatccttatgactaatgccaacactaaacataaaacaggatgttactctttctacaatgagctttggtgtttttgtttttgaaaaakattttcggtatatggtttttgtttctgataggaattctcctttaggctattgtcaatttgttttcctgtaatgatttgaaacaattatattaacttaaaa

SEQ ID NO: 21007 - DNA, 201 bp, Homo sapiens
catatttgtgcctccagcacagcagcgagtacaagtagcacatgtgcctgtctccaagcaggaacatctcctcctggctgtggtcagattgatctggcaattttatgtggtttgatggaatataaattgacctgggatgaaaactgactccagtaaagccttctagtttgttttactccatgtggagttagtggtcactgt

SEQ ID NO: 21008 - DNA, 201 bp, Homo sapiens
gcagcagtggagagctcggctcaaagtgcgaagttgtttagatttccacgttacacaaacacacaagcttctcaggggaagagcatgatgaatttctttctttttttttttttaaactaaaattagaataggccgggcccaatggctcacacctgtaatcctagcactttgggaggccgaggcgggcggatcacgaggtca

SEQ ID NO: 21009 - DNA, 201 bp, Homo sapiens
cacttaatgcatattttgagagctgttacccaaacctttttccttccttcaatgagaagacttatatctttttgagcagaaactgtggattcagaaaccarcagaactcttcattctccttaaggagatagaggccagggaaagtgtttttaggtaaataataacgccttcttgcctctctccctttatctccccattctc

SEQ ID NO: 21010 - DNA, 201 bp, Homo sapiens
tattctgcttataaagagccagtcaaaagagtctcagtttgaagtgttcagttaagtttaagtctcagtgataagttttcaggcattcacatgtgttagtaaaaaaaaaaaaaacaaaaaacttttagagaaacaaattaacaaattttatttcaaaataaaaatttaagttcctcatgtcgcaggaacccagatgaaaag

SEQ ID NO: 21011 - DNA, 201 bp, Homo sapiens
ttgaggcaagcagccctggggatgtaagcaccttttaatttggcagcttatttgataagcaaatgggttctatcttaaaatccaaagttgtttacacttawtgcatattttgagagctgttacccaaacctttttccttccttcaatgagaagacttatatctttttgagcagaaactgtggattcagaaaccaacagaac

SEQ ID NO: 21012 - DNA, 201 bp, Homo sapiens
tatagacataaagaagtcttcacttgtgaaaaattaaatgtagacccgtatcctttaacaccgcagatgcctgctagtttagaggttgtttcttactaaawtattattattattattattattattctcttgagatggaatctctcactgtcgcccaggctggagtgcagtggtacgatctcagctcactgcaacctccgc

SEQ ID NO: 21013 - DNA, 201 bp, Homo sapiens
tgaccgttggccagctcatgctttgggaaccagagggccagcctggctgcctgctttgcgggcttaagacctgcctctggaagggtaagggcctgcccgtccagataagtgctgctcacctgcattaaacaaacggccacacagagcccagtgggagcctgcactggtttctcttcctgcctgtggcagttgagagagaca

SEQ ID NO: 21014 - DNA, 201 bp, Homo sapiens
ctttttttttttttttttttttttttttgcgacagagtctcactctgttgcccaggctggagtgcaatggtgggatctcggctcgctgcaacctctacctyccgggttcaagcacttctcctgcctcagcctccagagcagctgggattacaatcatgtgccaccacgcctggctaatttttgtatttttagtagagacga

SEQ ID NO: 21015 - DNA, 201 bp, Homo sapiens
gagtctcactctgttgcccaggctggagtgcaatggtgggatctcggctcgctgcaacctctacctcccgggttcaagcacttctcctgcctcagcctccmgagcagctgggattacaatcatgtgccaccacgcctggctaatttttgtatttttagtagagacgaggtttcgccatgttggccaggctggtcttgaact

SEQ ID NO: 21016 - DNA, 201 bp, Homo sapiens
agtaacagtcttaatttgttttgtggaagcattctccataatgctctctgcagctctaatccacaggcaggcaggcccgggccatttgcatgggctgctatttgcttgtaaagtcagtattttgttgtgtttctaaaggtcgtctggtgccaaagttcacaaattgacttgcgttgcttttttcaccgaagacagccgtca

SEQ ID NO: 21017 - DNA, 201 bp, Homo sapiens
gtgttttttggaggtgcacatttggtagttcattgttgggttggtatttgtctccataacctgtttcagcctcaaggtcatttacctttgatcagtgcttsaagcttagcggtttgtttatatacatgttcatgtataaattatattactcagtctgatcataatatatgcccagtgcaaatcatttcattaaagcctcag

SEQ ID NO: 21018 - DNA, 201 bp, Homo sapiens
acctttgccgatttatatcaccatcctctttttttctttctttcacaattactcctgtcttgccgctgaacgccctgctctcagccaggaaaaaaaagaaaaagaaagaaatctggaaaacaaatctacattttcactatggcttgttaaagagccattttttaatcataattttttttttcatttctcaagggaaaattg

SEQ ID NO: 21019 - DNA, 201 bp, Homo sapiens
attatattactcagtctgatcataatatatgcccagtgcaaatcatttcattaaagcctcagggatacacggtgccaccgtttcctcattcagggacacgrggatagtggtagtgtgtcttcagcacgacatggggaaattcaaaggcagccatccgtggaagagccaacggcagcccgtgcaggcgtcagcgcctgggga

SEQ ID NO: 21020 - DNA, 201 bp, Homo sapiens
cctttgccgatttatatcaccatcctctttttttctttctttcacaattactcctgtcttgccgctgaacgccctgctctcagccaggaaaaaaaagaaaaagaaagaaatctggaaaacaaatctacattttcactatggcttgttaaagagccattttttaatcataattttttttttcatttctcaagggaaaattgt

SEQ ID NO: 21021 - DNA, 201 bp, Homo sapiens
cgcctggggaatagtagcagtctacatctttagctgtcagggtatctcgttgtagcctcatcctgccctctttaggggtccttggatgagttatcagttgyagtattgacattttctgtaaatagtgtcactcaagcgagtgacagtgggaagcagacaccagcccttagggagcagcccaggatgcttttttcctccaaa

SEQ ID NO: 21022 - DNA, 201 bp, Homo sapiens
ttttctcgccatggatgtggttctgtcgttgtgaagtttgactgattcgtcgccttgtgtttctaagaacggttggaatgatgcatgatggtctgattgcrtttagcgttctgttcctcttcccgtagatcccaactgggccagtttgaacttgggagccctcatgtgcatcgaatgctcagggatccaccggaatcttgg

SEQ ID NO: 21023 - DNA, 201 bp, Homo sapiens
ttgcagctctccatgtgaaaatgatctgtttgtttcttcttattactatcaatattaatattgatcctgtagtgctttcacacttaaattgttgagttccmagtcttgtctaataattatctcagcaattgcgataccattggctgaggttcatggaggttttcaggctaatgtcactgaatgatcggaaggactcactgc

SEQ ID NO: 21024 - DNA, 201 bp, Homo sapiens
gtaactccagtctccgccacggagactgcttaccctcttcctctttggttcaggctgaaccatcctcactcatcttgtagagcctcccgttcccatctcckcatcagagtttcctactttccttgaactttcctttttgaggagatttgagaagtgtgttgtccaagataggatttagtatcctggagccaggcttggaat

SEQ ID NO: 21025 - DNA, 201 bp, Homo sapiens
aatcaaaaagttgcagatttggagggatgtttgcagccactttttacccaacatggctctctatgtggtcattcagttgcttaaacaaagtctgggtagasttacaatttttttttaatacaagtaatatttgcttatagttttaaaaaagggagtataaccatcaaaagtaactctagcgaatgattttggaatattcca

SEQ ID NO: 21026 - DNA, 201 bp, Homo sapiens
cactctccaaggatctgtgtttcctggagcccttcttccctgcaggcctaggaggctgggctgaaaccacctcgggcctgtgcatctgtaggaacagcacragagctccttggagtggtagtgtcagggcggtagccatctgagctcacactggccctaggggctgtactttggggtatccaggggcaacacgtgccctct

SEQ ID NO: 21027 - DNA, 201 bp, Homo sapiens
gggtaatatctggtcaagggcttgcggcagataggaagagttctctctctgccgcctgtgcccaggccactgctgtggcctagatcgggttggctctggcygtgccccattcctcatgtgctggctattgagtcaccccctgcccccactttaaacaagcatgtttgaatgcagagcgattcgtggtgacagtttcataag

SEQ ID NO: 21028 - DNA, 201 bp, Homo sapiens
acatggattagctcatttatacctagggaaacagaggcaccagaggccacaaaagctattcagggtcacacagcctatgtgtgaggtttacataataaacstcaaaaaacgcaggctctaaggaacaaaaaggaagatttgagctgggtggaggctccttatctctcctacaacctgagccaacaacaccccatcacttca

SEQ ID NO: 21029 - DNA, 201 bp, Homo sapiens
agacgcaaattcttcttttggccttttcgcactggaagagagagggggttccaataaaaatgagcacattagacttgacctggagtgcactttcgggaagrggtgttgctcagtgttttgtagacgtgctcagaaagccacatttgtgagatttgaaggctgaggatgaaaccaccaagagactgctttacagccccccag

SEQ ID NO: 21030 - DNA, 201 bp, Homo sapiens
ctttgccgatttatatcaccatcctctttttttctttctttcacaattactcctgtcttgccgctgaacgccctgctctcagccaggaaaaaaaagaaaaagaaagaaatctggaaaacaaatctacattttcactatggcttgttaaagagccattttttaatcataattttttttttcatttctcaagggaaaattgtt

SEQ ID NO: 21031 - DNA, 201 bp, Homo sapiens
tttgccgatttatatcaccatcctctttttttctttctttcacaattactcctgtcttgccgctgaacgccctgctctcagccaggaaaaaaaagaaaaagaaagaaatctggaaaacaaatctacattttcactatggcttgttaaagagccattttttaatcataattttttttttcatttctcaagggaaaattgttg

SEQ ID NO: 21032 - DNA, 201 bp, Homo sapiens
cttttgatgtatgaagttatcacatattcactgtctataaagtgacccttcatgaaaatttgtatcctgaacattttaacttttgttttaacctcacgtcgtgagtgttacactaaatatatccatccccaagtggagtatcttttaaagtggtccacttgagtgatttactcaaaggcacccaaaaaacaccacccaagt

SEQ ID NO: 21033 - DNA, 201 bp, Homo sapiens
ttttgatgtatgaagttatcacatattcactgtctataaagtgacccttcatgaaaatttgtatcctgaacattttaacttttgttttaacctcacgtcgtgagtgttacactaaatatatccatccccaagtggagtatcttttaaagtggtccacttgagtgatttactcaaaggcacccaaaaaacaccacccaagta

SEQ ID NO: 21034 - DNA, 201 bp, Homo sapiens
tttgatgtatgaagttatcacatattcactgtctataaagtgacccttcatgaaaatttgtatcctgaacattttaacttttgttttaacctcacgtcgtgagtgttacactaaatatatccatccccaagtggagtatcttttaaagtggtccacttgagtgatttactcaaaggcacccaaaaaacaccacccaagtaa

SEQ ID NO: 21035 - DNA, 201 bp, Homo sapiens
ttgatgtatgaagttatcacatattcactgtctataaagtgacccttcatgaaaatttgtatcctgaacattttaacttttgttttaacctcacgtcgtgagtgttacactaaatatatccatccccaagtggagtatcttttaaagtggtccacttgagtgatttactcaaaggcacccaaaaaacaccacccaagtaag

SEQ ID NO: 21036 - DNA, 201 bp, Homo sapiens
cctgccttctccactgaacagcccagatggtcactgttcctctgagcagatgtgagcaggcctaacttgttggccattccctccaacactcgttttcttgrtcacagttctgagacttccaactcattcacagttaaacaaattacaggcccacatctgagaatgatggtcttgctgagtgtgaggtaggcctgcctcctt

SEQ ID NO: 21037 - DNA, 201 bp, Homo sapiens
cgaatcctgacctcaggtgatccgcctgcgtcagcctcccaaagtgctgggattacgtgtgtgagccaccacacccaaccccagatatttcttataatccygctaatgacaagacaagcagagctgatgctttatgacagaccacactgagaaactctgatttctcttgacgaacttccctaaagacagctgttgacaaat

SEQ ID NO: 21038 - DNA, 201 bp, Homo sapiens
ctcggctcactgcaacctccgcctcccaggttcaagtgattctcctgcctcagcctcctgagtagctggtattacaggtgcgtgccaccacacccagccatttttttttttttttcggtattttagtagagatggggttttgccatgttggccaggcaggtcttgaactcctgacctcagatgatccacctgcctcggcct

SEQ ID NO: 21039 - DNA, 201 bp, Homo sapiens
gggtgatcaagcatctcagaagactaagggggaaaatattgcaagatggtggtgcccatcagcaacgtcaggtgctccagaaagaggggggtcagtgagamagaagactaagcacagcccatggcccctggctgttccttgatctgtaatcttacagagtgaggtttcaatcaggtggatgatggggaagcattattagaa

SEQ ID NO: 21040 - DNA, 201 bp, Homo sapiens
tgcagaggagagccatgacttccagtcaagttgaaacatagctttctttatacccttcccagttggacttctgtcatattttacaaaattcaaggcttttmatttaacttagatttatggcttttccatggactatcttgaggtttttctccaaagcaaaccagctcataccttgacattgtcaaaatagcaaaaacacac

SEQ ID NO: 21041 - DNA, 201 bp, Homo sapiens
cagtatacggagaagacaggtggtgggatagatttttaaagtgagtgatcggccaggtgcagtgacttatgcctgtaatcccagcatttggggaggccaasgtgggcggatcacctgaggtcaggagttcaagaccagcctggccaacatggtgaaaccctgtctccactaaaaatacaaaattagccggatatggtggca

SEQ ID NO: 21042 - DNA, 201 bp, Homo sapiens
gaggaacacaggatgcatattcaggcaggaagttgttggggttaacatgagtggaccctagatttccctgcctgaagggggccccgtgttagtttcctgtrgctgccgtaacagccacaaactaggtggcttaaaacaacagaacatcattcttttacagttctggaggcctgaagcccaggatcaaggtgtgcccagagc

SEQ ID NO: 21043 - DNA, 201 bp, Homo sapiens
cacaggatgcatattcaggcaggaagttgttggggttaacatgagtggaccctagatttccctgcctgaagggggccccgtgttagtttcctgtggctgcygtaacagccacaaactaggtggcttaaaacaacagaacatcattcttttacagttctggaggcctgaagcccaggatcaaggtgtgcccagagctgtgct

SEQ ID NO: 21044 - DNA, 201 bp, Homo sapiens
tagggtgtgttcactgtgcccctgtgtgagggtttgtagtcttacacctttgccaaaccctttctgggttttgcccctcacaggagatgcaggtctttctrtggaacctgtaggttctgagaccgagccttgggtagtttttatttcttaggctctctggagttctcccaaatccccattgccaatcagtagctgaaagtg

SEQ ID NO: 21045 - DNA, 201 bp, Homo sapiens
ctgctcgctgggacctgatagttcgcctttgtacggatgaaaaaaaccaaacactgagcctggtctgagcggggctgtttgttgaggctcctgatgcagasaagggagcagtgtctgcacagggggtctggattgcacccgacaccatccaggtgcctgcgtgtgctggtcccgccgtcaggacttcccctcgtgaggagc

SEQ ID NO: 21046 - DNA, 201 bp, Homo sapiens
cggatgaaaaaaaccaaacactgagcctggtctgagcggggctgtttgttgaggctcctgatgcagagaagggagcagtgtctgcacagggggtctggatygcacccgacaccatccaggtgcctgcgtgtgctggtcccgccgtcaggacttcccctcgtgaggagctgggtaccactgttatcctgcctgctggtctga

SEQ ID NO: 21047 - DNA, 201 bp, Homo sapiens
gtttgttgaggctcctgatgcagagaagggagcagtgtctgcacagggggtctggattgcacccgacaccatccaggtgcctgcgtgtgctggtcccgccrtcaggacttcccctcgtgaggagctgggtaccactgttatcctgcctgctggtctgagggtccgagcgtgattgggagcagagacaagagttccagggcg

SEQ ID NO: 21048 - DNA, 201 bp, Homo sapiens
tgcctgcgtgtgctggtcccgccgtcaggacttcccctcgtgaggagctgggtaccactgttatcctgcctgctggtctgagggtccgagcgtgattgggrgcagagacaagagttccagggcgagcctcagttctgggaccaccattgaccagtagagctataaaggacttggccaccaaggttggagctgagcccccca

SEQ ID NO: 21049 - DNA, 201 bp, Homo sapiens
agcttgagcctgacctttggcaggtccaggagtgtgctgagtctttctaccccgctgcgtggtgctgcctgccgaggtggtgtggctctttgtgctggcayttagggtgtcactaaagcccaagaccaggattgcttgtcctttgcagtgtgctggacaggagccacacagtgtagaagcgacttgccctaaatgcctcat

SEQ ID NO: 21050 - DNA, 201 bp, Homo sapiens
agcctgggagaagtcagagagagggggctcgtggtccttcttgggctctcattgctgttagcaggagttggcacttgagtcccacgtcctagcctcccggsatcacagccttatgctgcatttcctaaagtgctttctagcactgaccgactccaggaggcagcactggcaaggattttggtgagcctttgatggagtgtg

SEQ ID NO: 21051 - DNA, 201 bp, Homo sapiens
cagaatccttgcaaaacccccatctcaaaatctttcacctcttcacatgcacacagtggctttgccccgtggagccacatgctctcaggttccaggaatgrgtctgtgggcatctctgggggccactgttcagcctgaatgtgttctgaggcttagtattttgtctctttgagttctacattcattttgatccttacatca

SEQ ID NO: 21052 - DNA, 201 bp, Homo sapiens
aggctgaggtctcttggtgataatccacacactgtcctgggccttggttttgcagcatttccaacttgggttgtcagagtgagactgtgcaggactgcccygtacagtacggcttctatgtgtgaacaacacagaccactaagagatgtgacaaagctgttccatcagaggaaacatagtctgggggacaaatcctcccat

SEQ ID NO: 21053 - DNA, 201 bp, Homo sapiens
ggctggatttttgggggactcatttccagcagccaccagcaggtggagggagtgagatgcgtaaacaaactgtccctcatgcttggtgtttgggcagatgyattgctaaagcgtgctcactaataaatcccctgctgatatggcacaaatatttatagccgatgattgatgtgaaattaacaaaaactagcagttgacagc

SEQ ID NO: 21054 - DNA, 201 bp, Homo sapiens
tggatttttgggggactcatttccagcagccaccagcaggtggagggagtgagatgcgtaaacaaactgtccctcatgcttggtgtttgggcagatgcatygctaaagcgtgctcactaataaatcccctgctgatatggcacaaatatttatagccgatgattgatgtgaaattaacaaaaactagcagttgacagcgat

SEQ ID NO: 21055 - DNA, 201 bp, Homo sapiens
aagcgtgctcactaataaatcccctgctgatatggcacaaatatttatagccgatgattgatgtgaaattaacaaaaactagcagttgacagcgatatgasgtggcaaaggctatttgggaaagtttccgttgtctttgaaaattaagaaaaattatacgtttacttgccttgctaagaactgtttaagaataaatcaaca

SEQ ID NO: 21056 - DNA, 201 bp, Homo sapiens
ctggagtgcagtggcgcagtcttggctcactgcctcccaggttcaagcagttctcctgcctcagcctcccgtgtagctgggattacaggcgcctgccaccrtgcctgactaatttttgtgtttttagtggagacaaggtttcaccatgttggccaggttggtctcaaactcctgaccttaggtgattcgcctgccttggcc

SEQ ID NO: 21057 - DNA, 201 bp, Homo sapiens
gagtgcagtggcgcagtcttggctcactgcctcccaggttcaagcagttctcctgcctcagcctcccgtgtagctgggattacaggcgcctgccaccatgyctgactaatttttgtgtttttagtggagacaaggtttcaccatgttggccaggttggtctcaaactcctgaccttaggtgattcgcctgccttggcctcc

SEQ ID NO: 21058 - DNA, 201 bp, Homo sapiens
cagcccagggagagcatttattttcttaggtttaccatttaaaatgaatcggaggaatctggaaagttacagaagcagggacggtgactggagaatccctyatctttttgtgtatattttgggttctgaggattaccaggagatgtgtggatgacagagcccgtcgctaggctcttatgtcacagatgggctgctgtgctg

SEQ ID NO: 21059 - DNA, 201 bp, Homo sapiens
tagacactcacacacgttgtatagacaacgaaatatctgctattccaaggaggaaaaaaggaaaaaatctgaaaagtcaaaacaaactaaatcttgtaaakaggtggcttggagctcctgggggtacctaggcaactcctgacgccacagacaagcatttgagctccttagcctgctacacagaagcataaactcaccttt

SEQ ID NO: 21060 - DNA, 201 bp, Homo sapiens
gctgggtcttctgcgggagcgggccctgagctggctgcccgcgacacctgtggggccgccccagggagccgaggctcgccggtcgccgccgcacaggtgcsgctgcctggatgggagaagccggcattcatcctggcgcccctccctgcctcgagtcgtctccctgttagtgctaccatctgtcagtgttgtgatgtggac

SEQ ID NO: 21061 - DNA, 201 bp, Homo sapiens
atacgtttacttgccttgctaagaactgtttaagaataaatcaacataaactagggcagcttcttaaactatgatggagaagcacaaggtcaaagtgtttygtctcagaatgaagcagtaatgtattactttgcgtactgtgtacaggggccggcagatgtttctgatgttatgaagctatgctcctggaagtggttgtga

SEQ ID NO: 21062 - DNA, 201 bp, Homo sapiens
aataaatcaacataaactagggcagcttcttaaactatgatggagaagcacaaggtcaaagtgtttcgtctcagaatgaagcagtaatgtattactttgcrtactgtgtacaggggccggcagatgtttctgatgttatgaagctatgctcctggaagtggttgtgaaaatcgcagccctgtgaattgtgtgccctaagag

SEQ ID NO: 21063 - DNA, 201 bp, Homo sapiens
gagaaagtattttaaggaagtggggtcagctttcctctgctcccctgacttcacaggatagctatgcattttgcctcttggggagctgggttattgtgaamctaggtcaaattattgttttttctctttatgctcatagccattccaaagacagaatcctttcctcaaaaaatgaatttttgagtgttcctatattcttgg

SEQ ID NO: 21064 - DNA, 201 bp, Homo sapiens
tgaaaatcgcagccctgtgaattgtgtgccctaagagccagctgtgctcctaacagtgatgccgtctttccatggaaatcacccataagcacagccttcartctaacttcatgtcaagtctaagtggcacagctatccatgaacactgtaaacattcccagctccatctaaggtgattaaacggagtcagaacccggccat

SEQ ID NO: 21065 - DNA, 201 bp, Homo sapiens
tttggcatgctgaagtggctttaccagggaattgtgactttaattttaagaattaatcgtaatgtagggggaaaaatgttcttaaaacacaaaacaaacaygtgtgaatagatgaggaacagcagttaaaataataactttcaaaaactaggttaaaatgtccagagaattagattttgttaatgttcaaagcacagctaa

SEQ ID NO: 21066 - DNA, 201 bp, Homo sapiens
tcccctgccatggcccatgtggctccggaagttcctgggagtggctcgtagagcctgttttcatccttcagaggaatcctgcagtccacttgcccagcgtyacttcctccagtgccctttctgggtcccacgtgattctacctgatcgctggctctctagggcttttcccctccaggttcagagagagcgcctgccccagg

SEQ ID NO: 21067 - DNA, 201 bp, Homo sapiens
tggctgctgctgtgcttcctttaactgaaccccggtggcccagttgctcctcttggtggactcactaagtcaactttgacgcttcagccaacgtcggtttygagaatgcgacctatgaaattgggagccctggctggatcagaagcacatggttcagtggacactgtcagaggtgctgtggatcacttggaccacggtagc

SEQ ID NO: 21068 - DNA, 201 bp, Homo sapiens
gggagccctggctggatcagaagcacatggttcagtggacactgtcagaggtgctgtggatcacttggaccacggtagctaatgtttgtagcgcgctcacrtatgccagactcttcttagcgctaagccattttcccaggccgggttatgcagtgagacttcagggcaggcacacatgtcgcttcctgcacccacactgga

SEQ ID NO: 21069 - DNA, 201 bp, Homo sapiens
tatttaagaagaagtaacctgagtaatactaaaaatgtattttctgaggggcgaaagtatagttgaagtaaaaagttttagtgcactttccagaatgggcyggatggtgactattttaggttttgaggatggtaccgtctctggcaactcctcaactcttgtagggagaggtacagacacaaattggcatggcgtgtttca

SEQ ID NO: 21070 - DNA, 201 bp, Homo sapiens
tggaaaagaaggggggcataggctgaattgggacagtgcccttgactgacacagggagagggtctgagccccccatgcacttactgggcaggcttcccccygaagcaaggtggacctgcttccagtgggaggagaagggggagcactagagccctccgtgagaccattgactgcactggggtagttcagtggtgagcggat

SEQ ID NO: 21071 - DNA, 201 bp, Homo sapiens
ctttttcagacaggccaactgtatttactgattattccccgtccctggttcgtggttggaccatcaggggattggcattcctagggttagtcaggaatgaraaatacagaaagtgtgcggggcatgctctgtacctcaggccatggggacgaccgctccctgtcatgcagacccctcagaggggccgcccccggcccggcc

SEQ ID NO: 21072 - DNA, 201 bp, Homo sapiens
tcagttctcaagttaattggtcctgctccttctctgccctggtgtgcccctcggctcgccactggcttaggtgcaggtacatttgtccttcatcggaacargaccaccctcccttggctgccaccatggcaacgctcagccccgctgcctccgtttgtcatttctcctcctaatgatttgaactgaggtctgtgtgctggc

SEQ ID NO: 21073 - DNA, 201 bp, Homo sapiens
cgtgattattaatacattgtaatgacattttggggattccgccatattttgtatggttgccagcaaaatgttgacagttgtattgtggttaataaattcawttagatttataagcattgtttacagaacctgttcgcctgctgaaactctaacagcatctgttccttcttactaattaactgctaattacaaatgagcttt

SEQ ID NO: 21074 - DNA, 201 bp, Homo sapiens
acaatgattttctttgtgcaattggaaagtcaaaatagaaacagcaaaactaaagttatctttgattccttaatgttgcacaaaggaggggctttcagttgaaaaaaaaagacatgttctttccttaaaagaatccgctggccacgggtgcaggctgtgccaccagcactggatggtcctggcaccccagccagttgtgta

SEQ ID NO: 21075 - DNA, 201 bp, Homo sapiens
gataccacttttccagaccaccctatggtaattatttggggacttaaggccagaatgttttatcagacaatatgactgaacagtgattttggatgttaatraaaatttaatcagatgaatatattattcagcctcatttagggagtaaagtatgataagtgcatctacaagtgctgaaatttgtagaacaaatgaggtcat

SEQ ID NO: 21076 - DNA, 201 bp, Homo sapiens
gctgacctttcttccaagacatccgtgagatttttcttattagagcggtgtgctaactatggggtgggaagagagaaaagaagggcacaagaaagaaaaarcaatccgtagtgagtaaaatgctgaaggctttattacattagtacattacataaactcatgcatttattcaaaaaatatctataggccaggtgcagtggc

SEQ ID NO: 21077 - DNA, 201 bp, Homo sapiens
atgcttgggcacagagagtgaggtgtttgctgggaaaagccatttgggatgggtgaaggtccatgctggagttggagagcgcagaaaatggggtgagtgtraaagtctagcctgggttacggccccagtgatcctggacaaatttggagtaagaaactcccgccagtctcatggccagagtgcccagggaaagtcttctct

SEQ ID NO: 21078 - DNA, 201 bp, Homo sapiens
ttttctaatggtgaagtacagaaacttccattctgtgtgtgactagcatggcttagctatgtttctgtgcaaacatactcacacacagtttccaaatgaaktcacaaacttcccttataaaacttcctttgaggctgggcccggtggctcatgcctataatcccagcaatttgggaggctgaggcaggcagatctcttgag

SEQ ID NO: 21079 - DNA, 201 bp, Homo sapiens
ggctgaggcaggcagatctcttgaggccaggatttcgtgactagcctggccaacatggtgaaaccccgtctctactaaaaatacaaaaattaggccgggcrcggtggctcacgcctgtaatcccagcactttgggaggccaaggcgggcggatcacaaggtcaggagatcgagaccatcctggctaacacggtgaaaccct

SEQ ID NO: 21080 - DNA, 201 bp, Homo sapiens
atttgcttggttccctccacttgacctccaagaataccagctgggtttgtcctgtacctccacctcctctgtgttcccctggtccttctgctgcgtcggtsctaactcatctctggcctgtcattcttacttcccaaaagtcctctctctctgcagccaaattcaccttttaaaaaaacaaaacatgagccagattgccac

SEQ ID NO: 21081 - DNA, 201 bp, Homo sapiens
aagtggaaataattttatagtgagtacttgtacactgattgccaagattctgtaaacaatatttccctctgcttgtgtcatctttcatttgtccattcctygatttattattattattattatttgaggtggagtttcactctgtcgcccaggctagagtgcagtggcgcaacctcggctcactgcaacctctgcctcccg

SEQ ID NO: 21082 - DNA, 201 bp, Homo sapiens
attagctgggcatggtggtgagtacctgtaatcccagctacttgggagcctgaggcaggagaatcatttgaaaccaggaggcagaggttgcagtgagccasctcacgccactgtactccagcctgggcgacacagtgagactccatctcattaaaaaaaaagaaaaaaaaagctgtctgtgaaaagtcctctctcctccct

SEQ ID NO: 21083 - DNA, 201 bp, Homo sapiens
ttagctgggcatggtggtgagtacctgtaatcccagctacttgggagcctgaggcaggagaatcatttgaaaccaggaggcagaggttgcagtgagccagstcacgccactgtactccagcctgggcgacacagtgagactccatctcattaaaaaaaaagaaaaaaaaagctgtctgtgaaaagtcctctctcctcccta

SEQ ID NO: 21084 - DNA, 201 bp, Homo sapiens
taaattagatttacataggagacaaagaaatccttccctccctgttccagttgtggaacatatggtcaccgttctgtgactgggagcattgctgtttggcrtgcttgtgggcacggtttaagggttgagaccacatcctaggtggcggtcacaaacccggcccagcggcctccctgctaggcagtcctccatcaatactga

SEQ ID NO: 21085 - DNA, 201 bp, Homo sapiens
ttcctgttttgaggtggtgatttatgatgcctgtgtacttccctgtggtgcccaggcctgcagattacagacgctgtgtaattagagaatccctctccacrtgtgttctctgaacagggagcccagggaggcttggatctttagattgataagcaggatagtaaaccagttgtgaggaacattgtatagagaaaaaacaac

SEQ ID NO: 21086 - DNA, 201 bp, Homo sapiens
aaaactcttgcaggtcctacttcctgccttgacaccaccccctgcccacagccttctcattcttgtcctgtagcccagtttcgtttcacctgtcctctgcytgtaatccttttcagcccctctgaagagcggcccagtaggatggttgactgacgttagcttggctttcttcctaaggcaccgtcttcctcattgaaactg

SEQ ID NO: 21087 - DNA, 201 bp, Homo sapiens
cgcaaggaaggacgatggattagccaaccatgaccggccaggctgtgcgagctagccaaggagaggccacgaggcgggagagccaaggaggacagcctccrggtgggccatcactgctggtagagagggtttctgggtcccaggaccggactgcgtggtcctggttatacctgctggtcaaaggtcagtctgccaaggccc

SEQ ID NO: 21088 - DNA, 201 bp, Homo sapiens
ccggttttcctcttgtggcacctggtggtgtgctggtgtgtggtttataaaacatgctctgccgctttgatttccctgcttagatttacataattgttttwgaagaaggttcaggtgctttgctggcagaaaaaggaagacgacctcttgcaaagtggggttagccctagccttgcaggaaggggtctcggcttccttcca

SEQ ID NO: 21089 - DNA, 201 bp, Homo sapiens
gagcccgttggcctgggtgtccactgtcagaggatggagattgatctggggttacctttttcagcctttgctttgtttgtcacctgaaggggctggatccygagccctgtaaggcccccttcggctggtgcacacaagaggacagctttgagcctccaccaaggtctctggattccactttaagtgcgggcttgggtgtgg

SEQ ID NO: 21090 - DNA, 201 bp, Homo sapiens
tgtgaatagagactagttaaaataaacatcacaatggcgatggaaaatgttatttcactttattaagttaaaaacaagttataaaatagtaggtcacatayaagctcagttttgtatttaaaaaccctcaaaactgtatatatgcccagaaaaaagacaggaaagaaagataccacagtatgaatggtggttcccaattag

SEQ ID NO: 21091 - DNA, 201 bp, Homo sapiens
acttaaaatctgcagcccttctgggtgtgatctgctgctgttccatttctggcagtgtgcagcaggctgtatgcagggcagggtcactcctggcagacgcygtgggtgctgagggctgccttgtgtctgatgattcctcggatccattccagcatcacggaaggatgtgccattagtgatgaggtctcccaagttagcaga

SEQ ID NO: 21092 - DNA, 201 bp, Homo sapiens
ctcgagggcagcctcctggaggtggaagggcagcggggcgcgagactgctgcgctggtgggatgcttggattcccaggccccaagtcactatcggggaacrttctttgaggtttaatagtattttaggattttttaaaggatagataatatctagatgttgtgttctaccaaaacaaatattgttcttttggaaatatgtt

SEQ ID NO: 21093 - DNA, 201 bp, Homo sapiens
ttaaatgaaagaaatgagacactttttattccgttgttgtgttagccctgcagtgctttttcaggccctcccagattaataatgaccttgtttactcattsacagtaaccaaagagcctgctaaaaaagttgtgaagttaaggtcaaagcagttttatgggaggaaatctgtgagtgtttaaaggaaggtatttccataat

SEQ ID NO: 21094 - DNA, 201 bp, Homo sapiens
agggactgtccccagtaggtctatgagagcccaccacagcagcagccctctggatggggatttgggtcttggttttgctagcactcccagtggacagtcakgcctggacttgtcttctccaccttccacttgtcctaacagctgtcgggaccatcatccaccaggggccagctgtccagaggcagacccaccctggaaggc

SEQ ID NO: 21095 - DNA, 201 bp, Homo sapiens
cccaggctggcctcagactcgtggactcaagcaaccttcctgcctcagcctcccagagtgctaggaatacagatgtgagccacagtggctggccgagattstgcttttctagcgcctcccaggtggctgtgctgatgctgcttgtctgggaccttgccctgaggagcactacgctgtaggttctatcacggtaacgatact

SEQ ID NO: 21096 - DNA, 201 bp, Homo sapiens
cagactcgtggactcaagcaaccttcctgcctcagcctcccagagtgctaggaatacagatgtgagccacagtggctggccgagattgtgcttttctagcrcctcccaggtggctgtgctgatgctgcttgtctgggaccttgccctgaggagcactacgctgtaggttctatcacggtaacgatactgtaatgtacagtg

SEQ ID NO: 21097 - DNA, 201 bp, Homo sapiens
ggtaatatgctgagttagtgaatgagcacacttggatagcatccccaaataggaatagtccaagtggtggcaggggtggggtggcttggtgtatttcgttmgatttgcaaaatgagctccaaggattctgccagttttatatgatataatcttctgaatttttaagtatcttaatgctttgcatattgctttagaaactgg

SEQ ID NO: 21098 - DNA, 201 bp, Homo sapiens
ctcccagagtgctaggaatacagatgtgagccacagtggctggccgagattgtgcttttctagcgcctcccaggtggctgtgctgatgctgcttgtctggraccttgccctgaggagcactacgctgtaggttctatcacggtaacgatactgtaatgtacagtgcatcagatgtcactaatttaaagatctaggctgatg

SEQ ID NO: 21099 - DNA, 201 bp, Homo sapiens
aggttcattcgttgcttatttcaatctggattgggacaggatgacaaaggcccatgaagggattttatatataactgtgtgcttagtgtagcgtgggtgtytgtgttttatcgcctggcctctttgtggcatgtgacatctttgacaggaacaccaattgattcctctgtgctcaataatgtcttcactgccatggtattt

SEQ ID NO: 21100 - DNA, 201 bp, Homo sapiens
cgagacctgcggggagggagacggccgcacggcgctgcatctggcctgccgcaaggggaatgtggtcctggcgcagctcctgatctgggtaggtggtcggyacgcctggcagaggacggggccacaggaggcactctctgctttgttctgcttccgtgggcatctttctggcagaaggctgttgttctcgatctgcaagtg

SEQ ID NO: 21101 - DNA, 201 bp, Homo sapiens
tgttacatttcttcttcctaaagcagtgatcggtgcttctgccctggtggagaaggcttgagcagtccccggctagtggctgttgccacctacaagccccygcctccattaggaagccatttatttatggggcctaggtaggggcaggaggttcctttcaagaaaacaacagattgcttaatgctggtctccctcttgctg

SEQ ID NO: 21102 - DNA, 201 bp, Homo sapiens
agagaggggttgcagggggctgtgccacacacttgtaaacaaccaaatctcgtgagaactccttatcacaggaacagcaccaaggggacggtgctcagccrttcatgaaggatccaccccatgatccagtcacctcccaccaggccccacctccaacactgggggttaccgttcgacatgaggtttgggatggggacaagg

SEQ ID NO: 21103 - DNA, 201 bp, Homo sapiens
ttcgttggccagacaggatctgctgtatccttatgatacctcgtcatcttggagtccaccgtgcacttgtccgcttgggctgccataacaaaataccagaygctgggtgccttaaaccacagaaatgcattttctcacagttctagaggctggaagtccaagatcagggtgctggcatggttggactctggagagactctt

SEQ ID NO: 21104 - DNA, 201 bp, Homo sapiens
cttgagttttcagtagagaaggcctgctcctcactttgaccccggacctgcatgcgcgctgaggatggcagaggggctcctgcctgtctcagtgctctggrgtcccgtgctgagggagcatccttatggtaaacgtccctggttctgtaccggaggaacaggagctctggaggtcttctgtttgctgttgtatgctgtggc

SEQ ID NO: 21105 - DNA, 201 bp, Homo sapiens
ggacatggggcagggagagcttcagaatgagcgggaagcctccacaacaggtggagaaaatagcaagggctgctgggcacgatcattcgagattccaagasgtaagaactgggggctgggctgtggaagaagtgcgagagggagtggggaaggcaggctgggcgtgctgtggttataggcagcctacatgtcttgagtttt

SEQ ID NO: 21106 - DNA, 201 bp, Homo sapiens
tagggcttactttgtttatttactttttatacctgtatatggtagaaagaaaacataaaggaaaagcgtgtaatttctacataatgtttggcttgtaaataaaaaaaaaaaaaaaatccagctgcttccattgccctgcggaggccatgttcctgattggctctgtaccgaggttcatttaaaaggccagggacctcattc

SEQ ID NO: 21107 - DNA, 201 bp, Homo sapiens
cttgtgttttacatgatggatcttaccaggcggccttggaagccacttctcacaccagggttataaagtcctatgttttcacagtctggttaatacaatgrggaagaattaaaacctttggcataacaaagcttttggtcagttctataagcaaatgccattcacagcctcctgagtgatacctgtttctaggcactgctt

SEQ ID NO: 21108 - DNA, 201 bp, Homo sapiens
gactgctgctatatagaatttaatattcttgcatgcattttctgaaccttctagtcacttgttaaatcccagttcagaacatcacattagatatatgatctgcactgtgctaggacgtgctccccaccaaaacgtcagcgtcttaagcttgtattcatatgaccataggaaaacctacatgcagaactttgatagtagttg

SEQ ID NO: 21109 - DNA, 201 bp, Homo sapiens
ttaaactttctcattacacaacaggacttgaattcaaccatttgttttggcctatgttgctagcctggaacagggtttcattagcccagaaaccagattcyaaatcactttatatctccaataagaaaaaaaaaaaaccctggagtccacgtgtgacgtagattgtggtttgatttccaaggagaataaaaatagagttca

SEQ ID NO: 21110 - DNA, 201 bp, Homo sapiens
aataacaagttttggtttagtagactccgtttaaaattgactaattagttttagatcattgtgaactctctggattaaatgtacatggtgcattgcggtgraagctgttatggatgctccagtgatcccatcttctgcgtgtggaagcatttcaggaagccttctgtgttctcttgacatgacattgaccacttcctggat

SEQ ID NO: 21111 - DNA, 201 bp, Homo sapiens
agaagcctctgtgggcaggagaatggctccgcctctcaggcacagggcttgtgaccggtgtgcacctccggtccagctcactgctttgctctcctctctcytgcgggcacctacacagcatcggtaatcccttaggaactgtgtaggcactggctgcccttaaaaaggggagagtctttccacacatggagttggattatt

SEQ ID NO: 21112 - DNA, 201 bp, Homo sapiens
cctgactcatttcaatcacctgctccaccctgactcattccgattacctgctacctgctctgccctgactcattctccaccctgcataaccatttttcccrccgaaccactcaccgggtcactctctttaaattagccaatcggaattagtttagcctgtgcggtctaaccctagccaacaggggaacgacacagcagcag

SEQ ID NO: 21113 - DNA, 201 bp, Homo sapiens
agtgatgccacctcaacccttagccaggtgcaggcgtaacaagggagacccacctgtgcaatatagtgagacccccatctttaccataaatgaaaaaaacrttagccaagcatggtggctcacgcctgtaatcccagcactttaggaggccaagatgggagaatcatctgaggtgaggcgttcgagaccagcctgggcaac

SEQ ID NO: 21114 - DNA, 201 bp, Homo sapiens
cggtgtgcacctccggtccagctcactgctttgctctcctctctcctgcgggcacctacacagcatcggtaatcccttaggaactgtgtaggcactggctkcccttaaaaaggggagagtctttccacacatggagttggattattctggtggtgcaggtttcgtccatttgaagcaaataggaacgcagccttagagagg

SEQ ID NO: 21115 - DNA, 201 bp, Homo sapiens
acagcttgaggaactgataagttgatcatctatgtctaaatattgtggcctccgataacatcctagaccagtatctatcagcccaccaggtaggaaatcgrggatttgatggaagagaagttcagttttcattattaatggtgaatatttagcatgtacacagaatgcctggcacataggattttaaccaatttaatcttc

SEQ ID NO: 21116 - DNA, 201 bp, Homo sapiens
gctctcctctctcctgcgggcacctacacagcatcggtaatcccttaggaactgtgtaggcactggctgcccttaaaaaggggagagtctttccacacatrgagttggattattctggtggtgcaggtttcgtccatttgaagcaaataggaacgcagccttagagaggggccagccagtgtcagcgtgaagatgtgggag

SEQ ID NO: 21117 - DNA, 201 bp, Homo sapiens
ttgggtgtacgctgggcgggttcgcagtgctggaagagagagtggacagattttacaccagcacctttcatctcaggggtgcttgtgaattgattgcaccyctcctgtggcgtggaggcggtgcctggttaaagtggggctcagatgccccttggttgcatttaatgtgtgtgcataatcagagggcaaggacagcagtaa

SEQ ID NO: 21118 - DNA, 201 bp, Homo sapiens
cctacacagcatcggtaatcccttaggaactgtgtaggcactggctgcccttaaaaaggggagagtctttccacacatggagttggattattctggtggtkcaggtttcgtccatttgaagcaaataggaacgcagccttagagaggggccagccagtgtcagcgtgaagatgtgggagaggaaggggttaaatagggcca

SEQ ID NO: 21119 - DNA, 201 bp, Homo sapiens
cctgactccttagaacctgcaaatgcatgaaactcatgttaagaacagttgtggttcacgtgtaccaaacttgggaaatcctgaccagcgcatccagggtygcttgggcacagtggtccttttgcatggggtggccggccaggtgtgctgagtgccacctgggcttgcatgccggacgcatacctggcacctgcttccagg

SEQ ID NO: 21120 - DNA, 201 bp, Homo sapiens
tttggcctcagggggtccttggagtctagaagggatggtgacattggccagagtcaccccataatcatacagttagcagtgtggccagcgtcacttaaagyggggaggtggctggtgctggagcgtgtataacaaaagtgggatccggaaagggctgctggcgagtgggagttttctagggagccgctgctcttgcttcag

SEQ ID NO: 21121 - DNA, 201 bp, Homo sapiens
aaacccagtgcccttgtctgagtcctgttttcatactagtgaaatttcagctgctaacaagaatcacgtctgatgcagacacaaagcccagtggctgcccyaactccctggccacctcctactgtccgagaaaacactgaaatatagcagtcccaaaggactcagaagtcagcattgaaagcttctgtttttgttttgttt

SEQ ID NO: 21122 - DNA, 201 bp, Homo sapiens
tgttgaaccagacattctgcagcctttaaaagagaatggaaatggagagattgtgatgtgttcattggtgacttttgacacggatgctaacctgtaagatrtgcagatatatcatgtgcaaactgttaagatgctgtcaacattttgaatgacttcttgcaaatagtaaggaaattaaacacgcacagagctgggcaaatg

SEQ ID NO: 21123 - DNA, 201 bp, Homo sapiens
ttcattgtcggggtggcctgttttatgatttgtttttgttgctatttttttctcctttattacagattagattggaactagtgtgtgtgtgcatgcgtgcrtgtgtgtgtgtatatgtgtgttagcgagggaatacttcaaaaaataagattttttacacttgaaagcaagccatgtatatgtgtacattaggcacttgat

SEQ ID NO: 21124 - DNA, 201 bp, Homo sapiens
ccactgccaacacgcccacgcccgttcgcaagcagtctaagcgccggtccaacctgttcaccgtgagtgtcaaccctgggtggagatttgaatgcgattcygaagcgttcccattaacgtaaacctggttgccacatggttcagtggtatttgtagaatctcaactatattaaagtgaataacattgatttctgtggagga

SEQ ID NO: 21125 - DNA, 201 bp, Homo sapiens
tcattgtcggggtggcctgttttatgatttgtttttgttgctatttttttctcctttattacagattagattggaactagtgtgtgtgtgcatgcgtgcakgtgtgtgtgtatatgtgtgttagcgagggaatacttcaaaaaataagattttttacacttgaaagcaagccatgtatatgtgtacattaggcacttgata

SEQ ID NO: 21126 - DNA, 201 bp, Homo sapiens
tttttctcctttattacagattagattggaactagtgtgtgtgtgcatgcgtgcatgtgtgtgtgtatatgtgtgttagcgagggaatacttcaaaaaataagattttttacacttgaaagcaagccatgtatatgtgtacattaggcacttgatatatgttgaaaaggtggattaatgggtcattaattgtccatttttt

SEQ ID NO: 21127 - DNA, 201 bp, Homo sapiens
ttttctcctttattacagattagattggaactagtgtgtgtgtgcatgcgtgcatgtgtgtgtgtatatgtgtgttagcgagggaatacttcaaaaaataagattttttacacttgaaagcaagccatgtatatgtgtacattaggcacttgatatatgttgaaaaggtggattaatgggtcattaattgtccatttttta

SEQ ID NO: 21128 - DNA, 201 bp, Homo sapiens
tttctcctttattacagattagattggaactagtgtgtgtgtgcatgcgtgcatgtgtgtgtgtatatgtgtgttagcgagggaatacttcaaaaaataagattttttacacttgaaagcaagccatgtatatgtgtacattaggcacttgatatatgttgaaaaggtggattaatgggtcattaattgtccattttttaa

SEQ ID NO: 21129 - DNA, 201 bp, Homo sapiens
agtctcgctctgtcacccaggctggactgcagtggtgtgatctcagctcactgcaagctccacctcctgggttcacaccattctcctgcttcagcctcccmagtagctgggactacaggcgcctgccaccacgcccggctaatttttttgtatttttagtagagacgggctttcaccgtgttagccaggatggtcttgatc

SEQ ID NO: 21130 - DNA, 201 bp, Homo sapiens
ggttcacaccattctcctgcttcagcctcccaagtagctgggactacaggcgcctgccaccacgcccggctaatttttttgtatttttagtagagacgggstttcaccgtgttagccaggatggtcttgatctcctgacctcgtgatccgcccgccttggcctcccaaagtgctgggattacaggcgtgagccaccgcgcc

SEQ ID NO: 21131 - DNA, 201 bp, Homo sapiens
ctgcgctcataaaacaccctgcaggttggcaaaaacactcataatattgatcagaagtcaggcgggatatttattttgtctttgccccactagcataaatycttgtccactgcctcctcctccccgcatgcgggatttacagtggccagcttcttaaaagcattcagtaattaaggaataaatatccattggcctttgtgg

SEQ ID NO: 21132 - DNA, 201 bp, Homo sapiens
ctatcatggcttttaactggcattgcttttaagctatgaattgtggaggaagtggcatctttactgtgtggagttccttatcgtggaacactgttctttcscagtttattcaaatttgtattatagcctccagcaaagttcagcattttttttttttatttagctgctggacatgtcttgttaatctattctgtttataat

SEQ ID NO: 21133 - DNA, 201 bp, Homo sapiens
agtccaaagataaacacacaagtaagatcattgtaaggaatgataagtgctgaagggccatatggggcaattgaatagaaaatacctggaggggctcgggrgtggggtattcctagcatttgggaagtgatttgcctgtattgaaatagtgactacatttcacactttaaaatgctggaaatgtggtcatcttcatgtcag

SEQ ID NO: 21134 - DNA, 201 bp, Homo sapiens
cgccagcggattctcctgcggaacctcaaacttcagaggcagcaggccttgaatcattgagcctccagagggaaaactgaagcctgggagagggtggctgyccagggccccacagccaaccatgtccttgcccagagaggcctgggtccctcctcctctgtgctgggtgcttcctgagtgcttggcacatctagacaccaa

SEQ ID NO: 21135 - DNA, 201 bp, Homo sapiens
cgatgatcaaaagaataagagaatattacttaactaggatagtcagaagttgttataatctgtagctgatgttttccagttattttgaagttttttataatttttttttccttagggaatatggacataggccgggcgcacagtggctcatgcctgtaatcccagcactttgggaggccgaggtgggtggatcacctgagg

SEQ ID NO: 21136 - DNA, 201 bp, Homo sapiens
caaaagtcagctgggaagagtggatttcaactttgttttcctaagagaaaaataggccagatgtggtggctcacacctgtaatcccagcactttgggaggytgaggcaggtggatcccctgaggtcaggagttcaagaccagaccggccaacatggcgaaaccctgtctctactgaaaatacaaaaaagaacttagctgag

SEQ ID NO: 21137 - DNA, 201 bp, Homo sapiens
agtggatttcaactttgttttcctaagagaaaaataggccagatgtggtggctcacacctgtaatcccagcactttgggaggctgaggcaggtggatcccytgaggtcaggagttcaagaccagaccggccaacatggcgaaaccctgtctctactgaaaatacaaaaaagaacttagctgagcatagtggtgggcacctg

SEQ ID NO: 21138 - DNA, 201 bp, Homo sapiens
gtgtatgtgtgcgcgcgcgcgcacacgtgcacctgccgtgtttgaaaaaaatggactgtcatgcattgtgagactttatagcatactctttcacatacacrtggagcatccctaatctgaaaatccaaatcttaaactggaaatgctccaaaatccgaaatgttttgagtgcagacatggcacacaagtgctcacgcagaa

SEQ ID NO: 21139 - DNA, 201 bp, Homo sapiens
gatgaggccacggctgccccttctgtttcttccctgcgcactttggggtgaagtgatggggtgttgttggctcaggttgtaggagagatgaggagcctccrcccagctcaaatcttcctttttgttccttagagcctgcgttttttgaggtttattatgtaaagccgtgccccttttcctgttggatggtgaagttccttc

SEQ ID NO: 21140 - DNA, 201 bp, Homo sapiens
aacatcctcagtctcagaagaagagaaagaaatggagaggcaaggcagccctgaccgtaggtggtatgaagtgcaccggccagctcacagccccccacacrgtaggtctaaatgaaacccgccagtcagcatgggccatacacctgctcagagcccacaaccagccttctggttggccaaggctgcagagaaaaccccttc

SEQ ID NO: 21141 - DNA, 201 bp, Homo sapiens
tcccaggggagactgaggtgggagaatagcttgagcccaagaggtcaaggctgcagtgagccatgatcatgccactgtactccagcctgggcaacagagtraggcctatgtcaaaaaaataaagagtatgtgaaaatactataggagaaaaagttttatgaataaagattgtgaaaataaaaaattcattagataaatact

SEQ ID NO: 21142 - DNA, 201 bp, Homo sapiens
ggagactgaggtgggagaatagcttgagcccaagaggtcaaggctgcagtgagccatgatcatgccactgtactccagcctgggcaacagagtaaggcctrtgtcaaaaaaataaagagtatgtgaaaatactataggagaaaaagttttatgaataaagattgtgaaaataaaaaattcattagataaatactgtaaaga

SEQ ID NO: 21143 - DNA, 201 bp, Homo sapiens
ggatgggagaggaggctctgcaaaaatacaaataaaatcttaaaacacaccaaaaataggagaacaacaaggttacctacaaaagaagagaaatctgactstagacttctcaagagcaacatgcattcttaaatataatggaaatattccctcctaaggacaaataattctgaacctagaagcctatgcaaagatgactac

SEQ ID NO: 21144 - DNA, 201 bp, Homo sapiens
agagaaggaggtaaaacgtcaaggtattttctgacatgaatgtttggccagcctagtttggtgaagctgtatccacatgtaacaatgcagagttgtattarcttccacagttattttcacatttaagtagagagcaggaaaacataatgtccaagagcaagggtttcagagtccaaatcactgaatagaatcccatttctc

SEQ ID NO: 21145 - DNA, 201 bp, Homo sapiens
tgtatccacatgtaacaatgcagagttgtattaacttccacagttattttcacatttaagtagagagcaggaaaacataatgtccaagagcaagggtttcrgagtccaaatcactgaatagaatcccatttctcctgtctcagacccttctgaagttgtctcactaaaccccagcttccttgtttttaaaatggggaaatg

SEQ ID NO: 21146 - DNA, 201 bp, Homo sapiens
aagtattgaatgagcttgtttttggccatccagccagtgcttggttatgtttgtgtttaggcctcctgtctattttagcctcttagtatttgcaaaatgcyaaatagagtgatttgatgatgcttaacggttgtccgtttctgtttcagggaattgtgggtaacttggccagcggcaagtctgccctggtgcaccggtacc

SEQ ID NO: 21147 - DNA, 201 bp, Homo sapiens
tgctcctggaaggggactgtaaaattcagagatgaccggggaacgctcccctcaaaacagtgttgtcaaatgaaaatgaatttcatgttaaaaacacacasacacacacctgttgcatttatcatataaaggagaaagaatattgtaaagatggaaccgttattcatggcaaaggaagacaccaaacaaagaaaaattctt

SEQ ID NO: 21148 - DNA, 201 bp, Homo sapiens
ttccttgtacaaccctgttctgtctcttacacttcctgacctgacctctgcattcacaagccattccaatgacattttctaggtttttggataagtgttaytggtacaacatacacataagacgcacagaatcataagtcatagccacgtttacaggggccgccactcacatccagaagcagcaggtagccagccctcatg

SEQ ID NO: 21149 - DNA, 201 bp, Homo sapiens
gacctctgcattcacaagccattccaatgacattttctaggtttttggataagtgttactggtacaacatacacataagacgcacagaatcataagtcatrgccacgtttacaggggccgccactcacatccagaagcagcaggtagccagccctcatggaccccttcctgtcccgtgcacccccaccccaccccacccca

SEQ ID NO: 21150 - DNA, 201 bp, Homo sapiens
ccagcaccagccagaaggaacttcggatcgatgttcctcccactgccaacacgcccacgcccgttcgcaagcagtctaagcgccggtccaacctgttcacygtgagtgtcaaccctgggtggagatttgaatgcgattccgaagcgttcccattaacgtaaacctggttgccacatggttcagtggtatttgtagaatctc

SEQ ID NO: 21151 - DNA, 201 bp, Homo sapiens
tccaatgacattttctaggtttttggataagtgttactggtacaacatacacataagacgcacagaatcataagtcatagccacgtttacaggggccgccrctcacatccagaagcagcaggtagccagccctcatggaccccttcctgtcccgtgcacccccaccccaccccaccccactcacaagggtgaccaccatct

SEQ ID NO: 21152 - DNA, 201 bp, Homo sapiens
tctcttggtttgacagaaagggatagatctaactgtttagtgttgccaagtgagcccccaaacatctcccctggaaaagtcattaggaatttaccatctcyatctgcaggggccaagtgagataaccgtatctagtatatccatctgagcaaaaccctgtttctcttcccttgaataggaagccagaaactgctgcagcgc

SEQ ID NO: 21153 - DNA, 201 bp, Homo sapiens
ggaagggccttagccaggcatgatgtgggagcgttggccctggcattcccgggtcttcatgagcttaattcagcaggggctccttccttcagtgatggaawctggagtttctgactgattcttaaccaactcaaaattttaggcagaaagctagctccaaggctgaggcagccctgaatgtgcctaggccaacagccagcg

SEQ ID NO: 21154 - DNA, 201 bp, Homo sapiens
gcagatgggaggtctgtttgggggacagcagctgtgtgctctcctttctttctttctctttagcattttttaatctctatatttgagtacagatacacagycatacgccttggcctcctccgtgcccttcgcagagccccggccagagaacctgtccatcccctcctgcctctgatgtccaggctgcataaaccgttcaag

SEQ ID NO: 21155 - DNA, 201 bp, Homo sapiens
ccatcccctcctgcctctgatgtccaggctgcataaaccgttcaagacttgccttgtacttggtagcgtacgctagaaggatttgaattttttgaaaatcrtgctcagtttatctcatcgtgcttacgcaattgaaagcgtatcatttttacttggtggggacacacagaacctcctcactacatcttttgagacgttgtg

SEQ ID NO: 21156 - DNA, 201 bp, Homo sapiens
gatgtccaggctgcataaaccgttcaagacttgccttgtacttggtagcgtacgctagaaggatttgaattttttgaaaatcgtgctcagtttatctcatygtgcttacgcaattgaaagcgtatcatttttacttggtggggacacacagaacctcctcactacatcttttgagacgttgtgttgtctcctgaggtttca

SEQ ID NO: 21157 - DNA, 201 bp, Homo sapiens
ttagaagcacttgagattcatttctgcaacataactcatcccaggcgcctagtcatcaccctgggtcattttctggccaccagaacttggtgcacacgccraacctacaaccacagcctcagctgtagtgttcgaaatggagaattttggctcaaacactacagcaggcaagaagagttaacctgtcgtaagtcaggaaca

SEQ ID NO: 21158 - DNA, 201 bp, Homo sapiens
gctggtctcgaacttctgtcctcaagtgatccgcccacctcagcctcccaaagtgctgggattacagacgtgaggacctggcctatttgttgattttcacrctgcaaaggaattgttagatgtgtttagttataacaagttaatatcactttaaatcaagaagcaactaaatcacagctagtttttacttgtgaataatgt

SEQ ID NO: 21159 - DNA, 201 bp, Homo sapiens
gccagtcatttgggacacctgaaacaggactgagcactggctagggagcattttttctcgccatggatgtggttctgtcgttgtgaagtttgactgattcrtcgccttgtgtttctaagaacggttggaatgatgcatgatggtctgattgcgtttagcgttctgttcctcttcccgtagatcccaactgggccagtttga

SEQ ID NO: 21160 - DNA, 201 bp, Homo sapiens
gccactcacatccagaagcagcaggtagccagccctcatggaccccttcctgtcccgtgcacccccaccccaccccaccccactcacaagggtgaccaccrtctgatttctcactccgtagatgggtttcgcctgtccttggacgggatcctaacagttggcactctcgtgcttgtctccggctctgtgttctgtgtgtga

SEQ ID NO: 21161 - DNA, 201 bp, Homo sapiens
aacaagagccaaccactgactggagaggctccggctgtcaccgtgattattaatacattgtaatgacattttggggattccgccatattttgtatggttgycagcaaaatgttgacagttgtattgtggttaataaattcatttagatttataagcattgtttacagaacctgttcgcctgctgaaactctaacagcatct

SEQ ID NO: 21162 - DNA, 201 bp, Homo sapiens
tcacggtttgtccatgtatacaccttgatgtggcccaaattcagtcatgctgtttcagtgtagtcccgcagtgggaagtgggtgtggctggggctgggggrccttcacgagctatagggctctaagagtctgccgtcagaaggattgtggatagctggtctggtgtcttccatctggacaccaggagcatgtggtcttgcc

SEQ ID NO: 21163 - DNA, 201 bp, Homo sapiens
ctggaaggtttctaggcctggttgtcatcggagaaccactctccagggagaaggagcaagagaagcggtgctctattgagtgccatgttgtcatcgttgtyccatagatggagggacagacagacacagtgaaattcctttttgtttttcaggtatttggaccttgtgtgcctaaagctggtataaaatgaggtctgtgga

SEQ ID NO: 21164 - DNA, 201 bp, Homo sapiens
aaggtttctaggcctggttgtcatcggagaaccactctccagggagaaggagcaagagaagcggtgctctattgagtgccatgttgtcatcgttgtcccawagatggagggacagacagacacagtgaaattcctttttgtttttcaggtatttggaccttgtgtgcctaaagctggtataaaatgaggtctgtggacaga

SEQ ID NO: 21165 - DNA, 201 bp, Homo sapiens
ggtgcagcccatatgggtgccttcccaggaggagagcagggcggagaagggatgtgaagggatgtagcaggaacatggtgggcacgggctccaggaggggrtcccgagatgggagtatctcctctgctcctcagggatgctgccttctgtggggtctgaatgccctattgtaatagggatctggctaaggcacacaatacc

SEQ ID NO: 21166 - DNA, 201 bp, Homo sapiens
tccaggagggggtcccgagatgggagtatctcctctgctcctcagggatgctgccttctgtggggtctgaatgccctattgtaatagggatctggctaagrcacacaatacccagaggacagccacagggtggcttcgatggtggcacgtggaaaatacagggaggagcatgagtgctccccttagtgccatgtcgccagc

SEQ ID NO: 21167 - DNA, 201 bp, Homo sapiens
gcagggaaggaacaggcccataggcacccctccatgggcccctcaaggctgtagacccctctgtctgaccagcatcccattccctgaagtgaagcagctgscaccaggctggcttttcccaggcagtcacactctgggatgcccccacccctcagcacacacagtgactgtgttttcatgttttccaccaagggagggagg

SEQ ID NO: 21168 - DNA, 201 bp, Homo sapiens
acgtggaaaatacagggaggagcatgagtgctccccttagtgccatgtcgccagctctgggctgctcctccacgtctcttaagatgccacatgcctggccyacctcccccggctgctgtgaggcctggtgcaagagcaagcatgggagcaccacatggcactgtcattcaagatgtgggctccaaatgacgctgtgtgttt

SEQ ID NO: 21169 - DNA, 201 bp, Homo sapiens
ggcagggaaggaacaggcccataggcacccctccatgggcccctcaaggctgtagacccctctgtctgaccagcatcccattccctgaagtgaagcagctsccaccaggctggcttttcccaggcagtcacactctgggatgcccccacccctcagcacacacagtgactgtgttttcatgttttccaccaagggagggag

SEQ ID NO: 21170 - DNA, 201 bp, Homo sapiens
tgccagtggtctgccgtggtggagttttgattgtgattttttgttttatggtggtgactttctggctggagtggtttttttaattaatgtgcacacagatygcctgggatcttactaagaggcaggtggcaggtggggcctgggattctgcatttctcgaatgcctcttggcgatgctgcttctgtaggtccgaagaccac

SEQ ID NO: 21171 - DNA, 201 bp, Homo sapiens
gggatgccactgagtgagatgattggcatgttccaggatgagactctgtagacatgacactaatacacctggcaaagccatagacgcaagtcagccattcycatgcatcccttccatggggctcatgctcacttgttggttatgaccttgcctaagtggaggtcttgggttcctgagtatgtcgttaatgaaaccttggat

SEQ ID NO: 21172 - DNA, 201 bp, Homo sapiens
gctggacaggacgccctaagctctcatgctcctctgggagcgcagcaccctgtggggcggctgcatcagagactcacatcttgcctttcatctgtggaacrttttgtccttgctaggctgtcttgcccctgtcatctcatctgttcctctttggcacagggaggaggtagtcatcccatttggtcagtttggaaactgagg

SEQ ID NO: 21173 - DNA, 201 bp, Homo sapiens
gtaaagagaattgagtatgaagatggcctgttgattccttttaagcgtttaagtttttccgtgcctgggattgccttatgtgcaaccgccagcttctgtcstttgaaggttttcctaagatattttcctagtttaataggaagtgtggacatgggacattgtacggcttaggagactgcgttgtgtttggttttgaatata

SEQ ID NO: 21174 - DNA, 201 bp, Homo sapiens
ggtgacagagacctcgtctcaaaaaaaaaaaattatatatatatacacacacacacacacatacatacacacacacatatacatatacatacatacatatrtatatagtgatccatgcaaaatctgcagcaggggtaggcagacaggaggaagtgggttgcagggtcaaggcaagcctcagagaaaaaaacctgagactga

SEQ ID NO: 21175 - DNA, 201 bp, Homo sapiens
tttcaaagatagaaaaacattggaaacacattttaggaatttctgatataagttttcaaggaggttgtgcagaattggtaaagagaattgagtatgaagayggcctgttgattccttttaagcgtttaagtttttccgtgcctgggattgccttatgtgcaaccgccagcttctgtcctttgaaggttttcctaagatatt

SEQ ID NO: 21176 - DNA, 201 bp, Homo sapiens
tcccgcgttcctctatccatggagtgtctgtggatctacgcgagtgcttagatagaaattaaccctgcagccggagattagcggccctaacttaattttcrtcccacagataaggatggtcagccatgagttacatggttattctcctaagttgctttgtgtgtgcaccacacagagacgctgacatcactcgttgatttc

SEQ ID NO: 21177 - DNA, 201 bp, Homo sapiens
cgtgggaattgatgcctctcccacggtaacaggtcctctgccataaaagaacagaaccttcccgcgttcctctatccatggagtgtctgtggatctacgcragtgcttagatagaaattaaccctgcagccggagattagcggccctaacttaattttcgtcccacagataaggatggtcagccatgagttacatggttat

SEQ ID NO: 21178 - DNA, 201 bp, Homo sapiens
gtagctaccaagtctggggcctgtctcagctgagatcctcctaaggcacgcgggatcccatgcactctccctgtctgaaaacgtgggaattgatgcctctsccacggtaacaggtcctctgccataaaagaacagaaccttcccgcgttcctctatccatggagtgtctgtggatctacgcgagtgcttagatagaaatta

SEQ ID NO: 21179 - DNA, 201 bp, Homo sapiens
aaagggaagcatgttctgtttcattttgagcaagaaaaaaagccgtaaaatcagaataaggagatagtcatgtttttggcattgatgaaattggcaggacraagtgtgtttttgagttggctgtatggaactcagaatgtattgtcccatattgttataattaatttgacaagaaatccagggcttaccaaaagccatact

SEQ ID NO: 21180 - DNA, 201 bp, Homo sapiens
tgattattaatacattgtaatgacattttggggattccgccatattttgtatggttgccagcaaaatgttgacagttgtattgtggttaataaattcattwagatttataagcattgtttacagaacctgttcgcctgctgaaactctaacagcatctgttccttcttactaattaactgctaattacaaatgagctttgt

SEQ ID NO: 21181 - DNA, 201 bp, Homo sapiens
ttgccaggcgtcagtgccctgctcggggtccctttgcagctcccctgaacgtgccatttgaagcatagcaaccattactttgagaacctgtgcaggtccakgtgccgagggctgtcagatccctgcatcaactctggggatgggttcaattattatcctctctgtaaacagttctcagttattccaagtattctatttctt

SEQ ID NO: 21182 - DNA, 201 bp, Homo sapiens
tgcttcgctgaagtgaggaggggtgtatcttgtaatttttaaatgccattattaacttccctagggatgcttgtaaaatgaacaaacgtgcatctttaaattttttttattttttttttttaagcttggaaagagttgaaaagtcaaagtcacatcagctctctagggattgggctgggctcacattttatgaatttgctg

SEQ ID NO: 21183 - DNA, 201 bp, Homo sapiens
ccgtggcctgcccaaggaaatcgtgttaagtgctcacttcactgcgggtcagaaccccggagtgtttcacccatggaaatagtcagcagtcgccacatgcrgggtcctcactcactgctggtacctttgtgtagtagttactttgtattttacaatgtaaattaaaaaaaaaagttgggagaggaagtgaaatctgatttg

SEQ ID NO: 21184 - DNA, 201 bp, Homo sapiens
cttgcatttgtgcagcgattccagcaacaaccctgtgcggtagattattgtcccataaatctataagattgattgattggttatctgtaggagacatctaygtatacgtatttatagagcaatgaagaaataagcccaaggctatcccatgagttaggggcttcagggcttctgcgctttgctggcccttgtgctgccttc

SEQ ID NO: 21185 - DNA, 201 bp, Homo sapiens
gggataataatagtacctacctctctgtggcactttgggggtagaatggatgaactgaattaacgtctgaagtgccacagtgttgtatctgagtgagtagygtcctccttaagcattggctttggtgcactgggaaggggcgtcagctgggcaggctgagcctgtcacctttttcaaaatttccaacaactgtggcttctt

SEQ ID NO: 21186 - DNA, 201 bp, Homo sapiens
acatggcagtaaccccctgggagcggctgctgatgttctggctctctgcagttgggtaggagtggaggaggggtgcgatcggaagggagtgccgcgcagaccccccccaccccctcagaacagcggccactgtgtggatgtttctgacggcctcttacagactctgtcctttttgttgtagctgatggagcagaattttaa

SEQ ID NO: 21187 - DNA, 201 bp, Homo sapiens
tgaaccccacagcgctgggcggttgacgaggtgtggccagcttgcatctgctgaaagaaccggggtggccccactgcatcttgatcagacactgccatgargtccctcccctctctgatggcaaagggaaacagtgggctctacacatggagctttgaagtcaagagtcattttcatccttagctcaggcatgaaaaaaaa

SEQ ID NO: 21188 - DNA, 201 bp, Homo sapiens
aatatgaactagttcacaatgaattatattttgtatgcatgattgtctgtgattattaattgatgtgtacttcctctttgtcaaaagttataatgtatccrtctaccatgaaaggtccctagaacatgaaaggtggtttctctacatgcctgtgaaattgatgagcagggagaggcttactcatattttaatgccagcagt

SEQ ID NO: 21189 - DNA, 201 bp, Homo sapiens
aatgaggtcagtagagtgggccctaatccagtaagactgtgtccttataagaagaggagattaagacgcagacacacagaggaaagaccatgtgaggacamagggggaagacggcatgtccaagccgagagacctcaaaagagaccagccctgtccacactgtgctgatctcggccttctaggctccagaactaggataac

SEQ ID NO: 21190 - DNA, 201 bp, Homo sapiens
cctaagctcatattcaacactttagaatgccttaatcttttcttgttgtgttttgaataggttacatgcagacatccaaaataaacttttttttttctgtacaaaattagatttagctaaagtagcttaggttttataaaagctgatgttcttcatgctcttcccaattttgggaaaggagccttcgtctttgcttcctag

SEQ ID NO: 21191 - DNA, 201 bp, Homo sapiens
cacaggtgtgcctgggccagatgcatgtctgacagggacatcaggtttggggagactgaaaaccatttttgaaaatgaagttatgctgatgtcatttaatvgtacgtcatcataattggcagcagagaaggttgcacatcactcatggcagatccattacatgggccatgggccaagctgtgcaccaggtgctgggaggat

SEQ ID NO: 21192 - DNA, 201 bp, Homo sapiens
agtgttaacaggagtctaacaaatccagtattgtccttgtgaatcttattctcatttgtggaatttctcaaaaatacagcaactgactgagattccaaacrgctcacaattaaagacagtacaatgttttgctttacagagaagtggcagtagtacagattctgtttttttgtaataaatgtttctgacattttaatagtg

SEQ ID NO: 21193 - DNA, 201 bp, Homo sapiens
ggtgcagtgcatggcacatgggaagtgtgtgtgacagttaatggtggcgttttttaaaagtacatatgtctatagcagtctggaaaggcatacgccagaatgtttgtggcagtgacagtggattttataagtgatttttttccctttacattttttcttaaatatgcatttctcttttcctcaatgaacacgctaattatg

SEQ ID NO: 21194 - DNA, 201 bp, Homo sapiens
tggcttttcactttctgtgtttttaaaaaggcaggaaacgcacactctgccctggttggggagcccagttgaaatgacatctggaaatttctgtcgtttgktttgttttttggccttttcctttgagtggtttgatctctagagcagtgagagttagagagcttgctgggtgcaattgggagtcccaccttctctctgtct

SEQ ID NO: 21195 - DNA, 201 bp, Homo sapiens
ggtcatttccagaagtgccgttttgaccactgctgtgcctttcatccagatttttgcaactggtaaaggtgtcacaggcaccattgaaatctactccctcrtcagggaacacactcttgttgatagcaacagcatgcaatctctgttacagcctctaagttggaacagagaaggctttcgtagaggacatttggtggaaat

SEQ ID NO: 21196 - DNA, 201 bp, Homo sapiens
gtgcagtgcatggcacatgggaagtgtgtgtgacagttaatggtggcgttttttaaaagtacatatgtctatagcagtctggaaaggcatacgccagaatgtttgtggcagtgacagtggattttataagtgatttttttccctttacattttttcttaaatatgcatttctcttttcctcaatgaacacgctaattatgt

SEQ ID NO: 21197 - DNA, 201 bp, Homo sapiens
tcccggccttctttgttttcaagtcctcattctcatttaattttgtatttatcactagaactttgggttaagttttaccatgtacatgttttacatataamtgaatgcacttttcacttacatgcagaagtcagagtttaacctgttaaaaacttagaccaaatgtattagaggtgataaccttggccataaaaacctatc

SEQ ID NO: 21198 - DNA, 201 bp, Homo sapiens
cttgagctcattcttttcgtcagagatcaaaaccaggagtgcctccttcagcttgtactaccggatggcttagcacctggcgagtgagtgtctcagaaagraaactgcaggagtgcattagaccactcaggggccctgctgtcctgggtgttcatccatggctccattcatccatggctccgtgcacgtgcagcccgggac

SEQ ID NO: 21199 - DNA, 201 bp, Homo sapiens
tgcagtgcatggcacatgggaagtgtgtgtgacagttaatggtggcgttttttaaaagtacatatgtctatagcagtctggaaaggcatacgccagaatgtttgtggcagtgacagtggattttataagtgatttttttccctttacattttttcttaaatatgcatttctcttttcctcaatgaacacgctaattatgtg

SEQ ID NO: 21200 - DNA, 201 bp, Homo sapiens
ctcaggaggtttgactttaggactcagaatgggcttttgcttagactcactgtgaaaagtgacagtgaagttcccagcctggaaagatcccctgcgatcargttctgttctctgagttctgagtacacatccatgttccatcagtaggaagggagtgtctgagatcccgggagttgggaccacacacacctgcgtgtgact

SEQ ID NO: 21201 - DNA, 201 bp, Homo sapiens
gttccgcctgcagcccgggcctgtggtggagtagagcttctctccccagctttcccgggagtgtgtggtctcctgtttcccatctgcatttgcttatgggscgccatgacaccaacacatggagccacttggagacttgtgtgttagttgtgcacagatacctacacttcccactgcccgacagtacgtgcagtgattttg

SEQ ID NO: 21202 - DNA, 201 bp, Homo sapiens
gcagtgcatggcacatgggaagtgtgtgtgacagttaatggtggcgttttttaaaagtacatatgtctatagcagtctggaaaggcatacgccagaatgtttgtggcagtgacagtggattttataagtgatttttttccctttacattttttcttaaatatgcatttctcttttcctcaatgaacacgctaattatgtga

SEQ ID NO: 21203 - DNA, 201 bp, Homo sapiens
ggggtaggcagcgttagaggtcagagcatatgggatgggaaagaacggaagaggaattaggttcattgccaaaggattcctgggctggggtgaggcctccrcccgctggcgggaggggcagctctgccagcaggagctctttctgggcagtagccaaggactgcacgaatgttcataattgggcaagatgggaatgaatga

SEQ ID NO: 21204 - DNA, 201 bp, Homo sapiens
agaagtcaaatgcaattcatgactcagcttttattgtcagataacacattccagtgcattaggcaaaagaaactctcctctttgtgttatatgtaagtttrtgttacatataagtttgttatatccgtggtgtataagatagatgtataaacaaaattaactttattcttggggaagaaatgcagacgttctacccattga

SEQ ID NO: 21205 - DNA, 201 bp, Homo sapiens
gaccgtatccctggaacgggggtgcagcctatggaggctgtagtggtgattgtcagagaagaaacccttaactgcagagttcacttgccttccagtaacgrggaaacgtcagcccaaccctatttcatagggctaagaaaataacatgagaaaagagaaaagaaaaaactgaataaattcctcaggacatcactttttaaa

SEQ ID NO: 21206 - DNA, 201 bp, Homo sapiens
tttactttcagttttttcactgtcataaagaactctaatcaacgttcctctgtttatctctctgtccccttgtccaatttgcctaggatacattcctagcrattggcttcctgcgttgaagagtcgcatgtgctttcatggtttttgctgtattttgtcaaattcccagaaaggttgtatcagtttatctcatctggcagt

SEQ ID NO: 21207 - DNA, 201 bp, Homo sapiens
cagagactcacatcttgcctttcatctgtggaacgttttgtccttgctaggctgtcttgcccctgtcatctcatctgttcctctttggcacagggaggagstagtcatcccatttggtcagtttggaaactgaggcggcagacagggcaactggcttacccagggtcacgtgacagaagtggcagcgctgagaaataagat

SEQ ID NO: 21208 - DNA, 201 bp, Homo sapiens
actggtttctgttgttactgaaagcacctcccatgcgttactattcagtgggattcgagatgcagatatggatagattcttacatagatattctttattgyagtaaggaaattcctttgtgctcagtgtcctgctagtttagttttggaatatagtcagactggttctccagggggccttcagatcgaagagatgtaatac

SEQ ID NO: 21209 - DNA, 201 bp, Homo sapiens
ttgtgcaggtcgtttaaggattgatagagttgatcaaggaaagcttcccaaagaaaatcaaacttgagaaatgcttaaagaaccagatggatttttttgtrcaaaacagcaggaggaagttattataagcattggggcacttcggacaaagacccagagaggaggaaaagggaagatggaatagccacgagccgcagtgaa

SEQ ID NO: 21210 - DNA, 201 bp, Homo sapiens
ccccaggcccgtgcatgaggccagctgcctgttttcataaatagacttttcttcttttttttggagacagagtctagctctttgcccaggctggagtgcartggcgtgatggcagctcactgcaacctctgcctcccaggttcaggcaaatcttgtgcctcagcctccccagtagctggaattacaggtacacgctgccac

SEQ ID NO: 21211 - DNA, 201 bp, Homo sapiens
ggaaaagggaagatggaatagccacgagccgcagtgaagtgaaaggtgatagttggggtgcagaaaaatgaggagagaccagaagagatgagtgttgagarcccagcactgccaaattagcatctgattttcagacttgggagctgacattttacagagcaaagatccagaaagacagcagaatggtgcacagaagtctga

SEQ ID NO: 21212 - DNA, 201 bp, Homo sapiens
caacctcttgtgtagattctttatggacccagaattgatctacatgtcagatcctgttgtggtttaaactgtttatcactgtaatggcagtagtgagcccktgaccaccaacttataatcctgggtgaaagaaattggtgtttgcagtcaatgaagaggcagctttgctttattgatagattcagaacaattatctctgca

SEQ ID NO: 21213 - DNA, 201 bp, Homo sapiens
tcctgtctctgcatgtggccgaggagcaggcagaagcgtcctggggtaactggacacagggggtgaaaggtggattttttttcctcccaatcagaatgttktaactttgtactttgtctccttagttccttcctatcagctattttcagcagtagctgctgaccaggggaaacagaggacagtgaaatgctgccccatgat

SEQ ID NO: 21214 - DNA, 201 bp, Homo sapiens
gtacagataatggaacaggagtaccggacctggtggggaaggcttgggtgtggtttgtctgcagaaacgctgtcaagacttacattctgcactaagaggaygagagaggttctgaatgtctcactgggctccgaggatcctttcgggggccacattttgagaaagacatcggcacactgggaagcacatgaagcggagggc

SEQ ID NO: 21215 - DNA, 201 bp, Homo sapiens
gggggcgatttttaaaaatacttgttcctggggccagccgctagagatctagtccatttggcctgggatggaacccaagcagtggaatgtcccccaggggkttcagatgcgcagccagggttgagaagctctttcagagggacctgaatgatgtgtgtgaatggtggttataggacaaaatctgatcctgattctgtataa

SEQ ID NO: 21216 - DNA, 201 bp, Homo sapiens
gtcccagcgactgtttccagccttctcctctggcatctctgccttcctctcccttgcctgaaggccctctgcatcctttcccgatgaaactggggaacgtscccacttctctcccatgccaaaacccatgcctctccagcctctggagcttccatgtatgatctgttcctgcttggacatggggtagggcatcccttccac

SEQ ID NO: 21217 - DNA, 201 bp, Homo sapiens
taaattctatgtacgtgtaattaatcaaaacattgattaatacccctggaagtatttcaaagatagaaaaacattggaaacacattttaggaatttctgayataagttttcaaggaggttgtgcagaattggtaaagagaattgagtatgaagatggcctgttgattccttttaagcgtttaagtttttccgtgcctggga

SEQ ID NO: 21218 - DNA, 201 bp, Homo sapiens
ctgttacttctctttctttgttatcctctcttagttttgtgacctagcaattattttctcattaggtatatattcctgcatgttacccatcatgttaaatrtaagtgatggatgttgaggagattagttgctttcctgcagataatgttcccctgtagtagctctctgtggtcctgagcattggtgtgtaattcagaagta

SEQ ID NO: 21219 - DNA, 201 bp, Homo sapiens
tgctgtggcgtgatctcagctcgctgcaacctctgtctccagggttcaagcaattccaccatgcccggctaatttttatattgttggtagggacagggttytgctatgttggccaggctggtctcaaattcctgacctcaactgatccgcccacctcggcctcccaacctgctgggattacaggcgtgaaccaccacgcct

SEQ ID NO: 21220 - DNA, 201 bp, Homo sapiens
gagcctactaaaaactcactggtgttacaccaacacagaaaaggactctgtatcaaagtctatttctgtctatgtaattctttctttgttttatatacccycagggtttggaaatgtttgggatttaaaaataaaagggccgaaagctatcctcacgacatttcattattgatgttgttgacacacagtgaatggaagcag

SEQ ID NO: 21221 - DNA, 201 bp, Homo sapiens
tgactggcttgttgcatttaacattatgtcctcaagattcttccagttgtagtgtgtgtcagaatttccttcctgtttgaggctgagtaatattccgtcayatgtacacaccacattttgtttgtccatggatggacacttgctttcacctcttggccactgtggacaatgctgctaggaatgtgagcatacagataactc

SEQ ID NO: 21222 - DNA, 201 bp, Homo sapiens
tgcctctgttgagaatgttcttttctgccccatctctttgcctcactaactcctctttccaatcctggcttaaatgctacttcctcttgggagtttccccrcactcggcctatttgggcacccatgctgtgtgtgctctcacgttactctattgggccatctctctgattctcccacaagactggaagctccttgaggcaa

SEQ ID NO: 21223 - DNA, 201 bp, Homo sapiens
gagtgaaactccatctcaaaaaaaaaaaaaaaaaaaaaaaaaaaaaaaaagagacacccttgcaggcagtggtcacaggccgaggaacctggtggacaagktggggaacgactcaatggatgatgataaacaggaagttctagtaccactgagaaaacgatctgccagatatctccatcagcaatgttcttaacatgtttt

SEQ ID NO: 21224 - DNA, 201 bp, Homo sapiens
gcagctggacttagagacaggcgtcctgagtgttgatgccagccttaccctgaccctgtgtgtggcagcagtgggtcggtcaaacctttccaagcctccgygtcctcatctgaaaatgggaatgaggatgcctatccgaggtgacttagcagaggatgaagcactcccgtgagtgagctgcgcacagtctccttgtacaag

SEQ ID NO: 21225 - DNA, 201 bp, Homo sapiens
ggcaggagaattgcttgaacctgggaggcggaggttgcagtgagccgagattgtgccattgcactccagcctgggcaacaagagagagactgggtctcaaaaaaaaaaaaaaaaaaaaaaaaaaagaaagaaagtttaaaggatgttaaaaattttccacacattatcttttaatgtgttgtcaaggagcaatgatcatca

SEQ ID NO: 21226 - DNA, 201 bp, Homo sapiens
tgggaggcggaggttgcagtgagccgagattgtgccattgcactccagcctgggcaacaagagagagactgggtctcaaaaaaaaaaaaaaaaaaaaaaaraaagaaagaaagtttaaaggatgttaaaaattttccacacattatcttttaatgtgttgtcaaggagcaatgatcatcataatggcactggggaaatgga

SEQ ID NO: 21227 - DNA, 201 bp, Homo sapiens
cgccccaggccatggagacctggagatgctcagggaagggggtggtcaggccctgggtcccatgttggcagcctccctggcccagcgttgggctgggaccmtctgcctctcccagtgagaccaaccctgccctctggacggatggaaggacactggggagccgatgatgcccagagtgtctgggggacgcatccagggtcc

SEQ ID NO: 21228 - DNA, 201 bp, Homo sapiens
aaactcctgagcccaggcaatctgcccaccttggcctcccaaagtgctaggattataggcatgagccaccgcgcctggctgtaaatagacttttcatgacrcagagccacgctttgtgtcgatgggctgcagcgggtttgggcccctctccagctgtgacagcagagatgagggtctttgcggcctgagaagcccagaata

SEQ ID NO: 21229 - DNA, 201 bp, Homo sapiens
aattagctgggcgtggtggcaggcgcctgtagtcccagctactcgggaggctgaggcaggagaatggcgtgaacctgggaggtggagcttgcagtgaaccragattgcgccactgcaccacccgagactccgtctcaaaaaaaaaaaaaaaaagaaaagtcaagagtcttcacaatgaatgttgacagtaatacaaggtca

SEQ ID NO: 21230 - DNA, 201 bp, Homo sapiens
tcaccatgaagccccctgcactaactagggcgtgtgccccttgaggagccgcatccgcttattgggcctaagaaaaactgattcccaggtgtgtttgggcygtctagaaccatgtgacctggcagccacttcaacttgggcagcatctcggctgggagccccagggagcctggcagtacctcagtggcagatgcagctcgt

SEQ ID NO: 21231 - DNA, 201 bp, Homo sapiens
gctgggcgtggtggcaggcgcctgtagtcccagctactcgggaggctgaggcaggagaatggcgtgaacctgggaggtggagcttgcagtgaaccgagatygcgccactgcaccacccgagactccgtctcaaaaaaaaaaaaaaaaagaaaagtcaagagtcttcacaatgaatgttgacagtaatacaaggtcagcttt

SEQ ID NO: 21232 - DNA, 201 bp, Homo sapiens
ttacatagaaacttgaatttatttgtccaagagtttcttgttttgaaaataggatgccactgggaacattcttggttaggagccaccggaagccgggtctrtatgggcagggccagtgagatgcaaagccacacacgaaagctaagcacacactcttgttttcctcactcacatccatgttcatcctctttcctgtgctga

SEQ ID NO: 21233 - DNA, 201 bp, Homo sapiens
ggcactgggggctggggcgggctggatgtgcggacttggcagctgggggctgcaggtccgtctgcagggactgcacagggctctcgttcctagattgcttmacagccagcggctctgtgcctgtcagattctgcatggctctgtttgcctcttcctgcaactgggaaataacctatatacaagtttttctatttttaaagt

SEQ ID NO: 21234 - DNA, 201 bp, Homo sapiens
cccagcactttgggaagccgaggcaggcagatcactaggtcaggagattgagaccatcctggctaacatggtgaaaccccatctctacaaaaaaaaaaaamaaaaaaaaaaaaacattagctgggcatggtggcatgcgcctgtagccccagctactcgggaggctgaggcagtagaatcacttgaacctgggaggcggag

SEQ ID NO: 21235 - DNA, 201 bp, Homo sapiens
tctttatgattagatggtgatctttggatggaaaatattaaaataagaattgattaaaccagctagggatggtggctcacgcctgaaatcccagcagtttrggaggccaaggtgggtggatcaccggaggtcaggagttcgagaccagcctgcccaacatgaagaaccccgtctctactaaaaatacaaaaattagctggg

SEQ ID NO: 21236 - DNA, 201 bp, Homo sapiens
atggccatcttagttatctgaccactttccagccttcagccacgcagccctcagaccccccctaccccccaggccactgtgtccctggagacccctgtccyctgcatgcttcctactccttagaggcccatcagcctccaagagccaccctaagcaagtcacctgtctgtgggtgacagcattgagtccatgttaagagag

SEQ ID NO: 21237 - DNA, 201 bp, Homo sapiens
acataagacagatgaatgggggatgaagccgcaaagggtccccgctgctgcccccttggacatcgtaatagtgaactgtgttctggccttgggtgaggatsaaggaagctgggcccagatctttttccttggttttcaaagccttccaggtaaatatgggacctgccagggtctttcagcactggaaatagccgacatgcc

SEQ ID NO: 21238 - DNA, 201 bp, Homo sapiens
aacacaaaaattagccagttgtggtggcgggtgcctgtaatcccagctactcaggaggctgaggcaggagaatcgtttgatcaggggcagggagcagggtrggcagaggttgcaatgagtcagctactcaggaggctgaggcaggagaatcacttgaatggggcagggtgtagaggttgcagtgagccaagtttgtgccac

SEQ ID NO: 21239 - DNA, 201 bp, Homo sapiens
catacattcagaggtttaaaaaaatccaacaaaatgaaaaatacttttgagttactatttttagaaaaaaattagtttgggttgaaaaattcttaccctcrtgaagctataaaagcacatgttttactgatgagagaagcttctggcacatcaactgagacaaaaatcttccatattcactcggtaaatacaaatacagaa

SEQ ID NO: 21240 - DNA, 201 bp, Homo sapiens
tgaaaaattcttaccctcatgaagctataaaagcacatgttttactgatgagagaagcttctggcacatcaactgagacaaaaatcttccatattcactcrgtaaatacaaatacagaagatgggctgggcgcagaggttcacagctgtaatctaagcactttgggaggctgaggcaggcgaattacctgaggtcaagagt

SEQ ID NO: 21241 - DNA, 201 bp, Homo sapiens
gcggaggttgcagtgagctgagatcacgccactgcactccagcctgggcgacagagcgagactccgtctcaaaaaacaaaaccaaaaacaaaataaatacraatgtgtaagatagaattcgttatgaagctacaccagacattttcaggagtaatttgagaatgtgcttgaggtgattatccttaaatcatccaagtgttt

SEQ ID NO: 21242 - DNA, 201 bp, Homo sapiens
agaaacgttaagtgtgcacagatgctcatacgtgtgcagagaaatgcctgaattaactctcacactgccaacattagatcattaaacacactattagtaartgttctctattttgattttcatgttaagactcatctcttttgctcatagaattaattttatcaatgacatagaaaatggttattttaatacttctctgca

SEQ ID NO: 21243 - DNA, 201 bp, Homo sapiens
agtggtgacggtcagggtgtgagtgtggggacgtggctggcgtggtgacgggtgtgtgggggcatcattgggagtgatggcgatggcttgtcttctcaccrgccggtttggagtccagaaccacatgaatgacctcagggtgggtcagaacaaggagctgtcagtctgagacctctcagtgtgctctttcttggctagcaa

SEQ ID NO: 21244 - DNA, 201 bp, Homo sapiens
gatctcctgatctcatgatctgccctcctcggcctcccaaagtgctgggattacaggcgtgagccaccatgcccggcaattttagcccttttgacacactytatgacccttcttacgcgcctcccgaggaggaagcatgcactagagcgtgactacaaacctggtgccatgctagagcgggagaggagtgactgcaaacct

SEQ ID NO: 21245 - DNA, 201 bp, Homo sapiens
ttcaccgtgttagccaggatggtctcgatctcctgatctcatgatctgccctcctcggcctcccaaagtgctgggattacaggcgtgagccaccatgcccrgcaattttagcccttttgacacactctatgacccttcttacgcgcctcccgaggaggaagcatgcactagagcgtgactacaaacctggtgccatgctag

SEQ ID NO: 21246 - DNA, 201 bp, Homo sapiens
cattccggccgggcgcagtggctcatgcctgtaatcccagcactttgggaggccaaggcgggcggatcacgaggtcaggagatcgagaccatcctggctawcacggtgaaaccccgtctctcctaaaaataaaaaaattagccgggtgtggtggcgggcacctgtggtcccagctactcgggaggctgaggcaggagaatg

SEQ ID NO: 21247 - DNA, 201 bp, Homo sapiens
gcgcagtggctcatgcctgtaatcccagcactttgggaggccaaggcgggcggatcacgaggtcaggagatcgagaccatcctggctatcacggtgaaacmccgtctctcctaaaaataaaaaaattagccgggtgtggtggcgggcacctgtggtcccagctactcgggaggctgaggcaggagaatggcatgaaaccgg

SEQ ID NO: 21248 - DNA, 201 bp, Homo sapiens
ctcatgcctgtaatcccagcactttgggaggccaaggcgggcggatcacgaggtcaggagatcgagaccatcctggctatcacggtgaaaccccgtctctmctaaaaataaaaaaattagccgggtgtggtggcgggcacctgtggtcccagctactcgggaggctgaggcaggagaatggcatgaaaccgggaggcagag

SEQ ID NO: 21249 - DNA, 201 bp, Homo sapiens
tgggtactatggctttgggcactcccaatccaggtgccatggcatggggagcagtgggtgaaccaaatcctggagcctggactgttccattgggtgcattyctggctggcagatagaggaccacccagctgtgcttgatggggtctagaagcattgaaactggtttgccgttatgatgtccatgaggttggagtcctttct

SEQ ID NO: 21250 - DNA, 201 bp, Homo sapiens
cggtgaaaccccgtctctcctaaaaataaaaaaattagccgggtgtggtggcgggcacctgtggtcccagctactcgggaggctgaggcaggagaatggcrtgaaaccgggaggcagagcttgcagtgagccgagatagcgccactgcattccagcctgggcgaaagagcgaagcctccatctcaaaaataaataaaataa

SEQ ID NO: 21251 - DNA, 201 bp, Homo sapiens
ttaagtagtgatgtactttttgacctagttaaccctccatggaatcgatgatcaaaagaataagagaatattacttaactaggatagtcagaagttgttayaatctgtagctgatgttttccagttattttgaagttttttataatttttttttccttagggaatatggacataggccgggcgcacagtggctcatgcctg

SEQ ID NO: 21252 - DNA, 201 bp, Homo sapiens
agagcttgcagtgagccgagatagcgccactgcattccagcctgggcgaaagagcgaagcctccatctcaaaaataaataaaataaaataaaataaaatawaatataacataacataacataacataaaataaaataataaataaaaaagtgcagactccctggccatcagcctcatctcttctacctgagtggattaagt

SEQ ID NO: 21253 - DNA, 201 bp, Homo sapiens
gtgagtgatagcccagccagctcattcagccaggcggcccgattcccaggttcccacgcatcgccgggaaggttggccttcctctgaggttgagccctcakccagcccacaagcctccatccccaccaggtggccgatgagaggaaacccaggctctccactggcctggcacttggcaggagaaccctgccctgcacttct

SEQ ID NO: 21254 - DNA, 201 bp, Homo sapiens
gccagtgagggcaggctccggtgagggctctcttcctggcttacacacggctgccttctcgctgtggcctctcatggtggagagagagagagaaaggctgstctcttcctcttcctgtaaggacactgatcccatcatgctcctcacggccatgacctcatctaaacctgatcacctcccagaggccccacttcctcatga

SEQ ID NO: 21255 - DNA, 201 bp, Homo sapiens
agagataggtttaaaaaacaatgtatgtttcactcagagcataaacaaaattgttgaagagccagcctacatgcaagtttaaaaattaaaaatggccttaygtattaaaaacaatccaggctgggcacagtggctcacgcctataatcacaacactttggatggccgaggcaggcggattatttgaggtcgggagttcaag

SEQ ID NO: 21256 - DNA, 201 bp, Homo sapiens
aaaactccttggcaccatctaattttttaaaaatgagcctaatactgttcacgttttagcacctggcaaatgtattgatactttacgagcattcacatgcrtttaagagtgctcttagcagttcgcgttctatatagaactgtttacacctctcaggattcttactctaacaaacaggtatagacaacatcctagttgcat

SEQ ID NO: 21257 - DNA, 201 bp, Homo sapiens
aaaaagcaaaactgccagttccttgagcatggctgtgtgtcgttggtgctctgaagggcttgagaatctctctctacccttcattttcatgcacagaaacygagtttcagggaagagctgtggcccaccacggtcgcttcagcccctccccgttgcccatgtttattccttttctgcctttcctcattgtccatctggact

SEQ ID NO: 21258 - DNA, 201 bp, Homo sapiens
ggaaacagattttccaattggatattttaataaatgatggcttcagaaggggcacaatattctacgccactgattgaatgatgacaagaaatattttaatrggtgcattgctgtcgcagtgtagtaaaaagtaaagaatggttcaccaagtcagaggtcatcctcagatgtccctatgtgtctgttagtggagataaagtg

SEQ ID NO: 21259 - DNA, 201 bp, Homo sapiens
aagcaaaactgccagttccttgagcatggctgtgtgtcgttggtgctctgaagggcttgagaatctctctctacccttcattttcatgcacagaaaccgaktttcagggaagagctgtggcccaccacggtcgcttcagcccctccccgttgcccatgtttattccttttctgcctttcctcattgtccatctggactggg

SEQ ID NO: 21260 - DNA, 201 bp, Homo sapiens
gattacctgctacctgctctgccctgactcattctccaccctgcataaccatttttcccgccgaaccactcaccgggtcactctctttaaattagccaatyggaattagtttagcctgtgcggtctaaccctagccaacaggggaacgacacagcagcaggggccacgtgagtcagggataagaaccccttccctcccttg

SEQ ID NO: 21261 - DNA, 201 bp, Homo sapiens
gatccatgtttcccaggcacctaaagcacatcccccccactttggtgatcgtaaaaatctgttattccatgtttgaaatatcaggatttcagaactcagtsactgacaggtcactgccacaacagctaaagaattaaaacccaaacatgtctccttatctctgctgcgtcctgagtcggctcggctgcctgcatgttccca

SEQ ID NO: 21262 - DNA, 201 bp, Homo sapiens
acgggaagaatttatggctttataagtgagtatttccgtattagcaaagagacatctacacttgaaagactttcctgcagcctcccgggggtcgaggtcargagtctgggaggaggtgtggagcagagtgtccgggtgagagggtgctgggggcacgtgcccagcaggggtggaggggtggacaggctcaaaagagagacc

SEQ ID NO: 21263 - DNA, 201 bp, Homo sapiens
gtagggcagtgttatcctgggtgagttggggtatggccataggagggggctccaggaattcagggaaggaaaagaccatggcgctgaggaggcggcacggsctggccctccacctccaagctgaccaccctactcagctcctttagggtggagtggctgtaaggccgtgaccaggaaaaaagggacccagggtggtggcac

SEQ ID NO: 21264 - DNA, 201 bp, Homo sapiens
ggaggggctgtgactcatccccagccaactgtattccaagcacagccatagttcagagtgaatctttatggtctgtgaattctggagtttcagaaaactcyctcattcaacgttgtgagtaaaccgtaagaaaaaatattgaacaccaacatagtcatctgggtactgggaaatactcccatgcccgcaccaagatttcat

SEQ ID NO: 21265 - DNA, 201 bp, Homo sapiens
tggcccatgaagcacagtgtatgcaagtgctgttgtaatttagtaaaccgccactagggggcattgaaagcgcgtctaaggattattctcctgcgcaaatkttttccttttgctgtcaccatggagaatacagatataataaaacacactggtttaagagaccatttagacctgtaataagatacactccgtaaagcgtgt

SEQ ID NO: 21266 - DNA, 201 bp, Homo sapiens
ccatcagcctctgtgcagccgttgctttttccgttgaccaaagccatgaccttacctttatgcagtcgtgttcagagagagatgaagcctcaaaggcaaartcagactgacactcctgggagcatgacgggagttgatcattttttggaaatgtagatattccgtttacaaatctaagcaccgttaccaagagtggtaagt

SEQ ID NO: 21267 - DNA, 201 bp, Homo sapiens
tcaagcctggggaacaccgagctagggacacgctggctaatagaggaaggagagctgggtatggtggctcacacctgtaatcccagcactttgggaggccraggcgggtggatcatctgaggtcagcctgaccaacaaggtgaaaccctgtctctactaaaaataaaaattagctgggcatggtggtgggcgcctgtgatc

SEQ ID NO: 21268 - DNA, 201 bp, Homo sapiens
agctactttcatattaaagttcatctcagtatgtgaacattgccctggtctcaaacagtgagaattgacctccccctcccacacctggctaagttaggagcccagggttctggtcccacccttgacagtagcagagatctctatctttccacgttgctgtttgtttctcagcttacagacctgggtgacctttaagtctgt

SEQ ID NO: 21269 - DNA, 201 bp, Homo sapiens
actaaaaatacaaaaattagccgggactggtggcgcgcacctgtaatcccagctactcaggaggctgagacaggagaatcacttgaacccaggaggtggaggttgcaggagccgagatcgtgccattgagctcccgactgggcaagagcgagtgagcctctgtctcaaaaaaaaaaaaaaaaaaaaaaagtcttctttatt

SEQ ID NO: 21270 - DNA, 201 bp, Homo sapiens
tgaagtctagtgattcaaagcatgaggaataagatcgggaagctggccagatgtggtggcttacacctgtaatcctagcactttgggaggctgaggtgggyggatcatctgaggtcaggaattcaagaccagcctggccaacatggtgaaaccccgcctctactaaaaatacaaaaatttggccaggcatggtggctcaca

SEQ ID NO: 21271 - DNA, 201 bp, Homo sapiens
gagacaggagaatcacttgaacccaggaggtggaggttgcaggagccgagatcgtgccattgagctcccgactgggcaagagcgagtgagcctctgtctcaaaaaaaaaaaaaaaaaaaaaaagtcttctttattgaaactcaaaaggtaaaatgattctgtcttggagacccctccttacaatgaggatgtaatcagagg

SEQ ID NO: 21272 - DNA, 201 bp, Homo sapiens
ggattagcagctgctgtgttccctgtggggttggcagtgggctgggggcacagcacggatgggattgtaatgtataccatttatcttggtatagaatcttscagtttcttgtctttttttttttttttttttttttttgagacacagtctcgctctgtcgcccgggctggagtacagtggcgtgatttggactcactgcaa

SEQ ID NO: 21273 - DNA, 201 bp, Homo sapiens
caggaggtggaggttgcaggagccgagatcgtgccattgagctcccgactgggcaagagcgagtgagcctctgtctcaaaaaaaaaaaaaaaaaaaaaaartcttctttattgaaactcaaaaggtaaaatgattctgtcttggagacccctccttacaatgaggatgtaatcagaggtaccacatccagagcccttagag

SEQ ID NO: 21274 - DNA, 201 bp, Homo sapiens
acacattagcatttttccgtgtcgtgttgtaatattgcacatccatgttactggtaagctgtatttgagaaagaattagggggttagtttggggagcagcrgctgatgtgtgcctcagttctcaagttaattggtcctgctccttctctgccctggtgtgcccctcggctcgccactggcttaggtgcaggtacatttgtc

SEQ ID NO: 21275 - DNA, 201 bp, Homo sapiens
gtagctgggactacaggcacccacgccatcatgcccggctaatttctgtatttttagtagagacagggttacaccatgttggccaggctggtttcgaactyctggcctcagccattccactcgcctctgcctcccaccgtgctagaattacaggtgtgagccaacatccctggccagagtcttctagtttttgaaggtttt

SEQ ID NO: 21276 - DNA, 201 bp, Homo sapiens
ctggggagcctttgcataatgtccccagccctgctcttcagccttcttggcttggacctctcttcccagacattgtctttccctgagaccgatgctgaccrctgggaagacttctccctcattctgagtcaaatctaggctgttgggagcccgtgaccgccctgcttcctgtggtgggagaaggtgagggagaggagatgc

SEQ ID NO: 21277 - DNA, 201 bp, Homo sapiens
gaggtggaggttgcaggagccgagatcgtgccattgagctcccgactgggcaagagcgagtgagcctctgtctcaaaaaaaaaaaaaaaaaaaaaaagtcttctttattgaaactcaaaaggtaaaatgattctgtcttggagacccctccttacaatgaggatgtaatcagaggtaccacatccagagcccttagagttt

SEQ ID NO: 21278 - DNA, 201 bp, Homo sapiens
gggagccaatgggtagagctggggcccaaggttcaggtgttgcagtcgaatcagtaaactccggcggcatccagggatgtgcacggtgccggggcacattsacagaacctacctgcaggtgggcacggctttgtagagagggtaggcacagccgccgtgggatgaagcctgctcccagcactgttagcggttgacagtgtt

SEQ ID NO: 21279 - DNA, 201 bp, Homo sapiens
ttaagaacagttgtggttcacgtgtaccaaacttgggaaatcctgaccagcgcatccagggtcgcttgggcacagtggtccttttgcatggggtggccggvcaggtgtgctgagtgccacctgggcttgcatgccggacgcatacctggcacctgcttccaggttggcctgccagccgatgttgtgatcttgtggagggaa

SEQ ID NO: 21280 - DNA, 201 bp, Homo sapiens
gagctgctggggcagaggatactgagcctgaccactgccctgtgcttgttcctgtccccatggaggagcactggacttgtccaggggcacctagcagggakccagggacccaggcagggccggaaaggggatgttctttgcatggatttctgggaatgtacttggcagaagggaagcctgggagtgagctccaggcagaag

SEQ ID NO: 21281 - DNA, 201 bp, Homo sapiens
agagggtaggcacagccgccgtgggatgaagcctgctcccagcactgttagcggttgacagtgttgtcggggatctgggcagccatgtgggccaggccccrgtttggccagcgctgcagcttcctctctctgattcatcgagttcccagatctgtttcttacagaagaagaaacacctgctgccgaaatacagtttgaaaa

SEQ ID NO: 21282 - DNA, 201 bp, Homo sapiens
gaatgtgcctaattggcgcgggcctccctgtagaatgaggctcctcctgcagttcgaggagaggctgtaattaacagtgaattagcatatagtggcgccgygtggcccgcagggtggccttgtccatctgctgtgtaggggacttaggtgacacctggctagtggtagtctgcaagaaccctttgttaatgggaatattgt

SEQ ID NO: 21283 - DNA, 201 bp, Homo sapiens
ctggattagaaattgccagccttggatccttttctcagatattttgttttcctgggtattttccctcttctgggttcttagtgcccgtcccccgtagctcygtcacacagtcctgttgctgctaccttggggcccaggcgtgtcttttgtcccccagtgcctggcacggtgccctccaggagtactcctgggattggtggc

SEQ ID NO: 21284 - DNA, 201 bp, Homo sapiens
tgtaggggacttaggtgacacctggctagtggtagtctgcaagaaccctttgttaatgggaatattgtgcatgagtcagaattcagaatctttggtatggttttttttttttcccccttttgtgtgttttggccaaatactcaaaagcactaagttttcttgcgtggtatctgttcatatattgattcaccaaatattgat

SEQ ID NO: 21285 - DNA, 201 bp, Homo sapiens
ccctgcttttcctgtgctggccccaggctgttttgaggttttttttttttttttttttttttgatagggtctctgttgcccaggctggagtgcagtggcgygatcttggttcacttcaacctccacctcccgggtttaagcaattctgcaacctctacctcccgagtttaagcaattctcctgcctcggcctcctgagtag

SEQ ID NO: 21286 - DNA, 201 bp, Homo sapiens
gtagcttgggcctaagaaggtgggtgacactgaacacaaggcagagagttcattgtcacaggactgagcacagctgagcggctgtgaccagccttcacatrgaaccagccgcgagtagacaggcagaggccgccctcggagcctgggatgcaagcgggtctctctctgaccttcaggaggtcactgagtccttgtgggccc

SEQ ID NO: 21287 - DNA, 201 bp, Homo sapiens
tggacctgggaatggactggtgagtcatgtcctctcctatggaagtttcctgagatgggggctggttttcttcggagaatcacagtttatcttctaattarttgagtgccctttgttttcctttactgtccttgcaccaaaaaaagaaaaaaatctcgaaaatattgccaacatttattgaagagacttttttcttctttt

SEQ ID NO: 21288 - DNA, 201 bp, Homo sapiens
tcccaggaggctgatgagatttgctgagcattacaacctgatgggcaggatttgttttaatcatgtaacacaatcacaaaattagtagtggcaccatgctrtcgctgcccctttcccatgcatgtgctgcagacttatctgtgggggaaaaattatccatgccacctctcagaatgagccccgtccccaccttatacgaga

SEQ ID NO: 21289 - DNA, 201 bp, Homo sapiens
attcttgatattatagacatttcttctgtaaagtatggcacatctataaactaaaaatgcacatctggaaaatccgtaaggcagaaattccagcctccccyatccacagccatcagaggagtccctcacacacctgtcgccagcccagggctgggaagatagaggtgctgctgcagagggagttccatgactcacccctgc

SEQ ID NO: 21290 - DNA, 201 bp, Homo sapiens
ctttcggggcaagtcctgctgtcactgcacagctcaccttgtatatgtggggtgctcttctcctctcctgaggagttatgggtgattaggaagcaaacgcktctcagacttggagatcaaatgaagagaggctgtgtaagcaccaggatgcatggggggttccggcttcttcgcagtttcacctggtttaacccaaaggca

SEQ ID NO: 21291 - DNA, 201 bp, Homo sapiens
tgctgaaagaaaagtcattgtgtattcattttgcattggaggaaatgagcattggggtgctttggtgacagcttggaggagcaggggagtcagtggcatgrctaggcctgggtcccctcatcccgcccctcattcacccgctagtgctgtttgagggccagaaccaactgtgcctgtgtttagactgggtttgttgctgtg

SEQ ID NO: 21292 - DNA, 201 bp, Homo sapiens
tgtttgcaaggtggcacgagagggcccttgggaccttttcatcactgtctgattctcatattacgcaaccaaatctgctgtcatcactcttggccgccgtygctggtagcgggtaggagtgctggtctcccagccaccagcctgatccagttctgaggtctcgccccaccctggcagcctgggcgagtgtcctctccagcc

SEQ ID NO: 21293 - DNA, 201 bp, Homo sapiens
tacagtcgaatggccaactatcggaacacgagcgagattcctctggttctggtgggaacccagggtgagtgatgttcgtgtgcagattgttttgaaagggwtctaacagttacatattttcagtatggaggagtttaaaaaatgctttaaagaaggaaaaattgcctactgaacgctcacttttttgggaaaaattatgga

SEQ ID NO: 21294 - DNA, 201 bp, Homo sapiens
gcgccatctcggctcactgcaagctccgcctcccaggttcacaccgttctcctgcctcagcctcctgagtagctgggaatacaggtgcccaccaccatgcycagctaatttttttgtatttttagtagagacggggcttcaccgtgttagccaggatggtctcgatctcctgatctcatgatctgccctcctcggcctccc

SEQ ID NO: 21295 - DNA, 201 bp, Homo sapiens
tcgcaattaccctagatgcagcaggctgcctgcatctttatggcggtactttgattccaatcagagatttcacatgaacttattttggtcttttcaatgamgtctcagagtagaaaacagatgcagtcctaaagtaattactaacctttttatcttgtgaaagagaattcagatgagcgagatctctgcggtgggttgatc

SEQ ID NO: 21296 - DNA, 201 bp, Homo sapiens
gctggagctcccttctgagagccaaatttatttttttttatggaagagattcccctgtaaattctgggaaagtttgagagaaagctccaggagtagtgacraagcaaaaggactgggtgaacagaaggggcatcggagattgtcctgtctgcctgcagccagctggggaacagagaaggtgagtggggacagagcccacag

SEQ ID NO: 21297 - DNA, 201 bp, Homo sapiens
agcccctctacttcagacagacttccgaaactttctgcctctcttggggtactttagtatgccctgcagatgtaagctgctttcagaaaaagccagatccwgccacatgagactgcaggccctactagaatctgttctatcccacatctccagttataggtgggtgggaagtgggaattggaattttttccttttgttcag

SEQ ID NO: 21298 - DNA, 201 bp, Homo sapiens
actggtgttgcctcctccctcagcctctctccccctacctactgcccattcggaagtccaggcctcctcctcagtcactgagactgctttgtcagcctccygcttctgtatccaggcagatgaccccacactgaatctttgctgtgctggcctctgctcttgcctgtgacagagctcagataggattctttcctgttcgaa

SEQ ID NO: 21299 - DNA, 201 bp, Homo sapiens
tctgtagggcttgtcttagcagaagttcacatggaagagaggaggcgtaagaagcagtcagaacgtctggattggagtcttggtcctgccgcgtgctggcygtggagctcttgctctgtgtctgaactccttttcctcctgagtggatttgggtgttgccagtgatgtttgcgtcataagatggggtgagggctaacggag

SEQ ID NO: 21300 - DNA, 201 bp, Homo sapiens
ctggtgttgcctcctccctcagcctctctccccctacctactgcccattcggaagtccaggcctcctcctcagtcactgagactgctttgtcagcctcctscttctgtatccaggcagatgaccccacactgaatctttgctgtgctggcctctgctcttgcctgtgacagagctcagataggattctttcctgttcgaaa

SEQ ID NO: 21301 - DNA, 201 bp, Homo sapiens
tagttcagttctgaggtcggaattcccggctaccatgtggctcccctgactggagacgcagtgccagggtcctcatctgggaaactggtgatgatagaggycctgccagtgcttggagcagggccccacacaaggtaggactcagcatggcctggagatgacggtggcctctgatggctgtgttcttggtctagactgtaa

SEQ ID NO: 21302 - DNA, 201 bp, Homo sapiens
ggtctagactgtaaaccccatgggatcaggaacaaccacatctagaccctcatattagggatgccagcccgggcaccacatctttgtcacctgcatctctrtggcctctccagccccgtggcagtcctcactgcaggaggctggcaccctctctgtgcctcacatggatcaactgacttccctcaccaaccccaagaagca

SEQ ID NO: 21303 - DNA, 201 bp, Homo sapiens
gcagcaaaatatatatatatgtatttccacagaaaattggattctgcccataaaacttagtaatactaataaagacaggtcattaccagttttaagccaartaagcaaactcaaagagatcttctgtcagtgtgattcttggtggttttttatttttttggagaagtgtaaatcagctttagtgcagcaagcacaccacag

SEQ ID NO: 21304 - DNA, 201 bp, Homo sapiens
ggattctgcccataaaacttagtaatactaataaagacaggtcattaccagttttaagccaagtaagcaaactcaaagagatcttctgtcagtgtgattcktggtggttttttatttttttggagaagtgtaaatcagctttagtgcagcaagcacaccacagatttgctgaaatcattcctgccccttctgacggtgggt

SEQ ID NO: 21305 - DNA, 201 bp, Homo sapiens
accaagagcatggcatttgattcaaagccatggttgagtggattttcaatctatttgaaggataactttggctactatatagtatttacactcctgcccattttttttttttgtattttttccatcaaaagagaaatctgttttgaaaacagaggtaatgtctttaccatctttctcatgtatattattttttggaggaag

SEQ ID NO: 21306 - DNA, 201 bp, Homo sapiens
gtgtgggaaaaaaaattaaatactgtggggtttttaaatggctttaaaattttacatgtataagaataaaattctctgcagccactctttgctaaatattstctggacaattatttaagacattttaaaaaaagaaacccaaactaataatgacagaggcaaacctgtgatattagtcattgccttaaaatttccactgat

SEQ ID NO: 21307 - DNA, 201 bp, Homo sapiens
aaaattaaatactgtggggtttttaaatggctttaaaattttacatgtataagaataaaattctctgcagccactctttgctaaatattctctggacaatkatttaagacattttaaaaaaagaaacccaaactaataatgacagaggcaaacctgtgatattagtcattgccttaaaatttccactgattatatttaatc

SEQ ID NO: 21308 - DNA, 201 bp, Homo sapiens
agaattcacgtaagccaattctttcattctgggctcccatgaatgcatttggagaaggtggctggagtcacgcacagccagctggtgggcagggctctctkcaggccatgggctcattttcccacctgcgtaagtcacggtgctggtggtagcaggatggggtctgcaggtctcgcaggagtaggtcaagaggaccaggca

SEQ ID NO: 21309 - DNA, 201 bp, Homo sapiens
tataaaaagcccccaccaagtcaggatttgtccagaatggtcactctgctttggagaactgcggatcccctgccatggcccatgtggctccggaagttccygggagtggctcgtagagcctgttttcatccttcagaggaatcctgcagtccacttgcccagcgtcacttcctccagtgccctttctgggtcccacgtgat

SEQ ID NO: 21310 - DNA, 201 bp, Homo sapiens
ccaattctgtgactgcctgaactggccaggacaaatagagaaggggtggtaggggggcagtgttagattctttctggagcactagggtgcaaatcagaagygtcctttgttgctgcagctctccccagccgcctggaggatctgtttgggaggggagcactctctaaggctagttttgttcttgctcagatgatcaaatct

SEQ ID NO: 21311 - DNA, 201 bp, Homo sapiens
gctgcagggtgagctctgggcgacccaggaggaagtatttgcatgaattagccacacgcagagggcagttatgtgtgatgtgggaaatgactgcaaagctrtcttactctttattccatagccacaaaaataagtttataaaaagcccccaccaagtcaggatttgtccagaatggtcactctgctttggagaactgcgga

SEQ ID NO: 21312 - DNA, 201 bp, Homo sapiens
atgaaaaaaatggattcccgctggggccctgtctgtgtggagcgtgcacgcgctcccgtgtttcctgtgtgtggagcgtgcacgcgctcccgtgtttcctktgtgtggagcgtgcacgcgctcccgtgtttcctttgtgtggagcgtgcacgcgctcccgtgtttcctttgtgtggagcgtgcacgcgctcccgtgtttcc

SEQ ID NO: 21313 - DNA, 201 bp, Homo sapiens
attttttttcttaaataccatttttctcagtgagctttgaaccatgatgtcaccaaagacaaagtgtttctcaggcttttcttagtgaaagatactttccwaaggtagtttatagcaagatttggggattaaaaaaaagagttgaatttatggcctgaagagtcattataaccttttacctatagctaacatttacatacc

SEQ ID NO: 21314 - DNA, 201 bp, Homo sapiens
gggattaaaaaaaagagttgaatttatggcctgaagagtcattataaccttttacctatagctaacatttacatacctcaggtcaaataaatttagatgtrtgcttaatgttctaaaagctctttgttccttgctcatccttggccggaccagagaagttattgataatcaggtgttgctttctttgtggtaggacatcac

SEQ ID NO: 21315 - DNA, 201 bp, Homo sapiens
tggagagaaaaagaccttgtgacgtccctgtcatcacaggattctagtatcttgttatgccagagatgtggtttgaaaacttgtttttatggacgtacccrcaaaacattatgctctgtggaaagaggcacgcacagaaaagaatgattccatttatatgaagttctacaacgggcaaactgattggtgatgaaagaaatc

SEQ ID NO: 21316 - DNA, 201 bp, Homo sapiens
ggctgaaatcaaattcaaagaactcacttctaccaaaagagaaagaactggtttgtataatatgtttcaaagtacagaaggtagaaggtacatcaccaccrtccatcacgtgaaggagtagaaaaagtgggatgccacagttgcggcagagaatatccaaaaggaaagggtccaagtcagaccgctcacgtgggtggcagc

SEQ ID NO: 21317 - DNA, 201 bp, Homo sapiens
atcttcccgagagagcctgtgcccgccccacagtcccggctgaaatggcaaatgcggtgtaggactgtggtgcacactgcccatgacgggctacttggacrgctcatgcccacctctgactagtttgatgttctgaatcaggccccttggttaagcgtgataacatgatcacctggtgttttaaagcttttctctgtttcc

SEQ ID NO: 21318 - DNA, 201 bp, Homo sapiens
agcgtgaagtcaacccgggcctgagttcttggtcttctgatgatgccagccagtttcacgcagtgagtgctccagttctggggtcccagtgctgctgtctraatccatttcttgtcctgcacaatccttgcactagtccttggtctagtttcacagcccaaagcctgtcaccattcattctgcaagtcagcgttggttgcg

SEQ ID NO: 21319 - DNA, 201 bp, Homo sapiens
ctgctggagcggaggcaaggttctcccctcagtcagccccagccttacctgtctctaagcagagggtggtgagcatggggccctggaacactgtgcccccrccccctgcaacattttgggtttcagagaattcggagtccggcacaggaatgtgtcccacgcatgaatgtcgtccttcagatctggacctgacagcctggg

SEQ ID NO: 21320 - DNA, 201 bp, Homo sapiens
tggcagaagacatgatgtagcaatcgatattcacctcagaggacagatgtatatgctctgctgtcttaaaactctactgtttggccgggcgcggtggctcrcacctgtaattccagcactttgggaggctgaggcaggcggatcacttgagatcaggcgttcaaggccagcctggccaacatggtgaaatgccatttctac

SEQ ID NO: 21321 - DNA, 201 bp, Homo sapiens
ctcactgggcacatcccagagcactgtttccagagtggacgctgagcctctggagctttgggggtgcctgtctataaagggattctgagagccagtgaatytgggaaactcttaacaacgtccgactcccaggaagttgcagccttcggacacctgtgcttccggggagtactgctctgaagctacctgttcagcatggcc

SEQ ID NO: 21322 - DNA, 201 bp, Homo sapiens
tgagcctcacttccctcggcctcccccaggccaccacgcagcctcgtcaccatcgagcacaaacaccatgtccatcttccacatggaaggagtgtatcacrtgtgtgtgtgtacgggtgtatgctctggtccctgtttccttctggccacgtaatcattatatctttccagtagactctgtggttataaagcagccgatcc

SEQ ID NO: 21323 - DNA, 201 bp, Homo sapiens
tgttaatagagcagtaggttgggaattacagtattggtgaaatttaactgtttttcacgtgtgtatacctaagtcctataaagggtctaatttagtttgctttttttttttttttttttttttttgatacagagtctcactccgtcacgcaggctggagtgcagtggcacaatctcagctcactgcaccctctgcctccca

SEQ ID NO: 21324 - DNA, 201 bp, Homo sapiens
atacaggttgtaacgtgggtgaacctcgaagacatgatgctaaaggaaaggaagcaggcacagaaggccacaccgtgtaccattccatctgtctgatggcsaaaacaggcacctccatagtaatgcaaagtagattcctgcttgccaggtgcaggggagggaggggcagtggcgtatacggagtgattgcctaatgagtac

SEQ ID NO: 21325 - DNA, 201 bp, Homo sapiens
gttaatagagcagtaggttgggaattacagtattggtgaaatttaactgtttttcacgtgtgtatacctaagtcctataaagggtctaatttagtttgctttttttttttttttttttttttttgatacagagtctcactccgtcacgcaggctggagtgcagtggcacaatctcagctcactgcaccctctgcctcccag

SEQ ID NO: 21326 - DNA, 201 bp, Homo sapiens
ttaatagagcagtaggttgggaattacagtattggtgaaatttaactgtttttcacgtgtgtatacctaagtcctataaagggtctaatttagtttgctttttttttttttttttttttttttgatacagagtctcactccgtcacgcaggctggagtgcagtggcacaatctcagctcactgcaccctctgcctcccagg

SEQ ID NO: 21327 - DNA, 201 bp, Homo sapiens
gcattactttcagattacttcctttaattctttagatgggtgctaatggtttgggttattaactggcacagatctgagttctttttgtctatgcttgttgtttttttcccccttcaaaatgaatttgcaaaagcatcactagaaaagcttatgtgtaaacatttatgctagtaatagataaaaggtgctgtgtagcagtac

SEQ ID NO: 21328 - DNA, 201 bp, Homo sapiens
acagtattggtgaaatttaactgtttttcacgtgtgtatacctaagtcctataaagggtctaatttagtttgctttttttttttttttttttttttttgakacagagtctcactccgtcacgcaggctggagtgcagtggcacaatctcagctcactgcaccctctgcctcccaggttcaagcaattctctgcctcagcct

SEQ ID NO: 21329 - DNA, 201 bp, Homo sapiens
gccgtttcctctggtgcccttttctttcccccgatcacatttgctagatgtccatttctgtaagttttccctctagaacaaacctatcatttttcaccacrggatatttacagcttcaatcagtgccaaattcaattggcttctgatctcatcgctggaagttatagatgcagatattatttgcactgcggttaattatgg

SEQ ID NO: 21330 - DNA, 201 bp, Homo sapiens
gggtggccgggcacctctgctcccggcctctgggctgatgtgagatgcacgcgtgccagggttttctgcctggatagcctgtctgtcctttgccggggaakgcccggccttgcccctgcctctgaatttgccccactgtagcacagtttctgatcctttctccagtggtcttcagcccattgttcttcctcctggttctga

SEQ ID NO: 21331 - DNA, 201 bp, Homo sapiens
aagagagtaactacacttgccatactgaccccccaggttgtatggaagctcagtggagaaaatggccggggtgcgtgtctgaaccgcgctgcatttggacrgacactttgtgtgtcacatgttagtagctgcagtgtgtcctccacccgactgagagtctgtgtatcaagataggggtaaatcctttctgaccacttgcag

SEQ ID NO: 21332 - DNA, 201 bp, Homo sapiens
ggtcctggatcatgggggaggcacaggcgacgctccgaggcagcctggcttgtgttagctgagttctgctttggcacaggggagggaggacatggccctcrgctgccaaggagcatccagtcctttccaaggactttggttttccagagttacacttcacatgtatttctattaagatacacacttatgtatgtttcatat

SEQ ID NO: 21333 - DNA, 201 bp, Homo sapiens
cagggtcttctggaagctcccagcagcctcctgagacagacaggttggagcaccacagctgcctgcggctggcacacagagtcgtaatttttcttggtttyaaaaaccaatccagatcttggaattatccaccgttgtggtaaacttaaaattgtccaaagacaccggatgactctccttcaaatggtgtccctggcccat

SEQ ID NO: 21334 - DNA, 201 bp, Homo sapiens
agaaactgctgtggccaagtgatttttatgggaatcattcttttatgttttctgtcttcatgctgcctgtgttatgaggcatgctggcccgggtggtgatrggaggtgtgtgctgcagtcctcgctggtgatttaaaccacccttctctggtcttggtcctagtctgcttataggttgaacagttgtgagtaaatcttaat

SEQ ID NO: 21335 - DNA, 201 bp, Homo sapiens
ctgggaccacaggaagttacatgagtcgggcctggttttgttgctgttgctctggcagtctctggccctggggttcaggtgtctggtggggcagcgctggrggccctgggtttctggagtaagaacaaggaccacgactcactcatggtggcctttctgctatatggctatttggtcatttttgtggcttttcgctgtttt

SEQ ID NO: 21336 - DNA, 201 bp, Homo sapiens
taaggaaaacatggtgtgactggcccgggatccaaattatttgcagcgcctgtcgtctttgttaactcttctcagttctctttttctttccttctctctgyttctttcagttttggtttttctttttgaagacggaatcaaagggaaattattttcattttcttcacagggagttcccaggcttccccctagcctttgctt

SEQ ID NO: 21337 - DNA, 201 bp, Homo sapiens
aagcctgtgtcctggcctgtcattgaacgtaataattacattaacaagtgaatgatttaagttctgcactctttgttcttataggaacaaggttaagggaygactgtgttgtgggttgaaatgtgtcccccaaaatagtatgttcaagtcctaaccttggtagctgtgtgtgtggccatacttggagatggtctttggctg

SEQ ID NO: 21338 - DNA, 201 bp, Homo sapiens
ggccccacaggcttgtgatcagtgggctccggttctcacttcttgtctttgagttctcaggcttctcccctctcctgttgtaagagttgagctagcagggkccgcctctacccttggctgctgcttccaaaccatgtgggtttcctatgtcatgaaagcttttcttcatcacgtgctaatgacttcctgttccacaggcgt

SEQ ID NO: 21339 - DNA, 201 bp, Homo sapiens
gatggtggttggatttgtggctatttttccagctgctcaatagttgtacaaaatgtagcttgatatgatgagtgtttccaaaattcctaaattacatgtcrtgtttgttgattatttgtatatgttttaatgtgtattaaaaagacaccaaaggtgtgagttcataaatattaatacttaggataaacttaagatttgaaa

SEQ ID NO: 21340 - DNA, 201 bp, Homo sapiens
gcacagggtttttgtttttgtttttaattatgttctttccccttttctctgaaaggaaaagggaaatcccgctgccctagacatggtagaaatttcccctsattctaaaattctgaaattaacgtcagcagccttgactttgctctgtcctgaaggtaactgtttattacagtcggcatttaaatcccccgattaatagga

SEQ ID NO: 21341 - DNA, 201 bp, Homo sapiens
cagatgtagctcatggtacgcttggggtttctgcagagcatgacatcaggctgtcttccagccttgcctcactaagaacttgaagcatgaccctcaataarccacttttttttttttttttgcatggaaatctgtgaagaaagaaggccttgggaaagcctgtgtcctggcctgtcattgaacgtaataattacattaaca

SEQ ID NO: 21342 - DNA, 201 bp, Homo sapiens
tttaattatgttctttccccttttctctgaaaggaaaagggaaatcccgctgccctagacatggtagaaatttcccctcattctaaaattctgaaattaaygtcagcagccttgactttgctctgtcctgaaggtaactgtttattacagtcggcatttaaatcccccgattaataggagcaattaaacaatagcttcatt

SEQ ID NO: 21343 - DNA, 201 bp, Homo sapiens
ttaggagcaggttgttcaatttccatgtaactgtgtgagaaccgccaaattcttctcttacatcattctgtgacttcaccttgtcctcatccgttcatgcrtaatacggaattaaagaagctcctgtaattaggctccctcctaattacaaaaataggtgatataaacatgttaaaaatattgttgctttttccagaaaat

SEQ ID NO: 21344 - DNA, 201 bp, Homo sapiens
atttggctcggaacctgccaaggacccctgtgtgttaaagttgaaatagttccctagtaaactggccactttcagaccagctgcattttctagaataaacytcatttgtccttgactcataaagggaaaagccagaagccaggggctctggggcacctccaagtgggccagggtcaggtgtgggtcctctgcctgggtttt

SEQ ID NO: 21345 - DNA, 201 bp, Homo sapiens
acaacgagataaaaagaatacagacaagaactgaatttcagattaagaattcagacttcagtacttcaggaaaaacttaaaagcttcactagaagaaattwaagcaagcttggctttttaaccacagcctattttagattagagggttgtttgctcaaaaaaaaaatacatatatatagtcatattttgtgcttcgatact

SEQ ID NO: 21346 - DNA, 201 bp, Homo sapiens
aaaatacaaaaaaattagctggatgtggtggtgtgcacctgtaatcccagctacttgggaggctgaggcaggagaattgcttgaacccaggaggcggaggytgcagtaagccgacattgtgccactgcactccagcctgggcaatacagcgagactcagtctcaaaaaaaaaaaaaaaaatttttttttttttacaataag

SEQ ID NO: 21347 - DNA, 201 bp, Homo sapiens
agaaatgacctgtatcttctaaccaccccaggtatctttccaaagcatagatctcttcacttctctattcaatttgaataaccccccattgccttaaggayaacttcacacttgccactcttctctgcatatcaggtccttagaaatgcatttctagttgcctgtttcagcatcttctcccactaccttcttataaccttc

SEQ ID NO: 21348 - DNA, 201 bp, Homo sapiens
gcagtgttcccaagtggtcgtgctgtgccctaaaggctgctagaacctcaggggccgttgagggcaggttcgagtcccgcaggcaagaaggtggaactctrgagaggagggggatgccttggcctgggccccctctgagggaggactgtcgcccctgctgctgggagcatcattagctgcagctcctcatggagagatgcc

SEQ ID NO: 21349 - DNA, 201 bp, Homo sapiens
tgcatttctagttgcctgtttcagcatcttctcccactaccttcttataaccttcccaccccagccccactgttgactcatccattcattcatccagttgktgtgtgcccactgagtgtcaggcaggccctggccccgggaagttaaatacagcatggcctcaagcatttccagaagaggtcccagctcggtggaattggc

SEQ ID NO: 21350 - DNA, 201 bp, Homo sapiens
cctgtttcagcatcttctcccactaccttcttataaccttcccaccccagccccactgttgactcatccattcattcatccagttgttgtgtgcccactgrgtgtcaggcaggccctggccccgggaagttaaatacagcatggcctcaagcatttccagaagaggtcccagctcggtggaattggcccattgtcttggaa

SEQ ID NO: 21351 - DNA, 201 bp, Homo sapiens
gtgatataaacatgttaaaaatattgttgctttttccagaaaatcaaaccgaaagtatgcagaatgttggtagttaaaactccttttgttattttgtgttygttcgtttgttctgttttgttttttgaaacaagagtctcactctgttgcccaggctggagtgtggtggcatgatctcggctcactgcagcctccacctcc

SEQ ID NO: 21352 - DNA, 201 bp, Homo sapiens
cagtgcttactcggaattgctcccccgcctcccaagttactggcctcactgtgctccagctttcccagtagcagaggaaccctcttcccaaacgtgggctygatttacaccgagtcattagttgtcatctaatggtggctcttcagtgtcactgcaatctatacgctttctctgtgtcttccttagttctctgcccccact

SEQ ID NO: 21353 - DNA, 201 bp, Homo sapiens
ggagttcaagtcctgcctgggcatcccagtgagaccccacctcttaaaaaaggaaagaaaatggttttttaaatcatttcatttcgtataagattattttscgaggttggtgcatgacattggagttgcccagcaattggaaaaagacatgagcgtttaatactgggcgttctttctaaggctcttaaagtgaaggcaatc

SEQ ID NO: 21354 - DNA, 201 bp, Homo sapiens
cacccttcacgtgtcatctggtcccccacaaagcttttgcatggggttcatctgcctattccaggagagactatggtccttatccagtagtactaatgtgsggaaataccaggagtggacaagccaccttccccaaacatgaaagagcccagttttgctaaggagctgttgaaaaactggaaatagaacagcgccgtggta

SEQ ID NO: 21355 - DNA, 201 bp, Homo sapiens
cacatctctgtaagcttcagaaagaacagagcccttattaaagatccaaattagctttatatcgttggccgtgtatcaaaggaagtgcgttttaatttacragttcctacaacgacttcatcttgagttcacagggggcttcagccctcaactgatttcctctcctggcacctacaaatgggcctgtctttgataatttta

SEQ ID NO: 21356 - DNA, 201 bp, Homo sapiens
agcctgccagccgcctgcctgcaaccccatagccgagtcagctccctggatgggctagtgtgttgaccttccactgccccgaggggaggactctgccctastggatcctccacctctcacttcattttgccagttgaaatgttcccctgcctagtgtagggactgccacttcatgctgtcttgccagagcaccttcccagg

SEQ ID NO: 21357 - DNA, 201 bp, Homo sapiens
gtctgtatcagtatagaattaggattggattagtgtgaagtgtttgcactgtaaattttatctgtgtttttttttaaaaaaaactggaaatattctgtttygttccactactatttccccagggccttaaacagtgcctccccctgagtggccctgggtagttgttgatcatatctgtaaatatctggagtttccgcacac

SEQ ID NO: 21358 - DNA, 201 bp, Homo sapiens
ctctggagctttgggggtgcctgtctataaagggattctgagagccagtgaatttgggaaactcttaacaacgtccgactcccaggaagttgcagccttcrgacacctgtgcttccggggagtactgctctgaagctacctgttcagcatggcccaacccagcatgtcccaggcccatcggacagtggggcctttgtttag

SEQ ID NO: 21359 - DNA, 201 bp, Homo sapiens
gtggaggttgcaggagccgagatcgtgccattgagctcccgactgggcaagagcgagtgagcctctgtctcaaaaaaaaaaaaaaaaaaaaaaagtcttctttattgaaactcaaaaggtaaaatgattctgtcttggagacccctccttacaatgaggatgtaatcagaggtaccacatccagagcccttagagtttgag

SEQ ID NO: 21360 - DNA, 201 bp, Homo sapiens
ggaaagatctgtaaggctgcactctggaaggttagcaccagttgtgtctgagtggtagggtcttttgaggcttggggattttcatgcagcgtggaatttgraattgtggtaacagctccctgacccccagttcttgcagagaatgctctagaccgccaggagccccctctgtctgctcactgggcacatcccagagcactg

SEQ ID NO: 21361 - DNA, 201 bp, Homo sapiens
ttgtgattcagccacctggaagcttcacttgtgaacgtgactctgcaaaaacatgttagaggaagcaaaggagaggatggacgtgaaatccgtcctatgcrtgctcacctgacatgcaacagggagggtcatctgccagggcgtcacggtcattccacgagagctgggtggtgacgctccccaagttcccactcctggaga

SEQ ID NO: 21362 - DNA, 201 bp, Homo sapiens
gatttttcaagtaatgcattttactgcactgaaatttcatagtattgtgtatggtttttaaaaatacattatttttaagagtaggagcgtgggtgagtacmttcctttcttcatctgcaaagtggaagtagctcatcccctccatggggccccatgcccaaggcttcctgggtcaggggaaagatcatgatccctgacctt

SEQ ID NO: 21363 - DNA, 201 bp, Homo sapiens
cacagtgtgttccattgtatttgggcccagctgggatgtcttttgcagtgcataattgacccttacatgttgactcacaccaaagcatttctcttgaacgwttatacatcaaaaggaaggattgtggggtgacctaaactgatcactaacatccctgcttctttgatttttcaagtaatgcattttactgcactgaaattt

SEQ ID NO: 21364 - DNA, 201 bp, Homo sapiens
caatgatggaccaagtaatgtgatggtggtcccatgagattataataccgtgtccttactgtgccttttctatggttagatgtttaaatacacacttcccrttgtgttgccactgcctacagtttttgatacagtcacatactgtatgggtttatgccctgggagcaataggctctgcacatagcctgagtgtgtggtagc

SEQ ID NO: 21365 - DNA, 201 bp, Homo sapiens
tgtgagtcggggaaaaaagtaaaagattcgctacagattcagacttgcaaaaaaacgcttagaatcttgctgtccgtaaaactgaaacatccagcctcacraatgtccacatttctctctcatctgtgaaggcccgttgagactgctcagttggtgtctcctctgtccacaggacatggccgtagccgtgtgtggagaagg

SEQ ID NO: 21366 - DNA, 201 bp, Homo sapiens
gggagctgggattcaatcctggggctgaagtaggggagctgggattcaatcctggggctgaagtgggggagctgggattcaaacctggggctgaagtaggrgagctgggattcaatcctggggctgaagtgggggagctgggattcaaacctggggctgaagtgggggagctggtcaatcctggggctgctggagcctagg

SEQ ID NO: 21367 - DNA, 201 bp, Homo sapiens
gtgccttcaaagtatatccaggatgcagtggcttcctgagccacctcagccattagcaccctggtcccgggcagcagcgttgcttggcggattactgctcwcctcttcaagccgatgctgctactctcctggacagtccacttgcccagcagccaggggcatccctgagaagccgggtcagagtgtgatgccctctgccaa

SEQ ID NO: 21368 - DNA, 201 bp, Homo sapiens
tcccagagccgtcggattgctctggtgcacttgctgcctggtttttctcacctgcaaaatgaaagagctgacaggatgaaatgagttaatagatgggaagygtgggccgcctagccctgctcagcctttgagcagcaaaaaggaggaagggggaggaggaggagctgtcctctggttatagagggcgtgaggttggcccgg

SEQ ID NO: 21369 - DNA, 201 bp, Homo sapiens
ctctgagccggcttctctgggcactggctgggctgaccccaatggcccctgcccatcatgcatttaggggctcctctgactccagatgtcagtgacccttytggtctctccaacacaagggttggtcattccctgtgcccattgttcatgcattggaacttggagtgcctgctctctgccctgggtttatgtcctaaggat

SEQ ID NO: 21370 - DNA, 201 bp, Homo sapiens
cttaggaagtttctcgcatcttcccttagtttctacaaatgaaaatgtctgcaaagctctcaaagcatgcatcctagtcctatttaattctgacatctgcmcatttcttacgaatgtaaagtcagtgtggccatccagctgaatagtaactctgaagctgggagtaaaatcagatttcagtgtaattgataatcaaagccc

SEQ ID NO: 21371 - DNA, 201 bp, Homo sapiens
agtgctgcgatattcctctgtaatttaaacatgattagctgatgaaggttatgtgatatcaatacactaccggaagataaattaattgatatcatcctttsaggatgataagaggcctattggaggtgggatgtaactaatgaagctgcttcttcctctctgtgagccattttttatatattgcattttcacttaatcata

SEQ ID NO: 21372 - DNA, 201 bp, Homo sapiens
gatccttttatgaaaatattcttgccttttaatttaaatgccaaccatcttgattagagaaatagtgttattccttcctgcacccaagccctgacgtcagyatgacctggcggtagagccagcccctgccagctggctgcccccggggaccttctgttcaccatcaagcggcagttcatctggagtaaggagagaggctgg

SEQ ID NO: 21373 - DNA, 201 bp, Homo sapiens
gatgtttctgacggcctcttacagactctgtcctttttgttgtagctgatggagcagaattttaaatgcattcctctaactagtggtcagcttgctactgyccaacctaagctcatattcaacactttagaatgccttaatcttttcttgttgtgttttgaataggttacatgcagacatccaaaataaactttttttttt

SEQ ID NO: 21374 - DNA, 201 bp, Homo sapiens
gcagaaccacacctctgtatctacaaaaaagagaaaaattagctgggcgtggtggcttgtgccttgggaggctgaggtggggggatcacctctgcccagcrgaagagctaggctgcagtgagtgtgattgtgccactgcattccagcctgggtgacagagtgagaccctgtctcaaaaaaaaaaaaaaaaaaaaaaaagaa

SEQ ID NO: 21375 - DNA, 201 bp, Homo sapiens
cagcatgacctggcggtagagccagcccctgccagctggctgcccccggggaccttctgttcaccatcaagcggcagttcatctggagtaaggagagaggmtggagcacagctcccagcctgcaggaacagacctctggagatgccaagggcctgaaatctgtgtgtaggtttatgtagacagaagtaaccatatattgaa

SEQ ID NO: 21376 - DNA, 201 bp, Homo sapiens
gcatgagccatagtgcacagccagcatgtgaagtgcttgaaaactccctgggtgattgagatgcagagaatctctgagctacagaggtggcaaaaatgctrccagcctgtcccttccctgtgcatagcagacattaccaatcaatctggattctacacagttgagccgcaaactccaggcacagctgctgtcaggtgactg

SEQ ID NO: 21377 - DNA, 201 bp, Homo sapiens
gtgctgggattacaggtgtgagccaccatgcccaccctctcccctgttaatttacctctttcattagtatggtacatttcttagagttcatgagtcaataytgatatgtttttattaaagtccacactttatttgcatctctttagctttaacctcatgccgtgtctctgttccaggatccaaatcctattccattgtcat

SEQ ID NO: 21378 - DNA, 201 bp, Homo sapiens
agcagttggggaggacagtgttggctgctgctgtgcttcctttaactgaaccccggtggcccagttgctcctcttggtggactcactaagtcaactttgaygcttcagccaacgtcggttttgagaatgcgacctatgaaattgggagccctggctggatcagaagcacatggttcagtggacactgtcagaggtgctgtg

SEQ ID NO: 21379 - DNA, 201 bp, Homo sapiens
tgctcccaagctagttgctgaagctgtgggccattgagccagcctggagatgcatggtaggttagggtgctgtgttgcaggtctgtgatgcagttgccatrtattttttgacttttggatcttcactcctcccctcattttggacattttctcagaatgaatgatacatctctgctttcagcctccctaagccattaattt

SEQ ID NO: 21380 - DNA, 201 bp, Homo sapiens
ttgcagtgagccgacgtggtgccactgcactccagcctcggcaacagtgagactcccatctcaaaaaaaaaaaaaagtccttcttagattcctttccattstgcatgtgcccacattaaaacagctgtggctctgtcatttctccctgacctgcaatactggaattttccttcttaaattttcctcctttaaaattgttaa

SEQ ID NO: 21381 - DNA, 201 bp, Homo sapiens
tttttgacttttggatcttcactcctcccctcattttggacattttctcagaatgaatgatacatctctgctttcagcctccctaagccattaatttacaygtcagatttttttgagtattgtagtttttttcaatatttatggaatgcttagtatttgtaatgcaacaaaaggtcagaattaataaggtgtagtgcccaa

SEQ ID NO: 21382 - DNA, 201 bp, Homo sapiens
acacctgtaatcccagcactttgggaggctgaggtggatggatcacctgaggtcaggagttcaagactagcctggccaatatggtgaaaccccatctctastaaaaatataaaaactaaccaggtgtgctggtgggtgcctgtaatcccagctacttgggaggctgaggcaggagaattgcttgaacccaggagacggagg

SEQ ID NO: 21383 - DNA, 201 bp, Homo sapiens
tcctccgctacttctgtgtccttagacagtagatggtgctctgtgtgcatgaggggaagcacctacagtggtcgcctgctgaagatgtccttcagtggttrgaatggaaaaacaattgttctgctacatgttgctctggttctttcattttacctgctctagaatattccatttagaacttaaaatatttcattacttaaa

SEQ ID NO: 21384 - DNA, 201 bp, Homo sapiens
aaaaaacctccttctggccaggtgtggtggctcacacctgtaatcccagcactttgggaggctgaggtggatggatcacctgaggtcaggagttcaagacyagcctggccaatatggtgaaaccccatctctactaaaaatataaaaactaaccaggtgtgctggtgggtgcctgtaatcccagctacttgggaggctgag

SEQ ID NO: 21385 - DNA, 201 bp, Homo sapiens
ttgtgaacacatgcataggaccatacatacatcatacacacacacatacacacacacttaaacatacacatacacatgcacatgtacacacacatacacayacacagctatgggcacaacttcatttcaacttgtagattgtgaagtaaaggcattggaactttgtggcttgcaaatctaaattacctccttccatcttaa

SEQ ID NO: 21386 - DNA, 201 bp, Homo sapiens
aggccggaggaggagggagcagccaggaagctggttacaacccaggcggagggctggcgtgggcctcaggggtcttcagcctcagcactattgacattttrtgccggataattatttgtcctgtgcatgtcaggatgttcaggagcatctctggcctctacctactagatgccagtagcatctcttccagttgcggtgacc

SEQ ID NO: 21387 - DNA, 201 bp, Homo sapiens
cgccttggggcctcgggaaggcacggacgcccgcggcgcggcgggggtgtgcgctgtgtgcgtgcgggtgtccacacacgccggccggggcacgcggctgmtccgccgagggagcactgcggcgctgcttgtcttgcaaggccgggcgagcgtcgcctgcgccccgccgcgccgcgagctccgccaggaagatagatcgtc

SEQ ID NO: 21388 - DNA, 201 bp, Homo sapiens
cagtgagattcctaagtggacctggaaggatgagctgagtggcctcacggtcaagccaaggacttcaaggtgcccctgtctaggaaagctcacctgtgttscggtcctggctctctgggcttcctcaggaggtcgtttggcagctgtgaaactcctcccctccgggccatacctggcagacgtgcatgaactgctcagact

SEQ ID NO: 21389 - DNA, 201 bp, Homo sapiens
agaccagtaatccctagttcctttgacttgcagctcagcctcactctgtcctttacttaggacataagctaaatctacatacccttcctacaccacagatrgaagatatggagggaaacctttttctccaggtctgtttcatgttgttgaaaacctcaaacctttttcttaggagagaacctctgtttctaagcagtggaa

SEQ ID NO: 21390 - DNA, 201 bp, Homo sapiens
gcatgcgccaccatgcccagctaattttttgtatgtttggtagaaatgggggtttcaccatcgtgccctggctggtcttgaactcctgagcttctgtgttmcccccacctccatctcccaaagtctcctggcattatagacgtgagccactgcgcctggcctaaaaatgttttaaataaagttattttaaaatacgaattt

SEQ ID NO: 21391 - DNA, 201 bp, Homo sapiens
tcatcactcacatggtcccccagcaggtaacttgcttcagcgccactttgcctgggtgctggtgatcctccagttctcacacacctgcaccttggggtcgytgagttttagtttaggtcttccgaggaatgcacagaccacacgttgtcaggcttcccttggccaataatgtggagtcttttggtttttctgttcttcaga

SEQ ID NO: 21392 - DNA, 201 bp, Homo sapiens
agggacttcagctgggtggtggccctgggatgtcactttccttcccacttaattgctttggatttctctttcctttctcgtcatcccccaaaagtgtcttwgccttttttttttttttttagccctgagccccaagctcagtccttacatagattgtttaggagaccagtaatccctagttcctttgacttgcagctcagc

SEQ ID NO: 21393 - DNA, 201 bp, Homo sapiens
ctacttgcagaagatcatgacaagggacttcagctgggtggtggccctgggatgtcactttccttcccacttaattgctttggatttctctttcctttctygtcatcccccaaaagtgtctttgccttttttttttttttttagccctgagccccaagctcagtccttacatagattgtttaggagaccagtaatccctag

SEQ ID NO: 21394 - DNA, 201 bp, Homo sapiens
atcccagcaggatgacctgctctttgaaactgtggcttcagaacaaagcagccagtcatgaaactgggggcacctgacattgcaggacaccgtggggctgrtgtgaggctgaaaatgtacctagaatgggtcggctgcctgggaacctcacgaatactgatccccagggactgcgtgtctccctcagaactggggcagctt

SEQ ID NO: 21395 - DNA, 201 bp, Homo sapiens
aggagaataaaaatagagttcaaccccacacagtggcttctgaaatgtcatcttttggtttgttaaagaaagccaattgatttagagtgcatccttcttgrgcagaagcctctgtgggcaggagaatggctccgcctctcaggcacagggcttgtgaccggtgtgcacctccggtccagctcactgctttgctctcctctc

SEQ ID NO: 21396 - DNA, 201 bp, Homo sapiens
tgtggccgtgctgtgcaccgagctcgtggaatcccagcaggatgacctgctctttgaaactgtggcttcagaacaaagcagccagtcatgaaactgggggmacctgacattgcaggacaccgtggggctggtgtgaggctgaaaatgtacctagaatgggtcggctgcctgggaacctcacgaatactgatccccagggac

SEQ ID NO: 21397 - DNA, 201 bp, Homo sapiens
cctgcctgcctcccatttcaccgggataatatctaagtgatttgtttcagcaaaatagtgcttattttctttaaaagttgaacagtggtggtgaaatccarttccccttgagctcagaaatacaagctctcctacaagtagaggaaagattctcaaagttaatgttgccagaacttgtttttgtcttgatgaatcaaaaag

SEQ ID NO: 21398 - DNA, 201 bp, Homo sapiens
atgtggccgtgctgtgcaccgagctcgtggaatcccagcaggatgacctgctctttgaaactgtggcttcagaacaaagcagccagtcatgaaactggggrcacctgacattgcaggacaccgtggggctggtgtgaggctgaaaatgtacctagaatgggtcggctgcctgggaacctcacgaatactgatccccaggga

SEQ ID NO: 21399 - DNA, 201 bp, Homo sapiens
agcctcagcactattgacattttatgccggataattatttgtcctgtgcatgtcaggatgttcaggagcatctctggcctctacctactagatgccagtarcatctcttccagttgcggtgaccaaaaatgtcttcaggcaatccagatcaaatgtccactggggggcagaatcacctgctgagacccactggttaaaata

SEQ ID NO: 21400 - DNA, 201 bp, Homo sapiens
cacatccgagggaaggatggatggctattgatttcccttcaggccatgccaatatgtttgtcaagcaacagatgcaattcaagtgctactgtgatccaggygtggctcgctgtttaggtaaagaagcttcacaaaggcgctgccacaaaccaacatgtgttctttgggtttcatctcgtaatttcattcatgaaggttggg

SEQ ID NO: 21401 - DNA, 201 bp, Homo sapiens
gtgtgttcgaaaataaacccagctcttggccaaacaaacagtcggtatgtggccgtgctgtgcaccgagctcgtggaatcccagcaggatgacctgctctktgaaactgtggcttcagaacaaagcagccagtcatgaaactgggggcacctgacattgcaggacaccgtggggctggtgtgaggctgaaaatgtacctag

SEQ ID NO: 21402 - DNA, 201 bp, Homo sapiens
gcagcaagcaggctgttgggtgctgcaggcgctctccattggagcagtgctgtggaagcaccgtcggcctgccgccgtgctgagtgatgccagggccacgrcagaggctggcgtaggcacgggagcgggaccacacgtggccaaatgagcaggaaggaagggacagggcaggattattttagaaacttagaaaaatcatac

SEQ ID NO: 21403 - DNA, 201 bp, Homo sapiens
ctttggcttcagccaaatgtgttctgaagctactaccaacggccagtcatttgggacacctgaaacaggactgagcactggctagggagcattttttctcrccatggatgtggttctgtcgttgtgaagtttgactgattcgtcgccttgtgtttctaagaacggttggaatgatgcatgatggtctgattgcgtttagcg

SEQ ID NO: 21404 - DNA, 201 bp, Homo sapiens
tattttctgaggggcgaaagtatagttgaagtaaaaagttttagtgcactttccagaatgggccggatggtgactattttaggttttgaggatggtaccgwctctggcaactcctcaactcttgtagggagaggtacagacacaaattggcatggcgtgtttcaataaaactttatttacaaaaacacatggtgggctgga

SEQ ID NO: 21405 - DNA, 201 bp, Homo sapiens
ttctaaatgtaaataaaattaggtttagatcccttttaattacctgaggtgctgtgagcgattacaatggcaattgataaacttaatttcttattaaagcaaaaaaaaaaaaaaaaaaccatgaaaagtttctctctgctatatacttaactcttcagtagccatggcctatgcaaaaaaaatttacctggtttatatgtt

SEQ ID NO: 21406 - DNA, 201 bp, Homo sapiens
atcacaaacacactggctatggctggaagaggttccctggaagagtcagtgtcatctaaggtggatggaatggattcttctactccgcagcccgcatctcrtatggcaaagtgcaaaacctgggatggattctcaacaaaggtacagtaattgggagacacaaacagtccagtgttttagccctgaaggaatactacctta

SEQ ID NO: 21407 - DNA, 201 bp, Homo sapiens
tcaaattgcagaaaaataaaagctcaaatattatctgttatgtcaaagttactatttgagctgtagatgctgttttcaaaacagatcatcctccttaaagyacccatctctctccactgacatgtgcccctgtgtccagccgcaccttccagcagagttccctgcaaagacgcttccctgcagcctctgtgggtcaggaat

SEQ ID NO: 21408 - DNA, 201 bp, Homo sapiens
atctgttatgtcaaagttactatttgagctgtagatgctgttttcaaaacagatcatcctccttaaagcacccatctctctccactgacatgtgcccctgygtccagccgcaccttccagcagagttccctgcaaagacgcttccctgcagcctctgtgggtcaggaattagaatgggtgcagctaggaaggcctgtgtct

SEQ ID NO: 21409 - DNA, 201 bp, Homo sapiens
tattatggggtgctgacttgagagcgccaggcttgcagttgtattaaacgtggaagattcagacagagatgagatagggccgtgcggcagcccatcaccgscagcgcttgctcgtggtggtgaggcctctcccttccggcacagacatttatcttctgtccacgtgtgtgccgctcacagtccacgtaaggctgcgccctg

SEQ ID NO: 21410 - DNA, 201 bp, Homo sapiens
ttgtacttattctctggtaatatgactggagaagtattttatgtctcaagaattattatgcatttcttatttctctgtcctttaattttgaagggtcagtwtaaaaatactttattcagtatattctagctcattctccacatacaattatattccaatatttgtagggtttattctctccaagcagcatgatcaatcaga

SEQ ID NO: 21411 - DNA, 201 bp, Homo sapiens
ccatagtttgcacccctgttcaagttcactctctctgaaacacctaaaccacccacccccactctccaaggccctcatgctcaccttgactctcctcatcrccccgccccctcctcagagtgcttgctaatgtcactctggatcccacctatcctggcttccatgtgggtagaaatcttgacttttcgttacagtgaatgt

SEQ ID NO: 21412 - DNA, 201 bp, Homo sapiens
aaggaaactagcatgcttttggggagacgggattctaatcagctaatacttctattatggggtgctgacttgagagcgccaggcttgcagttgtattaaaygtggaagattcagacagagatgagatagggccgtgcggcagcccatcaccggcagcgcttgctcgtggtggtgaggcctctcccttccggcacagacatt

SEQ ID NO: 21413 - DNA, 201 bp, Homo sapiens
ctccgaagttagacaggcatccggagaaaggtggatgtggaaagtgaggttgacttctgggcgcatgtgtggaatatccagtcccttagaggctcgggtckagtggtggaggatgaggcccctctgccatagggagagcctgtcttaatcacgccacgcaggtggaacagactctatgcagaaaacttgcggaagcatttt

SEQ ID NO: 21414 - DNA, 201 bp, Homo sapiens
aggtcccaaaattttacaccgtgagagtgacccagttatctcagtctggaaaatttcaaaagatcgtagaaccagatgatctcagttaaacacggaccatrctgtgacacccacatccttggctatctccaggatgtattacggcagaaggaccactgagagtcattggccacatgcagtggtggcataagtggtcaagtg

SEQ ID NO: 21415 - DNA, 201 bp, Homo sapiens
cacctagggaacctgacttcacattttagggtgcatactcccggctatttctatgtatatttctcttttccttccacaagcacatggtcactgtgtatacrctgcccacagcctgccttcctcactcatagtagatattttcatgtcaagaaatatacttgtacaccaccatttttaatgattatataatattccactgtg

SEQ ID NO: 21416 - DNA, 201 bp, Homo sapiens
tgttttccttggttgttgctgagagcataagttatattcctgcctataggctcatccaggccgcatttcctcctgatttcctgtttcctcacccgtatccygctgctctctctcttcccctgaagctctgggaagtcttccctacacgctcattagtgagttaaggaactttgatgtgtctccgtgtttagaagaaatctt

SEQ ID NO: 21417 - DNA, 201 bp, Homo sapiens
ttgtagggcagtgttatcctgggtgagttggggtatggccataggagggggctccaggaattcagggaaggaaaagaccatggcgctgaggaggcggcacsgcctggccctccacctccaagctgaccaccctactcagctcctttagggtggagtggctgtaaggccgtgaccaggaaaaaagggacccagggtggtggc

SEQ ID NO: 21418 - DNA, 201 bp, Homo sapiens
ccgtggcagtcacacaggtagaccagcaagcactccaagactcagcgactttttgaatatagaggcttaaaggtagaacatctcatgagactttaggtttygagaatgggtgcctgtaagaatggtggtttcattaacagaatagcaaactaaggaagaaaagatggtttggttcagaaaaaatactgctttagaaaggaa

SEQ ID NO: 21419 - DNA, 201 bp, Homo sapiens
ttaaagttggggtgttctagtttcatagcaacacattccataactcttacttgatgcagagaaatgtgtagattagaatatatggtggaagtcagtcattygattccattgtccctcagtatctatgggggatggattctgggatctgccttgtataccaaaatccatggtggtcgagtcccttatattaaatggcatagt

SEQ ID NO: 21420 - DNA, 201 bp, Homo sapiens
attgtagggcagtgttatcctgggtgagttggggtatggccataggagggggctccaggaattcagggaaggaaaagaccatggcgctgaggaggcggcamggcctggccctccacctccaagctgaccaccctactcagctcctttagggtggagtggctgtaaggccgtgaccaggaaaaaagggacccagggtggtgg

SEQ ID NO: 21421 - DNA, 201 bp, Homo sapiens
ttttgaatatagaggcttaaaggtagaacatctcatgagactttaggttttgagaatgggtgcctgtaagaatggtggtttcattaacagaatagcaaacyaaggaagaaaagatggtttggttcagaaaaaatactgctttagaaaggaaactgggactgaaaaacggccatctttttcatgtatggccattctggcttt

SEQ ID NO: 21422 - DNA, 201 bp, Homo sapiens
atataaaaaaatgcagacattctacccttgataaaatttaaagttggggtgttctagtttcatagcaacacattccataactcttacttgatgcagagaartgtgtagattagaatatatggtggaagtcagtcattcgattccattgtccctcagtatctatgggggatggattctgggatctgccttgtataccaaaat

SEQ ID NO: 21423 - DNA, 201 bp, Homo sapiens
gaactcctgacctcaggtgatccatccgcctcggcctcccaaagtgctgggattacaggcgtgagccaccgcgcccagcccagtggtgtgattattccatraccatggtggtgattcctgtgggctaaactgtgcctcccagaatgtgtgtgttttaagtcctaacccccagtgcctcataatgcgattctatttggagac

SEQ ID NO: 21424 - DNA, 201 bp, Homo sapiens
gatgatgatgttttgctgaaacaaaatgatggccatccgtgccaggggttagggatgacggttgcagggcaggctcctttggtgtcagctgcctcgtgacygtatcacgtggtgaccccagtctcttcctttcctgctttcatactgagaaatcgtttcgtgtacagcatgcggtgccttccccgggggttaacttgttct

SEQ ID NO: 21425 - DNA, 201 bp, Homo sapiens
ttttagtagagacagggtttcaccaatattggccatggttggccaggctggcctcaaactcctgacctcaggtgatctgcccacctcggcctcccaaagtkctgggattacaggcgtgagccaccgtgcccggcctggttaatgcagtttttttagtttgttctttctttttctctttgtctctcctctctctttctttca

SEQ ID NO: 21426 - DNA, 201 bp, Homo sapiens
aggtatgggcacaggaggaagtgatggtagatttccactgtagttattccctttttttttttttttttttttaagacagtcttactctgtcccccaggctrgagtgcagtggcacgatctcagctcactgcaacctctgggttcaagtgattctcctgcctcagcctcctaagtagctgggattacaggcatgcaccacca

SEQ ID NO: 21427 - DNA, 201 bp, Homo sapiens
cccaagctcagtgttggccgtcagcttccttaacaaagggaaacctgtcaaggtagagcaaggtttgctgggaattggtgttaaaacaagaagaaattctsaaccaccatttaagaagactggattaaacatgacttcaaaaatgtgttggtttcaaattctgagtggttttcaaggaggcttaatatgatttcattaaaa

SEQ ID NO: 21428 - DNA, 201 bp, Homo sapiens
tctaaatgtaaataaaattaggtttagatcccttttaattacctgaggtgctgtgagcgattacaatggcaattgataaacttaatttcttattaaagcaaaaaaaaaaaaaaaaaaccatgaaaagtttctctctgctatatacttaactcttcagtagccatggcctatgcaaaaaaaatttacctggtttatatgtta

SEQ ID NO: 21429 - DNA, 201 bp, Homo sapiens
agatctgcttaaatccctcgaacacccaaggctgtgtagatttgccgctttgggcatgcctagcgaattccatttttgtgctcttttgtgcctcttttgcrtagtaagcttatgagcgccatgctctttttgctaatatcagttaaaatctttccattttccacttatcctcgtaaaacaaaagcaaaacatgagttggtc

SEQ ID NO: 21430 - DNA, 201 bp, Homo sapiens
acctgtttcttccttttctgtagccagcgctgggaagtctgggaagacaccaaaaatagcaatgaagcagctccctggagggttgctgggagatgcttggrcacagagagtgaggtgtttgctgggaaaagccatttgggatgggtgaaggtccatgctggagttggagagcgcagaaaatggggtgagtgtgaaagtcta

SEQ ID NO: 21431 - DNA, 201 bp, Homo sapiens
cagtgatcctggacaaatttggagtaagaaactcccgccagtctcatggccagagtgcccagggaaagtcttctctcccagtggtgactccgggtttcccyagcccagcacaaggacttgggctggtgagctacagaattgcaaagaagagcaggagccagccagccagacctggccatggctgtgccataggatatcaca

SEQ ID NO: 21432 - DNA, 201 bp, Homo sapiens
tagtaatgaggacatactcatctaaaagtgtgccaggttttctggggttttttttgtttgtttgtttgttttgtcttagagacagggtctcactgtgtcayccaggctggagtgcagtggcacgatctcagctcactgcagactctgcctcctgggctcaagggatcctcccacctcagcctccggagaacctgggaccac

SEQ ID NO: 21433 - DNA, 201 bp, Homo sapiens
taaaagtgtgccaggttttctggggttttttttgtttgtttgtttgttttgtcttagagacagggtctcactgtgtcatccaggctggagtgcagtggcaygatctcagctcactgcagactctgcctcctgggctcaagggatcctcccacctcagcctccggagaacctgggaccacaggcatgcgccaccatgcccag

SEQ ID NO: 21434 - DNA, 201 bp, Homo sapiens
ctggagtgcagtggcacgatctcagctcactgcagactctgcctcctgggctcaagggatcctcccacctcagcctccggagaacctgggaccacaggcaygcgccaccatgcccagctaattttttgtatgtttggtagaaatgggggtttcaccatcgtgccctggctggtcttgaactcctgagcttctgtgttcccc

SEQ ID NO: 21435 - DNA, 201 bp, Homo sapiens
tatgaaaacccagaacattccagatgtcctaggaacacaggtcctaggtgtttttttttagcttgggaaagttacgatgacccataagcctgctccacagsatggctgtagcacagacaccttcccctgggacccccattggctgtgtgtcccccagcttctaattcctctagaatatcatgcccaggttaggcactcttt

SEQ ID NO: 21436 - DNA, 201 bp, Homo sapiens
gtgcaatagttgatgaagataacatagtttataacgcacacctcaaaattcatttcttctcacgtaacaactttcttagtgcttgtacttgtgtgcctctyggagttacttgttgataggacagcgttaagggggtcgtttctttctggtttgaaagttgagaagtaggtcatcactgtcatcgtcatagtggggacacac

SEQ ID NO: 21437 - DNA, 201 bp, Homo sapiens
ctccctgcagtgttattagctgttcctgatttggatgtgtaagcccaagccgccacgtgggctcggaggggtacagagattaactggaggcttgccaaccrtttgtcacacaaatagcagtgccagttaactgagatacgataaatcatttttctcaagattgaaaccttttatcagttgtgtcagtttcattattcgata

SEQ ID NO: 21438 - DNA, 201 bp, Homo sapiens
ttcatcattcattccattcacttgacaaatatataactagcgctttatcgtatgcagtggtgtcccagggtacattgggaagtgaccccagagaagatggrcacatcagttgatccaatccaatcaaatgctgccaagaactcagtaggctaaagggagtgtgggatccatgcgaagggaagggtgtgtgcggctatggag

SEQ ID NO: 21439 - DNA, 201 bp, Homo sapiens
tgtgctttgtcaggtggtgaaaagtaaaatgagggtgagcaggtgcaaggcatacgttcgcattctgaagtcaagtcgtgcatgcatgagtgtgcgaattmctaagcatgttttcaactgagaccatcacagcaatgtatctgttcatcattcattccattcacttgacaaatatataactagcgctttatcgtatgcagt

SEQ ID NO: 21440 - DNA, 201 bp, Homo sapiens
aaaatgaaaggtcataagcctcatcttctcattaacaccacaccagattgattccagtattcagtgcacagataacctcatgtttcagcttccttattgaygtgaatgtgctgagcagagctcacctgcctcttgtcagagacatgaatgggctgataatatctagttttcaagcagaggaagttagaggtgaaccgcagc

SEQ ID NO: 21441 - DNA, 201 bp, Homo sapiens
cagcctggttgctgggtatgaggcctccacctcggcaggactgcttcgagctgacctggactgtgtttagaacagtgtttggtgcacttgtatcctagctkgtcttgatgtcaggatccttacccctcaagcaatcaaaaaagttatccagcttgtttcacaaatgagaacttcagaccttcagccttaattaataactca

SEQ ID NO: 21442 - DNA, 201 bp, Homo sapiens
catagatacatgcatattgcctttaatgaagatcttttttgttgttgttgttacggagtttcactcttgttgcccagactgtagtgccacggcgcaatctsggctcactgcaacttctgcctcccaggttcaagtgattctcctgactcagcctcccgagcaactgggattacaggcgtgcaccaccacgcctagctaatt

SEQ ID NO: 21443 - DNA, 201 bp, Homo sapiens
cgtttgtatctggtagtataacacagttgaatatttctcttttatcttccagtttttcttggctactgctacctgcttatttttcctcaaatgaactaaasagtaacttgaaaccttctcctccttgataaaaataatcccctcattggtgcacatgacatcaggacctcccgaggctgtgatacgggcacgtaaataaaa

SEQ ID NO: 21444 - DNA, 201 bp, Homo sapiens
tttaatttcttatgtaacttcatttagtccacaagtatttattgaccacttactgtggccacccactgccctggccctgggagtggagcaggaatccaaayggagttcccaggtctctctaggtacaaaagaagaatcgacggataatcactaaggaaacaaattgaaatgtgctttgtcaggtggtgaaaagtaaaatga

SEQ ID NO: 21445 - DNA, 201 bp, Homo sapiens
aattttatggtcttctttacataaaaaggttttccctcttttttatttataatcagattatcttttactgttgtgatttctactttaagctatttagaaarcctttcataatcttgaaaccagatcacagtttacatatatatacttctaagttttaattttattgtttttttcccttaaaaaatatatgtatgtgtttat

SEQ ID NO: 21446 - DNA, 201 bp, Homo sapiens
cattttttggaaatgtagatattccgtttacaaatctaagcaccgttaccaagagtggtaagtttctgcaggcagtaggacctttccagaggattagcagstgctgtgttccctgtggggttggcagtgggctgggggcacagcacggatgggattgtaatgtataccatttatcttggtatagaatcttccagtttcttg

SEQ ID NO: 21447 - DNA, 201 bp, Homo sapiens
aatcaaggtgcgatttatgttcattaagtgcttgtcaaaactgaaaaattttctaatcaacagcaatctagctgcagccccctcgatggctgggagggccrcctctgccacatcggctatttgcctgttacaactctaggctaaaaatccgctgatgattacattaggctaagctgcgaagtaaatgaaccatgtcttatt

SEQ ID NO: 21448 - DNA, 201 bp, Homo sapiens
tggatcactcccttcagcttacatacctgctcggccatcgctcagcccaacaccatggccctctgcagtttccacctctccttctattctccttctcaccrcacgttccaggacactcgtctgtcctcagctaccacccacattctcttcaaccctctcccatgtgtcatcagcccagcaccctccaacactgctctcatc

SEQ ID NO: 21449 - DNA, 201 bp, Homo sapiens
ccctggaagagtcagtgtcatctaaggtggatggaatggattcttctactccgcagcccgcatctcgtatggcaaagtgcaaaacctgggatggattctcracaaaggtacagtaattgggagacacaaacagtccagtgttttagccctgaaggaatactaccttattttttactttgggctctatgaatgcttcagata

SEQ ID NO: 21450 - DNA, 201 bp, Homo sapiens
cacagcagcaggggccacgtgagtcagggataagaaccccttccctcccttgtccaagtgtgcgctcaccattgctccatctgtaagggcgcacccttctrtagaagtaacttgccttgctgagaattaaaaagaaaattttatatttgagtgctatttcttttgtggcactgaaactttatatataacataatgttgcag

SEQ ID NO: 21451 - DNA, 201 bp, Homo sapiens
ttctccatgttggtcaggctggtctcgaactcctgacctcaggtgatccgcccacctcggcctcccaaagtggggattacaggcatgagccaccgtgcccrgcctaatgaagatcttttaaaatataactcataatttaagacgtcattctaaattgcatttctaatgctttccagcacctttctctactaccttaaggtt

SEQ ID NO: 21452 - DNA, 201 bp, Homo sapiens
aagcgagatttcatagaagtattgaattttaccaaaagtttcagaagtccaattcattattagatttctataaatataaatatttatatgatatttcttgygttgaattcagtatgtgctcaagttaagtgtgatttgaaaaatgaccaagtctcctaaggtgaagtttgtgtgtgaacaggagggccggggtcgctgggt

SEQ ID NO: 21453 - DNA, 201 bp, Homo sapiens
ctgggatggaggtggactctgagcacagacaagggacccatggcccagagcccagagtcacccgcagcccccctgcgctgctgctgcccgcatggggtacycttaagtcccacatccaagctccctccaccccacactctcccttggatttgcgcctgttctttctctggctgtgcacctggcagtgctgagaggagagcc

SEQ ID NO: 21454 - DNA, 201 bp, Homo sapiens
ccagcccccagcctgctatccgcttcacagagcagcgagccagtccttggagaggggacgtgagaaggggcagaagtcaggggacctgaggctgctccccrgcaccagtgctgctcaacacacacaattgtgtgaccaccactgaacaaatctcacaagaaagaggtgcattttactccacacgtcatttggttttgaaaa

SEQ ID NO: 21455 - DNA, 201 bp, Homo sapiens
aggcaggttgggcgcaggcttctcgtgcgcaccagcgagcacccgggccaagcgtggaggctctgcgggctgggggtccggcccacaccatcagcctctgygcagccgttgctttttccgttgaccaaagccatgaccttacctttatgcagtcgtgttcagagagagatgaagcctcaaaggcaaagtcagactgacact

SEQ ID NO: 21456 - DNA, 201 bp, Homo sapiens
gaggaagtcttagctacagatttttggtggaaacaaatggtccaccctgatctactcatttaccatctggtttggggaaccttctgtcatcctacctgctrtgtatttgtgacctgatatattatttttaaatacagttgtttaatagtgtagtcaaaaatgaaaggtcataagcctcatcttctcattaacaccacacca

SEQ ID NO: 21457 - DNA, 201 bp, Homo sapiens
tgggtaacaggacattgggtctgtgacaaggtctgagctagaaggaccgtatggcccatgaagcacagtgtatgcaagtgctgttgtaatttagtaaaccrccactagggggcattgaaagcgcgtctaaggattattctcctgcgcaaatgttttccttttgctgtcaccatggagaatacagatataataaaacacact

SEQ ID NO: 21458 - DNA, 201 bp, Homo sapiens
aatttctgtatttttagtagagacagggttacaccatgttggccaggctggtttcgaactcctggcctcagccattccactcgcctctgcctcccaccgtkctagaattacaggtgtgagccaacatccctggccagagtcttctagtttttgaaggtttttttcttttccctcttagtttttcttaccctaagatagagg

SEQ ID NO: 21459 - DNA, 201 bp, Homo sapiens
catctgtatctatatttaacagatttcatattcttactggcataaaattggaaataactaagtgttttaacatgaggaatggctacaactatgttaatacyacctccatgatgcaactgttataagggacaggttggaaaactgtggaaacataatactttacattaaaaagtagtattttttattgtagagtctccaaca

SEQ ID NO: 21460 - DNA, 201 bp, Homo sapiens
aagggtgcacccgcccactgccctcagggagcttactgtcagtctaggaggctgcacaaaggatctcatgcagaaggagggaagaggccctggatgctctrggggctttgtggagagcagaactacatttgatttaggggtcaggacaggtatcatggcctgcgggatgtgacaggaaccacagtgaccgcatcctcagtg

SEQ ID NO: 21461 - DNA, 201 bp, Homo sapiens
tgggttgactccagggcacccagaacaggtgtcatccctcttccatcagacagaagttccctgtgctcagagtccccagtgagcagtccctggcattgggytctctctgtggtgcctgctggccaccaccctgagtgatagagacaggaccacctccccaccattgtgggtgacacactcacagccttcactttcactggg

SEQ ID NO: 21462 - DNA, 201 bp, Homo sapiens
ctcatactttgtacatcctgtctgtagtttgatgagaggctttgttgtagaaatattctctttactcatgaactgactcttcctagactccatagaaaggwtagaacattcatttgcatttgaagtttcatacaacagtcgtttccataacatatttgacttatcttaggaagtttctcgcatcttcccttagtttctaca

SEQ ID NO: 21463 - DNA, 201 bp, Homo sapiens
taacatttcatatggtaggaggaagaagaggcactgtgctttctgaagcatttattcctccttagaatttttcccaggggtaagtgttcagaaaatctgawgaattcaaaataatttgctccaaaatattatgatgtgattaactacgtattgtaccagccagcatttactgaccatatgtatgtattagccaccatcagt

SEQ ID NO: 21464 - DNA, 201 bp, Homo sapiens
tcactgctggaactgacctttgggtgcttgggccacccttaggccttgagaggcacaggctgaggccttctgtacaacctcctggccagtgtggaggggcygggctccaagcaagcttgtccatatcacagaaagtcaagagtcttgccgtgtgcggtggctcacgcctgtaatctcagtactttgagaggccgaggcggg

SEQ ID NO: 21465 - DNA, 201 bp, Homo sapiens
aggcacaggctgaggccttctgtacaacctcctggccagtgtggaggggctgggctccaagcaagcttgtccatatcacagaaagtcaagagtcttgccgygtgcggtggctcacgcctgtaatctcagtactttgagaggccgaggcgggtggatcacgaggtcaggagatggagaccatcctggctaacatggtgaaac

SEQ ID NO: 21466 - DNA, 201 bp, Homo sapiens
tgggcgtggtggcaggcgcctgtagtcccagctactcgggaggctgaggcaggagaatggcgtgaacctgggaggtggagcttgcagtgaaccgagattgygccactgcaccacccgagactccgtctcaaaaaaaaaaaaaaaaagaaaagtcaagagtcttcacaatgaatgttgacagtaatacaaggtcagcttttt

SEQ ID NO: 21467 - DNA, 201 bp, Homo sapiens
ccctggccacaaaggggggtcagtctattgcaaagcagccttcacgttctggaagcagggagcagtgggagcccgggaaggtcagccttgcagacttgtasatgtcataggattatttgagctgcttccgctgcaggtggttgggaagtactggatggaatccttggaggcgagatgagaggatgggagaagaaagtctgg

SEQ ID NO: 21468 - DNA, 201 bp, Homo sapiens
cacttggacgtccaacatggctgacgcgccttggacacacagcctcggcgctgcatcattttttaatcagctatctgaggaatatttatctgatcaacaargagtgttgtcaggaggagaccagaggtgacattaataagcctgtggtttcctggtacaatgatggaggaagagtttggaataaaaccctgctcgtttgag

SEQ ID NO: 21469 - DNA, 201 bp, Homo sapiens
gacgtccaacatggctgacgcgccttggacacacagcctcggcgctgcatcattttttaatcagctatctgaggaatatttatctgatcaacaaggagtgytgtcaggaggagaccagaggtgacattaataagcctgtggtttcctggtacaatgatggaggaagagtttggaataaaaccctgctcgtttgagcatgcc

SEQ ID NO: 21470 - DNA, 201 bp, Homo sapiens
acaggcgaggaggggtccacgccagctgtgtgccatgcctccaccctccacagccccaggccagggcctcctctgtgtccccgctgccctcttccttctcrtgccacctgtgcattggttctgactgcgcttttcagcgttgagtctctgcatttctctgttctcttctgcttgggtttttttcatttgatgcataggttt

SEQ ID NO: 21471 - DNA, 201 bp, Homo sapiens
agcctgtggtttcctggtacaatgatggaggaagagtttggaataaaaccctgctcgtttgagcatgccagcagactaaagaatatttttattctgcttayaaagagccagtcaaaagagtctcagtttgaagtgttcagttaagtttaagtctcagtgataagttttcaggcattcacatgtgttagtaaaaaaaaaaaa

SEQ ID NO: 21472 - DNA, 201 bp, Homo sapiens
caaagagaagaaaggcctggagagtcgtgcggacagcattgggagcggccgagccatcccaattaaacaggtgagcagcctccccatccttccctccctgwcgccggagatacacctcaggtcttcctggagatgatgctggctctcgcaccaaggtctgtctgatgtgctctgttgatgaatgtagaagtctctcacttg

SEQ ID NO: 21473 - DNA, 201 bp, Homo sapiens
tattccgtttacaaatctaagcaccgttaccaagagtggtaagtttctgcaggcagtaggacctttccagaggattagcagctgctgtgttccctgtgggsttggcagtgggctgggggcacagcacggatgggattgtaatgtataccatttatcttggtatagaatcttccagtttcttgtcttttttttttttttttt

SEQ ID NO: 21474 - DNA, 201 bp, Homo sapiens
agttattcagcccaaaacaccagcggtgccacggtcaggaagccccgatctggacaatgaaagtttcgcttccttggccccttccagctgcggttgctgcrttgcacagtaattcagtaagaatccttcccaaagaaaggaaagccggtttctggtttgcaagagggtcactgcagccaacccagagcagtgcctgatcct

SEQ ID NO: 21475 - DNA, 201 bp, Homo sapiens
agagttattcagcccaaaacaccagcggtgccacggtcaggaagccccgatctggacaatgaaagtttcgcttccttggccccttccagctgcggttgctkcgttgcacagtaattcagtaagaatccttcccaaagaaaggaaagccggtttctggtttgcaagagggtcactgcagccaacccagagcagtgcctgatc

SEQ ID NO: 21476 - DNA, 201 bp, Homo sapiens
ttttttttgccttttccggtccaatggcagacacagggctgggtgactccgtatgctccagccccagtatctccagcaccaccagccccaagctcgacccgcccccctcccctcacgccaacagaaagaagcaccgaaggaagaaaagcactagcaacttcaaagccgacggcctgtccggcactgctgaaggtaagggtt

SEQ ID NO: 21477 - DNA, 201 bp, Homo sapiens
ccttgggaggaggacgcgttgagcaaccaaaggtggccgactcagagctggtcatcgtgggcattggttgaacaggtgtgagggcataaaacatggaaatrctgtccacaaggagtagcgggaggcaaaaatacaggcccagttgaccaccagctttatagtattttacctgccagtggataattgagagctgatacaggt

SEQ ID NO: 21478 - DNA, 201 bp, Homo sapiens
atatattatttcacatcaatttgatgagatgtttcaatttatgaagaattcttacgcaaaaatcaagcttattgtaactgtcctctgaaattgatcaattkttgctttaaccataatattaaatgcatacttaataaataagcctcaaaaacactacatatcagccagacacgatggttcacgcctgtactcctagtgctt

SEQ ID NO: 21479 - DNA, 201 bp, Homo sapiens
cgatgatccctgtgcgagcagaggccggcaccatttggtccctgagactcaaaacaaagactgatttgcctggttaagacccccagtctctaatgcagtcrataaatctttgttggtaaataattgctatcgagcagagttttaatataaatttatgagtggtgttttatcacagcttggggctgcagcaaacactgagtg

SEQ ID NO: 21480 - DNA, 201 bp, Homo sapiens
taaaacttcctttgaggctgggcccggtggctcatgcctataatcccagcaatttgggaggctgaggcaggcagatctcttgaggccaggatttcgtgacyagcctggccaacatggtgaaaccccgtctctactaaaaatacaaaaattaggccgggcgcggtggctcacgcctgtaatcccagcactttgggaggccaa

SEQ ID NO: 21481 - DNA, 201 bp, Homo sapiens
ataaaatgaaaacaagaataatcacctgttctgtaatattccagaggagccatagtagatactcaataaatatttgagagattgtgttactttttcattgktttctttccaaaaactaaagttagggtcatgatatatgactgataaaaaaaggaagtggaagtaagtggccaggcaaaggctccatggagcatcagcctg

SEQ ID NO: 21482 - DNA, 201 bp, Homo sapiens
accattttggccaggctggtctcaaactcctgacctcaagtgatcatcccacctcagcctgtaaaagtactagtattacaggcgtgacccactgtgcccarcctatttatttattaaataattttttgttgttgtttttagagacaaagcccaggctggagtgcagtggcataatcacagctcactgcagcctctaactcc

SEQ ID NO: 21483 - DNA, 201 bp, Homo sapiens
atttagtttagcggccctagtttacacgtggttaaagtgttttattagaaaaatttttcaaacatacagaaataaacacgtgtgtactcaccacacgcttsatcaaatacaagcccttttctgctacgctgctactgcaagaaataagcaaatcctaagtaaaagttgcagctccttccatgtgcctccagaacacgtttc

SEQ ID NO: 21484 - DNA, 201 bp, Homo sapiens
cttgattgacaggaacctgcagaccagctgtgctcttggtcctgtggccttccatgggagagggtatgggaagggctttggtgcaccacagatgtcttggyctgtctcttccgatgacttccctttgcttataactcacacctgtttacttggagactgtgaattagatttttagttttgcagcaggaaaatcatttgaaa

SEQ ID NO: 21485 - DNA, 201 bp, Homo sapiens
gtaccacagttttctctcaaatcgtatgtgggtgggttgtgtccagaaacaaataggaaagcttccacagatggaatgaaatagtggaacagatatggtgrttttgttttggaaaggatttgtctccaaagttttggggtggaggcattctagtcttgtttttcttctgagatggaaacactggcaaacttggagtcttct

SEQ ID NO: 21486 - DNA, 201 bp, Homo sapiens
tagttgctgtgtgacaagttagtattttgtccatgacatgcagcaatcagtagaaatagataaaggatgggatattggaaaatcccctggagatgagaaayggtgggtgacatctgatgagaggaggaggattcagggagcagaatgaagacattggccaggcaagcatctcagtgtggaggtggggctgcttagacattt

SEQ ID NO: 21487 - DNA, 201 bp, Homo sapiens
gaagacattggccaggcaagcatctcagtgtggaggtggggctgcttagacatttaaattgacctaaatcaagcagttattaataagtgggcaaaacaccrgaaaaattgcactccattcctgtgcctgtcagggctgttctattatttggaaacagactttacttacttaccttattgattgagacagggtctcactctg

SEQ ID NO: 21488 - DNA, 201 bp, Homo sapiens
aagtgaaaagaaaaccaagagctcctacctgcctcagcttaccctttgtttggtgcgtgggtgcagtgggcagtgagccgtgccattccctcctggcagcyggtgcatggctggccatggtccttagcagtgactgtgaacagccgtgggctactttgttacccacccagtgctgcttttgtatgttggcaaatggggctt

SEQ ID NO: 21489 - DNA, 201 bp, Homo sapiens
gccatggtccttagcagtgactgtgaacagccgtgggctactttgttacccacccagtgctgcttttgtatgttggcaaatggggctttcgctttccttgrtttgattctgtcattgatgcttcagactagtcatgcttttgtttgaagggaaaaaaaaatcaatcaatcaatatcagtaacttgctatagatttttataa

SEQ ID NO: 21490 - DNA, 201 bp, Homo sapiens
tagtgctttcacacttaaattgttgagttccaagtcttgtctaataattatctcagcaattgcgataccattggctgaggttcatggaggttttcaggctratgtcactgaatgatcggaaggactcactgctggcagtcacttgtgtgttttgtgtttttttttcctctgtctctcgccctccatttttctgcacggcat

SEQ ID NO: 21491 - DNA, 201 bp, Homo sapiens
tctctctgcattgtcttaacctgagtttttcaaagttttgatccttttaatccttagaaaatacactaaaaaagtacaaaaaattagtcgggcgtggtggygggcactcgtggtcccagctactcgggcggctgaggcaggagaatggcttgaacctgggaggtggagcttgcagtgagctgagatggcgccactgcactc

SEQ ID NO: 21492 - DNA, 201 bp, Homo sapiens; identical to SEQ ID NO: 3589

SEQ ID NO: 21493 - DNA, 201 bp, Homo sapiens
ttcgtttttggctaaggcatattgtgtctgtggggctgctgaaggaaaaagagcatcttatttttatgtgattagcattattcaatcacaaaatgcattgsattctactcagactgtcggagaatatgcttgctcctctcctaggctctggaggaagaacctcagccactatgtgtgtgtgtgtgtgtgtgtgtgtgtgtg

SEQ ID NO: 21494 - DNA, 201 bp, Homo sapiens
cggcataggaatgtctgtgtttaaagttggtcttgagcagacgtggataattcacactccttaattttttatgtttgtttttaggcctggggatttctctyccccctcttagaaatgtattaagcttctaaccttatgaatatattactttaattaatacatttctaataggcataagctgtgccgttaacactaattatg

SEQ ID NO: 21495 - DNA, 201 bp, Homo sapiens
ttttggcaccattgtggggacagtgctgtcctcccacgagtggcattctctcccaggcccactgactgttctgcctacccagattagagctcagaaagttscatttaatttgcagactaaagtgagaagagatcagtctcgttgtctacactggagctgacagtcagtttgtaccacatctgaaattatacttgtgggatt

SEQ ID NO: 21496 - DNA, 201 bp, Homo sapiens
gtaatggtgagcaaatccttgtagaattaaaatgggatgaagagacccttatgaagggagaaagcaggtgaagatggtggggataggggcgggacgtgcasccccttcactttccatgccgggcagtataaaaagtgagaagaaacacttcagggctggtgtgtaaacttcatgttggataaatacgtgacttctggtatt

SEQ ID NO: 21497 - DNA, 201 bp, Homo sapiens
gatgtaactcctcattaatgttaattgttatccagtgtaaaaaacgcatttattttgaggccatttagtttctcatttttcatttacagctattataaacygtttttgagtacacatgcatatttaatgttcctaaggggtgataaaatggagtgtcttctgagaaggcgtatggcatggaggcagaatagagcatttcat

SEQ ID NO: 21498 - DNA, 201 bp, Homo sapiens
tttgtgtattgaatgcagagcctcatcgaagcgttgtgacgaggagagcgatgcactgacggccttaggagtctccctgatataagcaaaagtcagctggraagagtggatttcaactttgttttcctaagagaaaaataggccagatgtggtggctcacacctgtaatcccagcactttgggaggctgaggcaggtggat

SEQ ID NO: 21499 - DNA, 201 bp, Homo sapiens
gaaaacaagaataatcacctgttctgtaatattccagaggagccatagtagatactcaataaatatttgagagattgtgttactttttcattgttttcttyccaaaaactaaagttagggtcatgatatatgactgataaaaaaaggaagtggaagtaagtggccaggcaaaggctccatggagcatcagcctgactgata

SEQ ID NO: 21500 - DNA, 201 bp, Homo sapiens
gctactcaggaggctgaggtggaagggtggtttgagcccgagaggtggaggttgcagtgagccaagatcactccactgcactccagcttagacgatagagmcagaccttctctcaaaaagaaaaaagcgagacacaaaagatctataagtgattgattcggtttacatggcgtctcagaaaaggccagtctgtagagatag

SEQ ID NO: 21501 - DNA, 201 bp, Homo sapiens
gtccattgagattcgcgtatgtgtttttaaacatgtaagacagtgctgagacatcctgccgcatacatagctatgggaggcattgtgaaactctgtttacsaaagagacttttgcttacgcagcaagcaaaatagcagaatggaaaacactaacggaatgctcacaccctgctgcctttttgtttaataacaggtgaaatt

SEQ ID NO: 21502 - DNA, 201 bp, Homo sapiens
gaaacatgatagagtgacacccaaggaacctataaggaaaggaattttgattctttcagaaataacaggaagaaattatcttaaaatcttaaggttgatgytgcaaacaaccagagacaataaataaattgttatttagtgatgttgcagaatattgtgttaatagagcctgtgatctcttctggcaatttcttaccctaa

SEQ ID NO: 21503 - DNA, 201 bp, Homo sapiens
cccccaagggctcccagtttattaagaaaactaaggaaaacataagacagatgaatgggggatgaagccgcaaagggtccccgctgctgcccccttggacwtcgtaatagtgaactgtgttctggccttgggtgaggatgaaggaagctgggcccagatctttttccttggttttcaaagccttccaggtaaatatgggac

SEQ ID NO: 21504 - DNA, 201 bp, Homo sapiens
atgtgtttttaaacatgtaagacagtgctgagacatcctgccgcatacatagctatgggaggcattgtgaaactctgtttaccaaagagacttttgcttaygcagcaagcaaaatagcagaatggaaaacactaacggaatgctcacaccctgctgcctttttgtttaataacaggtgaaattttgatactagaataatag

SEQ ID NO: 21505 - DNA, 201 bp, Homo sapiens
gaatgtgcttgaggtgattatccttaaatcatccaagtgtttttgaatattatttcaattatttcatcttagaagtatgaaatcagcttgtttcttgtttrgagttgccctttctttttattattatttcttaattgagacaggatctcgatctgtcacacaggctggagtacagtgatgccatcatagctcactgcagtt

SEQ ID NO: 21506 - DNA, 201 bp, Homo sapiens
aatggagaattttggctcaaacactacagcaggcaagaagagttaacctgtcgtaagtcaggaacacgttggggttgattagggagctgaccgttggccarctcatgctttgggaaccagagggccagcctggctgcctgctttgcgggcttaagacctgcctctggaagggtaagggcctgcccgtccagataagtgctg

SEQ ID NO: 21507 - DNA, 201 bp, Homo sapiens
cactggttaccagggaatgagaacttgtgttgagtttgagattttacttacctggcaagttggccttccagtttcacggagctggtctaagatatgagacwtcagggtcagagacaaagaaaaatccgttattcacagcaatagcagtagccagagtattagcatttgggtcatttcccaggtcccagtgcccatagctgt

SEQ ID NO: 21508 - DNA, 201 bp, Homo sapiens
ctcactattagttgtttccgtgtttatacattgctcccactgaggtttaggcaaattcgtgtggtattgtttccatcattaaattgtaaactctttgaggyatacactgttacttctctttctttgttatcctctcttagttttgtgacctagcaattattttctcattaggtatatattcctgcatgttacccatcatgt

SEQ ID NO: 21509 - DNA, 201 bp, Homo sapiens
gccagcatattaacatttaaatgcacagtacattcattcatttcatgctgtaaggatcattctggaacgaatgataagtagtggtttttccctgacattcrtactctacttttggaagtgtgggagattgttgagcatttttaaatagccataatgcaaggggcttctgtgtatttctagttcttaaagaaaatgcaggat

SEQ ID NO: 21510 - DNA, 201 bp, Homo sapiens
tttaaaaggaaattataactcctatcaacagaaggatttaatatgttagttattaatgatactcataaaatgaggcaaacagagagcacgtgtttggcccrgcgcagtggctcatgcctgtaatcccagcactttgagaggctgaggcaggcagatcccctgagcccaagagttcaagaccaatctaggcaacatggtgaa

SEQ ID NO: 21511 - DNA, 201 bp, Homo sapiens
gaggctagtcctaggagcagactagccccacctccccagcgggggagccagcaggtaggctgctgggcaaggacttcactgcaaggagggacagggtgggscggggggacttcccagttatgtcaggtttcaaaatatatttggggaataaaaatagggtgcttggggccaggtgcggtggctcacgcctgtaatcccagc

SEQ ID NO: 21512 - DNA, 201 bp, Homo sapiens
cagtaaaatgtgaaggataactgatcttagtaagagtgacattttagtgaaagggaatttaaaaggaaattataactcctatcaacagaaggatttaataygttagttattaatgatactcataaaatgaggcaaacagagagcacgtgtttggcccggcgcagtggctcatgcctgtaatcccagcactttgagaggctg

SEQ ID NO: 21513 - DNA, 201 bp, Homo sapiens
gggccatacacctgctcagagcccacaaccagccttctggttggccaaggctgcagagaaaaccccttcatctgcctcatcaacccacatgctcttattcrtagataatggacaacgaaggtgtttgtgggaaccaacagtaaaatgtgaaggataactgatcttagtaagagtgacattttagtgaaagggaatttaaaa

SEQ ID NO: 21514 - DNA, 201 bp, Homo sapiens
actgtccaggctcttggctgaccagtgtgtggagaccctggtggcagcctagggatcccctccaggtctcttccttgtccttactgtagaccatcacaccrccactaatttcccccctctggccaggtgagagcagattgtcaccatttcagagaaatttgaaccaatcagaaagagagctcaggagtactggggtgactg

SEQ ID NO: 21515 - DNA, 201 bp, Homo sapiens
aaaccccgtctctactaaaaatacaaaaattagccgggcgtggtagcaggtgcctgtaatctcagctacttgggaggctgaggcaggagaatcgcttgaayccaggaggcagaggttgcagtgagccatgattgcgccactgcactccagcctgggtgacagcgagactctatctcaaaaaaaaaacagatttctctccta

SEQ ID NO: 21516 - DNA, 201 bp, Homo sapiens
aatgcagagcgattcgtggtgacagtttcataaggctaacgttgaatatgctcaaatgcttaaaaggcatttcatttgtgaatggcagcatgtctttatgrggggtgacagattgctcagatatgactttccctggttttcaggaggggtctcttcctgtccagtggtccagggctggtcaggcggtgtggcaggaacgga

SEQ ID NO: 21517 - DNA, 201 bp, Homo sapiens
aatgcttaaaaggcatttcatttgtgaatggcagcatgtctttatgaggggtgacagattgctcagatatgactttccctggttttcaggaggggtctctycctgtccagtggtccagggctggtcaggcggtgtggcaggaacggagccagcagactccctcttggtaaaattgtgcaagaaacgcaccacctaggtttg

SEQ ID NO: 21518 - DNA, 201 bp, Homo sapiens
acagattgctcagatatgactttccctggttttcaggaggggtctcttcctgtccagtggtccagggctggtcaggcggtgtggcaggaacggagccagcrgactccctcttggtaaaattgtgcaagaaacgcaccacctaggtttgtgcctcctgccgttgcttacgaggttctgagtcccgcagggactggctttctt

SEQ ID NO: 21519 - DNA, 201 bp, Homo sapiens
gactctgaaatagggggtgattcccagggccagggccaggggaccaggtgggaaggcgggctggagggtgggagtggcctcggtggatgcaggctcggccsggcctgtggggaggtgtgcctgtcggcgagtacagcaccgtggacgggagcctcccatgaatgaggaggagcaggaatgggggaggcccaaagagcagaa

SEQ ID NO: 21520 - DNA, 201 bp, Homo sapiens
cagctggggttttctgctttagcacattgttagttttactccgactccgttgctgtttcccagagtcatttgctctttctgaagacactggcccgtgggcrtcactgcccttagtggagttccttcctggaggctctccctgcagattctgcctctggaaatcaacacgtattgcccctgtgctcccccggattacttggc

SEQ ID NO: 21521 - DNA, 201 bp, Homo sapiens
gcatgcgggaagccttaactacactgtccaaagcaaaacacacccagcccgataacagagtagaaattcagactcccaccaccttcaccacctcctgcacrtcccctcaatagaaaatggaaaagtgaaagtcggggctggaatctccgcaagccggtctgtccatgacgtgagaagattctgcctttcgaagccaccccc

SEQ ID NO: 21522 - DNA, 201 bp, Homo sapiens
tctgctggtgctgaaagttccccaggcccaggaccaccatccacacacctccgatatctggtgaagcaccaggcatcgtaggcattgctgagtatttgggygactgacttctgagcatgaaggcagggagggtcccctctgtctggatggtaccccacccttcgcccctaggcaccttggccagaccctcctcattcttca

SEQ ID NO: 21523 - DNA, 201 bp, Homo sapiens
gttgtccccattgcacttaaaaacatttgggattggctgcagtgcaagtgatttcctagcaggacggagcagagccctctggcgccacattcctcttggcwgaagcctcgctctgcgtggcactgcatctccccatctttgtgtcctggtgtcaaagcatttggcccccaaggccctgcagggactcgctgctatttgcat

SEQ ID NO: 21524 - DNA, 201 bp, Homo sapiens
gctgaatttgcaaatgccagggtgaacttggtaatggaggcaacaggcagatgcttggtgtctgtgcgttgaacagaaaagagcccggtgaaattccacgmctgtttgtgtttagcacacggttcctgaattatttcatgagaatgcaggtatagcggtgacagctacaatatttgttagccaagctgcggacagagggtt

SEQ ID NO: 21525 - DNA, 201 bp, Homo sapiens
ccaaaatgttcagactgcaaggatatttcatacagatttgttagctggtatttaaataatattcaacactcctaagccttaaataggcaattagaagtatrctgcatttttttccctccagcatttcaaagacattactcaaattttgtttgttctttgtgctgcagtggtcttacttggcaactccctgtcttgacagac

SEQ ID NO: 21526 - DNA, 201 bp, Homo sapiens
tgaaattccacgcctgtttgtgtttagcacacggttcctgaattatttcatgagaatgcaggtatagcggtgacagctacaatatttgttagccaagctgyggacagagggttggcctcaggctgctgtttctgccccagggtcgtgagaaatagctgtgtccattttaaagcaagaaaacaaatggcacgattgctctgc

SEQ ID NO: 21527 - DNA, 201 bp, Homo sapiens
tatctgctcatgtgagagtgcacctttcattacaaaagtacccatgcgtttgactaggggtgctctgggacgtgggttagccaactcaggccactgccccrtttttgaacataaagggttattggaacacagccatagcctttcgcttatattgcctttggctgtgtttgtacctggtccttacagaaaaagcatctgtac

SEQ ID NO: 21528 - DNA, 201 bp, Homo sapiens
cagagatcaagtggcatgtccacatctggagtagaccctgagtggggcagaaccatcatcctgcgtgcagcctgcacactcccagcacccgtggcagtctyagcaggtggattatcaccgagcacacaggcagcccgaggcacctcctcgtcacagtgttctccgcagccctgactggcgaggagggcacgtccccacgtt

SEQ ID NO: 21529 - DNA, 201 bp, Homo sapiens
accattccatctgtctgatggcgaaaacaggcacctccatagtaatgcaaagtagattcctgcttgccaggtgcaggggagggaggggcagtggcgtatasggagtgattgcctaatgagtacgaaacttcttttggagacaacgaaaatgatctggatttacatagtagtgatggttgtacatccttgcaaatatactaa

SEQ ID NO: 21530 - DNA, 201 bp, Homo sapiens
accagacattttcaggagtaatttgagaatgtgcttgaggtgattatccttaaatcatccaagtgtttttgaatattatttcaattatttcatcttagaartatgaaatcagcttgtttcttgtttagagttgccctttctttttattattatttcttaattgagacaggatctcgatctgtcacacaggctggagtacag

SEQ ID NO: 21531 - DNA, 201 bp, Homo sapiens
taaattatgtcaattttgaaaaaaaaaaaaaaggaatttccaaaggaaaacagatgagccagggcgttccacaaagagcagctggagcaaaggtgcaggcrtacaggaacgcatgctgggtggcgggggcctgggtgcgggccgagggctggcgtggctgcccctcctcaggcctggggagtagagctctgagcaggatgt

SEQ ID NO: 21532 - DNA, 201 bp, Homo sapiens
aagggcctgcccgtccagataagtgctgctcacctgcattaaacaaacggccacacagagcccagtgggagcctgcactggtttctcttcctgcctgtggmagttgagagagacagacggtcctgtgagaccccttcttcagaaggtgaatgacagtgaccgccactaaacattccattccacctgcctgcacggcagtcc

SEQ ID NO: 21533 - DNA, 201 bp, Homo sapiens
acagagcgagactccgtctcaaaaaacaaaaccaaaaacaaaataaatacaaatgtgtaagatagaattcgttatgaagctacaccagacattttcaggastaatttgagaatgtgcttgaggtgattatccttaaatcatccaagtgtttttgaatattatttcaattatttcatcttagaagtatgaaatcagcttgtt

SEQ ID NO: 21534 - DNA, 201 bp, Homo sapiens
tgacctggggctgtgcctttgcttgcatttgcctgaagagttgagccaccctgtttaactcttgggtttttataaaatgtctcctgaagggcggagagaaygcctcaagtcgatgtcttccctgccacagatgtcagcatttctgagttgatagttgggagggtaagggcctggtggggtggagaatgtgtctctggaggg

SEQ ID NO: 21535 - DNA, 201 bp, Homo sapiens
ttttaaagcgtacgtggtcgctctcactcctgaaaccttcagagccagagctctgtttaatcctaacacagaagggaggagggattcttaggcctaatgcrccctctagtgttcaccaggagacaaggccgcaccacccaaaagtccttggttcttgtgagaatgcagagttgccgtatttgaggtggcatcttgaaaatg

SEQ ID NO: 21536 - DNA, 201 bp, Homo sapiens
aaatggagaggcaaggcagccctgaccgtaggtggtatgaagtgcaccggccagctcacagccccccacacggtaggtctaaatgaaacccgccagtcagyatgggccatacacctgctcagagcccacaaccagccttctggttggccaaggctgcagagaaaaccccttcatctgcctcatcaacccacatgctcttat

SEQ ID NO: 21537 - DNA, 201 bp, Homo sapiens
gagggtgggggccccatctcagtgagccagccaggcactgcacacagcctgagtggtgggcctgctgcgcccttgttaaattggttctcttccgaacccarcgtcccactgtcggtgacttggcgttttgtcctttctcctgagaacctgaggtggcatttgctcttctggttcctaggagctccatttagagccgtaact

SEQ ID NO: 21538 - DNA, 201 bp, Homo sapiens
gaaatggagaggcaaggcagccctgaccgtaggtggtatgaagtgcaccggccagctcacagccccccacacggtaggtctaaatgaaacccgccagtcakcatgggccatacacctgctcagagcccacaaccagccttctggttggccaaggctgcagagaaaaccccttcatctgcctcatcaacccacatgctctta

SEQ ID NO: 21539 - DNA, 201 bp, Homo sapiens
actctgtccctgcaacaggctctgcggtgggctagctccagtgttgcattctcccttcatcagtggagaaatgcactcttggaaccatgaagagtctgcasatgacagctctgcactcactaacattcaagcaccttgattcagagtttcacgagactaaggtgaggttacctttccctctctgttgttcttcccgtggaa

SEQ ID NO: 21540 - DNA, 201 bp, Homo sapiens
gctccttcaaagggtgtcatcatttcccaaggcagaggccagtttttgtgctgttttgagtagccacgtgtgaaacccagcagggcgaagcagacttctgygcgtgggtagttctttgacgttagatgcaatcctgatgaccctgctccacctctgcccttcctgagttcctctgttcaccgcaggggagttggagggctc

SEQ ID NO: 21541 - DNA, 201 bp, Homo sapiens
cgagcagaggttttattccatcttactgtgtcagatgtgattccggggacgcagttctttcttaagagctctgatgcatgttctaactaggagggcaggtrgctgccgctcccagcagcccctgatgtgttttccttcaagcctggggaacaccgagctagggacacgctggctaatagaggaaggagagctgggtatggt

SEQ ID NO: 21542 - DNA, 201 bp, Homo sapiens
gcctccagcaaagttcagcattttttttttttatttagctgctggacatgtcttgttaatctattctgtttataatttttggtgcattgtgaagctaatcytttttagagaggcggggtctattatgtcatctaattggtcagaaataaaactcctaatttttgtgttttctattattcagccatcttgctgaactcttgt

SEQ ID NO: 21543 - DNA, 201 bp, Homo sapiens
tattaggtgtatgtgtttcttacgttgtaattaattgtttaggtgtatcctttgcccatttttgcactaggttctttttcttattgatatctgagaactcyttgtatatttaggatatgaatatattttgcaggtatttccccagtttattatttgccttttaaattttatggtcttctttacataaaaaggttttccctc

SEQ ID NO: 21544 - DNA, 201 bp, Homo sapiens
cgtttttgcaaataattgccctgtgtcatgaaccttcccatgtctgctcatcagagataaggagaagatcctcttgagccctcccataaacacacacacasagtcaggctccttcaacatggggacatcccttcaagaatttgcattttctcctgcagaaagtccagaactttcttctctcccacctacatccagtcttct

SEQ ID NO: 21545 - DNA, 201 bp, Homo sapiens
ggttgagatcaagagatgaccaacgactggacatctgggaggcagtgggggtcagaggaagttgggtttttttttgtcttggtcaggtcacgatgttcctktgaatttttaataaaacatagttgtttacatacttctcctttaatcccacagctagttttaaaaactacatgattgtgttgctaggattagttaagaact

SEQ ID NO: 21546 - DNA, 201 bp, Homo sapiens
gtctgtactaaaaaaaaaatacaaaaattggccaggcatagtggcacacatctgtaatcccagctactcaggaggctgaggcaggagactcacttgaactygggaggcggaggttgcagtgagctgagatcgtgccactgcactgcattctggacaacagagcgggactccgtcttaaaactaaataaataacaaaatgcc

SEQ ID NO: 21547 - DNA, 201 bp, Homo sapiens
gcctgcttagctgctccgcaccatttatttgggtttcttatttgggaagtttgcatgtgactgggccaagtgacatttgttttgaggtccctcccagggcycaggggtgagctcttgacaaccccagagtagagatggggcacctgtgcccgggcattgatttcctgggaaggaaagaaaacgccaggccatgctgctgtg

SEQ ID NO: 21548 - DNA, 201 bp, Homo sapiens
caggaaaccaccagaagggctccagctttagggaggatggtccatttacacgcctgtggttggaggttccaagtgccttgaaaaatgccttgatgccactyggagctgtttctttcttctctttcctttcccttttaaaatcacggaaccatttctttctttctttctttttttagacagagtttcgctcttgttgcccag

SEQ ID NO: 21549 - DNA, 201 bp, Homo sapiens
caaagcctggccacttgcacaggaagatgctcatagatggctggttcctgccagtgacacacgtggacctcaagcaggtggatgggtggagctcagggaayaggcatgtggggcacactctccaggcacatccagggctggactggggccggcatgggggtcactggctgcaagcgaaggcagcttatgtcatgttccctc

SEQ ID NO: 21550 - DNA, 201 bp, Homo sapiens
gggccggcatgggggtcactggctgcaagcgaaggcagcttatgtcatgttccctctgccaccgccagctgtcctgcagcaggaagaggtagtcatgtttrgaggccgggctgtgcatgagctatgcaggccttggggtcttttcatcagattccttttggcagaatataaggaagttggcccaaaccacatttttgaact

SEQ ID NO: 21551 - DNA, 201 bp, Homo sapiens
acctgaagaagggttgtgcatgtgggagggagccagcctggtggaccgtggcctgcacacctgcagcagctcctcagagctgccccctcatgccttggccratcacagagcaccctttctgtccaggccactgatcagcccccaggtccaggtccaagaacaagcctgtgaccccctgggtcccctttgtccttggcctat

SEQ ID NO: 21552 - DNA, 201 bp, Homo sapiens
accttggaagctgttgctcaccgcgtgttgattttatttaagactggaaaggcttgtccatgtatcgccgttgggaagggaaatcactccgaagacggtgrtgctgggtacaggctctggagtcatcttgatttggtaaaaggcatgaagtctgagttcattccgaagattctggcttttgagaacttatataaagagaac

SEQ ID NO: 21553 - DNA, 201 bp, Homo sapiens
aaatgcaatttgcccaaagccgcatgctcccttattgtgtttgcagagtcattcctgtggtcttttcatctttttgtttgtgtgttttattttaccattcrtgttcctttcagcttacttaaattttgacctttcccttcagtcgtagagtagtgatgtttaaattacttcagaaacctattttctcctcttttttctttt

SEQ ID NO: 21554 - DNA, 201 bp, Homo sapiens
ctaaaggaaatcagtttttagttaacttttaaggctattcaccatgatttaaagtgattccttgattcctctgttacattaagtgtgattgaaactgtacmtttattttctcatgccttgataagcagtgtagtcaaatcataacatattatgactgcaatcaagtgattatagcacgtgattatactttttgtctctgtg

SEQ ID NO: 21555 - DNA, 201 bp, Homo sapiens
tcatgatatatgactgataaaaaaaggaagtggaagtaagtggccaggcaaaggctccatggagcatcagcctgactgatactgctggagaggtgaggcasatacagacagacagcagcttatcggaggccggaaggcttacgtgctgccttcatcacgggcttcgtcaaaacctctgggtttcaacacagcattggaaaa

SEQ ID NO: 21556 - DNA, 201 bp, Homo sapiens
tgttttggggcagagcgccctgttcctgaatagcacggattgcacgtgtttctgagcatggtgtgtgagactgctttcccttcctgcagtcaactcgccarggtgcctccccagccccagcagtccggcttctctcctttccgctgccccatgctttctggtggcctggcagactcaggactatctctgagtccttcacaa

SEQ ID NO: 21557 - DNA, 201 bp, Homo sapiens
gccaaggcaggcagattgcctgaagtcagaagtttgagaccagcccggccaacatggtgaaaccccatctctgctaaaaatacgaaatttagctgggcgtygtggcatgtgcctgtaatcccagctactcggaggctgaggcaggagaattgcttgaatccaggaggcagaggttgtagtgagccaagatcacgccactac

SEQ ID NO: 21558 - DNA, 201 bp, Homo sapiens
ttgctcatgggagtgggacttctttttggggtgatcaaaatgtccccaaattggttgtcatggtggttccatgactctgaaaaatgctaaaaccattgaayggtgcatttggagatgagtgaatcgtagggtatgtgaattacatctcagcaaagctgttagaaaaaagaaaagatatgccacattttaagtggtgggaaa

SEQ ID NO: 21559 - DNA, 201 bp, Homo sapiens
aacttgaagccacagatacatgtgtctttatctcccacctgtgtgtgaagcgctgagtcggagggcttttattgagtaggaaatgcattttgtaaagtttytaaaaatgttcagtgccttgaaatataagaattggctattttaaataccgattttatttattttttttttttagagctagttcttctgaggttgtaatgc

SEQ ID NO: 21560 - DNA, 201 bp, Homo sapiens
gagggatctggtacaccgagatactaatgactccgcgtccttctccaaaggcagccccacagaaggccggcgccacgttaagctgtgctgctgtcagcaasctgaaagctatgggtctctgacacggctctcaattgctagcaggtttctctcattgcacctcatttgcatctgggacatcaattagcatgtttgttgagg

SEQ ID NO: 21561 - DNA, 201 bp, Homo sapiens
ttgttttgtggaagcattctccataatgctctctgcagctctaatccacaggcaggcaggcccgggccatttgcatgggctgctatttgcttgtaaagtcrgtattttgttgtgtttctaaaggtcgtctggtgccaaagttcacaaattgacttgcgttgcttttttcaccgaagacagccgtcattgcttttgtataat

SEQ ID NO: 21562 - DNA, 201 bp, Homo sapiens
tacagcagcgaatcaattaattctctgtatcaggagggatctggtacaccgagatactaatgactccgcgtccttctccaaaggcagccccacagaaggcsggcgccacgttaagctgtgctgctgtcagcaacctgaaagctatgggtctctgacacggctctcaattgctagcaggtttctctcattgcacctcatttg

SEQ ID NO: 21563 - DNA, 201 bp, Homo sapiens
ttttttttatgattacaaatgtcaagggtcggaattactttgatgccaggcaagggaaaaccaccaccatcagcccaagcgcacataagggaggcgggggyatcgggcgtgtgatgcaaagcaggtcacaatccagcgatcttggtataatagggggacattttttttcacttaagtgcaagccaaatgggtcaagtaatc

SEQ ID NO: 21564 - DNA, 201 bp, Homo sapiens
atgagccaccatgcccggctggagtttgttttttaaaatgtgtacatgcttgagggtgttaccaggaatgatcaataaagtcagttactgtcatccttacscccacactaagtgctccggttacatggagattacaccttgccagctgagtcatgcagtggatttggcatggcaggcactaagtatgcgggtagcaggtgg

SEQ ID NO: 21565 - DNA, 201 bp, Homo sapiens
catgagccaccatgcccggctggagtttgttttttaaaatgtgtacatgcttgagggtgttaccaggaatgatcaataaagtcagttactgtcatccttamccccacactaagtgctccggttacatggagattacaccttgccagctgagtcatgcagtggatttggcatggcaggcactaagtatgcgggtagcaggtg

SEQ ID NO: 21566 - DNA, 201 bp, Homo sapiens
cgggagtccttgcagcagggaggcttgcagagatcaagtgcacctacgcccagcacctcccccagcggacacatttagagaccctcgggagcgcgagggayatgagaatcacaagcacagagactcatctcttgaatatcacccgggatatcaaaaacctatcagcacacctggcgaggaccctcaccaaggcgagctccc

SEQ ID NO: 21567 - DNA, 201 bp, Homo sapiens
cttgcagagatcaagtgcacctacgcccagcacctcccccagcggacacatttagagaccctcgggagcgcgagggatatgagaatcacaagcacagagastcatctcttgaatatcacccgggatatcaaaaacctatcagcacacctggcgaggaccctcaccaaggcgagctccctgcaatggttcatcaaaaattgc

SEQ ID NO: 21568 - DNA, 201 bp, Homo sapiens
caggaagtgaaagtctgtccaggctaatggagctgtgattgacaggccttctcattatggagcccatcaggggacagggcattccagtgttatttaggggkcgaggtgggaatgagaggaagccagagcccggggtgggggcgggagcgggggctagctgtgggtgttcattgaaagagtccaggtccccgacagccctgc

SEQ ID NO: 21569 - DNA, 201 bp, Homo sapiens
tccctccgtcagagccggtttagatgtggagtaatgaggcgctcgcttttttaatttggcatggcttttttctcttagcctctcccctcccatacttaacrccgtcgacagtagtcgtctgtcccggtgcccggtaattgatacaaaataaaatgcattctttgtatgcagccaggaggagcggatggcgctccgtgggcc

SEQ ID NO: 21570 - DNA, 201 bp, Homo sapiens
cagcatagagctgataagtgttgtggatacattccaaaaaattttcaacattcttaggataaaattttagctgggcgtctttagccatttttaatagagcygcttaaattcttggtcaggaatgagatagaaagggaacgaagtcatggaccccagagatacacaggagggcactggccagcacttattcatcggccttat

SEQ ID NO: 21571 - DNA, 201 bp, Homo sapiens
tgagtcccaggtgacacttcctgcccgacttctgtctcctgccacggcccccctcaattcacatcctaattcaccccgccatcaccttctcagcaccatgrtggccactccctcgtgtagccggttcccctgctgctgcagccgggccctcccacaggcaagcatctggaactagcaccagagcttcctcctgtcaaagct

SEQ ID NO: 21572 - DNA, 201 bp, Homo sapiens
gacataactctctgtcttcttcagtctgttttcccaggttaaaagttaaactgatttatgctaaaggaagatcaccttactgctcaagtgtagttgcacastgtatattgttctttaagaagagcagtacaaggaaaatattattttatgtaattttaaatcctctttttcctctttttctattcagaaactaaaagaaat

SEQ ID NO: 21573 - DNA, 201 bp, Homo sapiens
ggaggtggaggttgcaggagccgagatcgtgccattgagctcccgactgggcaagagcgagtgagcctctgtctcaaaaaaaaaaaaaaaaaaaaaaagtsttctttattgaaactcaaaaggtaaaatgattctgtcttggagacccctccttacaatgaggatgtaatcagaggtaccacatccagagcccttagagtt

SEQ ID NO: 21574 - DNA, 201 bp, Homo sapiens
tcccctagctttactgctttttcttagaagcctgtgattacattgaacccacctggatagttcaagacaccctcacctcaatgccattaatttaatcacaycagcaaagttccttttgccatataaggatatggcagcgtattcataggttctgggtgttgggacatggacattttgggggacccatgattcagtttccct

SEQ ID NO: 21575 - DNA, 201 bp, Homo sapiens
aggaggtggaggttgcaggagccgagatcgtgccattgagctcccgactgggcaagagcgagtgagcctctgtctcaaaaaaaaaaaaaaaaaaaaaaagwcttctttattgaaactcaaaaggtaaaatgattctgtcttggagacccctccttacaatgaggatgtaatcagaggtaccacatccagagcccttagagt

SEQ ID NO: 21576 - DNA, 201 bp, Homo sapiens
gcgaggcatggaggcagacacctatggtcccaggtacatgggaggctgaggtgggatgatcgctggagcttgggaagttgagggtgcagtgagccacgatygtaccactgcactccagcctgggtgacagagtgagatcctgtctcgaaaaaacaaaaacaacaaaccaaaaaaaaggtgacattgagaataaagagatgg

SEQ ID NO: 21577 - DNA, 201 bp, Homo sapiens
aggtttgcatgcctaaaattataacacttttttattgcaaaggttcttttcagcttttttcttttcaagtaaatggagatgtgtctttcttctgtttctgktgtcctttttctttccgtaaaataaccacctctttactgagattggggagggaagtctgtctccattgaattgtctgctgtcgacatcagataagacatt

SEQ ID NO: 21578 - DNA, 201 bp, Homo sapiens
gcgcacctgtaatcccagctactcaggaggctgagacaggagaatcacttgaacccaggaggtggaggttgcaggagccgagatcgtgccattgagctccygactgggcaagagcgagtgagcctctgtctcaaaaaaaaaaaaaaaaaaaaaaagtcttctttattgaaactcaaaaggtaaaatgattctgtcttggag

SEQ ID NO: 21579 - DNA, 201 bp, Homo sapiens
gatgctggaagcagccccagcacatgtgcatctgcagcgggacttggtgatgtggacttggggcttccgatgctcgtgctagcctgaatctccgggagacrtggagcatctcagggtggggtcaggttcccaggtgaagcccctgctgctgatctgtagaccgtgcttggagaacactggtccagtgcactggagttcgta

SEQ ID NO: 21580 - DNA, 201 bp, Homo sapiens
gtgggatagatttttaaagtgagtgatcggccaggtgcagtgacttatgcctgtaatcccagcatttggggaggccaaggtgggcggatcacctgaggtcrggagttcaagaccagcctggccaacatggtgaaaccctgtctccactaaaaatacaaaattagccggatatggtggcacatacctgtaatcccatcttct

SEQ ID NO: 21581 - DNA, 201 bp, Homo sapiens
taattgagagctgatacaggtataggcatagctagacagacagacaaaccaaccaaccacagaaatgatacaggtacacagagagacagaggcacatccctttgtatgtgtgtgtgtgtgtgtgtgtgtgtgtgtgatcacacacttgcattccagatgccagtgtaaactgtttaaacatattttgaatacttgggtatc

SEQ ID NO: 21582 - DNA, 201 bp, Homo sapiens
aattgagagctgatacaggtataggcatagctagacagacagacaaaccaaccaaccacagaaatgatacaggtacacagagagacagaggcacatccctttgtatgtgtgtgtgtgtgtgtgtgtgtgtgtgtgatcacacacttgcattccagatgccagtgtaaactgtttaaacatattttgaatacttgggtatct

SEQ ID NO: 21583 - DNA, 201 bp, Homo sapiens
ttgagagctgatacaggtataggcatagctagacagacagacaaaccaaccaaccacagaaatgatacaggtacacagagagacagaggcacatccctttgtatgtgtgtgtgtgtgtgtgtgtgtgtgtgtgatcacacacttgcattccagatgccagtgtaaactgtttaaacatattttgaatacttgggtatctaa

SEQ ID NO: 21584 - DNA, 201 bp, Homo sapiens
gagagctgatacaggtataggcatagctagacagacagacaaaccaaccaaccacagaaatgatacaggtacacagagagacagaggcacatccctttgtatgtgtgtgtgtgtgtgtgtgtgtgtgtgtgatcacacacttgcattccagatgccagtgtaaactgtttaaacatattttgaatacttgggtatctaacc

SEQ ID NO: 21585 - DNA, 201 bp, Homo sapiens
aacctctgcctcctgagttcaagcgattctccagcctcagcctctcaaggagctgggattacaggtgccctccaccatacccaactaatttttttgtaatkttagtagagacagggtttcaccatgttggtcatgctggtctcgaactcctgacctcaggtgatcctcccatctcggcctcccaaagtgctgggattacag

SEQ ID NO: 21586 - DNA, 201 bp, Homo sapiens
gaactcctgacctcaggtgatcctcccatctcggcctcccaaagtgctgggattacaggcatgagccaccaccgcacccagcctcttctcacatttcttgkggtatctatcactgccttcttgcatatgtagtagatgttaaataaaggactggctttctgatttctgatcaactggcgtaaggctattgctggttacttg

SEQ ID NO: 21587 - DNA, 201 bp, Homo sapiens
cataccttaaatcccaatgttttgggaggctgaggctggaggattacttgaagctaggagttcaagaccagcctgggcaaaataacaagaccgtatctttaaaaaaaaaaaaaattctattgtatttctttctgtacactagcagtggacaatcaaaataaaattaaggacagttccatttacaaatagcatcaaaaagag

SEQ ID NO: 21588 - DNA, 201 bp, Homo sapiens
ctttttttaaaaaaactcacatatcctgtggtttttcaattctcaaaaaaagcttttgtctctcctgtctgttctctccaaaagtagtcttcgttgtgggtttttttttttttttttttttttagagataaggtcaccgggcacagtggctcacgcctataatcccaggactttgggaggccaaggcagacagatcacaag

SEQ ID NO: 21589 - DNA, 201 bp, Homo sapiens
aggagacctgcagccccccaccagacccccagaatcacactatgctggttggcctgggcatgcccctccccccaagcatttccgctgcacatcccagctcaagaaccaccctctgggtgccaaggtctcctccaggagcacaggttctcacctggggctgatctgccccctggggacatttggaaatgcctggagacatcc

SEQ ID NO: 21590 - DNA, 201 bp, Homo sapiens
ccagctggtaggaccagcccatggatcccagaggcccagcatgctcagggctccttcttttttctcatttctctcctccccatctccagacagcctttacygttcataaaaagaaatgcaggcctaaagaggactgggggctggaagagggttaggctgagtcccattgcccagggcatgaccagggaccatgtggtggcc

SEQ ID NO: 21591 - DNA, 201 bp, Homo sapiens
tgtgctaggaagaggcaaggagggatcccctcccccagccttcataaggagcacggccctgcagacaccttgatttttgaacttctggcttccagaactgygagggaatacatttctgctgtttgagccacctggtttgtggtacttgattacagcagtgctaacctccccacagttacccacaacctctgagtacctgtt

SEQ ID NO: 21592 - DNA, 201 bp, Homo sapiens
cacgcaaaaatcaatcaatgtgatataccacattaatacagtaaagagagaagaaaacataatcttttcaagggatacagaaaatacatttgacaaaaccmcgtgccctttcatggtaacaaacactcagcaaactagaaataaaaggaaacttgctgaacctgataaaggacatctctaaaaaacccacagctaacattg

SEQ ID NO: 21593 - DNA, 201 bp, Homo sapiens
tttgggaagaggaacttaaggctccacagaaatttgagtccatttttacttaaatgtactttttacctttagaaaaacttgtaggtaaaaaccaacaggtrcattcaaaccaatcacacgccaacttttaccacccaccaccgtcttaccttctgctgctgtgttggctcattattttgcgcggacccgaaatgaaggctg

SEQ ID NO: 21594 - DNA, 201 bp, Homo sapiens
ttgcatgtatccttataatagggagggagaagggtccacgtggagcagaggagtttgaagatgctgcctggatgttgggactaacatggcccaggagtgckgccgccgcaggtgctgggaggcccacagataactgctcacctgtagtctctgggtccggcatggcccccagcaccttgtcagccaagtgatggcgatttt

SEQ ID NO: 21595 - DNA, 201 bp, Homo sapiens
gcaaggaaggcaaggttggttcgacacgcaaaaatcaatcaatgtgatataccacattaatacagtaaagagagaagaaaacataatcttttcaagggatrcagaaaatacatttgacaaaaccacgtgccctttcatggtaacaaacactcagcaaactagaaataaaaggaaacttgctgaacctgataaaggacatct

SEQ ID NO: 21596 - DNA, 201 bp, Homo sapiens
aaatgtaaggatttaggtcggccattgtctccgtgtaagtcaacactaccttgtgtgtgtgcgcatacacacaaagagggtgagccctcagcccgccataygggcatgttatccagaagagaggagagagaagcccgctgcactctccactgaccagaccacccactttgccctctgcacgctcactccacgaaggatgca

SEQ ID NO: 21597 - DNA, 201 bp, Homo sapiens
ccctggacttcattcctcacttctttagacccaggtcttctgttttcttcctttaccagactgttgtctggcttagcatatccagtatatcccagcagatrttacagccagagagcatctacaagaggattagactctgtgatcaggtggcactgaatgcaaggaaggcaaggttggttcgacacgcaaaaatcaatcaat

SEQ ID NO: 21598 - DNA, 201 bp, Homo sapiens
catgcagaggctgactccagaggatgctgtgcacaggcctgtgtgacctgaaggcccttgcaggctgaggtctcttggtgataatccacacactgtcctgrgccttggttttgcagcatttccaacttgggttgtcagagtgagactgtgcaggactgccccgtacagtacggcttctatgtgtgaacaacacagaccact

SEQ ID NO: 21599 - DNA, 201 bp, Homo sapiens
cctgcagatggcttcctgctgagcacctcggtggtcccagccactcctggaaggattggttctagcacagagaacagagcccacccaagggactgtgaggrcctggcttggggtggcagggcctgaccccaaggatacatacaatctggaacatttatttgttcaacagccactctcccagaaccacactggggccatgcg

SEQ ID NO: 21600 - DNA, 201 bp, Homo sapiens
ggaagacctgagtgagggagctttcttgaggacgggttttgtcggagtgtagttcatataccatgcacagcctgtcagcatacagcttgaatgaactcacrtgtgtaaccagatcaagaggcagaatattactagggtggcagttttgagtcccatgaaaacaaacacatttactctgtctagctccatctctagttaatt

SEQ ID NO: 21601 - DNA, 201 bp, Homo sapiens
gagcctttgacacatcagtaggttatttcacacagcacatctccattaggactagccacgtttcaagcatctgatggccacatgtggcccatgtttggcartcatgggtctagatagcttatcaggacaggagttacatttgccctatcagcttgcaaaacatgctgcaaaacagcttgcaaaacagctggggactggaga

SEQ ID NO: 21602 - DNA, 201 bp, Homo sapiens
aaatttccaaggtatttttttaagtgaggcaccatcctggatgctggggaagaatctttgttggaatatgaccctgggttttgtatggaaaagggaggggscagtgcaggatgtggcaaggcagttgttggagctccgatacttccaataagtaactagcagggctgtacacactctaccaggaaagacaaagaaatgcag

SEQ ID NO: 21603 - DNA, 201 bp, Homo sapiens
tagggtttcttctcctccacttctctacactcaaccacccttcccatttctttaatgccaacgcaccgtcaccttcctcacccttgatgctgagacattcragaccccttagaacccaggactcccggtggctgctacaccctggtcatatctggcctctcacacttaacccctccaaatagtaaaatctggataaaaaaa

SEQ ID NO: 21604 - DNA, 201 bp, Homo sapiens
gtaaagaatggttcaccaagtcagaggtcatcctcagatgtccctatgtgtctgttagtggagataaagtgatctcaagacggtgacacatttaaagtgaygtgaactagtttattagtagtcagtggtccccccggccacttctaaagatgacatgcttctaatcatacccacaggatttctaagatcctttttttttct

SEQ ID NO: 21605 - DNA, 201 bp, Homo sapiens
aaaaaaaaagagacacccttgcaggcagtggtcacaggccgaggaacctggtggacaaggtggggaacgactcaatggatgatgataaacaggaagttctmgtaccactgagaaaacgatctgccagatatctccatcagcaatgttcttaacatgttttgtttttgacatactccagtcctcattttgacaagcttaagg

SEQ ID NO: 21606 - DNA, 201 bp, Homo sapiens
agatactttgtggggggaaaacaacctacttatctttcccattatgctatctcttaatagggcccctggtatctgagccagcatacacatttggttcttcygtgtcctgtgatcttcctctgagtgaaaactgattatctactcaaaggaagcagatgacagagcccccgtgatgtgtgctgcctttgctctgtgcctctg

SEQ ID NO: 21607 - DNA, 201 bp, Homo sapiens
tccgcaccccaccctttaaaggtgaaagcagcaggtggggtggactcctggggctggggaggccgtgcccctgggggcaggtgcaggagggagcctggctyttcaggttaaattgtgtttcaaaggcagagctcacattggagcacttgatattatgcatttgaaacattgagacacagcttctagtttaaaataaaggtg

SEQ ID NO: 21608 - DNA, 201 bp, Homo sapiens
ggagacctgcagccccccaccagacccccagaatcacactatgctggttggcctgggcatgcccctccccccaagcatttccgctgcacatcccagctcaagaaccaccctctgggtgccaaggtctcctccaggagcacaggttctcacctggggctgatctgccccctggggacatttggaaatgcctggagacatcct

SEQ ID NO: 21609 - DNA, 201 bp, Homo sapiens
gagacctgcagccccccaccagacccccagaatcacactatgctggttggcctgggcatgcccctccccccaagcatttccgctgcacatcccagctcaagaaccaccctctgggtgccaaggtctcctccaggagcacaggttctcacctggggctgatctgccccctggggacatttggaaatgcctggagacatcctg

SEQ ID NO: 21610 - DNA, 201 bp, Homo sapiens
tagccaggcatggttgcacgcgtgtagtcctagctactcaggaggctgaggtggaagggtggtttgagcccgagaggtggaggttgcagtgagccaagatmactccactgcactccagcttagacgatagagacagaccttctctcaaaaagaaaaaagcgagacacaaaagatctataagtgattgattcggtttacatg

SEQ ID NO: 21611 - DNA, 201 bp, Homo sapiens
gaaacaatatgaaccgcaacgggtatttctgcaagtttctaagactggcaggagtcagctcgggggaagcaggaagaatccccagttggttggctattctygggaccgaagagataatccccattgaacagagcctacactcacatccttgagtccgtgatgttcttcgcttccctgggaacagccagagtccagctttcc

SEQ ID NO: 21612 - DNA, 201 bp, Homo sapiens
gggtctttgctctgctcacagccatgctgtatccatcagggttctccagagaaacaaccaatttgtgtgtgtgtgtgtgtgtgtgtgtgtgtgtgtgtgtgaatctgaagtgtgtagggcaggccagctggtgtgtgtgtgcatgtgtgtaatctgaagtgtgtagggcaggccagccgggggtgtgtgtgtgtgtgtgtg

SEQ ID NO: 21613 - DNA, 201 bp, Homo sapiens
atggatgtgaaaatgtattgtgaacacatgcataggaccatacatacatcatacacacacacatacacacacacttaaacatacacatacacatgcacatrtacacacacatacacacacacagctatgggcacaacttcatttcaacttgtagattgtgaagtaaaggcattggaactttgtggcttgcaaatctaaatt

SEQ ID NO: 21614 - DNA, 201 bp, Homo sapiens
gcactttgggaggccaagcgggagagtttcttgaggccaggagttcgagaccagcctaggcagcatagtgagactctgtctctacaaaaaaagaaaatttaaaaaaaaaaaaaaaaaaacaggcatggtggcatgtgcctgtggtcccagctactcagaaggctgagttgggaggatcgcttgagcccaggaatttaaggc

SEQ ID NO: 21615 - DNA, 201 bp, Homo sapiens
cactttgggaggccaagcgggagagtttcttgaggccaggagttcgagaccagcctaggcagcatagtgagactctgtctctacaaaaaaagaaaatttaaaaaaaaaaaaaaaaaaacaggcatggtggcatgtgcctgtggtcccagctactcagaaggctgagttgggaggatcgcttgagcccaggaatttaaggct

SEQ ID NO: 21616 - DNA, 201 bp, Homo sapiens
actttgggaggccaagcgggagagtttcttgaggccaggagttcgagaccagcctaggcagcatagtgagactctgtctctacaaaaaaagaaaatttaaaaaaaaaaaaaaaaaaacaggcatggtggcatgtgcctgtggtcccagctactcagaaggctgagttgggaggatcgcttgagcccaggaatttaaggctg

SEQ ID NO: 21617 - DNA, 201 bp, Homo sapiens
agcccaggaatttaaggctgcagtgagctgtgatcgtgccactgcattccagcctgggtgacagagacctcgtctcaaaaaaaaaaaattatatatatatacacacacacacacacatacatacacacacacatatacatatacatacatacatatatatatagtgatccatgcaaaatctgcagcaggggtaggcagaca

SEQ ID NO: 21618 - DNA, 201 bp, Homo sapiens
gcccaggaatttaaggctgcagtgagctgtgatcgtgccactgcattccagcctgggtgacagagacctcgtctcaaaaaaaaaaaattatatatatatacacacacacacacacatacatacacacacacatatacatatacatacatacatatatatatagtgatccatgcaaaatctgcagcaggggtaggcagacag

SEQ ID NO: 21619 - DNA, 201 bp, Homo sapiens
aggaatttaaggctgcagtgagctgtgatcgtgccactgcattccagcctgggtgacagagacctcgtctcaaaaaaaaaaaattatatatatatacacacacacacacacatacatacacacacacatatacatatacatacatacatatatatatagtgatccatgcaaaatctgcagcaggggtaggcagacaggagg

SEQ ID NO: 21620 - DNA, 201 bp, Homo sapiens
gcctacccagtcagcatccctagggggtagggtccagtggtgtgttttaactctctaggtaattcttatgcacattaaagtttgagacactctggtctgcmctaagtagtaaaaataaaagtccacaatcttgcctgtgaactcactgtgttaatccaagtccctggacttcattcctcacttctttagacccaggtcttc

SEQ ID NO: 21621 - DNA, 201 bp, Homo sapiens
aggaggctcctcctccactgccctggccacctggatgctgcatttaattctgggcaccacgcgccagaaggaggagtagatgagccatgttctggggggcrgtgagcaggatggtgaaggaggagtagatgagccatgttctggggggcagtgagcaggatggtgaaggaggagtagatgagccatgttctggggggcagt

SEQ ID NO: 21622 - DNA, 201 bp, Homo sapiens
acttaagccttccccaagtatctggagattccaaaagctgcatctccctgctaaacctcctcattggagtctccaccctctcctgcgtgagtctgttgccrtgttttcctcagctgaaagggtttggagaccctggggagtccacacacaccccctatttcggagtttgaagctaaaagcacatggtcacccccaggtgtg

SEQ ID NO: 21623 - DNA, 201 bp, Homo sapiens
agaggtagcgtctcctcctctgtactctcctttcttccttgagaggaggaataactttctgtctcttgctgttctttgtaaatgagtttccttttggcttkctttcttctgtccttccttcctctgatgggtagagcatctctgtgggccaggtactgtgttcagcatttcatgagatttatcaattttaaagaagaattg

SEQ ID NO: 21624 - DNA, 201 bp, Homo sapiens
tgctttacagccccccagagcgccccagccctgccacacacagcggcccctgtgaggactgaggtggacgtctggctgcccgctctcttgtctgtgtcccrttcatctcccagaccccgccacaagacagtgctgaaaggcagtcagaagctttgtggttatttgcttaaaactttcttttctgggaatccaacccattaa

SEQ ID NO: 21625 - DNA, 201 bp, Homo sapiens
acatcatgaggagatatggcttctgcaggaagaggcctcaccaggaaccaaattgaccagtaccttgaacttggacttccagctgccagaactgtgagagstaaacgtgtgttgttgaagtgcctctgccggtggtctttgtgatagcagccccagccgactcatcacagccagattaagggagatcaaaagagttaaggt

SEQ ID NO: 21626 - DNA, 201 bp, Homo sapiens
taacagtggacagaactaactaggttttaggggtttaagaagggagccgtcagctgtgtgtaggacaggacttcgtaacacccggcttgtgcgtgtgtgcrgtaccataacgtagcgtgttgtagggcgtcgagcagctgggccgggggccgccagccaggcggggctctgggttccagtgttagaggtacatggtgttac

SEQ ID NO: 21627 - DNA, 201 bp, Homo sapiens
tgatactattattattttagggttacccaaaaatgtgcagcacgccctcgaatgacatggatttgttctaacgttggtgatgaaaaaaatggattcccgckggggccctgtctgtgtggagcgtgcacgcgctcccgtgtttcctgtgtgtggagcgtgcacgcgctcccgtgtttcctttgtgtggagcgtgcacgcgct

SEQ ID NO: 21628 - DNA, 201 bp, Homo sapiens
ggatgccgagtcacacgtgctttttcccacacaggtcagccctctcaaggtgaatgctgctgtgacatatgggaaagtgcatcttttctatccaaaccaaygctgtcaattatttattgtgcgggaaattccaaggctttggcttcagccaaatgtgttctgaagctactaccaacggccagtcatttgggacacctgaaa

SEQ ID NO: 21629 - DNA, 201 bp, Homo sapiens
attaaggaaaatgcctgcagttgtttccaccgtgcgtctgaaggtcgctttaaaaggaaagccatccgtggcttgcggggaccatgatacctggcaaatcrgaggtcgcaggtcctgtctgagatgagcttgtgcatgtgagtgcggatggggggtgggaaagggaggccagtgcaggggaggtgtgggccagtttgttct

SEQ ID NO: 21630 - DNA, 201 bp, Homo sapiens
aagtgtaatacgaaaaaaaatcatgcaaatcaattaccagtatctggtgtttgaaattgtaagatgctgaaaagaactgttaattatactctgtatctgcsgggggaatgtaaactgactttaggattcgaagagaccttgctgatgagagaaggaatcactgctccttttagaggcaatgaaagttgggcctggagtcct

SEQ ID NO: 21631 - DNA, 201 bp, Homo sapiens
ttccaggtgatgctgtttacctcctgtgatatccttgtgtcctggggaagcacagatttcagtgagactgggactctgttttcccctctcactgagatgcrgtcacagctgcccagcgacctggttccaccttagggtcaggcagctgcgaccgatctgtctggttcctcaccctgggggtgcccgccgttgggaggtgct

SEQ ID NO: 21632 - DNA, 201 bp, Homo sapiens
cttcccaaacctcacaggcctttctgcgtccctgacagaggtctcaagaggagcctttgacaaacagcagtgagagctgattgctgcccagtgtcatcaasatgccgccattgattctagctttggaatctgtggccaaataggtgactcaatctgaaatttatttggagaaggcagacaaacattcagaggaagcagcag

SEQ ID NO: 21633 - DNA, 201 bp, Homo sapiens
gaatttaaggctgcagtgagctgtgatcgtgccactgcattccagcctgggtgacagagacctcgtctcaaaaaaaaaaaattatatatatatacacacacacacacacatacatacacacacacatatacatatacatacatacatatatatatagtgatccatgcaaaatctgcagcaggggtaggcagacaggaggaa

SEQ ID NO: 21634 - DNA, 201 bp, Homo sapiens
ctcccgcctcctccccctcccccccccccgccccctgcccctcgttgggtgttgggtgttgggtgttgggtgttgggtgttgagtagcccagggcttctcyttcctggctgggatgcaggcagtagtcatatcatcacagtcatcaacagccaaagtgactcagtgtcgcccacaggttctgagtgggggcttgactgagc

SEQ ID NO: 21635 - DNA, 201 bp, Homo sapiens
tccagtagagacacatgactccttccttaaaacaacttacagtgaaaatatgtggatggttgaaaaagtaatgtttccagtctgctgaaagttctgtgggttttttttttttttttgcagggcaattatctgtataaaatactttttttcttttaagtagaatcctattgctaatgaaaccatattttgaacatgaaaatt

SEQ ID NO: 21636 - DNA, 201 bp, Homo sapiens
tttgggaggctttcttatgatcattcttaaatagtttattgtcttataataatgtgggcttttttgttttacttaatatataggaagatttttttttaatrccttaaaaatactgcacattaagtctgtttttttacagaaggataaatggatgaacaggtgttttaggagccacaataaaccatcgcagagcaaggagtg

SEQ ID NO: 21637 - DNA, 201 bp, Homo sapiens
ctactaaaaatacacaaaaaattagccgggtgtggtggtgtgcgcctgtaatcccagctactcaggaggctgaggcaggagaatcacgtgaacccgggagrcggaggtcgcagtgagccaagattgtgccactgcactccagcctgggcgacagaacgagactccgtctcaaaaaaaaaaaaaaaaaaaaaaaaattttta

SEQ ID NO: 21638 - DNA, 201 bp, Homo sapiens
atagtccctaagagctggccaacttccacgatcattatatttttgagttttgcatcatggcgcatagctgcttttttccttttaggatgtgcctctccatagagaagaagttcacattccttttctgtgtgacgctgctcttttagaaattcttccgtgattcagggttcgccaacatgagttatttcccattaaatttcc

SEQ ID NO: 21639 - DNA, 201 bp, Homo sapiens
tagtccctaagagctggccaacttccacgatcattatatttttgagttttgcatcatggcgcatagctgcttttttccttttaggatgtgcctctccatagagaagaagttcacattccttttctgtgtgacgctgctcttttagaaattcttccgtgattcagggttcgccaacatgagttatttcccattaaatttccc

SEQ ID NO: 21640 - DNA, 201 bp, Homo sapiens
tccctaagagctggccaacttccacgatcattatatttttgagttttgcatcatggcgcatagctgcttttttccttttaggatgtgcctctccatagagaagaagttcacattccttttctgtgtgacgctgctcttttagaaattcttccgtgattcagggttcgccaacatgagttatttcccattaaatttccccag

SEQ ID NO: 21641 - DNA, 201 bp, Homo sapiens
ctcacacagtggcgtctgtctgagggagcaaaggagcaccagattctggattttttaactgtcatgaaatatacataatataaaatttgtcatcctaatctttttttttttttttttttttttttttttttgagatggagtcttgctctgtcgccaggctggagtgcagtggcgcgaccttggctcactgcaacctttgcc

SEQ ID NO: 21642 - DNA, 201 bp, Homo sapiens
gtgcagtgactcacacctgtaatcccagcactttgggaggccaaggtgggaggattgcttgaggccaggagttcaagaccaacctgggcaaactggtgaasccactgcactccaacctgggcaacagagaaagaccctgtctctaaaagaaaagaaaaagacccccttctctacaaaaaaaaaaaaattgaaaattagctg

SEQ ID NO: 21643 - DNA, 201 bp, Homo sapiens
aagaccaacctgggcaaactggtgaacccactgcactccaacctgggcaacagagaaagaccctgtctctaaaagaaaagaaaaagacccccttctctacaaaaaaaaaaaaattgaaaattagctgggcgtggtgatgtgcacctgtagttccacctacttgggaggctgaggcaggaggatgacttgagcccgggagtt

SEQ ID NO: 21644 - DNA, 201 bp, Homo sapiens
ctcaaatgatccacccacctcagcctcccaaagtgctgggattacaggtgtgagccaccatgcccaccctctcccctgttaatttacctctttcattagtrtggtacatttcttagagttcatgagtcaatattgatatgtttttattaaagtccacactttatttgcatctctttagctttaacctcatgccgtgtctct

SEQ ID NO: 21645 - DNA, 201 bp, Homo sapiens
tttaaagatgagtaggtgcaaactgcagccacagtaaacttcagggtgtcaacttcaggggaatataaacagcctccagggagcccctctctccatcccarcctttcttcctctctcgtaactgttatttactcagtaattacaggttcaagtcccttgtccaaaatccaaaaagccgacactggaaatattctgtagctc

SEQ ID NO: 21646 - DNA, 201 bp, Homo sapiens
ttactgcttgttgttctggccccagatctcagagtcctggtaacgcctctcctcttctcactgccttcagtatccagccaagctgggaaacgccactgccmcagtacctgcagggtccagccagctccccacctccactggatgccactgtgttagcttgggctgccacgacagagaccacagagtgggtggcttaacaga

SEQ ID NO: 21647 - DNA, 201 bp, Homo sapiens
aagagacttgatagccggccattgcacgttcatcagcccggttttcctcttgtggcacctggtggtgtgctggtgtgtggtttataaaacatgctctgccrctttgatttccctgcttagatttacataattgttttagaagaaggttcaggtgctttgctggcagaaaaaggaagacgacctcttgcaaagtggggttag

SEQ ID NO: 21648 - DNA, 201 bp, Homo sapiens
tcaaggggctgaggtaggaggatcacttgagcccaaagcaatccagcctgctcaaacccagcctgggcagtatagcaagaccctgtcttaaaaaaaaaaagagagagaagaagactgggcactgtgtctcaacacttgtaatcccagcacaaagcaggtggatcacttgagtccaggagtttgagaccagcctgggcaaca

SEQ ID NO: 21649 - DNA, 201 bp, Homo sapiens
aaggggctgaggtaggaggatcacttgagcccaaagcaatccagcctgctcaaacccagcctgggcagtatagcaagaccctgtcttaaaaaaaaaaagagagagaagaagactgggcactgtgtctcaacacttgtaatcccagcacaaagcaggtggatcacttgagtccaggagtttgagaccagcctgggcaacatg

SEQ ID NO: 21650 - DNA, 201 bp, Homo sapiens
gtcttgctgtctgtgcagcacctgctttctgttcacaggtgctgggagttgtatgacgctgggcaaactgggagcagcgtgggcatcccggcccaagctcaggggctcaggaggcaggaggcggcactcgcattcacacgcacacgcacagaacgctctcccgctctctcagtctggtccctgggcaggttgaaggcagct

SEQ ID NO: 21651 - DNA, 201 bp, Homo sapiens
tcttgctgtctgtgcagcacctgctttctgttcacaggtgctgggagttgtatgacgctgggcaaactgggagcagcgtgggcatcccggcccaagctcaggggctcaggaggcaggaggcggcactcgcattcacacgcacacgcacagaacgctctcccgctctctcagtctggtccctgggcaggttgaaggcagctc

SEQ ID NO: 21652 - DNA, 201 bp, Homo sapiens
ctttggccctgctaggttgctggccggccaccttatggccccaggcctgtcctgaaggcgggggccagattgggagcccccctgcttccgctctgcagccctgtctggctgaatggtgtaaaattccctaagtctttccttccttcttgctgtgtttcaaagaaggaaaagccgggtctgtcagttctaggctctccactg

SEQ ID NO: 21653 - DNA, 201 bp, Homo sapiens
tttggccctgctaggttgctggccggccaccttatggccccaggcctgtcctgaaggcgggggccagattgggagcccccctgcttccgctctgcagccctgtctggctgaatggtgtaaaattccctaagtctttccttccttcttgctgtgtttcaaagaaggaaaagccgggtctgtcagttctaggctctccactgt

SEQ ID NO: 21654 - DNA, 201 bp, Homo sapiens
tgaaataaaattactgaaacaatttgataaagtttgatttttaaatttgatttgttactgaaaaggacactttttgttggttggttggttggttggttggttttttttttttttttgagacagagtctcgctctgtcgcccaggctggagtgcagtggcgcgatctcagctcactgcaacctctgcctcccgggttcatgc

SEQ ID NO: 21655 - DNA, 201 bp, Homo sapiens
ggagtgcagtggcacaatcatagcccactgtaacctcaaactcctgggctcaagcaatccccccaccctagcctcccaagtaattgggaccacaggcatgccacccccatgaatggcagtttttaaaaaattttgtagacttacgttcttaccatattgcccatgggttttgaactcctgcctttaagcagtcctctcacc

SEQ ID NO: 21656 - DNA, 201 bp, Homo sapiens
taataatgtgcaactagttgagataagagggttacagatcattgtacatggaaaatattcccagcagtaaacacttccattaatgtgatctacggcttttraaaaggagcatctcagaataagatggtggtacaatttgcttattaaaattgagaaagaaaaaaaaagacacactggagtatattagaaaggaaaaagaag

SEQ ID NO: 21657 - DNA, 201 bp, Homo sapiens
ggaaatctagctattatacagaattattagtctacctttagggctccccacagcaacaagcaaactcacagagcccagggcaggaggagctgttctgactkcaggcggccttgccaggagcccgttggcctgggtggagcccgttggcctgggtgtccactgtcagaggatggagattgatctggggttacctttttcagc

SEQ ID NO: 21658 - DNA, 201 bp, Homo sapiens
tatatatatatacacacacacacacacatacatacacacacacatatacatatacatacatacatatatatatagtgatccatgcaaaatctgcagcaggrgtaggcagacaggaggaagtgggttgcagggtcaaggcaagcctcagagaaaaaaacctgagactgagtggccctgacaggcagttggtgggacagggaa

SEQ ID NO: 21659 - DNA, 201 bp, Homo sapiens
atatatatatacacacacacacacacatacatacacacacacatatacatatacatacatacatatatatatagtgatccatgcaaaatctgcagcagggktaggcagacaggaggaagtgggttgcagggtcaaggcaagcctcagagaaaaaaacctgagactgagtggccctgacaggcagttggtgggacagggaag

SEQ ID NO: 21660 - DNA, 201 bp, Homo sapiens
gcagggtcaaggcaagcctcagagaaaaaaacctgagactgagtggccctgacaggcagttggtgggacagggaagggggtggtacagacggagggaaccmccatgcaaaggtataaaagaggaccccccaatatgctaacatgtattccactgttgctgaagactaacactcaaggcactggttaccagggaatgagaac

SEQ ID NO: 21661 - DNA, 201 bp, Homo sapiens
tggatggtaccccacccttcgcccctaggcaccttggccagaccctcctcattcttcaagattcagcagcccttgccttctgtgaggagtgagttaggttycatctgtgcccagctgtgctgtgtgctttgcaaatgaactggaacagtctgtctgtgaaggggatgtcagaaattcaaggatgggggacagctgtcatca

SEQ ID NO: 21662 - DNA, 201 bp, Homo sapiens
gagaccaaccctgccctctggacggatggaaggacactggggagccgatgatgcccagagtgtctgggggacgcatccagggtcccaggcccagaaaacartggagccaagagaggaacgaggtctctggattccggacgccctgctgctacttggcctccaaccaaaaaattgttcttctccttccttttttagtagggg

SEQ ID NO: 21663 - DNA, 201 bp, Homo sapiens
tctgtcctttgaaggttttcctaagatattttcctagtttaataggaagtgtggacatgggacattgtacggcttaggagactgcgttgtgtttggttttkaatatatattagatgcgtgaccctccctcttaagaactgattttgctttgagaagatctacaagggccaaaagtggacctgtttcaaaattctggtcaca

SEQ ID NO: 21664 - DNA, 201 bp, Homo sapiens
cctgagactgagtggccctgacaggcagttggtgggacagggaagggggtggtacagacggagggaacccccatgcaaaggtataaaagaggaccccccartatgctaacatgtattccactgttgctgaagactaacactcaaggcactggttaccagggaatgagaacttgtgttgagtttgagattttacttacctgg

SEQ ID NO: 21665 - DNA, 201 bp, Homo sapiens
gtgctctggagggagatgctatctccatcatccaaggctgtttcctgtgcatgttcttggaaagatagttgggaaaaaaggcaggcagagcctctgctggmaagacacagggaaaggagagagaagaattgttacccggcaaagatcagactgcctcctccaccaagtctctggtctagattctgtgagtccagaaacctc

SEQ ID NO: 21666 - DNA, 201 bp, Homo sapiens
gttttaggagccacaataaaccatcgcagagcaaggagtgcctcttctgagatcccattcgatgctctgccctcaattaaatgaatccgagataaatgggmatgtgcgtgtgtatgcacacacacgtgcacacatacacacacaggcacacatatgcacacaccaaggttctagatgagaaggaacagagggatccagctc

SEQ ID NO: 21667 - DNA, 201 bp, Homo sapiens
tcccaagcagcttcacctgttccctgtaacacctgtcctagcatttaactcttgtcctgaatactgcggaaccgttcggagaagtataaaagtggcttgaggctctgccaccgttttgcagaattgtgtagtcatgtcatgaacacctcatgcatcaggaagagaccttccatactgaaatgatgatctaggaagattaga

SEQ ID NO: 21668 - DNA, 201 bp, Homo sapiens
gaggaaaacctggcttagggatttatctgcagggactgtccccagtaggtctatgagagcccaccacagcagcagccctctggatggggatttgggtcttggttttgctagcactcccagtggacagtcatgcctggacttgtcttctccaccttccacttgtcctaacagctgtcgggaccatcatccaccaggggccag

SEQ ID NO: 21669 - DNA, 201 bp, Homo sapiens
tttccttaaactcaccgtcttagctatcaggtctaggtgtgaaaatgtgatttaactaatcaacacagtagcagcagagcttggtgtctttgttgactgtyggcggccacgtgggtttaggtcccctgcccttcagcctggttgctgggtatgaggcctccacctcggcaggactgcttcgagctgacctggactgtgttt

SEQ ID NO: 21670 - DNA, 201 bp, Homo sapiens
attcccctgtcttctattaaaaatgtcgtgggggcaaattctaaagaatagtctaggcaggcaaaccctttcaacttcactttgcaaacctgcctgagagwgagtctgagaggcaaattctttttctttccacttgaagaagtgtcagaaatttggtggattggaaaagatgggagagaaaagtccaggagtcctgactgc

SEQ ID NO: 21671 - DNA, 201 bp, Homo sapiens
tccctgatggagacaatccagaggctctctttcctgggcattactggggctgagggttggggcgtggcttcctgcagaccccacgcaccttgcaatcctcrtggcatttctgaatgtagctctatttctattagccttcctgaactggcaactttaatgcctgggtagcaagcacttgggcgtttccttaaactcaccgtc

SEQ ID NO: 21672 - DNA, 201 bp, Homo sapiens
tctgctgtctgttacctaccaccatttttattcccctgtcttctattaaaaatgtcgtgggggcaaattctaaagaatagtctaggcaggcaaaccctttsaacttcactttgcaaacctgcctgagagtgagtctgagaggcaaattctttttctttccacttgaagaagtgtcagaaatttggtggattggaaaagatg

SEQ ID NO: 21673 - DNA, 201 bp, Homo sapiens
atgattgcgccactgcactctagtctgggtgataaagccagaccctgtctcaaaaaataaaaaagcctcaagtcagtggttggcacattgcaaatacttgrtaagcattggctgtgaacattactgatacttttcctagtctgcataacagagtttgtctaatagtgactctacatttatataaatatatgtccatgatca

SEQ ID NO: 21674 - DNA, 201 bp, Homo sapiens
taaaacccaaacatgtctccttatctctgctgcgtcctgagtcggctcggctgcctgcatgttcccacccctgatgggggcacctgggagcgcccgtgggrtgggggcatctgggagcgcccgtggggtgggggcatctgggagcgcccgtggggtgggggcatctgggagcgcccgtggggtgggggcatctgggagcgc

SEQ ID NO: 21675 - DNA, 201 bp, Homo sapiens
aacatgtctccttatctctgctgcgtcctgagtcggctcggctgcctgcatgttcccacccctgatgggggcacctgggagcgcccgtggggtgggggcayctgggagcgcccgtggggtgggggcatctgggagcgcccgtggggtgggggcatctgggagcgcccgtggggtgggggcatctgggagcgcccgtggggt

SEQ ID NO: 21676 - DNA, 201 bp, Homo sapiens
ccctgcatgtaactttacagaagaatcaaagaaaagttggccaaagatacaaagtttttcttttgtatttttttgagaaggagtctggctctgtcgcccargctagagtgcagtggtaagatctcggctcactgctacctccacttcctgggttcaagcaattttcatgcctcagcctcccgagtagctgggattatatgt

SEQ ID NO: 21677 - DNA, 201 bp, Homo sapiens
tgcgcttcttaatgtctgtgccctgttcttctgatttaattagtgcgtgagtatcctttatgtcataatcctgacccgtggctgggatatgtagactgctgggaggggtgagggtgagggccttcctgtcttcaggggagagctctctcgtggtagaaacatttctggtgcagagccgtctccagatccaagcctgctttt

SEQ ID NO: 21678 - DNA, 201 bp, Homo sapiens
acctaattgcatttctttgtttacaagcacttaacttcatccctctcaggcgcacaccagcactgtctatcactaatactggcagttctagggtgaggtgkacagttgctcttagtcagaaactcactttgctgttttccactagattcccagatagagaaggacagttgtttcaggcaagcttaagaccctgtaacattt

SEQ ID NO: 21679 - DNA, 201 bp, Homo sapiens
tctacctactagatgccagtagcatctcttccagttgcggtgaccaaaaatgtcttcaggcaatccagatcaaatgtccactggggggcagaatcacctgctgagacccactggttaaaatagtgtcagtaggggtggagagaaggggacaaaagagtcttagagccatttgagagggagcttctagaggacttgatggat

SEQ ID NO: 21680 - DNA, 201 bp, Homo sapiens
tcagcactattgacattttatgccggataattatttgtcctgtgcatgtcaggatgttcaggagcatctctggcctctacctactagatgccagtagcatytcttccagttgcggtgaccaaaaatgtcttcaggcaatccagatcaaatgtccactggggggcagaatcacctgctgagacccactggttaaaatagtgt

SEQ ID NO: 21681 - DNA, 201 bp, Homo sapiens
atttaccacagtgtcttagatgtatgactccgtttgtatctggtagtataacacagttgaatatttctcttttatcttccagtttttcttggctactgctrcctgcttatttttcctcaaatgaactaaagagtaacttgaaaccttctcctccttgataaaaataatcccctcattggtgcacatgacatcaggacctcc

SEQ ID NO: 21682 - DNA, 201 bp, Homo sapiens
tgctgtgagaggtgagtgtggccccctcacagttgcagctcttcaaacgggagcctggagactccaggcctatgtcttgggaggtgcactgcacagggtgsctgctctgtaaaccttgactgaagtcgtggggaaaactgcagtgtgctccaagaacaaattgtgaatagagactagttaaaataaacatcacaatggcga

SEQ ID NO: 21683 - DNA, 201 bp, Homo sapiens
ctaggacctcaaaatgtgactttttttaaaagacagagccttactctgtcacccaggctgggctggagtacagtggcgcggtcatagctcactgcagcctygacctcctgggttcaagtgatccttccacctcagccccgcaagtgactaggaccacaggtgcatgccaccatgcctagctaattgtattattattttttt

SEQ ID NO: 21684 - DNA, 201 bp, Homo sapiens
accaagtcgtcgtgtcatcacttgttgggggttgaagtcctaacgcccggtgcctatgaatgtgatcgtctctcagaatggaaataaggtcgtcgcagatktaattatttaggatgaggtcatgccagagtggggtgggcccctcatctaatatgatggatgtccttctgagaagggaaatttggacgcagatgcacagag

SEQ ID NO: 21685 - DNA, 201 bp, Homo sapiens
aggccgaggaggacagatcacctgaggtccatagtttgagaccagcctggccaacatggcaaaagcccatctctactaaaaatacaaaaattagccggacrtggtggcacgtgcctgtaatcccagctattcaggaggctgaggcaggagaatcgcttgaacccaggaagtggaggttgcagtgagccaagattgtgccac

SEQ ID NO: 21686 - DNA, 201 bp, Homo sapiens
tgtgtgcagtgagattcctaagtggacctggaaggatgagctgagtggcctcacggtcaagccaaggacttcaaggtgcccctgtctaggaaagctcaccwgtgttccggtcctggctctctgggcttcctcaggaggtcgtttggcagctgtgaaactcctcccctccgggccatacctggcagacgtgcatgaactgct

SEQ ID NO: 21687 - DNA, 201 bp, Homo sapiens
gctggatcacagttcaggtggatcgagggcagcctgttctaagaccctgagagtccctttctgtggacttaaatgtgagccttagggagcaccttgatagwaaaatggaggcataatgagaaagaacttggacctcagggcttcacagttcagcgtggccacctattcatcttccatgtcgcaagcacggccgtcgagtgc

SEQ ID NO: 21688 - DNA, 201 bp, Homo sapiens
atgtacctgcaggggtgggcatggtggcatcttggtggccaggtgttcgtcaccctgcactgagagggcctggtgaatggcaaggtcaggggatgctgtcsggacatgtcaggatgggaaactgtcttgtctgtggatctttgaggctgctgaaaaggatctttgagcctgaacttccagggaagcctgaaaccaatctgg

SEQ ID NO: 21689 - DNA, 201 bp, Homo sapiens
tgttcacaggtgctgggagttgtatgacgctgggcaaactgggagcagcgtgggcatcccggcccaagctcaggggctcaggaggcaggaggcggcactcrcattcacacgcacacgcacagaacgctctcccgctctctcagtctggtccctgggcaggttgaaggcagctcagcatccatctttttccagagaagagaa

SEQ ID NO: 21690 - DNA, 201 bp, Homo sapiens
ctcaaactcctgacctcaggtgatctgcctgcaggctagtcttgaactcctgatctcaggtgatccacgccccttggcctccaagtactgggattacaggsgtgagccacctcgcgcccgaccagaaatgcttctattttatggtgaggaaattgagagaccagaaagttaaccgaggtcactgtcaaacccatggctcct

SEQ ID NO: 21691 - DNA, 201 bp, Homo sapiens
gcaaactgggagcagcgtgggcatcccggcccaagctcaggggctcaggaggcaggaggcggcactcgcattcacacgcacacgcacagaacgctctccckctctctcagtctggtccctgggcaggttgaaggcagctcagcatccatctttttccagagaagagaactttggccctgctaggttgctggccggccacct

SEQ ID NO: 21692 - DNA, 201 bp, Homo sapiens
acgctgagatcgtggcacacctgaggagggcagaaaggtggccccacaagcttcccaagatgaaactaaactgtatatggattgagtgggagcttttatcgttggttggttggttggttggttggttggttggttggttggtcgatcgacagagacttaagaatgttcatagaccaactccaagctgcaaaatgaaagtac

SEQ ID NO: 21693 - DNA, 201 bp, Homo sapiens
cgctgagatcgtggcacacctgaggagggcagaaaggtggccccacaagcttcccaagatgaaactaaactgtatatggattgagtgggagcttttatcgttggttggttggttggttggttggttggttggttggttggtcgatcgacagagacttaagaatgttcatagaccaactccaagctgcaaaatgaaagtacc

SEQ ID NO: 21694 - DNA, 201 bp, Homo sapiens
gctgagatcgtggcacacctgaggagggcagaaaggtggccccacaagcttcccaagatgaaactaaactgtatatggattgagtgggagcttttatcgttggttggttggttggttggttggttggttggttggttggtcgatcgacagagacttaagaatgttcatagaccaactccaagctgcaaaatgaaagtaccg

SEQ ID NO: 21695 - DNA, 201 bp, Homo sapiens
cagcaccacatcaaatgaggaactgggccccctcctttctgctgacggccggccgcgccaataattcattttttagctcattagctaacggaggctgtgarcggtgatcctcccggggattggaatgaggggaggtgatctactgccggctgcctgctcttgaactggccttccttggggaaaatgaaaggctcagccaag

SEQ ID NO: 21696 - DNA, 201 bp, Homo sapiens
ttggtcatatgtgacttgcgtatggagacgctagtgagaaagatgaaggatgctatccagagtatgtgtcagctcaggctgccaaaataaagtattacacktgggtggcttaagtgcgggacattcacgtctcacagttctggaggctggaagtctggagtcagggtgcccgcagggttggttctggtgagacctctctcc

SEQ ID NO: 21697 - DNA, 201 bp, Homo sapiens
gctagcttgggagaccctgcattggtcgactttcattagaatctaggatctgtcttgaagtcattttcttgatggtctcaaaatgtttgagctctgaggcktttcggatgtcatttaagtctcggtgaaattatggtccacttggaccaaggtcctgaagccagaagaggggctggttctagcggccagtgctgttcaact

SEQ ID NO: 21698 - DNA, 201 bp, Homo sapiens
gttaaccgaggtcactgtcaaacccatggctcctggctccctgacccctcacacccatttccctctgcgtcctcttgatctcccatggacactgggatggrcagggccaggtgggagaagcagggctcatctctgagggctgcgttatggggtaggagtttagcctcagtaactgcagcactttctgcccatggcaacctg

SEQ ID NO: 21699 - DNA, 201 bp, Homo sapiens
aaagcaggggagcttgtgaagtatgactccctatcccaagactcattgcctgcgattcgtaccgcttgacagtaatgatcttattacagtactgtggaccytgaagagatttcatgaggagagtgaaaggacgaccctccgtgtaatcaagtggcgctgaatattccacgcgtttttgatcacacactgattgggcacagt

SEQ ID NO: 21700 - DNA, 201 bp, Homo sapiens
acactgggatgggcagggccaggtgggagaagcagggctcatctctgagggctgcgttatggggtaggagtttagcctcagtaactgcagcactttctgcycatggcaacctgtgctgttttcacatttctcagaaattcccgctcttggagttttacacttgtaacatctgcttagcaaattttgaaaaattgaagatga

SEQ ID NO: 21701 - DNA, 201 bp, Homo sapiens
ttcccatttttctgcaagagtagtcgataacagaaagaagtgttttccaaattaattggtaatgctgttcactgatggtattaagacacaattagttaccmctgactgagtgcttgctgggtgtcaggcccacgctagtgcgttcctcgcatcatctgtccacgggtaatgtttgtctgcagcatgttggggtggtgtttg

SEQ ID NO: 21702 - DNA, 201 bp, Homo sapiens
ttgtctgtctcctgaacccgtatttcccagacattgtcagtgcttttgtgcttgtgtttttgcccgagtggggtgcaggggctgcctccgctgcatttgtsggggccggtgtcagttctcagctgtagccaagtgtttgtcctggaaatctccaaatgaaaagagtcgggggtcactctggggtcactcacatgtaccagg

SEQ ID NO: 21703 - DNA, 201 bp, Homo sapiens
gcacaaaattcccacatttggctgcaccctactcaaaacttcactgttttctggcatcttcaggaatttttgctgttggagtgaggtgcagccttgtccaggggaaggatgttttggctaatgcttatttcagagcgcgtggaggtgggtctgggttgtaaaatctcttaacgatggactaaacatattttagttgaaagg

SEQ ID NO: 21704 - DNA, 201 bp, Homo sapiens
ctgagatcgtggcacacctgaggagggcagaaaggtggccccacaagcttcccaagatgaaactaaactgtatatggattgagtgggagcttttatcgttggttggttggttggttggttggttggttggttggttggtcgatcgacagagacttaagaatgttcatagaccaactccaagctgcaaaatgaaagtaccga

SEQ ID NO: 21705 - DNA, 201 bp, Homo sapiens
ggtgtattctctgacaggtgcatacgagtccgttctgttgtgacttgttaggggaagtgctgacccacaccagctgagttagtctggtggtcttggttcamaatgggaagaggcattcaatgggacacccacgagccgaatccagattttccttcataagaaacttgagaatgtgcaaatgtgttgctagttcaggtccca

SEQ ID NO: 21706 - DNA, 201 bp, Homo sapiens
tgagatcgtggcacacctgaggagggcagaaaggtggccccacaagcttcccaagatgaaactaaactgtatatggattgagtgggagcttttatcgttgkttggttggttggttggttggttggttggttggttggtcgatcgacagagacttaagaatgttcatagaccaactccaagctgcaaaatgaaagtaccgag

SEQ ID NO: 21707 - DNA, 201 bp, Homo sapiens
atcttgctttcttggtcataagctaaggtgcttggagctgtcctttggcctttcatgtgctgtgtctgtggtgcgggtgtgctgtgtcctcataagggtgygccatgtctgtggcgtagtgtgcaccgtgtccatcataagggagcgctgtgtctttggcgcgggtgtggcgtgggtgtgccatgtccatcataatgaagc

SEQ ID NO: 21708 - DNA, 201 bp, Homo sapiens
gaagtcacacagaggtgatcttgcagaccatactcccctgagtgtgcaggcctgcatttttgctcagttcagctagcgcagtggcctgctcataaagtttyccaaaacctgtaggctgtatgaagaatagcggttactcctaagctgcttttaactttcaccttgtgattctcatcatatttttgttgatttccctccttt

SEQ ID NO: 21709 - DNA, 201 bp, Homo sapiens
tgaggccaaaaattcttacacaaggtaaataaatcaaatccctctggtttcctcagcaacagtaagtcacagccgaggactcagtaggagaggatgactgkggggggtcatgaggaatgttcttttacttctactaagaaattgaatttcattattatattttataaatattttcttctttggcttataacctgattgcgg

SEQ ID NO: 21710 - DNA, 201 bp, Homo sapiens
cctttgctctggcgcctgcttggaaaaaataagccgcatgatgatcatggacaacttgagaaggaaaatgcaaataggtttgcaattactactttttcaarctgttgaggggcaggagatggcacctctggggggcctggctcttgagtgggccccagggacttgttaagtgctgtttaaaagtacttggctttgaattac

SEQ ID NO: 21711 - DNA, 201 bp, Homo sapiens
gaggaacttgaagccacagatacatgtgtctttatctcccacctgtgtgtgaagcgctgagtcggagggcttttattgagtaggaaatgcattttgtaaartttctaaaaatgttcagtgccttgaaatataagaattggctattttaaataccgattttatttattttttttttttagagctagttcttctgaggttgta

SEQ ID NO: 21712 - DNA, 201 bp, Homo sapiens
cacagatacatgtgtctttatctcccacctgtgtgtgaagcgctgagtcggagggcttttattgagtaggaaatgcattttgtaaagtttctaaaaatgtkcagtgccttgaaatataagaattggctattttaaataccgattttatttattttttttttttagagctagttcttctgaggttgtaatgcctaactcagg

SEQ ID NO: 21713 - DNA, 201 bp, Homo sapiens
ttctaaaaatgttcagtgccttgaaatataagaattggctattttaaataccgattttatttattttttttttttagagctagttcttctgaggttgtaaygcctaactcaggcaagaaaacagatcccttagcccatgctgagctaaagataaatgggttcccttgccgctttcgaatctggagagcagacacttggtac

SEQ ID NO: 21714 - DNA, 201 bp, Homo sapiens
acacggagccacaggccccaggagggctgtgtaaagggcagggcttggagacccagtgatgctgcggtcggctccccaggaggtaggccaggcttcaaggratgggggctacctgctgagtttgaataaaggataggaatttgccaggcacacagatatgaaggaagggcaccaattctgtgaagaagcgttcactatgta

SEQ ID NO: 21715 - DNA, 201 bp, Homo sapiens
gccactttgggaagaagaaagtgcctcacggccacagcagtgctaagggaagtggcaccctgaccaagcatgcgggtgaagtcatcagctggtgtgcggcrggagggcgcagatctcagatagcagctccctgttgattgctcagcttcattcttgggttctgagaataagccatgggcggaggcacttctgtaagaggaa

SEQ ID NO: 21716 - DNA, 201 bp, Homo sapiens
gtaaacatcaaacggtcacccagaaacatgaccttgtgtcttgctcaggggtggaaaagaagtgtggcagcccaggctgctttctgggggtggagcgttckcgctcctgctcacaggcgagtttgtgtggcttgcggggctgggtgagctggttccacaagatggtttctgcttgacctgggcagctgagccggacgtggg

SEQ ID NO: 21717 - DNA, 201 bp, Homo sapiens
gcgtatggagacgctagtgagaaagatgaaggatgctatccagagtatgtgtcagctcaggctgccaaaataaagtattacacttgggtggcttaagtgcrggacattcacgtctcacagttctggaggctggaagtctggagtcagggtgcccgcagggttggttctggtgagacctctctccctggctgacagatggtg

SEQ ID NO: 21718 - DNA, 201 bp, Homo sapiens
ttattatgggttatctgaagagtgtttcttaattttaataagttaatattccaaccataaaaacttctgacattttacccgaggctgtgcttcagcagatygacagaatgcatttttacagcacttagaaaataccagatccacgaagaacaaatgatcaaagtttcaaaggctgtaattttggaaagctggcatatataa

SEQ ID NO: 21719 - DNA, 201 bp, Homo sapiens
agtctggagtcagggtgcccgcagggttggttctggtgagacctctctccctggctgacagatggtgccttctccctgtgtcctgcctttcctccgggtgygctcagagggagagagacatcaccagtgtctcgtcctcttatacgggcacctggcttattgaattagggctctatctttatagcatcatttaaccttaat

SEQ ID NO: 21720 - DNA, 201 bp, Homo sapiens
catccaccggggcaggggtctgggcaaggggcttctccccttgctaggccccctccttttgttcagctcctcctctccagcaccaacctcccatcactttmtacattctggcccctttttctcctttccttctttctcttccattctcctttttcctgtaagactgtccttgcttctcttgtttaatttcttttttcttct

SEQ ID NO: 21721 - DNA, 201 bp, Homo sapiens
ccacaggaggtggccttcaagtcacagcaggtggctgacatgcattagtttgctgaagtagcaccaaaaaacccagtgcccttgtctgagtcctgttttcrtactagtgaaatttcagctgctaacaagaatcacgtctgatgcagacacaaagcccagtggctgccccaactccctggccacctcctactgtccgagaaa

SEQ ID NO: 21722 - DNA, 201 bp, Homo sapiens
ctaaaggaactgtgtttttaatgttattttgtttcaattcacgtcaacacccacgggcagcttacagctgccccattggggggcacacctctagattcttyctctgaagcaaaccctacctaacccttcgtcagagaccagaaccaagtgttaagatggccaaagggagagcatgagaaaatgatgctgtggatccaccta

SEQ ID NO: 21723 - DNA, 201 bp, Homo sapiens
tttttatttccccaagaaaaaataaaaagttaaagtcagtctagtcaattgctttaacacaaagagcaaactgacacacagtttccctgggcattgctacrtattccttgctcttccgtaaaggacacatgtgtctctgtgcctctcagtctcccagttgcaaagatgccatcccaggtcaagctgaggtccttgcaaatg

SEQ ID NO: 21724 - DNA, 201 bp, Homo sapiens
tcctctttttctattcagaaactaaaagaaatactgcccatttaaagtctttggacagcaatttgattgcaggtaacatagtttctcttttaaatagctgraagtctcatccaaacaaaactaaccgtcactcagcatagagctgataagtgttgtggatacattccaaaaaattttcaacattcttaggataaaatttta

SEQ ID NO: 21725 - DNA, 201 bp, Homo sapiens
tctagcggtgctgcagagtcttgagttttcagtatctgtcacgctcttttttgagaaaccagaaaccatcatcagtagccacaaagtacaggagctgctcrcctggggtccttcctttgggtcaacataaacatgccttactgttggtttcctcttctatttgttaagcttctcatctcatcctgtcctctccttcttagc

SEQ ID NO: 21726 - DNA, 201 bp, Homo sapiens
gtgaaatatgtggcatttgtgtgtatggttatgtatctgtgtatgtatgtatatatgtgtatatatgtctaatttccgtgtgtatgtttatatttatgtakgtatctatgtatgtatgtatatatgtctaatttctgtatgtgtgtgtatgtattttctaatttgaccgtgaaagcaaagcagatgagctcttgctgttct

SEQ ID NO: 21727 - DNA, 201 bp, Homo sapiens
taactgtttaaaatcagagaagatgacacccagacaggaaaagtgacttgcctataattaacccagtgacttggaccaagccagaattagcctgtgaaccygtcacccagagactcctgagagaagccaacagcgtggcttaggagcatggagttatggctgcaaatgcctctagtagctttcagcctcaaatgctaaagc

SEQ ID NO: 21728 - DNA, 201 bp, Homo sapiens
agctgaaagggtttggagaccctggggagtccacacacaccccctatttcggagtttgaagctaaaagcacatggtcacccccaggtgtggggagcgcacyggctgtcccttccccccacccccggcccagctccagccaagtgtcctatagccctcacttacagtcctgcttacagtaaagcaactctcggccccagaga

SEQ ID NO: 21729 - DNA, 201 bp, Homo sapiens
cacctcctgcacgtcccctcaatagaaaatggaaaagtgaaagtcggggctggaatctccgcaagccggtctgtccatgacgtgagaagattctgcctttygaagccacccccgctccctctgccccactccgcccctcctggtctctctgcagaacctacgattgttagtagaaacagctggaaggttcttttaatgtgg

SEQ ID NO: 21730 - DNA, 201 bp, Homo sapiens
atgtggtcctggcgcagctcctgatctgggtaggtggtcggcacgcctggcagaggacggggccacaggaggcactctctgctttgttctgcttccgtggrcatctttctggcagaaggctgttgttctcgatctgcaagtggaaacagttcctaatgggaaactctgattgaagagcagagggccttacggagagacagc

SEQ ID NO: 21731 - DNA, 201 bp, Homo sapiens
gatgatgccagccagtttcacgcagtgagtgctccagttctggggtcccagtgctgctgtctgaatccatttcttgtcctgcacaatccttgcactagtcsttggtctagtttcacagcccaaagcctgtcaccattcattctgcaagtcagcgttggttgcgctgcgtgataacctcaccaaagggccctgcccaccaac

SEQ ID NO: 21732 - DNA, 201 bp, Homo sapiens
gactgattcttaaccaactcaaaattttaggcagaaagctagctccaaggctgaggcagccctgaatgtgcctaggccaacagccagcgagctcctggccrggagcctggtaatggggatggctggtaaaggctgtgccggccctgcctccctcccagaagggcgaccctccagccccatgtccaggctctcccatcttcc

SEQ ID NO: 21733 - DNA, 201 bp, Homo sapiens
accaacccttgccgatgagtcattctctgctggagcggaggcaaggttctcccctcagtcagccccagccttacctgtctctaagcagagggtggtgagcwtggggccctggaacactgtgcccccgccccctgcaacattttgggtttcagagaattcggagtccggcacaggaatgtgtcccacgcatgaatgtcgtcc

SEQ ID NO: 21734 - DNA, 201 bp, Homo sapiens
atttcagacatagaatcaatattaagaggacaaatgggtgacagcctgtgtcactgccatgatatagtatctttggcgtcacaccgagagcaaacgtgagygtgtgtcaggtcacattgagggctgatggaaacagattgccggcccctcccatacctcccgagtttctagttctgtgggtttggagcaggacgcacgaat

SEQ ID NO: 21735 - DNA, 201 bp, Homo sapiens
agcgaagtgtcccagttgggccttaaggcatctttcaaggaaattgcagtggtgatgcttagataccaacccttgccgatgagtcattctctgctggagcrgaggcaaggttctcccctcagtcagccccagccttacctgtctctaagcagagggtggtgagcatggggccctggaacactgtgcccccgccccctgcaa

SEQ ID NO: 21736 - DNA, 201 bp, Homo sapiens
tgtgggtttggagcaggacgcacgaatgtgcctctctaagaagtgtcctgaggatgcggatgccctggtccagggaccgcacttctggaagcatagctgtaaaggaaaggcagctccagttgacttggtatcatctctgggccgttgtttcttcttccttgctgtgcttgtagccagctgagaaggtttcctatcagcctg

SEQ ID NO: 21737 - DNA, 201 bp, Homo sapiens
gtaggagagatgaggagcctccgcccagctcaaatcttcctttttgttccttagagcctgcgttttttgaggtttattatgtaaagccgtgccccttttcmtgttggatggtgaagttccttccttctggctttaatgtttcccccttgttttattaggaaaggaggaaaggaaattcagttatagtgaagttctaatctg

SEQ ID NO: 21738 - DNA, 201 bp, Homo sapiens
tcgccagccccctaccctacagtatggaaaaaaggcatagaacagtcaaatcacgtaggatttcttggtttctccatgcaggctcatcgaatagcaaccaycctttcttagtttcttgaaacaagtaccttatttacattcagagaattatatgtggacaaacagctcataagcccgtacttttacatactcacttcctga

SEQ ID NO: 21739 - DNA, 201 bp, Homo sapiens
agcagtgctaagggaagtggcaccctgaccaagcatgcgggtgaagtcatcagctggtgtgcggcgggagggcgcagatctcagatagcagctccctgttkattgctcagcttcattcttgggttctgagaataagccatgggcggaggcacttctgtaagaggaagcagcttcattaaaatcttgggaaattttaatttg

SEQ ID NO: 21740 - DNA, 201 bp, Homo sapiens
gaggcacttctgtaagaggaagcagcttcattaaaatcttgggaaattttaatttgcattcaccttctctaaacatgaacatgaatctgtaaagtgatacrttctttcttgcttaagaaattaaagcgtttggggatttgagtttttatactctttgaaaattgagtttcttgtgctaaaatcatcattcacaaaatgtcc

SEQ ID NO: 21741 - DNA, 201 bp, Homo sapiens
tcattaaaatcttgggaaattttaatttgcattcaccttctctaaacatgaacatgaatctgtaaagtgatacattctttcttgcttaagaaattaaagcrtttggggatttgagtttttatactctttgaaaattgagtttcttgtgctaaaatcatcattcacaaaatgtcctctcacctgaggaattccaacacagca

SEQ ID NO: 21742 - DNA, 201 bp, Homo sapiens
gatttgagtttttatactctttgaaaattgagtttcttgtgctaaaatcatcattcacaaaatgtcctctcacctgaggaattccaacacagcaaattcartctgaaataaattgaggctacatttaagagacgggacttccagctaaaaataggtattagagagctgtttttgccaaaaaattgaatacttaaccttatt

SEQ ID NO: 21743 - DNA, 201 bp, Homo sapiens
ctgactctagacttctcaagagcaacatgcattcttaaatataatggaaatattccctcctaaggacaaataattctgaacctagaagcctatgcaaagaygactactaatcaaatgaagatagaaaaaaaagacatctttagacaacctacagggttatacaacatctctgtcttaaagggttttgaaaaaattacttaa

SEQ ID NO: 21744 - DNA, 201 bp, Homo sapiens
gatgactactaatcaaatgaagatagaaaaaaaagacatctttagacaacctacagggttatacaacatctctgtcttaaagggttttgaaaaaattactkaagggtctactccagaaaaaaaagaagaatccaaaagatattcaggcctggttaaaccttcccttcctcattcaaggtcactggcttctcaagatgtgca

SEQ ID NO: 21745 - DNA, 201 bp, Homo sapiens
ttgttggaattggttttaatgtctatttgacaatttttagggaaaatgttaatgttttgtgaggcttctcagacatcagaaagttagctaaatctgacatyagaggacactaaagttcatcttagttctttttaagaattgcagcatcttcagcttttatgagcaatgcgttctcactattagttgtttccgtgtttatac

SEQ ID NO: 21746 - DNA, 201 bp, Homo sapiens
tctcactattagttgtttccgtgtttatacattgctcccactgaggtttaggcaaattcgtgtggtattgtttccatcattaaattgtaaactctttgagrtatacactgttacttctctttctttgttatcctctcttagttttgtgacctagcaattattttctcattaggtatatattcctgcatgttacccatcatg

SEQ ID NO: 21747 - DNA, 201 bp, Homo sapiens
ggtcggaataagactccacgttttaggaagtgacgacgaaccgtctaattctaggatgttgaattctgcttggccacgttgatgtatttagtagtcgttamatttgtcattgcaactgggtctggattctgtatattcttttttctgttatgtagaactgtgtggctggagaaagcaactttgtctttagaataaatactt

SEQ ID NO: 21748 - DNA, 201 bp, Homo sapiens
ttgtctttagaataaatacttacacttatttctaaatataattacttaaatgagaacttagcgtctgacatggtaaatattttgtcttaaattgtaccaaytgccacatgatatccactcccaacatggagcagtaacccagggatgggagggaagggatgactctggcgctccagctcactgtcacctgctgtcaggcca

SEQ ID NO: 21749 - DNA, 201 bp, Homo sapiens
actcaccccccaaagtaggccacatccttgtacttatccccgagtataagtgtaccctcggcttccggggtagaagcttcctttaagacccttgtatttgygcgtgacttgaggttggtgaattaggaccacttgttagactcacctcgtctactccaggaaggagggcattctaatctggcttttacaatctcctccttc

SEQ ID NO: 21750 - DNA, 201 bp, Homo sapiens
gggctgccataacaaaataccacagacaggggtgcttcaacaacagacatttattttttcacagttctggaggctggaagtacaagatcaaagggccagcrggaatggttcctggcgaggcctctctcacggctggtagacggccgccctctccctatgttctcacagggcctttcctctgcactcgctcctggtagctct

SEQ ID NO: 21751 - DNA, 201 bp, Homo sapiens
agctctctcctttccccccacccccttctttttgggacaaagtcttgctctgtcgtccaggctggagtgcagtggcacaatcatagcccactgtaacctcraactcctgggctcaagcaatccccccaccctagcctcccaagtaattgggaccacaggcatgccacccccatgaatggcagtttttaaaaaattttgtag

SEQ ID NO: 21752 - DNA, 201 bp, Homo sapiens
ctgacagcagcagacacccaggtgcaccccagtgggtgtgtgtctagggcccctgggtgctgaaagaattatgaatacatggctccttgtgcctggaagcytcttagtcctgctgaattcatgcttctcatggctgagccacctttcccgtgtagaaccaagcaggtggccactgtctttgcccctcttaatgagaccagg

SEQ ID NO: 21753 - DNA, 201 bp, Homo sapiens
ctgggtcaggggaaagatcatgatccctgaccttttctcatgccctgcagcagccctccctgggcatgtggcctctcaccttttgactcgaggtcccaggkattgttctgtgggagtgtgaggagctgacagcagcagacacccaggtgcaccccagtgggtgtgtgtctagggcccctgggtgctgaaagaattatgaat

SEQ ID NO: 21754 - DNA, 201 bp, Homo sapiens
actcctgggctcaagcaatccccccaccctagcctcccaagtaattgggaccacaggcatgccacccccatgaatggcagtttttaaaaaattttgtagasttacgttcttaccatattgcccatgggttttgaactcctgcctttaagcagtcctctcacctcggcctcccaaggtgttgagattacaggtatcagcctc

SEQ ID NO: 21755 - DNA, 201 bp, Homo sapiens
tttttatcctgtggatggatattgatggagttgtttccagttcttggcttttacaaatagaggtgctgtgaacattcacgtgcaagtcttcatatgggcaygtgctttcatttctcttgggtagatacctaggagtggagtggctgggagatgtgctgggtatataattaacttttatgtaaactgcctgctgttttccaa

SEQ ID NO: 21756 - DNA, 201 bp, Homo sapiens
tggaaaagcaagtggtttgtcagtgaataagcctggcttgcgggcaggcacgtctgtctgcttgctcttaaccgcagtattctcctgtctgttgtcatggrgagcaagtgcttacctgtaaggaatccttccccacacattggtaaaataaccctacaagattattttagaagttttgcacagaggcagtatcgtagccat

SEQ ID NO: 21757 - DNA, 201 bp, Homo sapiens
tcttgatctgttgctgcatcagcagaatgctgggcagatggctgcatcttgtttgggagtttgggagttttctttgagtatctgttttttaactttcaggrgagaataccaaggttgggaaacactggttttgctgacataagaataagaaaattggccaggtgcattggctcacacctgtgatcccaacactttgggaga

SEQ ID NO: 21758 - DNA, 201 bp, Homo sapiens
tgcagtgagccatgattgcaccactaccctccaacctgggcaacagagtgagaccctatcattaaaaatcagtcaatcaatcaatcagtcaatccatgcgygtcctcccccattcctgccttgatttccctgttaggatttgccatggggtgggcagctgggcaaaggcatctgagctggaggtaggtgataagctccctg

SEQ ID NO: 21759 - DNA, 201 bp, Homo sapiens
  misc_feature (1)...(201): n = A,T,C or G, or insertion/deletion polymorphism (see Tables 1-2)
aaagatggtaaaaacagtaagtaatgtttcattaaaagagaaatgtgagtcatagaaatgtatcacattaatctgaaaaagaggattccagcctggccatnatcagtcagttacattttttaaatgcctaggctaaacattggagggaaatatgccaatataatagaattgattggctctgggtagtagagttgatggtat

SEQ ID NO: 21760 - DNA, 201 bp, Homo sapiens
ctgttatacccacgtatggaagatgaaagcatggatggtaaggcacagaagtgaagtagtttagtcaaggctagtgagtggcagaactaggattcacaccyactctttgtgacattgactcttaggctgtttccaccacttttccagtagaaaattgatttttgattgtaaactaatttgagttggctcgacttagtgact

SEQ ID NO: 21761 - DNA, 201 bp, Homo sapiens
  misc_feature (1)...(201): n = A,T,C or G, or insertion/deletion polymorphism (see Tables 1-2)
cttttctctcttagggaatgaggattgttagatcagaacaagaatttcaagaacagttagagtcagcacggagagaagctaagaagtctttcaatgatgaygctatgctgatcgagaagtttgtagacacaccgaggtgggttggccttatttttctgactcnnnnnnnnnnnnnnnnnnnnnnnnnnnnnnnnnnnnnnn

SEQ ID NO: 21762 - DNA, 201 bp, Homo sapiens
catggtgaaaccctgtctctactaaaaatacaaaaattagccaggcatggtgacaggtgcctgtaatcctagctgctcaggaggctgaggcaggagaatcrctggaacccaggaggtggaggttgcagtgagccaagatcatgccattgcactccagcctgggagacactgcgaggctctgtctcaaaatatatatataaa

SEQ ID NO: 21763 - DNA, 201 bp, Homo sapiens
tgttggccaggctggtcttgaattcctgacctcaggtgatccgcctgcctcggcctcccaaattgctgggattacaggcatgagccaccacacctgacccrgaattatttattaaaacgttaaaaaactggttccaagtctattgtgaacagtgctgcaataaacatacacatgcatgcgtctttatagtagagtgatttg

SEQ ID NO: 21764 - DNA, 201 bp, Homo sapiens
tttataaccacatcttccaggtatagacaaaaagataggtggaattgcttctgtaatttgtttgtttccctgcatatgctttttatttatttatttatttwtttttttgagatggagtctcactctgtcacccaggctggaatgtagtggcacgatcttggctcactgcaacctccacctcccaagttcaagtgatactcc

SEQ ID NO: 21765 - DNA, 201 bp, Homo sapiens
tggtttggcatcagaagcctaacttttggcttatctcagcttttgacattccttcctcactaaacttaatcatttctagcttttgatttaaagtgggagayatgtaactcttcatttgaccacttataggccattgtagggttattaattagtctaatttcaatattgtattgcctcagggaatagggagacccatagaga

SEQ ID NO: 21766 - DNA, 201 bp, Homo sapiens
aaaatacttagataaaaagagcagatggttttctgaacatattgttttccccactcagcaggaactgggggtttattctcttcctagattgttggactgcmcaccaacattgacttcttactcaacctgtctggccacccagagtttgaagctgggaacgtgcacactgatttcatccctcaacaccacaaacagttgttg

SEQ ID NO: 21767 - DNA, 201 bp, Homo sapiens
atatgttagtattttgggattaaaaaatagggtgagatgagctaccacatgaaatgagggaaactaactaatagacatattaaatttgtattattttgtcrtctcagactcgatgttttctttaaagagttccattgtaatttatagactgggctatatttatgtttgtcttgaatgaaataatttgtagaatttggggca

SEQ ID NO: 21768 - DNA, 201 bp, Homo sapiens
ctttctgtatggcacactgacctctcttttctcctctcagtgactgacaccattcttttcagatgtgttttttagtatgaaggaaagctcttcacttaccrtggatgcacccataaacactatttaacccattaactggagtgtaactaatcacctaacattgtagaaatggatctctttggccaggcgcggtggctcacg

SEQ ID NO: 21769 - DNA, 201 bp, Homo sapiens
ctctctggtttcccttaagcctttgactattatgactgtagttaagagaatatcttatgcttgtatttcagacccaatttggggaaattaccccctatacrgtttctaactgattgtttactcagttgggctgtgattcctttaagaataaaaacttggcaaaaagtaaaagctcaaatcagacattcacaagcccctaaa

SEQ ID NO: 21770 - DNA, 201 bp, Homo sapiens
gagtgcagtggcgcagtcttagctcactgcagcctctacctcccaggctcaagtgagcctcctgcctcagttcccaagtagctgggactataggcgcgtaycactacactgggctgatttttgtattttttgtagagatgaggtttcgctatattgcccaggctggtcttgaactcctgggctcaagccatctgcctacct

SEQ ID NO: 21771 - DNA, 201 bp, Homo sapiens
tagggtgagatgggatgtcatggtatgaggctcccaggatcttggtgctctgaggcagtaacatgtggtccacccttgttctcactgttacaagctgaaayggattcataatttgggcttaccatttgctcacaaccccaaatatacttttccgttgccaaatttcatgcagctctctatttttgactaagattcatatgc

SEQ ID NO: 21772 - DNA, 201 bp, Homo sapiens
tttttctttttatttatgttttattgtttatattcatggtttgcaacatgatgttatgagtatatatagacagtaaaatggttactataatgaagcagatkaacatatctaggacctctgtgttttcaaatattaacctgtcacactgaatctcaaggtgtttgtcaaagctggagacaaagtgaaagcgggagattccct

SEQ ID NO: 21773 - DNA, 201 bp, Homo sapiens
tttgtagagatgaggtttcgctatattgcccaggctggtcttgaactcctgggctcaagccatctgcctacctcagcctcccaaagtgctgggtttacaakcgtgagccactgggcctggccatgatgactaatatttaacaaattgctgggaaacaattattacctcaggtatattagtaaaaatatagtgataggatgt

SEQ ID NO: 21774 - DNA, 201 bp, Homo sapiens
acttgtttgaaagagactgtagtgtgcagaggcgacatcagaagatcattgaggaggccccagcggtaaggaccttggaaagaaatttgtaagcttctccrtaatgtgaatcttactctgattttcacatcagaaatctgtgaatctggtgtctctcacccctcaaactcctgctggacaactgttgcctaatagcagtgt

SEQ ID NO: 21775 - DNA, 201 bp, Homo sapiens
tgaaaaggtaatcacatgacatctgtagaatgatgttcagtaagttttaatacgtggctttgttaaacttgtcatttatgtccttttccctttctaaaccktgctcattggaaagcatccacttcacaaaaacaagaggatctattacagattcaaattgtttattacagtcctcactgaaaatacccatttacctaattt

SEQ ID NO: 21776 - DNA, 201 bp, Homo sapiens
gattcacttccccctaggcccgggcagccagcaggtgagattgtgtcacaggggcttgctcacaaccacatcacctcaaggtcaaagcctcatggtctacytaaggccacagcattctgggccaggccatcattcggtttcagatcagggcagatactaggcaagatgaaatgagctaaggcagagttgggaatgaagagc

SEQ ID NO: 21777 - DNA, 201 bp, Homo sapiens
aaagggctttaaaaagaaattcctaggagcccacaatcagggaaaaaaaagttttctttttctccatggggttagggtgagatgggatgtcatggtatgakgctcccaggatcttggtgctctgaggcagtaacatgtggtccacccttgttctcactgttacaagctgaaatggattcataatttgggcttaccatttgc

SEQ ID NO: 21778 - DNA, 201 bp, Homo sapiens
ttgtccctcccaggatgtgaatcgtccctttgtccagtgtctccacgctgtctccactccccatctgttagtcactcaggagccatctaggttatcaaatygactgtcatggtaccaccatgcttgtgttcaagtcacccttattttatttaaatcatggccccaaaatgcaagagcaatgatggtggcaattcacttatg

SEQ ID NO: 21779 - DNA, 201 bp, Homo sapiens
ttgctttgagtggtttcagttacctgcagtctactatggtgtgaaaatattaaatggaaaattccagaaatcaacaattgataagtttcaaattgcacgcyattctgagtcacacagtgagatcttgcacagtctgctttgtccctcccaggatgtgaatcgtccctttgtccagtgtctccacgctgtctccactcccca

SEQ ID NO: 21780 - DNA, 201 bp, Homo sapiens
tgagagagatgatttagggtatctggcagaagaaatttctaagcagaaaagcattcaagagacgacttgggtgctattaaagggattcagttttataaggraagcagagcataaaagttcagaaaatgtgcagcctgacaatgtggtagaaaagaaaatcccattttctgaggagaaattcaagctggctgcagaaattta

SEQ ID NO: 21781 - DNA, 201 bp, Homo sapiens
tttgcctagatccatcagaagactcacaatgtatggcagctattgccttacaaaatatatttcttaataagacttgaaagttgaaattactccttgatccrtgggctgcagaaaggatgttgtcttagcaggcatgaaaacattaatctccttgtatgtctccatcagagcccttgggtggtgactatgtgcattgtcatt

SEQ ID NO: 21782 - DNA, 201 bp, Homo sapiens
cccaagtttgaacaacgctatcagatgactcagtctagctcacctgactccagctctgtttcaaattttgagctctaagctttggtggcaataactctggyagtgaaaaaaccctcaggcttgtagatagctttgcttctttgtcttcttttgcttcatcgttatcatccttcatcattctggaaagattgacagtttagt

SEQ ID NO: 21783 - DNA, 201 bp, Homo sapiens
tttgaccagtatatttgggctgtaggcctctgatttgaccagtgcatttggcagatggcacaaccacatgggctctacttctgctctgtaagtttatatamcaaatctatggaccacaaaggacctctgtgttgttttttttctttttatttatgttttattgtttatattcatggtttgcaacatgatgttatgagtata

SEQ ID NO: 21784 - DNA, 201 bp, Homo sapiens
ggttataatttacaaagttctcctctaataaaaagatacttgccgattaggagagcaaaccttcctttaatgttgactttaaagaagaaacttattggccmtctagtaaaggacattgaataacacttgtatagtgatttgaaagaagttttctaaaagtctagaattgttcttaatgtggccattttgacatacttttat

SEQ ID NO: 21785 - DNA, 201 bp, Homo sapiens
ctggtggcggcggagaggaaccggtggcatcgtctcccgagcctgctcctgccgccgaggtgggtggaggggccatggctcagtgggcagaggcgggagcraggggtgcacggacccgcgtgagcggtgggaggtgcggcggaacccagggtcggtgtggggaggacggtaggaaaaccccaggcactttcggaggggttc

SEQ ID NO: 21786 - DNA, 201 bp, Homo sapiens
tttatgccactatgggattagagtttagattgcaaatattcagattcttcaatagaagctagaatttttcacatgaaatttcataagatgtaaacaaaacyatccctttaaacttaacaagaagaacaaaaaaagcacatctgagctgccagtttaggacgtgtgtttttttttttttttttttttttgagacggagtctt

SEQ ID NO: 21787 - DNA, 201 bp, Homo sapiens
ctcccaagtagctgtgatgggactgtaggcacacgtcactatgcccagctaattttttgtttgtttgtttgtttttgaaacaaagtctcactgtgtttccyaggctggtctcaaactcctgggctcaagtgatccttctctcttggcctgcctacgtgttggcgttaccgacgtgagccaccgccctggccacactcgttc

SEQ ID NO: 21788 - DNA, 201 bp, Homo sapiens
agccctgggtctcatcctcaaggagaaagccatgaccgacactttcactcttcaggcacatggtatggaaggcttttctctttcctctgcttgtcaagttytgcaaatcatcattgaacatgcttttctttctgtatggcacactgacctctcttttctcctctcagtgactgacaccattcttttcagatgtgtttttta

SEQ ID NO: 21789 - DNA, 201 bp, Homo sapiens
tatgccactatgggattagagtttagattgcaaatattcagattcttcaatagaagctagaatttttcacatgaaatttcataagatgtaaacaaaactakccctttaaacttaacaagaagaacaaaaaaagcacatctgagctgccagtttaggacgtgtgtttttttttttttttttttttttgagacggagtcttgc

SEQ ID NO: 21790 - DNA, 201 bp, Homo sapiens
ttttgtttgtttgtttgtttttgaaacaaagtctcactgtgtttcccaggctggtctcaaactcctgggctcaagtgatccttctctcttggcctgcctaygtgttggcgttaccgacgtgagccaccgccctggccacactcgttctctcgattgccagttgtcttcagtcttctctggttgggaaagaggttgtagtta

SEQ ID NO: 21791 - DNA, 201 bp, Homo sapiens
gccaaggcgggaggattgcttgagggcaggagtttgagatcagcctaggtgacatagtgagatcctgtccctatttataaaataaaaatttttaaaaaggaaaaaaaaaaaaaagataccagaagtgccaggcacggtatctcccacccgtaaccccagcactttgggaggctgaggcaggtggatcacgaggtcaggaga

SEQ ID NO: 21792 - DNA, 201 bp, Homo sapiens
gtttgtcaaagctggagacaaagtgaaagcgggagattccctcatggttatgatcgccatgaagatggaggtaaggaaatcatgagttcatttgctatgargactttgggagcaatcatacctaatggttcttttgccttattttgtaagttaataccaccttaaatatgaaaagccatgattgacgaagcattaattgta

SEQ ID NO: 21793 - DNA, 201 bp, Homo sapiens
aagttcccacagtaaaaatccaagaaaaaaaaatccctcatgttttacagcagtgggaggggaaaagtaaccaatttgaaagagatccagagcattctatyctccctaacagaagaaatcctaactccaagggagatgttgccagaaccttttttgttcagggggaaggtagttagccaaccacaaccccctttagtcttc

SEQ ID NO: 21794 - DNA, 201 bp, Homo sapiens
acccgggaggcagaggttacagtgagctgagaccatgccgttgcactccagcctgggtgacagagtgagactccgtctcaacagcaacaacaacaaaaaamaaaaaaaaaaaaacaaaagcaagcaaacaaaaaactgttgaaagcttcctaggtgcaattctcatgtgaagctcaagttgagaactgcgagctacaccag

SEQ ID NO: 21795 - DNA, 201 bp, Homo sapiens
acaacttagaaatacttcgcagcacaaacacaggaccactaaaagacttgagatttaatcacaagtttatagaatgctttccctcccccataccctaccaycatgttgcaatggtctaaatatttgtatccctccaaaatttacatgttgaaacctaacccgctatccccaagtattaagaggttggggcctttggcaggt

SEQ ID NO: 21796 - DNA, 201 bp, Homo sapiens
tttaaattttttctagatcaattctctccattttcgtctagcagtggaagaagactgaatatctcgtataccagaaacatgactcttaaagatggtaaaamcagtaagtaatgtttcattaaaagagaaatgtgagtcatagaaatgtatcacattaatctgaaaaagaggattccagcctggccatgatcagtcagttac

SEQ ID NO: 21797 - DNA, 201 bp, Homo sapiens
gtgctctatcctcattttatccttttacattgaatgaaaatgcatctaaatacgtcccatgtggtattcctgagcctgaccttaacgtttttagaatggarcgttgtcttactgtgaccttccttttgaaagtttataattggtacagatatgaggttcagaataaattgcatcagcttagctatgctgaagctcctggat

SEQ ID NO: 21798 - DNA, 201 bp, Homo sapiens
actggcaaggtctagaacagtaaggcatgaaggcatgcaatgtattcggggcacagagtggatggcctgggccactaggcagagaagggcaagcaagggaygcagctgcctagcaataaaaggccttctcttgtcccagaggacttcattctggaggcagtgaggagctgctggagattttcaaccaacttaagtttttca

SEQ ID NO: 21799 - DNA, 201 bp, Homo sapiens
aagctcttcacttaccatggatgcacccataaacactatttaacccattaactggagtgtaactaatcacctaacattgtagaaatggatctctttggccrggcgcggtggctcacgtctgtaatcccagcactttgggaggccagggcggctggatcatgatgtcaggagatcaagaccatcctggctaacacggtgaaa

SEQ ID NO: 21800 - DNA, 201 bp, Homo sapiens
atggaccacaaaggacctctgtgttgttttttttctttttatttatgttttattgtttatattcatggtttgcaacatgatgttatgagtatatatagacmgtaaaatggttactataatgaagcagattaacatatctaggacctctgtgttttcaaatattaacctgtcacactgaatctcaaggtgtttgtcaaagct

SEQ ID NO: 21801 - DNA, 201 bp, Homo sapiens
ttcaccatgttagccaggatggttttgatcccctgacctcgtgatctgcccaccttggcctcctaaagtgctgggattacaggcgtgagccacggcgcccrgcctaaatcttttaatatactgtgaggcatgtataccgttacgcctttacaatgggaaaccaaggctgagagaggtttaataatttgctcaaggtcataa

SEQ ID NO: 21802 - DNA, 201 bp, Homo sapiens
gtttcaccactttagccaggctgatctcaaactcttgacctcaggtgatccgcccacctcagcctcccaaagtgctggaattacaggcttgagccaccgcrcccggccgactttccttttcacagagcagaagttttaagttttaatgaagtccagtatataaattatttgtagatcatgcctttggtgttgtatataaaa

SEQ ID NO: 21803 - DNA, 201 bp, Homo sapiens
tttttatatttgtaagttagccatcactttgcctgcttttgccatttaaaaactccgataccccaaatgatagactgttgccaagctgcatctgttttttrattttttgttttgcccaatactcaaatgagtagacaaaataatagtttttatttggctgcattgcaaaacctaaatgtacattttacctagaaaaaaagc

SEQ ID NO: 21804 - DNA, 201 bp, Homo sapiens
aggacgtgggtcggccgaggcagtgtggccgccggtgcccgcagtggacttcggcaacgcgcaggaggcgtaccgcagccggcgaaccggggagctggcgygcagcccgctggtgctgcacttgtgcgcctggcccgtgctggtggcgtgccatgagcaggcgcgcggggtgcaggcaggggcgcggggcttctgcccgtc

SEQ ID NO: 21805 - DNA, 201 bp, Homo sapiens
acatcatagagtgtccttacacaaactgagatagtatagtcaactacacacctaagctatggtatagcctattgctcctgagctacaaacctgtacaaacrttactgtattgaatactgtaggcatttgtaacacaatggtaagtatttgtgtatctaaacatctcaaaacataggaaaggtaatgtattgtgctattatg

SEQ ID NO: 21806 - DNA, 201 bp, Homo sapiens
tttaaagcattttggcattgctatgacatgcctactgtatttttcaaacatgtaagtttataactgttcttttactatggatagtttgagaagcactggtrtaaaccagaattccacaaaacatacttctcaaatattaataatagcttagtctgtttttgttctcataagaacaatagattttactttagccttcttttt

SEQ ID NO: 21807 - DNA, 201 bp, Homo sapiens
tgaaggtaacagacttgaaacttcaggcccttctttgacattaatctcttccaagaccctgacctaattttgtatttgcagttttgtattcttctccttaragaagacccccaaattgttttttgtttcaggccctataaaacaactgtcctgagcatggcatagtaaatgaaattcaattaaggcaaaaaaaaagggggg

SEQ ID NO: 21808 - DNA, 201 bp, Homo sapiens
tatttccagaattcaaggaaaaggaggataatttttctgaagcagtaaatcaagagagtttcgaccttggaaatcataagagaaaaaaaggtttctaaggrttaaggaaggagaaagcttttgggtattaaggaaaccagcagacatctatttcttgtaagagcttgtcaaggctcttcagaaagagaagccagcttttat

SEQ ID NO: 21809 - DNA, 201 bp, Homo sapiens
ttgtattttattccttcgtgttttgacttgaagaggttaccgtggttttcaatttcaggagacgaagtttccgtgcattatgaccccatgattgcgaagcyggtcgtgtgggcagcagatcgccaggcggcattgacaaaactgaggtacagccttcgtcagtacaatgtgagtgatctgagaccgtgccagtgaccttga

SEQ ID NO: 21810 - DNA, 201 bp, Homo sapiens
gtaataattatagtaacaacaaacaatagtgatcaccctgtttgtaatctggtatcatgcagtacatatcaacataacaaaattgaaaaaccatcattttyccctttctgttttgctttatcacccacttactggtgaagattacagcgtaggatgacaatgtcagctacactttttgcttggctgtgaatctagtcctaa

SEQ ID NO: 21811 - DNA, 201 bp, Homo sapiens
agatcattgaggaggccccagcggtaaggaccttggaaagaaatttgtaagcttctccgtaatgtgaatcttactctgattttcacatcagaaatctgtgratctggtgtctctcacccctcaaactcctgctggacaactgttgcctaatagcagtgtagtgaaaagacctcctgtggtattggggatgaggaggagatt

SEQ ID NO: 21812 - DNA, 201 bp, Homo sapiens
ttttgaatgttaaatttaatagcagcaaatttttcatgaaataatgacattttcttttagtgtacgtagttgcatctgcgttaatgtaaaaggctggtatyggtgaagaacagtacggtttggtgttgaatgcagtatataattcacagttgcagtccatactgtctgagtcagttcaggctgctagaacagaataccata

SEQ ID NO: 21813 - DNA, 201 bp, Homo sapiens
tagcctgggtgacagagcgagactctatctcaaaacaaatacataaatataaataagtaaagacacggatattgtttctagtgtttgtgattggaaagttwctaactagattgcctctgcctttattgtactttctaagcttataaaaatatatgtattatatatctattacatgctaaaatatattaatatttaatataa

SEQ ID NO: 21814 - DNA, 201 bp, Homo sapiens
gccccatttaaagtatgaccttttgttattctttatcctcttagccagccttcattttcttcatagcatgtaacattatattcaatacctgtttacagatattgttacttgttgccctagaatgtaagcagagactgtgaaggcagggacatcatatgttttgttcctcactatgtccccagtgcctggatcagagcctgg

SEQ ID NO: 21815 - DNA, 201 bp, Homo sapiens
cacaggtgagggttgtgaagagatttgcagtgcaaaaggaatacgttttgtgcaactgatgcaaagttacttatagaaattttctatttttagcctttccyaagatctttacatttgattattggattatcattgtaaactaggcatgtcccatctcatttctcagccagtctgcctttttactggatcctgtgtacttta

SEQ ID NO: 21816 - DNA, 201 bp, Homo sapiens
gctcaccatttggtgagtcaagagtctaagctcgaggacctgcctgtgcagtcaagccttcctagaacaagggttgaatgatgactgatgtaagtgtcctrggttcaggctgcagatacagatagttaacagtgttcagggaaagctggtgaaaatgtcaaggttaggggttccggagagccagtgtcagcctgagagaac

SEQ ID NO: 21817 - DNA, 201 bp, Homo sapiens
gtgatttgttgtattggtacataataactaaaatagtaataattatagtaacaacaaacaatagtgatcaccctgtttgtaatctggtatcatgcagtacmtatcaacataacaaaattgaaaaaccatcattttcccctttctgttttgctttatcacccacttactggtgaagattacagcgtaggatgacaatgtcag

SEQ ID NO: 21818 - DNA, 201 bp, Homo sapiens
ctgagacaagagaatcgcttgaacccgggaggcggaggttgcagtgaaccgagatcgcgccactgcactccagcctggacaacagggcgagagttcatctaaaaaaaaaaaaaaaaaaaaaggaaatggatctcttttcagtcaaacacttgttctccccacatcctacactaatttcttatcacttcttttgttcgccac

SEQ ID NO: 21819 - DNA, 201 bp, Homo sapiens
gctagtaagaagttttggttttgattatattgaacaaacactgatttttatatttgtaagttagccatcactttgcctgcttttgccatttaaaaactccrataccccaaatgatagactgttgccaagctgcatctgttttttaattttttgttttgcccaatactcaaatgagtagacaaaataatagtttttatttgg

SEQ ID NO: 21820 - DNA, 201 bp, Homo sapiens
atgatgctcaaaggaaatgctcattggaacagttcagattccagatacttggatcagggatgctaagccagttaaatataatgcaaataatccaaaatccaaaaaaaaaaaaaaaaatctgaaattcaaaacacttctggtcccaagcattttgggtaagtgatactgaacccgtattattataggatcctatcattagaa

SEQ ID NO: 21821 - DNA, 201 bp, Homo sapiens
ctaaactcaatgataatagctaagatttattgagtttttggtttatgtcagatactgtattaaacactttccaaagattgtttcatttgcattttcagaamaggccaatgagattagtgttattgttagtgtgaactttataaattactaatctctgtgagccaaggtcaaggctcagagagattagtaattttccaaaag

SEQ ID NO: 21822 - DNA, 201 bp, Homo sapiens
ggaattgttatttttaaagaataacaagtatttttcaacaacggactccttttttttgaaattcagcagtacttggtcaaacctaaccaggaaatattttrtgtgtactgttcttgaccttgcctcattccaaaaatgatttaagatgactgatatctgctatgcacaaggcagactgccttcaaaggacataaagtcaag

SEQ ID NO: 21823 - DNA, 201 bp, Homo sapiens
aggaagaccccagaggacctcctcagattcagccaggcctgaggcagtggggcctgaggcagggtagagcagtaggaatggaaggaagagatgcataggayagggaagaatttggcagctttgtagtaactgtccctatttataaaataaaaatttttaaaaaggaaaaaaaaataagatgccagaagcatttatgagtct

SEQ ID NO: 21824 - DNA, 201 bp, Homo sapiens
tcgctactgaagccgggctctggtctttgattggtgttcgtggagacgccctcacattcttggatcagcccaaaggtaggctcaggctccgacggtggccsgcgggggtcacgaggcttcgtagtggaggaacgggtttggcgtgtgggacgcagctgcctctgtactggggagtcacggagtggccgggctccagggaca

SEQ ID NO: 21825 - DNA, 201 bp, Homo sapiens
ccaccacgaccggctaattttttgtatttttagtagagacaggttttcaccgtgttagccaggatggtctcaatctgctgacctcgtgatccgcccacctyggcctcccaaagtgccaaacaggcgtgagccaccgtgcctagccaatccaggctctattcttagcacctgctacttactggctgagtgatcttagccaag

SEQ ID NO: 21826 - DNA, 201 bp, Homo sapiens
tatgacaattgttaaattttatatatatatgtgtgtgacctgtaagtcaagtgaaaagaataatttatttgggaaccatgactggaaagagatttaccttsaaggtaacagacttgaaacttcaggcccttctttgacattaatctcttccaagaccctgacctaattttgtatttgcagttttgtattcttctccttaga

SEQ ID NO: 21827 - DNA, 201 bp, Homo sapiens
gtggcggtttatagtgaggctgacagaaattccatgcatgtagatatggtatgtgttaaaaattggaagccacgtcttacgtttattcgtttactgtgtcmgtattttcgttctttatgatgacagttgatatttgctagtgttatcagggttgaagtaggtaagttcaaactgctcactgctaattcttgggaacatttt

SEQ ID NO: 21828 - DNA, 201 bp, Homo sapiens
tccctatttttttttctggaattttattttcatgtttgttgtttaagatgctgattataaagtttctcatttcatagatttttatgacaattgttaaattwtatatatatatgtgtgtgacctgtaagtcaagtgaaaagaataatttatttgggaaccatgactggaaagagatttaccttgaaggtaacagacttgaaa

SEQ ID NO: 21829 - DNA, 201 bp, Homo sapiens
acttctgttccttcctttcttctccttctggtattctcgttctgcgtagttaataccttttgtagttgtcttgcagtgctaggtattgttctgtttaaggttttttttctcactgtttttcagaattggaagtttctgttgtcatatcctcaagttcagaggttctttccctgccatacccaacgtactaatgagcccatc

SEQ ID NO: 21830 - DNA, 201 bp, Homo sapiens
gccctcacattcttggatcagcccaaaggtaggctcaggctccgacggtggcccgcgggggtcacgaggcttcgtagtggaggaacgggtttggcgtgtgrgacgcagctgcctctgtactggggagtcacggagtggccgggctccagggacatggcggcggcctctgcggtgtcggtgctgctggtggcggcggagagg

SEQ ID NO: 21831 - DNA, 201 bp, Homo sapiens
aaaaaatcttaacagcacagatagtttacattatttttatgttatgaatctttagtagctcacagaaaataatctctggtggcagaattatagacatgacmataagctggtatagagctaccttgaatcagggaagcagcttctttttttttttttgagacggagtctcgctctgtcgcccaggccggactgcggactgca

SEQ ID NO: 21832 - DNA, 201 bp, Homo sapiens
tctggtttttcttttcttaggcctccagggctcttcaggatagtaccatagacccatttcctgtcttccctttcaaagcttagctattgtctaaagaactrtcctcaagtatgtcactctggagagtgttagagttgttaatggcttatagaagtaaaactctttgccaggagacttggttcatgcctgtattttcagcag

SEQ ID NO: 21833 - DNA, 201 bp, Homo sapiens
ccagctaatttttatatttttttagtagagatgggtttcaccgtcttggccaggatggtcttgatctcttgaccttttgagctgcccgctgtggccaaggktactgattttattgatcttttcaaggaactggtttgggttttggtgatttttttctattgattttccattttcaatttcattaatttttgctttaatttt

SEQ ID NO: 21834 - DNA, 201 bp, Homo sapiens
ttggccaggatggtcttgatctcttgaccttttgagctgcccgctgtggccaaggttactgattttattgatcttttcaaggaactggtttgggttttggkgatttttttctattgattttccattttcaatttcattaatttttgctttaatttttattatttcttctgcttactttggatttaatttgctgttctcttc

SEQ ID NO: 21835 - DNA, 201 bp, Homo sapiens
ctgcataacaccattttattcaatataacaatggttccataagattaaaatgcagctgaaaaattcctatccagtgacattgtggcaactgtaacatcatrgtacaatgcattactttctttaggtttagatatatgtagatacacaaatacttaccactgtgttacagttgcctacagtatgcagtaacatgttattatt

SEQ ID NO: 21836 - DNA, 201 bp, Homo sapiens
ggggtttcaccatgttggccaggctggtctcgaactcctgacctcaggtaatccccccacctcagcctctcaaattgctaggattacaggcgtgagccacygcacccagcccacttatcctctttagctgaaacttaatagacgttatacttttttgttcctaaagtgaatctggcctgttttctgtcagctcttggttac

SEQ ID NO: 21837 - DNA, 201 bp, Homo sapiens
gtgtttttacattgttttggtcataattataatactcgctcacattttagaagaacaaatcccctcagggctactgatgttggagagggtgtggcttcatyactcattaaatcatccaagtcttctctgccttttgcctccttctgtttcttccctttttgctgtcagcgtgtttacttttagaaatcttgctgtccttca

SEQ ID NO: 21838 - DNA, 201 bp, Homo sapiens
gaactctgtacaacaaacccctgtgacatgtattcacctgtgtaatcttcacatgcaccccaaacctaaaataaaagttaataaaataaaattgaactttkgtttaaaagatataaaactctaaactggctgcaacatatgagtatccagcattttatctgtatctggcattgcattgtttcctgtcactaggatgtgggt

SEQ ID NO: 21839 - DNA, 201 bp, Homo sapiens
gcctgctcctgccgccgaggtgggtggaggggccatggctcagtgggcagaggcgggagcgaggggtgcacggacccgcgtgagcggtgggaggtgcggcrgaacccagggtcggtgtggggaggacggtaggaaaaccccaggcactttcggaggggttctgccggcagtcacggcgtcgggaggaagacatccccacca

SEQ ID NO: 21840 - DNA, 201 bp, Homo sapiens
ccaaagctctttcatatcacacacacaacacatataaatacacagacaaacagaagaaaaggactcattccctaagccaggaactgaatcctgaacccggkataccattgtgaaaagacaaagctaggccacatggttacaaggtcaagctcccaaggacatacaagacaagaggggaaacctcatccagttttttttttt

SEQ ID NO: 21841 - DNA, 201 bp, Homo sapiens
cactcatacatatgtcatccatcagcccctgtgacaactcttgggctccatagagccccatcgaaaaacacttttaaattaggtgcaacctttttttttttaaaaggagaaataactttattatgttgagcctatggattctattgaagaaataactttattatgaactgtcaaagaacatttatttcacgtgtgatatta

SEQ ID NO: 21842 - DNA, 201 bp, Homo sapiens
agcacttgcattttatgttttcttttgtaaggtgtaaatttcataggcttgatactcataagtttgttactgaattttaaattttttctagatcaattctytccattttcgtctagcagtggaagaagactgaatatctcgtataccagaaacatgactcttaaagatggtaaaaacagtaagtaatgtttcattaaaaga

SEQ ID NO: 21843 - DNA, 201 bp, Homo sapiens
gagctttcagaaaatgatacatagctaagtctccaaaaaatgctaataagcaatgaccacaattaaatagaatgcatgaaacaggaagcttaagagaccargctggtcacagtggctcacacctgtaatctcagcactttgggaggccaaggcgggaggattgcttgagggcaggagtttgagatcagcctaggtgacata

SEQ ID NO: 21844 - DNA, 201 bp, Homo sapiens
ctcgttacacctggtgagttttcaaagccttctgaacctcagggtcctcatgaataaatttgtgttgttatttatcatgcaggggtttatgaggattaagygtgaaatgtacataacaaaatgtcttgctcgttgtattttattccttcgtgttttgacttgaagaggttaccgtggttttcaatttcaggagacgaagtt

SEQ ID NO: 21845 - DNA, 201 bp, Homo sapiens
ttcctgagaattgtcctgttgccacatggtaccttagtaggttttttatttttcctaagagttgttcacagtagaaaatacttagataaaaagagcagatrgttttctgaacatattgttttccccactcagcaggaactgggggtttattctcttcctagattgttggactgcccaccaacattgacttcttactcaacc

SEQ ID NO: 21846 - DNA, 201 bp, Homo sapiens
gttgttggaagttggcggggcgcggtagctcacgcctgtaatcgcagcactttgggacgccgaggcgggcagatcacgaggtcaggagatcgagaccaacytggataacacggtgaaaccccgtctgtactaaaaaatacaaaaaatttagccgggcgtggtgacacgcgcctatagtcccgcctgttagtcccagctact

SEQ ID NO: 21847 - DNA, 201 bp, Homo sapiens; identical to SEQ ID NO: 3606

SEQ ID NO: 21848 - DNA, 201 bp, Homo sapiens
tcgttacacctggtgagttttcaaagccttctgaacctcagggtcctcatgaataaatttgtgttgttatttatcatgcaggggtttatgaggattaagcrtgaaatgtacataacaaaatgtcttgctcgttgtattttattccttcgtgttttgacttgaagaggttaccgtggttttcaatttcaggagacgaagttt

SEQ ID NO: 21849 - DNA, 201 bp, Homo sapiens
gagacatcaatagcttatttgagttattatgtaactccatgcctgcagcattttttgaatatgtaagttctttacttatgaaatgttagccatacattgcrtcacattataatttattcccccaatagctggaaagcccctgggaatcaaagacctggtagtatatacatttttattttttgtatatattgcctggcatac

SEQ ID NO: 21850 - DNA, 201 bp, Homo sapiens
ttttatgttttcttttgtaaggtgtaaatttcataggcttgatactcataagtttgttactgaattttaaattttttctagatcaattctctccattttcrtctagcagtggaagaagactgaatatctcgtataccagaaacatgactcttaaagatggtaaaaacagtaagtaatgtttcattaaaagagaaatgtgag

SEQ ID NO: 21851 - DNA, 201 bp, Homo sapiens; identical to SEQ ID NO: 3600

SEQ ID NO: 21852 - DNA, 201 bp, Homo sapiens
cttaccgatttcataaacagccattttttctctgtgtcctcacgtggtggaagggacaagggacctctcttcaggcctctttcataagggcactaatctcwttcatgaggccagatccctcatgacctaatcacctgctaaaggccccacctccaaataccatcatcctggaggtcaggattttaacaaatgaattctgga

SEQ ID NO: 21853 - DNA, 201 bp, Homo sapiens
ggggcaagccttcactctaaaatctggacaagcatgcaagtatagtgagtcacagccagatcagtttacctgctggagccctaacacttgcatgggaattytgaaaaatggctgaggctaagtgtgggccagtgtgcaagtgagaaactccttggggccctgtcttagagggacctcccactttcatgggttttgcctcca

SEQ ID NO: 21854 - DNA, 201 bp, Homo sapiens
taacgagtttaatgtagatgttggctcctccataattcctttgtgctttcctaagggaagaactcatatctgacacctttttatttttttaagcatacctyctagcaacccagtgagcttgtacatagtcctcaatttgtttttatttttgttttttgagacaggggttcacttatcatccaggctggagtgcagcagtga

SEQ ID NO: 21855 - DNA, 201 bp, Homo sapiens
cacacagacttgtctgtgaatgtttataacaccgttattcataataaccacaaactggaaaataattcaaatgaatgggtaaacaaaatgtggtatatccrtataacagaatccatattataaaaagaaatgagctactgacacactccacaacatgaataaaccttgaaaaattatgtgaagttaaagaagccagacaca

SEQ ID NO: 21856 - DNA, 201 bp, Homo sapiens
gaatggcgtgaacctgggaagcagaggttgcaatgagatgagatcatgccactgcactctagcctgggtgacagagcaagactgtctcaaaaaaaaaaaaagtgggcaaaggacatgaacaggcacttctcaaaagaagacatacatgtgaccaacaaacatgaaaaaaagctcaatatcactgatcattagagaaacgca

SEQ ID NO: 21857 - DNA, 201 bp, Homo sapiens
atgcagtatagccatacaatggagtattattttgccatcaaaaaggaatgaagtactgatttgtgttaaacaaaaaatggatgaaccttgaaaatattacrttcagtgacagagccagtcacaaaagactgcatgtattatatgattccatttatatgaaatgttcatataggtaaatctatagagacagtagattcacag

SEQ ID NO: 21858 - DNA, 201 bp, Homo sapiens
tttttaatctagacaaaaaaaaatccacattcctgtgccttcttataatcttttaccaaaaacgcatttcaaaaacaaaacaaaacaaaacaaaaaaaacrcatttcactttccttacacaccttacatgtagaattgtttcaatttctcaaagattacttaaatcacataaattaaaggcattatactttttacttttcc

SEQ ID NO: 21859 - DNA, 201 bp, Homo sapiens
cttttaagttgcagcttagataattgtgaaaaatggaatagatgatcagaacattgttgggatagtggattacagttaagtgggatctctgtctctttctscctctttttccctctctcccttcttctgtcttcactagaagattgcaaaagaaagctttaggtcaacagtagccttgaaaccgaatcagtcttaagctag

SEQ ID NO: 21860 - DNA, 201 bp, Homo sapiens
ttgataaaatagatatgccaagtgatgtggagaagagaaggaaatgtctttgtccctgctttttttctgttaaggaatttgccatttggaagtgtgtatgwtgagaagctggagagcatgatggtcaagagtgcgggccctggagttcctgtactttagtatttgacttttgtgaacatttttattttgataatttttctg

SEQ ID NO: 21861 - DNA, 201 bp, Homo sapiens
taggacggggaaagccagcttgtgtgccattgaatcaccacgttagggcctggtgctgttgggtggcccacctcgttacacctggtgagttttcaaagccytctgaacctcagggtcctcatgaataaatttgtgttgttatttatcatgcaggggtttatgaggattaagcgtgaaatgtacataacaaaatgtcttgct

SEQ ID NO: 21862 - DNA, 201 bp, Homo sapiens
tcagctcactacaacctttatctccctgacttaagcagttctcaggcctcagcctcccgagtagctgggattacaggtgtataccaccatgcctagctaatttttttttttttttttgtatttttagtagagacaggttttcaccatgttggctaggctggtctcaaactcctggcctcaagtgatctgcccaccttggcc

SEQ ID NO: 21863 - DNA, 201 bp, Homo sapiens
tttcataagaaacactattctattgccagattgcagcaggagagaagattcctttgagccaggaagaaataactctgcagggccatgccttcgaagctagmatatatgcagaagatcctagcaataacttcatgcctgtggcaggcccattagtgcacctctctactcctcgagcagacccttccaccaggattgaaactg

SEQ ID NO: 21864 - DNA, 201 bp, Homo sapiens
caagcgattctcctgcctcagcctcccaagtaactgggattacaggcatgcaccaccatgcccgggtaattgtgtgttttcagtaaagacagggtttcacygtgttggtcaggctggcctcgaactcccgaccccaggtgatccgcccaccttggcctcccaaagtgctgggattataggcgtgagccaccacgcctggcc

SEQ ID NO: 21865 - DNA, 201 bp, Homo sapiens
aaacagttaacactccgttccttcttcccccatcccctgagaaccacgattctactctctgtctctatgaatttgactactctaggtacctgatataagcrgaataatgtagtatttgtccttctgtaattggcttatttcacttggcacagtgtcttcaaggttcttccatggtgtagcatatgtgagaatttccttttt

SEQ ID NO: 21866 - DNA, 201 bp, Homo sapiens
ttctaactgattgtttactcagttgggctgtgattcctttaagaataaaaacttggcaaaaagtaaaagctcaaatcagacattcacaagcccctaaagtktgtgcctgtatttacagcaaaagcagcagttttcacattttttgtctcaggaactgtacactctttaaaatacccaccagagcactttggtttgtgttaa

SEQ ID NO: 21867 - DNA, 201 bp, Homo sapiens
actcagacaaattattatacgcttccacttacatgaggtactttggctagagaaattcataaacagaaagtaaaatgctggttactagggactaaggaacrggagggaatggagaattatgtttggagattaaaacatcctgaggatggatggtgatgacagttgcccaacattgtgagtgtacttaatgccactgaatta

SEQ ID NO: 21868 - DNA, 201 bp, Homo sapiens
aactcagacaaattattatacgcttccacttacatgaggtactttggctagagaaattcataaacagaaagtaaaatgctggttactagggactaaggaamaggagggaatggagaattatgtttggagattaaaacatcctgaggatggatggtgatgacagttgcccaacattgtgagtgtacttaatgccactgaatt

SEQ ID NO: 21869 - DNA, 201 bp, Homo sapiens
attatgctaggtgaaataagccaaactcagacaaattattatacgcttccacttacatgaggtactttggctagagaaattcataaacagaaagtaaaatsctggttactagggactaaggaacaggagggaatggagaattatgtttggagattaaaacatcctgaggatggatggtgatgacagttgcccaacattgtg

SEQ ID NO: 21870 - DNA, 201 bp, Homo sapiens
gtatatttgggctgtaggcctctgatttgaccagtgcatttggcagatggcacaaccacatgggctctacttctgctctgtaagtttatataccaaatctrtggaccacaaaggacctctgtgttgttttttttctttttatttatgttttattgtttatattcatggtttgcaacatgatgttatgagtatatatagaca

SEQ ID NO: 21871 - DNA, 201 bp, Homo sapiens
gccaaattcctgccctctgtagtttcccattcacttctctcgttcacacagatgctcattgatagacacatacccattttcttcctgaattctgaaacaartccttccattttctttgtcagagcatatctccctgctcagtgggtggtggtatctcagggctttgatgtctgaacacttttccccacccaccatccccct

SEQ ID NO: 21872 - DNA, 201 bp, Homo sapiens
gcattttttgtctcttctatgtttgacagtttttattttaaaaaatcaacaggaaaacatatttgctgatcacttctgtattatggcgtattatggtggtraataggtgaagtgaactacagtgtgaccatatcacaaacctaccgagaagaatttcatgttcaccaaatagtccatattagccttatttccacaaaagtt

SEQ ID NO: 21873 - DNA, 201 bp, Homo sapiens; identical to SEQ ID NO: 3610

SEQ ID NO: 21874 - DNA, 201 bp, Homo sapiens; identical to SEQ ID NO: 3614

SEQ ID NO: 21875 - DNA, 201 bp, Homo sapiens
agccatgtcccaggacttggggtcagagggaggacagggtgggcttcaggtgaggtccatcagctgcaggagcagagcccaggctgcaggtgggatgggcrggtggggctgcctctggccctggctcctctcttctgtcgcagttcgtcctcagatttctagagctgcttgcaggaaagaaaatcaaaaccaaaagccgcc

SEQ ID NO: 21876 - DNA, 201 bp, Homo sapiens
cacatcagtcaccagctcatctcccatgcctccgacaacagagcgagggagggtcgggggcgccgcgaatggctcctgagacccactgaggacgtgcatcrcatgtgagtggaggcctggccttagatattgataagagtaataatacccagagcgctccgggtgcctgagctcctttcgtcggtacaactgctctctgag

SEQ ID NO: 21877 - DNA, 201 bp, Homo sapiens
acggggtttcaccgtattagccaggatggtctcgatctcctgacctcgtgatctgcctgcctcggcctcccaaagtgctgggattacaggcgtgagccacygcgcccagcctctggatcttttttgttgtgagcagatgcttggcttcttgttagcgccttcacctgtgcctgagttggtctcttctctgcccagataagg

SEQ ID NO: 21878 - DNA, 201 bp, Homo sapiens
ctctgtgggctgttctctctatccaggaagtgggtcccatccttcacctctttcatttctcactcgggagctacttcctctccagtgagccagggtagccmcagtgctctgagggttcctgccccagttgtgggggcggggggcttttttcagtcttccagtggaacaggggccatgtctgtccttgatcacagctcagaa

SEQ ID NO: 21879 - DNA, 201 bp, Homo sapiens
gttgtgcgggctcattagaatgcatagctcttcccagcatccgcccagcactgtgccccccacggtgttcaggccctggacacacagactagaaagcaggycagcctccggaaatctccaagctccctgtgactgtgggctggggactgcccttccccttcatcgggccctcaggctgaagctcagaaccctcctgtaagg

SEQ ID NO: 21880 - DNA, 201 bp, Homo sapiens
tgggaccaggctgagggtcctgccctcttgctcccaggggctccgtagctgtgtggccttggggatgcccctcagtctctgtcagcctcattttcctcatytgctatgggaatcaaatgagatgcaaactaaaatgttcagtatggggcccggtgcagacagtgctcggaggtgtcagctattgtcatttcaaattttgtg

SEQ ID NO: 21881 - DNA, 201 bp, Homo sapiens
gctccttcccacagagacctactcccagggccccctccccagtgctccccactcttcctgcctgcagatcctcaccaggggctccctaggaggtcagtgcrggagggtgggtgccaccgactctgggctcaggacagagtctccattgtctgaggctccagccattgaccaaacttggcccctgccccagtgaggcaggcc

SEQ ID NO: 21882 - DNA, 201 bp, Homo sapiens
ggtgtaccacctgcctcactcacctccctctgccccttctctctgctgcagccatgccagcccctctgggctcctggatgggccatgctccctcccaccaygccctctccagcctgtgccttttgccaagtactctcctgccatcctgtttttgtctcatctgctcttggctcaaatggcacttcctcagagaagcctttt

SEQ ID NO: 21883 - DNA, 201 bp, Homo sapiens
aggctgatgggtggcttggccaggaagctcttgctggttttgcagccccaccctggaccttaatgcagagccatggcctcacctgggtgtgcgcaggtgcrtctcccaatccacacactttgctccaccttcacattggctgccacacactctgtcctgctgtgccagctacctggctgctcttcctccctcctcctacct

SEQ ID NO: 21884 - DNA, 201 bp, Homo sapiens
cggaaccttgtctccaccagcgacggcaggtgtgcagcccagaccgtgtcaccctctacgggctgatggtcaagcccatccagaggttcccacagttcatmctcctgcttcaggtactgctcaggattccagcagcttcaacccacagggtttgcctgtgggctgggaggtgcctcctggggtaggagggaggaggtctgg

SEQ ID NO: 21885 - DNA, 201 bp, Homo sapiens
cacttgagtgcagtaatggggcctgggcttggatttgggagtaaccacctggccagccaaacaacgatcttttttttgagacggagtttcactcttgttgyccaggctggagtacaatggcgcaatctcggctcaccacaacctctgccttctgggttcaatagattttcctgcttcagcctcctgaatagctgggattac

SEQ ID NO: 21886 - DNA, 201 bp, Homo sapiens
cctagcactttgagaaaccttgcttgagctccggagtttgagaccagtctggacaacagagtggaaccctgtctctacaaaaaatgaaaaaaaaaaaaaaatagctgggcatggtgatgctacctgggagtctgaagtaggaggatcacttgagcccaggaggttgaggctgcagtgagccatgatcgcaccactgccctc

SEQ ID NO: 21887 - DNA, 201 bp, Homo sapiens
tcctagcactttgagaaaccttgcttgagctccggagtttgagaccagtctggacaacagagtggaaccctgtctctacaaaaaatgaaaaaaaaaaaaaaatagctgggcatggtgatgctacctgggagtctgaagtaggaggatcacttgagcccaggaggttgaggctgcagtgagccatgatcgcaccactgccct

SEQ ID NO: 21888 - DNA, 201 bp, Homo sapiens
ctcacgcctgtaatcccagcactttgggaggccaaggcgggaggatcacttgaggttgggagtttgagaccagcctgggcaacaaggtgaaaccccatctytactgaaaatacaaaaattagccaggtgtggtggcgggcgcctgtaatcccagctactcaggggctgaggcaggagaattgctcgaacccaggagggtgg

SEQ ID NO: 21889 - DNA, 201 bp, Homo sapiens
atgtggagtgctgtggtccccatcctctgggcttgttcagccccgatttgatgaagggggctgagtagagagtgtagccagcccccagtcccctggaaggrgcagaggagcctgaagggcccgcagcgtctcttctcccctgccttttccgccagccaggctgtgattgccgcgtcatcacagcctgttacagggttataa

SEQ ID NO: 21890 - DNA, 201 bp, Homo sapiens
aagaaattcacctttttccaataatttattcaaaaataatttaccaagtgcctatgatgtggaagcacttgactcagtgctgtggggtgatggatgggtayaaagatatggtgaagttttacgctccaataacccatggtccagcaaacaagactacgaacatttgcagggtcaagggcagggagggactgatttaccttt

SEQ ID NO: 21891 - DNA, 201 bp, Homo sapiens
attttatttaatgttactatatatatgtatttttttactgtaaggggtctccatagaaaagaaatgaaaatccaaagaggcagttagacccaggagcttaygtaacattttaacaaagggcgataaattgtggagaagtgaggagacaaaagaaaagtattggactcttaggggtcagtaaatttcaggaaagtgactagg

SEQ ID NO: 21892 - DNA, 201 bp, Homo sapiens
agatcacaggtgaggctttgggagctggtgttggcaggaccagggggtcagctgcaggtggccagtggggcttggcggggagggtgtattatgccctcatyggtatagggatggggttccagtctccagcttcctctcatctcaggtggcatggtggccagtagaactgaatcgtcctggccccagtctcccacctttctg

SEQ ID NO: 21893 - DNA, 201 bp, Homo sapiens
gcatccccaagatcacaggtgaggctttgggagctggtgttggcaggaccagggggtcagctgcaggtggccagtggggcttggcggggagggtgtattaygccctcattggtatagggatggggttccagtctccagcttcctctcatctcaggtggcatggtggccagtagaactgaatcgtcctggccccagtctccc

SEQ ID NO: 21894 - DNA, 201 bp, Homo sapiens
agcacctcccttccacagggctacctctgggtgagtcacccccctgcccagctgggcattctggcctcaggacaggagtagggagagcggcacctgggagrgggtgctggagacagcagctgcctgcctcatctcatgcagcttcatccaccaaggtcttcctgggcacctctggtgccaggcactgcatttggagttggg

SEQ ID NO: 21895 - DNA, 201 bp, Homo sapiens
gggctttcccagagctgcacgggttatttaagcagtttcctgggcatctgcttcctccccaatgagtgatgggaaaactccatggggctggtgcaggattygattaacaggtcacatgaggccagtgagggaggcagtccctgctgggaagggcagatgccaggcagagggcgaggggagggggagatggggagcacttcc

SEQ ID NO: 21896 - DNA, 201 bp, Homo sapiens
gggcaccttgatgattaacctcacatgtaccgtctctgtctctgcagcttggggccctggtccacagtcctgtcaactgtcccctgctgggtttctcagcmgtcagcacctcccttccacagggctacctctgggtgagtcacccccctgcccagctgggcattctggcctcaggacaggagtagggagagcggcacctgg

SEQ ID NO: 21897 - DNA, 201 bp, Homo sapiens
gtgatctctggttggaagatggacatgtgcacatgttacatacagtggagggatgtgcggagtgtagcaggggaatggggtagggagaggggaacaattcwtgcctctgaacctttgcacatgctgctccttctacccaggggagttaatgtgtgttttctccacccagaaggaatggcatgtgcaaaggctcagaggcat

SEQ ID NO: 21898 - DNA, 201 bp, Homo sapiens
atcacaggagctctccattccagcaagtgagttgttaccatgcaccaggaagagaggaaatgggacaaggaggaaattcagttaattgagagctgactttrccattgagtaaccctattcaggatgactcaggcatctgggaggaaaagcagcagtggtgtctgaggacagaccgtggacaaattaagtagcttggggctt

SEQ ID NO: 21899 - DNA, 201 bp, Homo sapiens
tcacagttccacatggctggggaggtctcacaatcatggtagaaggcgaaggaggagcaaaggcacattttacatggtggcaggcgagagagcctgtgtargggaactgtcctttataaaaccttcaggtcttgggagacttattcactatcatgagaacagcatggggaaaacctgcccctgtgattcaattacctccca

SEQ ID NO: 21900 - DNA, 201 bp, Homo sapiens
agagatttaatggactcacagttccacatggctggggaggtctcacaatcatggtagaaggcgaaggaggagcaaaggcacattttacatggtggcaggcragagagcctgtgtaagggaactgtcctttataaaaccttcaggtcttgggagacttattcactatcatgagaacagcatggggaaaacctgcccctgtga

SEQ ID NO: 21901 - DNA, 201 bp, Homo sapiens
gtaatttgtaaagaaaaagagatttaatggactcacagttccacatggctggggaggtctcacaatcatggtagaaggcgaaggaggagcaaaggcacatyttacatggtggcaggcgagagagcctgtgtaagggaactgtcctttataaaaccttcaggtcttgggagacttattcactatcatgagaacagcatgggg

SEQ ID NO: 21902 - DNA, 201 bp, Homo sapiens
actgacattcattacaaacctaccagtgttgtccaatgtcatcttatttacacctgcacctgacaggtaagcacaggaggcgcagagggctgcctgcttcrgagtggggctgctggagagcagaggatgagtgttgtctgggctggcttcataccaaggccgggttcctgtccacacacctcatccttctcttctgcctgc

SEQ ID NO: 21903 - DNA, 201 bp, Homo sapiens
tactgctattttcatactgctatgaagaaatacctgagactaggtaatttgtaaagaaaaagagatttaatggactcacagttccacatggctggggaggyctcacaatcatggtagaaggcgaaggaggagcaaaggcacattttacatggtggcaggcgagagagcctgtgtaagggaactgtcctttataaaaccttc

SEQ ID NO: 21904 - DNA, 201 bp, Homo sapiens
tgtggccttggggatgcccctcagtctctgtcagcctcattttcctcatctgctatgggaatcaaatgagatgcaaactaaaatgttcagtatggggcccrgtgcagacagtgctcggaggtgtcagctattgtcatttcaaattttgtgatctcaggcctggtgttccggtggaatacgtttgtcttggacttagtttag

SEQ ID NO: 21905 - DNA, 201 bp, Homo sapiens
tatattttataaagtaataaatactcaatttttttcctaattattttattctattattacctgtgcttttgtggttatttgctgctttgtgtgtgtgtgcrttggggagtgtattagttctttttcatactgctattttcatactgctatgaagaaatacctgagactaggtaatttgtaaagaaaaagagatttaatgga

SEQ ID NO: 21906 - DNA, 201 bp, Homo sapiens
catggtggctcatgcttgtaatcccagcactttaggagcctcaggtgggaggatcacttgagcgcaggtgttcgggaccagcctgggcaacacaagagaayatgtctctacaaaaaattttaaaaattagttggatgtgctggtgcacgcctgtagtcccagctactcaggaggctgagatgggaggatcacttgagcctg

SEQ ID NO: 21907 - DNA, 201 bp, Homo sapiens
ctggtgtgtgagagtgaattgcagataagaatggataccgggactgagcgtggtggctcatgcctgtaatcccagcactttgggaggctgaggtgggaggktcacttgagtccaggagttcgagaccagcctgggcaacatagtaagatccccatctctacaaaataaaaataaaaaaaaattagccaggtgtgccatgag

SEQ ID NO: 21908 - DNA, 201 bp, Homo sapiens
tgcaggctgggtcagctttggattttgttctcagagcagtaaaaagccttggaaacagatgtttcccaagctagggactagcacaatttgatatatagttygcattttttggatccttctggctggtgtgtgagagtgaattgcagataagaatggataccgggactgagcgtggtggctcatgcctgtaatcccagcact

SEQ ID NO: 21909 - DNA, 201 bp, Homo sapiens
gttgatggcatggctccagatcatgccgaagcggctgtgccagccactgtgggttgggtgctttgtggttcgccaggcgggagccggctttggcgcagggwttgccctcatcatggaatgctccagcgccatcaggcctcccgtgtattgagcacctgctgtgccccctggttctttcctgctattctcttattttaatat

SEQ ID NO: 21910 - DNA, 201 bp, Homo sapiens
gtgatctgtctttttctctttggggaggctcagggtgatctgtccttttatgtcccggggaggctcggggtgatctgtccttttcccagacaggatggggraggaaggggagagtaatggttgtcgtcagagtcacgggttttgggaatgaattttgctgaatatcctccctccctcccagaaaaaaatcccctttagaaa

SEQ ID NO: 21911 - DNA, 201 bp, Homo sapiens
atcttctgccaaaggaagaatttcaatatgggggtatgatgtgggtcagtgattcgggcttagagtggggggcatttatggaatacccacactgggccagrcacagggctaggatcagtaagctttgtcagagagcccttttctttttttttttttttgagacagggtctcgttccattgcccagggtggagcgcagtggc

SEQ ID NO: 21912 - DNA, 201 bp, Homo sapiens
ttacacccagtgtggcttccatgccaaggcagaaggaatactagggggagtttaggaccaggctgtgggcggcatccgcattgtctggttcctcgtaagtygcaccacagggttggtcagcagcagttcagctcttgttaaagctgatagggaaagaggacgggtgtttgggaacagttctcttgggggatcctggtcccg

SEQ ID NO: 21913 - DNA, 201 bp, Homo sapiens
cctttttggcctgagctccccagtgtgggcagtgcctggattcagaaagctgagtagggaggggctcctctcctggcccatgtccccgatgtgctcctagyttctgagctcctgttggcaactgtcgctgctgaagctccatgtccctgcctggaagtctcttttgcggccgctggttcgggcgcatcctctggtttgggt

SEQ ID NO: 21914 - DNA, 201 bp, Homo sapiens
atttcaaaacaaaaacgaaaacagaaattagctgggtgtggtggtgcacgtctgtaatcccagctatttgggaggctgaggtgggagggtcgcttgaaccygggaggcggaggttacagtgaaccaagattgtgccactgcactccagcctgggtaacagaatgagattctatctcaaaagaaaaaaagaaaagaaaagaa

SEQ ID NO: 21915 - DNA, 201 bp, Homo sapiens
tagcgcaaagtgcaaagtggggtgctagtggcccggttttggggaatcagtttgggtgatttgggctgagtcacttcacttgactgaggatcagtgtcctygtctgggatcatctaagcttcctagcggggctgttgtgagacccagagatgaaggaaggcccgcttctgtccacacctggcctctgatgccctcattccc

SEQ ID NO: 21916 - DNA, 201 bp, Homo sapiens
atataggcactacaggcaccaccatgcccgcacctgtagtgccagctacttgcaggctgaggcaggaggattgcttgagcctaggagtttgaggttacggygagctgattgtgccagcctgagccacagggcaagacccagtctcttaaaaaaaaacaaagaaagaaaaaaaacatagccaaggaaggggttggagtacac

SEQ ID NO: 21917 - DNA, 201 bp, Homo sapiens
ccacagcctggttctgatccatggcctgagggttggggacccctgcactatggagctgactggtgggagcggggccagactgggaggcagcggcgggggcmctgggtccccatcttggctttgccaccagattgctgagcaatcttggacaagtcacctaacctctctgaccagggaaataccacccctgtatgccctcat

SEQ ID NO: 21918 - DNA, 201 bp, Homo sapiens
gctgcaggacctgcagaaggacctggccgtggtggagcagatcacgcttctcatcagcacgctgcacggcacctaccaggtacgtggcctggcctgacctytttggcctgagctccccagtgtgggcagtgcctggattcagaaagctgagtagggaggggctcctctcctggcccatgtccccgatgtgctcctagcttc

SEQ ID NO: 21919 - DNA, 201 bp, Homo sapiens
tcctggcccatgctgggcacccaagaggtgtttgttgaactaataggagaggcagtggcaagctggggcacatcctagcagtgtgattgacgtgggagccrggggtctgggagccacagcaggcggccatgggaccatctgaccagggcaagaggggccctgggataggagcggaagttgaggactggcctgtgcaggagg

SEQ ID NO: 21920 - DNA, 201 bp, Homo sapiens
atcctctggtttgggttgagtggagcctggctgtggggcctttgtttgttctctgcacagtggccattccgttatgtggcccctcctgggcctctacccartgtggaggggaagctggctgcgacggcatgtccctctcagaggagggctccaggtgggatctgagcccagggctgggaagcctggggcatggcgagttgg

SEQ ID NO: 21921 - DNA, 201 bp, Homo sapiens
tgagttcagttgggtggttctagacctccaggcccagggcctaggatgtaatatttcaggtaatggggagccattgaaggattttgagctagggtagatgkaagtggaggcaggtggagaaactgtgggattgcagcatatgggggccaggaccaggtaacaggtgtgtggatggagtgggggatggatgcaagagacagg

SEQ ID NO: 21922 - DNA, 201 bp, Homo sapiens
tagactttactcttgaaaggatctggcttcccagctagtctgggcgctctggtcagggtaggaactggatgttactttctggaactctttcttttttttttgggttggagtcttgctctgtcacccaggctggagtgcagtggcgtgatctcggctcactgcaagctccgcctcccaggttcacgtcattctcctgcctca

SEQ ID NO: 21923 - DNA, 201 bp, Homo sapiens
actccagcctgagtgatagagtgagactccgtcttaaaaaaaaagaaaaaaaaaagaaaaaaaaaagaagttaggacctatgtcactggttttcattaatkgaaaaaactgttgagactctacatagttttgggcatgggggaagaataatgacaaaaacagagagatctctgctctcaaggaacttagatttatgagggg

SEQ ID NO: 21924 - DNA, 201 bp, Homo sapiens
gcaggcccccttctcagagctcccctccccctccctggtgaagaggaaaggaagttggagccgcccccacctcgggaagccctttgagtgtccatcaggtsggtgagggaggagctggggtgtgtggtcccttgccagattctgcagctctggcacctgcagggttgaggagggtctgggaggacgctccctgacccaccc

SEQ ID NO: 21925 - DNA, 201 bp, Homo sapiens
tccctttccttcttgtcttttttcccaggcctgccaaccacaggtacgtggttcagggggctccggggctctggggctctggggctctggggctctggtgycatgtgattctggatatggggctggggcctgggcgcctggtgcttctaccctggcgagggatccctgctctgcctggcttggttttggtctgaggtcttg

SEQ ID NO: 21926 - DNA, 201 bp, Homo sapiens
acatcccaagctcgccatgctctttgcttgttaccaggtgaccattcaggtgccatagtccatggaagccttgatatcaggcagcagagtgtggctttaamctcattccacacaggtgactcagataattatctaaatgaaaaccccaaataaggcttcccctccactcccctggggcttcataagacctcagtgtgcaaa

SEQ ID NO: 21927 - DNA, 201 bp, Homo sapiens
gtgtcatcacacgtgacctgtgccatcacacatgacctgtgccatcatacatggctggtgcccagaagggccccatgcttgctttcatgttctgccatggycatcttgaaattcatagtcactttgaacaagagcctgtgttttcgttttgcactggaccgcaagagtcatgtagccagacccggtcacatgttcattacc

SEQ ID NO: 21928 - DNA, 201 bp, Homo sapiens
aaggcttagagaggtgcccagagctagagaagggcagagtctaagactgggcctttcccccgcttcggccacacactgtgggaatgggtggattcggcagktgtactcggggacaccttctagggtgttggcctgttcttttttgcccaggaaaatgccaagagaagggcctcagatgatcccttgaaagaccactttggg

SEQ ID NO: 21929 - DNA, 201 bp, Homo sapiens
ggtacgtggcctggcctgacctttttggcctgagctccccagtgtgggcagtgcctggattcagaaagctgagtagggaggggctcctctcctggcccatrtccccgatgtgctcctagcttctgagctcctgttggcaactgtcgctgctgaagctccatgtccctgcctggaagtctcttttgcggccgctggttcggg

SEQ ID NO: 21930 - DNA, 201 bp, Homo sapiens
tctcaggaagccaaggcttagagaggtgcccagagctagagaagggcagagtctaagactgggcctttcccccgcttcggccacacactgtgggaatgggkggattcggcaggtgtactcggggacaccttctagggtgttggcctgttcttttttgcccaggaaaatgccaagagaagggcctcagatgatcccttgaaa

SEQ ID NO: 21931 - DNA, 201 bp, Homo sapiens
accctttacagttacgagacctttcacagatacccgcgagaggcctgcaacccagggtaggggcggggctaacctctcaggaagccaaggcttagagaggkgcccagagctagagaagggcagagtctaagactgggcctttcccccgcttcggccacacactgtgggaatgggtggattcggcaggtgtactcggggaca

SEQ ID NO: 21932 - DNA, 201 bp, Homo sapiens
tgcaggtggtcagggaggcctctctgaagagagacatttaagccagacctgaatgacaagcaggagctccccctgcaaggatctgagggaaaagtattccrggtaggagctacagcaaatgcaaaagccctgaggccagatgaacttggcctgtttaggagggtgtggaagaggccatgttagttaggactgttactctag

SEQ ID NO: 21933 - DNA, 201 bp, Homo sapiens
ctgggttcaatagattttcctgcttcagcctcctgaatagctgggattacaggcatgcaccaccacacccagctaattttgtatttttagtagaggtgggstttctccatgttggtcaggctggtctcgaactcctgatctcaggtgatctgcccaccttggcctcccaaagtgctgggattacaggtgtgagccactgcg

SEQ ID NO: 21934 - DNA, 201 bp, Homo sapiens
gcaggaggcatccaggcatgtgccaaggctcaggggagggaatagcagggccatgtcagggagggtgcaggagggtgctgctcaggagctctgtccattgyactaggggcttgtactttatcttgtgggccctgcgagccagtcaactgtttcaagctaggggatgacgggattagaactttttgtttggggtagagattg

SEQ ID NO: 21935 - DNA, 201 bp, Homo sapiens
ttgtccccagtgccaagctggggcctggcaggcagtaggtgcgcagtgagaagttggctgagtggggaaggatgagtggcttactttgtgaaaggtggagraggtgagcctgacccctggaggtgaggagggtgaactggggtcacagattccccaaaggttgtacctcagcttggccccctggaggctttagttcagccc

SEQ ID NO: 21936 - DNA, 201 bp, Homo sapiens
acagcagtggttcacgacagagctgggattccaacttgggtctgcagtgtgccagagctcaaacgtcctccatcctgcagtgctgcccgctttattggaaygtgaagccttccaggaggaggagagcagaccctttacagttacgagacctttcacagatacccgcgagaggcctgcaacccagggtaggggcggggctaa

SEQ ID NO: 21937 - DNA, 201 bp, Homo sapiens
cggacgcagccttctccggggcccggcactccagctggaagcggaagagttcccgtcgcagtaagtctcccctccggcccaccgcccaccccaggtagcargctccaggatattctagtctttctaacccaagagagctgatgtgggctcctgtgagcccagggttcatcctcaccgggggcttctgtggccctggaggac

SEQ ID NO: 21938 - DNA, 201 bp, Homo sapiens
tgatggcctctctgggtctctgctcccaggtcgggggcggacaggaaggcgcagggggccaggtggaaatcttttccttgaaccggccctcgccccgcacygtcaagtccttcccactggcagcccctgtgctctgcatggagtatatcccggagctggaggaggaggcggagagcagagacgagagcccgacagttgctg

SEQ ID NO: 21939 - DNA, 201 bp, Homo sapiens
cgtcgcaggcaccgtgcaaggcgcccccgtgggttagttccttggcatctggatcttcccctgctttcccctttcctctgctggccagcgtggagtgcggrtagaaggacgtatctcccgtgatggctgtgaggatgcagtgaggcagtgtggaaactgtgaggtgcagggcacgtagaagtgtctgttatggcaacgcgc

SEQ ID NO: 21940 - DNA, 201 bp, Homo sapiens
gatcagctggttccaggagtcccaggcccctcctctgaggcagaggacgacccaggagaggcgtttgagtttgatgacagtgatgatgaagaggacaccarcgcagccctgggcgtccccagccttgctcctgagagggacacagaccccccactgatccacttggactccatccctgtcactggtaagatgtttctggga

SEQ ID NO: 21941 - DNA, 201 bp, Homo sapiens
cctctgctggccagcgtggagtgcggatagaaggacgtatctcccgtgatggctgtgaggatgcagtgaggcagtgtggaaactgtgaggtgcagggcacrtagaagtgtctgttatggcaacgcgcgtgccctgtgtggtcgtgccctttccctgagggtctcttatgtaggcctttcctccctggtggcagggatcagg

SEQ ID NO: 21942 - DNA, 201 bp, Homo sapiens
ctcttccacactgagaccctggagcatctgcaagagatcaacatcgccaccaggaccaccttcctcctgccaggtgaggctgcctcgggcacgggggagcrgacagtcacagagcaccttccacggccaggtagtggtgtgacctgggcagcccatcccattttccctcatcagccctgaaaactggggctttaatttggg

SEQ ID NO: 21943 - DNA, 201 bp, Homo sapiens
ggagtgctcagtgtgtcatgaccgcttctccaacctctccccgcagcatcctcctctacagcagtgtggacactggcacccagtgcctggtgagctgcagragcccaggtctgcagcctgtgctctgcctgcgacacagccccttccacctgctcgctggcctgcaggatgggacccttgctgcttaccctcggaccagcg

SEQ ID NO: 21944 - DNA, 201 bp, Homo sapiens
cttatctgaaagctgctcactttcagagaccctgggctgatacagagcctcttgcaggcctcttctagccggaaggttctaggaaaggaagaacaaatgtragcgtgtaggaactgcctggagaagcaggcactcgtgaagcatgttgctttcctggcccccacccacagggattctaatccagggagagttggatggggc

SEQ ID NO: 21945 - DNA, 201 bp, Homo sapiens
tcccttggcagtgcccctccgtgagctccagctctttcctgccattcttccgtctgtacacctgctgggttgcagggacgcacatggacctccctttccckgcctgcctcatcctcctggggggctttgggtaggtcccttcccatctgagcctcagcttccctgtgtctaaaaaggaggtgaggaaacccacctctcagg

SEQ ID NO: 21946 - DNA, 201 bp, Homo sapiens
tcctcctggggggctttgggtaggtcccttcccatctgagcctcagcttccctgtgtctaaaaaggaggtgaggaaacccacctctcaggctgcctgcagmctaaacacactctcatgctaagtggcgagggcccagcagcgaggacgcccagcagctgggaggcgggcatccctgttgtaggtggggaagctgaggctct

SEQ ID NO: 21947 - DNA, 201 bp, Homo sapiens
ccttcccatctgagcctcagcttccctgtgtctaaaaaggaggtgaggaaacccacctctcaggctgcctgcagcctaaacacactctcatgctaagtggygagggcccagcagcgaggacgcccagcagctgggaggcgggcatccctgttgtaggtggggaagctgaggctctgatgggcgagttgatggcacacagta

SEQ ID NO: 21948 - DNA, 201 bp, Homo sapiens
ctgggcagggctgggtggccgctgcccagctcatcccagcagtccagctgctgcttcccccgcttctgcctggaccttgttagagaaagaggccggccttycctgtcctcaaggcacgacttgcgcagccttccagactttcagggcccccaagtgttttcttcctccaggcctcattcaggtggaagagggatggggcag

SEQ ID NO: 21949 - DNA, 201 bp, Homo sapiens
cacttggtgtttgttctctgtctttgctgtggcctctgcctggaatccacgctttagttggagcttgtcaggccttttctcatcctttaaggctcagtgcragggcagcctcatcctcggagcccttcctgaagccccagagagccccagccccttcctcttggcaccgtctcagtctctgaggtttttggttttctcctg

SEQ ID NO: 21950 - DNA, 201 bp, Homo sapiens
gtgccttcccctgccccagccagtctgtgccctagtacctgcaagctggctgcctccaagtccaggcattcccaggcagctgtgtttcatgctgctgcacrtaccaaataaagtgtagtgggaaggatgcgctgtctgtgctcatttgcacacacaaagcacacagacacatcaacacacaaacatacaataagcttgtgc

SEQ ID NO: 21951 - DNA, 201 bp, Homo sapiens
gcataaacacacatgtaaaaagaccccttgctcacaaaacagggaaacacgaaataagaagaggaaagatatacattgaagtactgaggtgcacaggctcrccctgggagcacactcccttccctccctcaactgccacttgcttagagacctaacccaaccccctccccccggccttaccagcactgtagggccatgtgg

SEQ ID NO: 21952 - DNA, 201 bp, Homo sapiens
ctttggagacagttgctgcccagagcttgtgtctctgaagtcctccctgcagcttctcctaaagaatccacaccagccagaagagcagcctcccagaggtyccctctcctgtctgccttggggagctggcaaccctggggggcaggagggccctgataagctggtgttaaatggcagcttctgggctcttagagtctgtta

SEQ ID NO: 21953 - DNA, 201 bp, Homo sapiens
gggtggtgcaggccaggtaggggagctgatgactgagccagggctgggggagggaggcggggctcagcaggcacccagactggccaggccctgtctgcggygcccctggggaggctgggaaaggggcggggaaggcctgagtgcctggggccagcctctggcctgacaggctctctgtctgctcttcttttgcagacccag

SEQ ID NO: 21954 - DNA, 201 bp, Homo sapiens
ttggggcctggagccaggggaagtgatggggcagccgtattctgggagaggacagggagactcatcttccctggatgtatcaggggctgagaggatcaggscaagaggagaccaggctcagcaaagcagtattggcacaggatggaaacagggcgctggtggcctgtggcttctgagactgctaggtgtgggggacatagg

SEQ ID NO: 21955 - DNA, 201 bp, Homo sapiens
gccactgttgctgttgttgttagtgttatgcctgccgagggtcccagcactggcctgcctggggctgatgtgggctcagcagaagcttggagaggagctcrggccagctctgccattgatttgggcacagggctttgtgcctttgtgccttggcttcttcacataaagcaggaaaatccccagctcacaggcctttgggga

SEQ ID NO: 21956 - DNA, 201 bp, Homo sapiens
gagctggaggaggcgggcacaacccctcccctccaactgccagctttttttttttttttttaaattactttgccttttctcccataactttttttttttttggagacggagtttcactctgttgctcaggctgaattgcagtggcgtgatctcggctcactgcaatttctgcctcccgggttcaagcgattctcctgcttc

SEQ ID NO: 21957 - DNA, 201 bp, Homo sapiens
gcagtggtgtgatcatggctcactgcatccttgaccttccaggcttgagcgattctcctgccttagcctcccgagtagctgggactacaggcatgtgccaycatgcctggctattttttttttttttttttctgagacagttttgctcttgttgcccaggctggagtgtggtggcgccatctcggctcactgcaacctttg

SEQ ID NO: 21958 - DNA, 201 bp, Homo sapiens
gaatatcaatagcccatacttcaagatgctttttctattccacttcctccagaatagccaggtgcactgatagatttcagggtttttttttttttttttttgagatggagttttgttcttgttgaacaggctagagtgcaatggcgtgatctcggctcactgcaacatctgcctcccaggttcaggcgactctccggtctc

SEQ ID NO: 21959 - DNA, 201 bp, Homo sapiens
ccctgcagaggctgatgcgggtgaaggaggaagagatccactcggccaacaagtgccgtctcaggctcctgcttcctgggaaacccgacaagtgagaggarggggtcttggagggagggctgctgcctctgctgggcttccagtggagcaggggatccggagagggtacctggagccctcttatttgtcgagatgccatgg

SEQ ID NO: 21960 - DNA, 201 bp, Homo sapiens
attgccggtcctgagggtgtaccacctgcctcactcacctccctctgccccttctctctgctgcagccatgccagcccctctgggctcctggatgggccaygctccctcccaccacgccctctccagcctgtgccttttgccaagtactctcctgccatcctgtttttgtctcatctgctcttggctcaaatggcacttcc

SEQ ID NO: 21961 - DNA, 201 bp, Homo sapiens
tctgagactgctaggtgtgggggacataggggctcatgggaagggcaggtcagcaaggccggagtgggtccgcagcgtctggaggaaatcttcaagatttyccagattgccgcagacctagtctggagtcgtttggaatcctgggcttctccttacatgtgctgtttcccaaatccggaacatttgagcctcctgcgtcct

SEQ ID NO: 21962 - DNA, 201 bp, Homo sapiens
gggctcatgggaagggcaggtcagcaaggccggagtgggtccgcagcgtctggaggaaatcttcaagattttccagattgccgcagacctagtctggagtygtttggaatcctgggcttctccttacatgtgctgtttcccaaatccggaacatttgagcctcctgcgtcctgtcccgcagggtccatgcgggacgtgagg

SEQ ID NO: 21963 - DNA, 201 bp, Homo sapiens
tgggctatcagaaaggagggtgctgcgtgccaccagctggtgcagtcctgatgtcatctgcagcacctctggccaggctgccacagcccacggtggtgctstctctccccacttccctcccagttgaccggttcactttccccgccctggaagaggatgtgatttatgacgacgtcccctgcgagagcccagatgcgcatc

SEQ ID NO: 21964 - DNA, 201 bp, Homo sapiens
cttttaaccagacaggtcattaataaaatgttctccaagagcctgagctttttaaagttgtatatctccagatagatggcttgggtgagttgaacactgcygcattaagtctctgtgataaaatatttattcaccattagaattttttttttctttcggactgtttgtgaagtgtcttgctcttttccttgaggtggaggg

SEQ ID NO: 21965 - DNA, 201 bp, Homo sapiens
ggctggagtgcagtggtgtgatcatggctcactgcatccttgaccttccaggcttgagcgattctcctgccttagcctcccgagtagctgggactacaggmatgtgccatcatgcctggctattttttttttttttttttctgagacagttttgctcttgttgcccaggctggagtgtggtggcgccatctcggctcactg

SEQ ID NO: 21966 - DNA, 201 bp, Homo sapiens
gaggcttgtgcggcagtgcctggtgtgtgattcctggtgaggtcccttcccttgacatgagagcagagcaaaaagagccggctcttcgctcccccaacacrgagatcttgtgagggcggaggggtgtgcaggtgtgtctctccaccagcagttgcctctatggggacagggactttttgattttttggagggggatgtttt

SEQ ID NO: 21967 - DNA, 201 bp, Homo sapiens
gttccataggtccctcccggggaggcttgtgcggcagtgcctggtgtgtgattcctggtgaggtcccttcccttgacatgagagcagagcaaaaagagccrgctcttcgctcccccaacacggagatcttgtgagggcggaggggtgtgcaggtgtgtctctccaccagcagttgcctctatggggacagggactttttga

SEQ ID NO: 21968 - DNA, 201 bp, Homo sapiens
gcgtctaagcagtcggtggaatgttccataggtccctcccggggaggcttgtgcggcagtgcctggtgtgtgattcctggtgaggtcccttcccttgacawgagagcagagcaaaaagagccggctcttcgctcccccaacacggagatcttgtgagggcggaggggtgtgcaggtgtgtctctccaccagcagttgcctc

SEQ ID NO: 21969 - DNA, 201 bp, Homo sapiens
gtagggagagaggctgcggcctggcctgcggcctcaccccgccctccccggcaggactaccgcaaccccctgatggagatggagcccaaggcgctgagcgyccgcaagtgccaggtggtgttcttccgcgtgaaggagatcctgcactgccactccatgttccagatcgccctgtcctcccgcgtggctgagtgggattcc

SEQ ID NO: 21970 - DNA, 201 bp, Homo sapiens
cagtaggcatctgggaggtaaatggattggtgatgggatggcacactgtgttaggcaatgctgggtgtaccccgagtcggtaacctgccttttggggtgaragagccacaccatttctctctgtgcctgcactgcagaggaagcacatacacccacatgtatggagttgaagtgtcatgcccaaggagggagaggtgatgg

SEQ ID NO: 21971 - DNA, 201 bp, Homo sapiens
ttatccatccaacaagaatatatatttaatccatccatttatttatctgtccatccatccacccacccacccatccattcattcaccgatacatccttccrtctatctgtctatcatctgtccatccatccatccatccatccatccatccatccatccatctatccatccatccatccaacaagaatatattgagtatgt

SEQ ID NO: 21972 - DNA, 201 bp, Homo sapiens
gaggaggctggatgaggtgacctcttagggccctcgcccatggccattagaaattttgttagaatattctaacaatgggtccagggacggctggggccttyagcaccagcagagggcagcagctgcctggaaaagggcccagtggtcggctgcatcctccttccagccaagagcagtctctactctgtcttctccttcagt

SEQ ID NO: 21973 - DNA, 201 bp, Homo sapiens
gcagagggcgaggggagggggagatggggagcacttcccagagccctgtgctatgagctctgtcactttgggcaggtgtctcacctctctgcagtcttggktccctcgcctgtagagataatatgaaatgtgaccaataggactgaagtaataaccagtgtccactgtaggcctgaagtgtgccaggtaccacgcatgatc

SEQ ID NO: 21974 - DNA, 201 bp, Homo sapiens
agccatccctagcacaggttacgatgtcaggagggcaggagggcagggctaaccgtgtttggactgctgtgctccagggcaggggtaaagtgcttaatgcrtgtgtgttatcttaattctcatgcaccccttgagaatttcctttgctttactgagatgatgctgactggagaccagacgcaccttctccccagccatgtg

SEQ ID NO: 21975 - DNA, 201 bp, Homo sapiens
cagcattctctcccgaggaggctcggggtgatctgtccttttctctcctggggatgcctgggggtgatctgtgtttttctctctggggaggctcagggtgwtctgtccttttctctcctggggatgctcggggtgatctgtccttttctgtcctggggatgcccgggggtgatctatctttttctctctggggaggctcag

SEQ ID NO: 21976 - DNA, 201 bp, Homo sapiens
gggggcttctgtggccctggaggaccaaccaccgcccccaagagccaaggtccaggatcagttgacacacccagtttttcatctgctcctcaaatacttaygaagttcccacaacaggccagggcggcccagtggtgggagtgccctggggaccagaatgaggtccctctgttaacagaaccagacaccttgccatgggaa

SEQ ID NO: 21977 - DNA, 201 bp, Homo sapiens
ttaccagtgaggaagctgcagctcaggtaaagagacttctctagctagtaagcagagatccatgatttgagcaggagcctacatgcctccagaactcacastcttgatccttctgtctacttctctagaagtagcacctgtcttggtcttttgtgtactttaccaaatatcactgttgctcatatggttcgtgcatttgaa

SEQ ID NO: 21978 - DNA, 201 bp, Homo sapiens
ctggccttgccccatcccgcccctgctgccatgggcacctgttccctttcctctccccaccaagaggcctgaacctgaacatggggagtgagaaaaaaaaatttatgactaagtcaattctgttctgttcagcaaacatttgacaaatatttgttgttccagctctttctaatattgctggctagtatcatctgggtgaac

SEQ ID NO: 21979 - DNA, 201 bp, Homo sapiens
ggcagcttcctgtcctcttgtatcactatgagagaggcagaattgcagatggtaatgagtgagggctttgtcctcagccccatctgagtttgaatcctgascctgccacttagactgtggggctggttaagtgacatgttgtctctgtggcttagtttcatcatcagtaaacatggggacaatgataccctctcctgggct

SEQ ID NO: 21980 - DNA, 201 bp, Homo sapiens
ggcctttgggcccctttctctctcgccccattttctgcagggaaaggcatggtctcactcaacgggcactgtgggcctgtggccttcctggctgtggctaycagcatcctggcccctgacatcctgcggagtgaccaggaggaggctgaggggccccgggctgaggaggacaagccagacgggcaggcacacgagcccatg

SEQ ID NO: 21981 - DNA, 201 bp, Homo sapiens
gaggtgtgaggacagagtccagggaaggccagtgtcgggaggtccaggagctgatcaggaagcacgggggaggctgagatgcccggatgaaggtggaagamcggaagggcagggtgagggttggaaggggagggggtgatctgtgctgaatgctgctgaggttaaggaggagcctgaggcctaccttggatttagccacac

SEQ ID NO: 21982 - DNA, 201 bp, Homo sapiens
tggtgtggaggagcaatgccctgggccagccctggggcagggtggctgcagcctctccagggccttgtcctctctgttccaacaggggccagctggagatyagcagcctggtgcccctggggcccaagtatgtggtgaagtggaacacggcgctgccccaggtgcaggtggtggaggtgggccaggacggtggcacctatg

SEQ ID NO: 21983 - DNA, 201 bp, Homo sapiens
tcaggcgctgagctctgttcttgctttgtaaaaggaagcagagcctgagacaaggattttgattcaggtcgtttatttgggaggggagaccagggaacccygatgggggcataaaatggggaagagaaggcagccagtgccgggggaggtattgaacatgttactaagtgggtacctcgggctcaagtctgctgaggggct

SEQ ID NO: 21984 - DNA, 201 bp, Homo sapiens
ttggctttggcccattccctcttactgctcgattcaccagtttgggcacctgggttggaaggaggtgaggctgccctgacaaggaccacaaatggcagacwtgtagcgtcgcatatcctagaggctggaagcctggggtccgtgtttggatgggtcatgtgccctcagaaggcactagggaagggccttactcccagctgc

SEQ ID NO: 21985 - DNA, 201 bp, Homo sapiens
catattctgaggtactgggggctgggacctcaacatacagatgaggaggcacagtttaccccaaaacatggggtttggggtccacccattggcttctagtstggggttggagcctgttagtcaggaccaaaagagccactgggaccattgaaccccacgccctcattttctggatgggagcagactgtccagagccccctg

SEQ ID NO: 21986 - DNA, 201 bp, Homo sapiens
gcagatgtgagggggctttggcttgtccaggtagagtggaggacatggggtctgaaggctgagatgttctaccagctttcctgccttgcaaacatgtgtgyaccaaacgcttactgagcacgtactatatgccatggacacagtggtgagcaaaatggacaggccgcctgctctcatggagcttacagtctatagagggag

SEQ ID NO: 21987 - DNA, 201 bp, Homo sapiens
tccgtgaccagctgtgggactggcatcagcttggccctcatccagattcactgaggccttagatacccctcagatacccccacccatcccagcagcagagycagggcttggaactgcacccgcatcaacctcgcaggctctgtatcaacctcagaacccaccatagtggccctggtggtgtggagggtccagggattgtga

SEQ ID NO: 21988 - DNA, 201 bp, Homo sapiens
ggatgggttgggcatcaggctgccgggattgagtcctcactgtgagagcttgggcctttcctttgcccctctaatcctcagtttcctcacccgtgaaatgrgggtgtggacagccccacttcatagaatggttgtgaagggtagacatggcaattcccacgagtgccgcgacacagcctggaggattggcacctcccacgt

SEQ ID NO: 21989 - DNA, 201 bp, Homo sapiens
tgtgcccagataaatattcttgcatattgtattgactccctgcaacatccggagaagggcaggcgtggttatcatgcccagtgtgcagataagggaaactraggtccagagaggcgaagcccccgtccaagttcacacagaagttctgaggccgaggactgccctgctctgcctgcttcccttggtgctcacgctggctgg

SEQ ID NO: 21990 - DNA, 201 bp, Homo sapiens
tgaggcaagagaatttcttgaacccgggaggtggaggttgcagtgagccgagattgcgccattgcactccagcctgggggacagagtgagacaccatctcaaaaaaaaaaaaaaaaagttgcttctaaattctgagattttctattttcaaggtttcatcaaatagggcattttgtccatccagggggcatttgtggaggg

SEQ ID NO: 21991 - DNA, 201 bp, Homo sapiens
gaacctgttttatagatgggaaagaggtggggagggagggaaaactgggcctggcagagcatggggtaggccagggtatggtagggaaggatggggagggrgtgggagtctagtttggctcttgtgaccacaccccagcagtggcttccatcacgtaccctggggcccttccggctttggagacagctgtgccccatcgtg

SEQ ID NO: 21992 - DNA, 201 bp, Homo sapiens
tccaccatatcatgctgcctcttctgagaagcctccctggatttcccctggtgcagagttagttccttccatctcagcagttctcaaggcccttgtgcacrcctgctcatttgtgcttggcgtgtcatgtgataactgttgattaacctgttggttgctctgaccagtggggcttcctagagggcgagacctgtgtctgat

SEQ ID NO: 21993 - DNA, 201 bp, Homo sapiens
caaggcccttgtgcacacctgctcatttgtgcttggcgtgtcatgtgataactgttgattaacctgttggttgctctgaccagtggggcttcctagagggygagacctgtgtctgattcctttctgtcttcccagcacccagtgcatggcatgggtggagtaggtgcttactgcatgtgtgcggaatgaatgaatgggaga

SEQ ID NO: 21994 - DNA, 201 bp, Homo sapiens
gcactatcctttggcttgtggccctggaggcctgccttccttttgctgaccctttcttatgtccaccccggcaccgctttcagctcccagtggcattccarggatcgattgggcagagtttgtccggaagcagagggggcccaaggtccctattgggcctgacctcttcctctgccacacatcgccaaggctaccaagaac

SEQ ID NO: 21995 - DNA, 201 bp, Homo sapiens
tgggatcagatgagcagtaatgcagcgtatttattcatttatttattatgacttttttgagatggagtcttgttctgtcaccccagctggagtgcagtagygcgatcttggctcactgcaacctctgcctcctgggttcaagtgattctcctgcctcagcctcccgagtaactgggattacaggtgcccgtcaccactccc

SEQ ID NO: 21996 - DNA, 201 bp, Homo sapiens
cccaggagggggaggttgcagtgaggcaagattgtgccattgcactccagcctgggtgacacagccagactccatctcaaaaaaaaaaaaacaaaaaaaamcaaaaaaaacaaaaagaaaatgcgtaggaacatgctaaccttttggggttggtgacgggctctgtgttggatgccctcacctgcagtatcagccttcaag

SEQ ID NO: 21997 - DNA, 201 bp, Homo sapiens
gggcctgggagcacagggggaggctgggagcacggaggtgagcctgggagcatagaggtgggcctgggagcatggcggcggggggggggcctgggagcacrgggcgggcctgggagcacgggggtgggcctgggagcatgggggtaagcttggctctgtcattcacccttttatgaccttgggcaaggcacagtcctctct

SEQ ID NO: 21998 - DNA, 201 bp, Homo sapiens
agaggaagtgcagaggatacgtttgctaggtgcttccttgtgggggtgggtacggcctctctacctcacgtcccatcacttggagctctctgcaaaacccrttctcccgggccctagatgcaaaaatccacccagttcatccgcccttgagaaatgatgttgagtcagatctggaaacactaaatgggtgagtcacagtga

SEQ ID NO: 21999 - DNA, 201 bp, Homo sapiens
ctatctaggaatctgtaagagtcaaacatttgccacctttttctacttcctgtcctctattgcctgtgggactcgaggagactgagatgaggaaacaattyagtgaaccctctatagtttgacacactgtagtttgagggtggtggctcatgcctgtaatcccagcactttgggaggctgaggtgggagtgtcgcttgagc

SEQ ID NO: 22000 - DNA, 201 bp, Homo sapiens
caagtggggcagacccgggaccagaaccccagcatcccagactcctggccttctgctcctttcactcctccagggcctcagagggggactggactgggagscagttgcctgggttctaatcccacttcttccttggaccagccagaagagcttgggcaacatttcactttgccccctgcctttaccctaagcctcagtttc

SEQ ID NO: 22001 - DNA, 201 bp, Homo sapiens
atcacttgataggatcctgtggggcactagcattctgcccacttgactttgggacaccccagtccctacaaccccttaagttttatcacgaagacttggarctccagtgggcctcagcccctggctcatcatctttcagccaagtggggcagacccgggaccagaaccccagcatcccagactcctggccttctgctcctt

SEQ ID NO: 22002 - DNA, 201 bp, Homo sapiens
cagctggggccagagccggaggctctgctttgtgaccctggacaagtcacttcccctctctgagcctcagcttccccatccaggaattgatggaacttgayagaaagtaaattagtggttgccagggacctgagaggagaggataatggagaatgactgctagactgctaggggttttggtggaggtgatgaaaatgttct

SEQ ID NO: 22003 - DNA, 201 bp, Homo sapiens
ttccaagatgagtaaggtgtggcgccccttaatctggtgagggaggtggatgggcaacagctgaagggtgggcggtgcctgatgcaggtggagggactcccgaggaggcttcccaggggagtgtccaagccaagcagtggaaaaggcagagttaggtcaggaagcaggaggcatccaggcatgtgccaaggctcaggggag

SEQ ID NO: 22004 - DNA, 201 bp, Homo sapiens
gcactgggcaaggaactggagattccaagatgagtaaggtgtggcgccccttaatctggtgagggaggtggatgggcaacagctgaagggtgggcggtgcctgatgcaggtggagggactcccgaggaggcttcccaggggagtgtccaagccaagcagtggaaaaggcagagttaggtcaggaagcaggaggcatccagg

SEQ ID NO: 22005 - DNA, 201 bp, Homo sapiens
tgggagacttattcactatcatgagaacagcatggggaaaacctgcccctgtgattcaattacctcccaccacgtccctcccatgacatgcagggattatkggagctacaattcaagatgagatttgggtggggacgcagccaaaccatatcaaggggtgtgagtgtgggtgtgggtgtgtgtgtaatgtacgtagtggtg

SEQ ID NO: 22006 - DNA, 201 bp, Homo sapiens
aacaagggaggatggcttgagcccaggagtttgggaccagcctgggcaacagagtaagaccctatctctagaaaaaattttaaaaaattagccaggcatggtggtgtgtgcctgtagtcccagctactggggaggctgaggcgagaggatcacttgacccaggagttccaggctacagtgagccatgattgtgccactgca

SEQ ID NO: 22007 - DNA, 201 bp, Homo sapiens
ggcggctgagttcagttgggtggttctagacctccaggcccagggcctaggatgtaatatttcaggtaatggggagccattgaaggattttgagctagggkagatggaagtggaggcaggtggagaaactgtgggattgcagcatatgggggccaggaccaggtaacaggtgtgtggatggagtgggggatggatgcaaga

SEQ ID NO: 22008 - DNA, 201 bp, Homo sapiens
aaaccacatggagggagaggctgcctgggtcctgccttgccctggttccagcactgcccatgccttggcccccaggatgagggactggtctggggggctcrtccctggctcagcctaggcccgtgcctgtctctgaccaatagcactgcccgctcaccttcacacctgcagtccatcctgggcgggagactcagcatggtt

SEQ ID NO: 22009 - DNA, 201 bp, Homo sapiens
tcaggcagggagcgaattctcccctcccagccttttccattcaggcttcagcagattgggtgaggcccacccacactgggaaggccatgtgcatgactaarcctaccattcagatgctaatctcatctggagacaccctcacagacacactcagagccacgtttaaccaaatatctgggctcctcgtggctcagtcaagtt

SEQ ID NO: 22010 - DNA, 201 bp, Homo sapiens
aggacctggcagtgaggacctttaacctcactggtgctactgggctgggccaagggacagtgagacaccaacaggagggaaactcctgccttagcactccyggttcctcggtcccctttctcccccaagaacagctggagcaactgcagctgcagactcccttcccagcccctggttcatgctgggggcttccctgctatc

SEQ ID NO: 22011 - DNA, 201 bp, Homo sapiens
atgaaagggtctggagggaggggaagccagaaattacaggcaggggcctgcgagagcagagaagtggctgccggctgctggcaggggaggtgtgagtggcrcggccccagggcacagagctgcccctgtgagctgggcctgtggggctcctcccaggctcttcaggcagctcaggagcacttgagacttcaggagtgggta

SEQ ID NO: 22012 - DNA, 201 bp, Homo sapiens
agtgggtgtggggcatcgagcccacactgcaggtctgccatcctctcgcctcactggaagacagccttcctcctgccgacagctgtccaggagcatgggayggatggccaagggaaggacaggggcccgggtcaggccctgcctggctctcacctgttcttgccccttgccagccgtagtgcagtcaactcccagcccaca

SEQ ID NO: 22013 - DNA, 201 bp, Homo sapiens
ggttgtggctagcatggcccaggaccaaatgtgaaaacacaggggcttaatctaggactgtgttacctctaaggggctttttctgactcctcccaccctcrggaagtaaaccaatgtatactgagcgattcctttggaccagaaatgagttttgcgctttacctataggatctcatttaatcctcaaatcacgctttgaga

SEQ ID NO: 22014 - DNA, 201 bp, Homo sapiens
ttgttaccatcctatccccatggcccaaggccaggcctgacgcagagcaggtgctcagtaaagggtggttaaggccagaagcccctcagggagatgggctstgtctgtaatgtttccccaagtggggggtgggggcattgcagagcagctgaccgaggcttggttttaaccggcttcggagcatgaaggtgcttcctgaag

SEQ ID NO: 22015 - DNA, 201 bp, Homo sapiens
cactggcagcccctgtgctctgcatggagtatatcccggagctggaggaggaggcggagagcagagacgagagcccgacagttgctgacccctcggccacrgtgcatccaaccatctgcctcgggctccaggatggcaggtgaggggcccggaaggaggggtgagagcagcctctgcagggctgggcagtgggtgggggct

SEQ ID NO: 22016 - DNA, 201 bp, Homo sapiens
ccctgcccaccccccgccccagccgccttccccacccttaattttcatgtttagtgcctaaacttagtttgcatgtattagctgttgtaaatctatcataygagtgtgatgcggcatgaataatgcatcactgggctgtattagttttctgtctcctatcttatttatgacatgaaacgggtgggaatttgcaaaagagaa

SEQ ID NO: 22017 - DNA, 201 bp, Homo sapiens
ggcatgaataatgcatcactgggctgtattagttttctgtctcctatcttatttatgacatgaaacgggtgggaatttgcaaaagagaaattcaggcgcarggcttcttgggtaatggtatgcaaattggcgtgagggtgaaaagatgcaccaggccctcccagcgcccaggagctgccgaggaggagcgcctggtgtctg

SEQ ID NO: 22018 - DNA, 201 bp, Homo sapiens
tctcaccgtcagacagagcgtgcatgtgaatgtaaatatgggctcagatctgcggagactcatggggagttctagagcgaccactcccaaccggctcccayggaacactgtgagcccggcctgtgccaccctggcgctctggtccccagcttgggttggctttggcccattccctcttactgctcgattcaccagtttggg

SEQ ID NO: 22019 - DNA, 201 bp, Homo sapiens
ctccgacaagaacaagttcacaaggaagatgagtgttttccagcatcaggaaggcttgaagttagatgttcagaaggactccctttcaggaagtttgtgargcatgggaggtaggggtgggtttgggaccccatagggccttcttatgtggagggtcagaaataagttggctggttgcaaactcgggcctggagggggtga

SEQ ID NO: 22020 - DNA, 201 bp, Homo sapiens
ttctggggaataaactgggagcctcttggctctgtggggtcctagaagcagaactaaggcctatggctggctgttcccaggagggaggtttcagcagcacrgggtagacctttctaagagtccaggaaggagtacccagagggagagtggccctttccatgtgtgctgcactttacagtatagaatgctgtctaacctgca

SEQ ID NO: 22021 - DNA, 201 bp, Homo sapiens
ggtccacctgcctcagcctctcaaagtgctggaattacaattatgagccactgtgactggccataaattttatacatatatatgtgtgtatatatatatawaataattttttttttgagatggagttttggctcttgttgctcaggctggagtgcaatggcatgatctcggctcactacaacctctgcctcccacgcacgt

SEQ ID NO: 22022 - DNA, 201 bp, Homo sapiens
tcttgatgtatcaattttgggacatcacctgttgtctccttgctgtgaatgatgaggatttggcccatattacccccgttccttccccggtcattctctcrgttgcctttgtcactttaaatcatttacataaaccacaacttctttcatgattttcggctccatctttcccttccgtaaggtaaagctctgaggggccac

SEQ ID NO: 22023 - DNA, 201 bp, Homo sapiens
tggtacatatacttgcaagaaaaaaaaaaaaagcatggagtggtttatcctgaaaggctcgtccacactccacatctcagtcctgctttttggaagagaawgcttttcacctgttctttttttaatccacctggcactttcctcaggacccaaacttgttcactctgctgcttcttgatgtatcaattttgggacatcacc

SEQ ID NO: 22024 - DNA, 201 bp, Homo sapiens
ttcagaaggaagtggctggtccgtggcggggtggggcctgcctcctggactgaggacgccactctgaagtggagtcttcagatgttggaggaggacagttsgggggggcagtgcgtgctgtgtgcaagtcatggccagggcaggggtgcggctgtgtggtacatcttgagcattggctggcctgaaacgtagggagcccac

SEQ ID NO: 22025 - DNA, 201 bp, Homo sapiens
gcccaccactcatgggtcctggagggttagacaactccatgagggcaaagcacagggccaggccaagggctcagtggagtcaagtatttccatctgggttsttttattgagccatccctagcacaggttacgatgtcaggagggcaggagggcagggctaaccgtgtttggactgctgtgctccagggcaggggtaaagtg

SEQ ID NO: 22026 - DNA, 201 bp, Homo sapiens
cccagaggtagctgagacatgccgggctggggctggggctagggctggggctggaggtgctgtgctgttctccctattcattcctgccctttcccccgccsgcctccccgctttgggctcagcaggtttgcacaagccttctgctaagccctctgggcctggagacagacttgttatgccactggagaaatgagcctggat

SEQ ID NO: 22027 - DNA, 201 bp, Homo sapiens
gatatcaggcagcagagtgtggctttaaactcattccacacaggtgactcagataattatctaaatgaaaaccccaaataaggcttcccctccactcccckggggcttcataagacctcagtgtgcaaaaccacggcctagagaatacagtccaaattcctagcccaggggcctagcgttcaaggccttccccatctggtc

SEQ ID NO: 22028 - DNA, 201 bp, Homo sapiens
aaagctacaaaaccataacattcaaattaacagcattaatgtaatgtgatggatgatgttgttttgctgaaaccaatttgttcacagtgtggatgtggctyaggccctggtagagcaggttcctctgcgctttcgtgcctgtgccacagggtgccctgtggggatctgcatttcccatgagctccccagtttgggtcactg

SEQ ID NO: 22029 - DNA, 201 bp, Homo sapiens
atcacaaattgaataaaaataaagctacaaaaccataacattcaaattaacagcattaatgtaatgtgatggatgatgttgttttgctgaaaccaatttgytcacagtgtggatgtggctcaggccctggtagagcaggttcctctgcgctttcgtgcctgtgccacagggtgccctgtggggatctgcatttcccatgag

SEQ ID NO: 22030 - DNA, 201 bp, Homo sapiens
tcaggggtcaagaaacagaagcaaacacctgaggacaccctggtccccaggaaggtgaggacaccggagtctattctgtggcatttctgaacgcctgactrctacggtgtcgaaggttcttcttggacccctggctccatccaagggggaatgctgtctctggaggggtggcaggagggcagggagggttcagcgcaaacc

SEQ ID NO: 22031 - DNA, 201 bp, Homo sapiens
ctggggaggctcagagtgatctgtccttttctgtcctggggttgcctgggggtgatctgtctttttctctttggggaggctcagggtgatctgtccttttrtgtcccggggaggctcggggtgatctgtccttttcccagacaggatggggaaggaaggggagagtaatggttgtcgtcagagtcacgggttttgggaatg

SEQ ID NO: 22032 - DNA, 201 bp, Homo sapiens
gtgggcccaggaggctcaggcaggactccaggctcgtggtgtgagaaggggacccaggagcccagaggtagctgagacatgccgggctggggctggggctrgggctggggctggaggtgctgtgctgttctccctattcattcctgccctttcccccgccggcctccccgctttgggctcagcaggtttgcacaagccttc

SEQ ID NO: 22033 - DNA, 201 bp, Homo sapiens
cctgtgcatggtgattcttatagttgtcattgtatggaagaggaaaccagggatcggagcagtggatggcatctgtgtcacagctggcctcagctgggatygagcacagagctcagtctcctaaaaatccctacccagggcatgatggtgacatggcaaaaaggggaacctggggggcacactggcaggaccagagattgc

SEQ ID NO: 22034 - DNA, 201 bp, Homo sapiens
caatgccctctgatccgggtttcccaacctcgatccattgacatttgggctggatcattctttgtgttggggctgtcctgtgccctaaaggatgtttagcrgcttccctggcttccacccaccagatgccagtagtgtcccccctccccacctagtgtggcaaccaaagtgtctcctgccattgccaaatgtcccttgggg

SEQ ID NO: 22035 - DNA, 201 bp, Homo sapiens
gccattcgtgggttggctctgcccctggaggaactggtgggaggattaggggaggcaccaggcatcccctggcctggagcagtgctcagagccaactccckccagaggtgccccagaacagctggaactgcactcacacccttatctggggaggacagcacatcactgaggggtgtggtttgaatcataagtgctggctgc

SEQ ID NO: 22036 - DNA, 201 bp, Homo sapiens
gctgagggcttaatgcagtggaggtcaggccctgggtgtaattagggaggctccctccctgggtggttgggaagaatgaatgaggtcacatgtgcagaggrtgtaggctagtgcctaatgcacactcaggcagagtggccgctacgcaatggtcctctgtgagcctggcagcggggtagcagggaaggtccacaggaggca

SEQ ID NO: 22037 - DNA, 201 bp, Homo sapiens
tgaatgaggtcacatgtgcagagggtgtaggctagtgcctaatgcacactcaggcagagtggccgctacgcaatggtcctctgtgagcctggcagcggggyagcagggaaggtccacaggaggcaacctctgcaggaggcattcccggctgcccctgcatgccttgtctgagtgggcttggatggtggtcagtgtgggctc

SEQ ID NO: 22038 - DNA, 201 bp, Homo sapiens
attgggtcttgtgggtgcgtatgtccgcaccatcctccctccagatggcaaaatatctgtgagcagggccagtgtcttatcctctctgtattgtcctgcartgcaagtacaggcattgacttggcttctctctctcctttgctttctttctccccaaaatctccccttttttcccacgccagctcttcccttctgcctgac

SEQ ID NO: 22039 - DNA, 201 bp, Homo sapiens
ctctctggagggcatttagcgggagggcccctgagaagcgtgagctgatgcctgtgcatgcctgtgagagggtgggaaactggtcagttatattaacatartcacgtgctgcatagtgactttcagtcaacaacagaccacacatattatgatggtcctatacgattacaatacagtattttactgtaccttttctatgtt

SEQ ID NO: 22040 - DNA, 201 bp, Homo sapiens
acagcatgtgagcttggagcgaggtgcacgcttctgccccgccttgccccaccctgcccctgcccctgccctgccctgcccctgcccatctgggccacccrgggttggttcgctctcttttcatagagtctccgtgaggtgggacgctgcgcgcacagtgcccagtcaggcattggaaagtcctgacacacggtgggtacc

SEQ ID NO: 22041 - DNA, 201 bp, Homo sapiens
ttggagcagtatcacccacctgaaactgactgtgtgggcgcctgtagcgggtggatggggggctgcagggaggggctccgtgggcaggctcaggacacacrggtttgtctcagctcacctgggttcattccaggtcacagtgcgccaatgctctccctggaatcctcaccgtgccccagaggcgtgttctctttttgtccc

SEQ ID NO: 22042 - DNA, 201 bp, Homo sapiens
cctcaagtgatccacccatcttagcctcccaaagtgctgggattacaggcgtgagccactacgcctggtcccccataactttttactttgaaaaatttcaractacaggaaaggtgagagaataatacaatacacagatattcttcacccaggtaactgttaacatgttgctacaatcttcccccatattatacatgcaca

SEQ ID NO: 22043 - DNA, 201 bp, Homo sapiens
ggtggtcctggggcagggggtgactccagctctggctggcctcatggcgagcagtggcccagactatttgtctagggagggcttgggctgggcagagggasttgctggccacagtgtagacagggtcggcactctgtaccagtggatgaggatgtgttgggttctttccttcaagggatcaggggtgttggggcaggaggc

SEQ ID NO: 22044 - DNA, 201 bp, Homo sapiens
ccacacttctgggcctcccagaccagccaaggatgagggcacaggtctggaggtgcttggcctgggattggggtgctgggtgagcagggtttcaccctttyctggttgggaggagagcagagtttgatgagctgacagcctcccctggcaatgaattctgagctctctcagggtacgtggataccttgtgtttggaaaatg

SEQ ID NO: 22045 - DNA, 201 bp, Homo sapiens
ctccccaaaagaaacccccatccaggtggggagcctctgccacctcgaacctggggaaccagggcccacgaacctcctcagtgcgagctctcagggcccasgaatatgtaggccagaagcatcctcagtcctgctggccccggctcactgtctccttaggagcgccagggctagtggagggaggcgagtgactctctgtgg

SEQ ID NO: 22046 - DNA, 201 bp, Homo sapiens
gccactgcctccaaggcctccccaaaagaaacccccatccaggtggggagcctctgccacctcgaacctggggaaccagggcccacgaacctcctcagtgmgagctctcagggcccaggaatatgtaggccagaagcatcctcagtcctgctggccccggctcactgtctccttaggagcgccagggctagtggagggagg

SEQ ID NO: 22047 - DNA, 201 bp, Homo sapiens
ccacccatctcagcctcccaaagtggtgggattacaggtgtgagccaccgcgaccagtcagattcctttttttttttttttaaaaaaacacaaaaacaaamaaacccttcccaatgctatatttcttctgtgatgacaaaagcattttcatcttcatgtactttttggcgtctgaccccagtttcatgaggtctgcagttc

SEQ ID NO: 22048 - DNA, 201 bp, Homo sapiens
ttctcctgtctcccccagggccttgggtctcttgagagcacaggatgcaggctgagccctgacagatcagaccccagtggtggagtcacagaactggccaytgcctccaaggcctccccaaaagaaacccccatccaggtggggagcctctgccacctcgaacctggggaaccagggcccacgaacctcctcagtgcgagc

SEQ ID NO: 22049 - DNA, 201 bp, Homo sapiens
ctaggcatgtatgcaagtatgcatgattgtttttatagaactgtggtttattgcacatgctgtttcgtggctcacctttttttttttttttttttttttttaaagctaattacatatcatgagcatttccccaggggaacttgtattgttttgcaacaacccacatggctctcgatacatttttgccaggggtgcagggcc

SEQ ID NO: 22050 - DNA, 201 bp, Homo sapiens
gctaggcatgtatgcaagtatgcatgattgtttttatagaactgtggtttattgcacatgctgtttcgtggctcacctttttttttttttttttttttttttaaagctaattacatatcatgagcatttccccaggggaacttgtattgttttgcaacaacccacatggctctcgatacatttttgccaggggtgcagggc

SEQ ID NO: 22051 - DNA, 201 bp, Homo sapiens
tagggtgaagttttgtctgtatttaaacttttaaataactattcagtgtggattttttgcattaatattgatttttttaaagttgccttactctctctctmtatatatacatttttgtgactgagtttttggtgcccttttaaattttgtacccaagctaggtgccccagtctatcaccctagtcctggccctggtggagg

SEQ ID NO: 22052 - DNA, 201 bp, Homo sapiens
tgctaggcatgtatgcaagtatgcatgattgtttttatagaactgtggtttattgcacatgctgtttcgtggctcacctttttttttttttttttttttttttaaagctaattacatatcatgagcatttccccaggggaacttgtattgttttgcaacaacccacatggctctcgatacatttttgccaggggtgcaggg

SEQ ID NO: 22053 - DNA, 201 bp, Homo sapiens
cagctcagggtcctgctgagacgtggcaagacttgatgtgggcggaggccagggctgtgactggagtaaggcgcctttgcctcaggcacaaaatttcagcygatgtcaaaaatctcaataattaagataaatactattttaatgcagtgcgtaaatataatcaaatcagcaaatttttccttgtggtttggccgctctttt

SEQ ID NO: 22054 - DNA, 201 bp, Homo sapiens
gtggcgccatctcggctcactgcaacctttgcctcctgggttcaagtgattctcctgcccagcctcctgagtagctgggattacaggtgtgtgccaccacrccgaactaattttttgtatttttagtagagatggggtttcatcatgttggccaggctggtcttgagctcctgacctcaggtgatccacccacctcggcct

SEQ ID NO: 22055 - DNA, 201 bp, Homo sapiens
cccgggaagcggaggttgcagtgagccgaaatcatgccactgcattccagcctgggtgacagagtaagaccctgtctcaaaaaaaaaaaaaaaaaaaaaaatggacctggagggagcagctcagagctcagctcagggtcctgctgagacgtggcaagacttgatgtgggcggaggccagggctgtgactggagtaaggcg

SEQ ID NO: 22056 - DNA, 201 bp, Homo sapiens
ctggggctggaggtgctgtgctgttctccctattcattcctgccctttcccccgccggcctccccgctttgggctcagcaggtttgcacaagccttctgcwaagccctctgggcctggagacagacttgttatgccactggagaaatgagcctggatttccaccaccgacttctcttttaattagattctgacagcagcac

SEQ ID NO: 22057 - DNA, 201 bp, Homo sapiens
aggactggtcaccctaggtttgaatttggctttcctcccatgtcctaagcagcgcgactttgcacatcatttagcctgtcagtttgtttcctcagcggtamagtgttgataagaatgagataaagacagggaagggagttgtgctaattgcctgtagaagatggcccttccacatgctcagtgcagccgtgcagagcggac

SEQ ID NO: 22058 - DNA, 201 bp, Homo sapiens
tcatccaccaaggtcttcctgggcacctctggtgccaggcactgcatttggagttgggaggtgcaacctcatctggggcaacagaaaaccagggagctaawaagagagtgtgccttttgcaaatggtgacagggctgagaaggaagtgaaagggggagctgtgcagaggacctgggtctcaggatcttcacccctggagtc

SEQ ID NO: 22059 - DNA, 201 bp, Homo sapiens
tccctcccatgacatgcagggattatgggagctacaattcaagatgagatttgggtggggacgcagccaaaccatatcaaggggtgtgagtgtgggtgtgkgtgtgtgtgtaatgtacgtagtggtgtgctactgcatatctcaactccattcagtgatgtcacattggcagcttgaaattggccagagtgagagtattta

SEQ ID NO: 22060 - DNA, 201 bp, Homo sapiens
aagggaacggcagaggcagggctaggatttgaatgtgggtcattctgacccccagttcaatgctctgtcccctaccccaggaggatttctgtggcattttrtgacagatgaggcacatttgatcccactgatcccacgaccccttgaggtcagcagggccaggcttatttatggctcccatgatgaagaggttaaatcacc

SEQ ID NO: 22061 - DNA, 201 bp, Homo sapiens
agatgtcagggagggaggtgcattgccacagagcaggaggccagaggctgggctttggcccagcatgtgtgtggggggccacctgtacagagatggctccycagaggcctcgacgctcactccctgctgaggtctgtgatatgatgccacctgagggccgctctgagacttcccctggggggcttctcactgctctctact

SEQ ID NO: 22062 - DNA, 201 bp, Homo sapiens
gccctcaaagctgtctactgaggcccacagggtttgcttctcctggtggactctgaagcacgtgcactcatgtccaccctgagctctcgctgggggagtcrtggttgaaagagcagccctgagtacccagcagtgcctgggaaacgtgagcgccacagatcgctggcttcctgtgtttttcctggactcaggcctgcaccc

SEQ ID NO: 22063 - DNA, 201 bp, Homo sapiens
ttgcccaggctggtcttgaactcttggctcaagcaatcctcctgccttggtgtcccaaagtgctgggattacaggcatgaaccactgcatctggcctgtawtatcttattacttgtacccctaggagccctagaagacaggtactattgaatatgcccattttgcagatgagcagctgaggcttagagaactgaagtaatt

SEQ ID NO: 22064 - DNA, 201 bp, Homo sapiens
tgagtttgatgacagtgatgatgaagaggacaccagcgcagccctgggcgtccccagccttgctcctgagagggacacagaccccccactgatccacttgractccatccctgtcactggtaagatgtttctgggaacttccggtcctggggctacagggagcatggagaactgggcggaagctccaggctctcagggatg

SEQ ID NO: 22065 - DNA, 201 bp, Homo sapiens
cctctccagggccttgtcctctctgttccaacaggggccagctggagatcagcagcctggtgcccctggggcccaagtatgtggtgaagtggaacacggcrctgccccaggtgcaggtggtggaggtgggccaggacggtggcacctatgacaaggacaatgtgctcatccagcactcaggcgccaagaaggcctctgcct

SEQ ID NO: 22066 - DNA, 201 bp, Homo sapiens
cgggcagctgtaacgaaatgccgtgactcttaccagcaacaggcagttatttctcaaagttctgaaggctggaagcccatgatcaaggcaacagcagattyggtgtctggtgagggcctgttccttatagatggtaccttctcactgtgtccctgcgtggtgggagggcctagccggggccttgtttacaaggatactaat

SEQ ID NO: 22067 - DNA, 201 bp, Homo sapiens
tgcagatgaataaactgaggcttagggaggttaagttgcacatttgctaggttgtggagctgggatttggagtccccactgtctgactccagagccggtgyacagacccacccatctattaggatcctcaaggaggaattctttctgtggctgacaggttggatttcaacctctcaaagacccctccgtcgtctgagagcg

SEQ ID NO: 22068 - DNA, 201 bp, Homo sapiens
gcaagaggggccctgggataggagcggaagttgaggactggcctgtgcaggaggagaggcctcattctgagaaactcgaggatgaggggagggctggatgyggggaggaggcagatttagactcttctcctgggggacgatgaatcttctgccaaaggaagaatttcaatatgggggtatgatgtgggtcagtgattcggg

SEQ ID NO: 22069 - DNA, 201 bp, Homo sapiens
ccttgaaggaacatacatcgcaggaagagagaactgaaagccaggacggcccgggctgtgggcagcagatatgggcggagggctagagagatgggggcatkgtctctcccctacacagcatggactactaaacctgactttgcacaggctgtgaggaggcgtggcctcctcccaaaaatcagaggctctgagcctcttgca

SEQ ID NO: 22070 - DNA, 201 bp, Homo sapiens
cagtagaacccctgttccaagagcagcctgaccctggggagaggaaccacactgctgtctcttctcccctcccctcccctcctctggggagcctggccttkcctgctacccctgcctcccttgctactcgcagctcagccatcagggactggctcagaaaaagcaatttccttggacagctcacagtcttgccctcctggt

SEQ ID NO: 22071 - DNA, 201 bp, Homo sapiens
ccccctcctcccaatcattgaggggctgtttcctccccattattcaggtctctcactaaatgtcacctcctagagacaccttccctgaccccagtcttaawggctttcagtattttttctgtgcagtgcttctcactatctgatgtaatctttctttgttttaattgcctcctgtcctgagaacgtttgccccacaagagt

SEQ ID NO: 22072 - DNA, 201 bp, Homo sapiens
ctgcaggcttggggacagcgggctcctggagcagctgggggtggagggcaggcccagagcaggcagggtggctgccacgggttctggctggagttgggaartgggccacggggtgggtgggggtggtgcaggccaggtaggggagctgatgactgagccagggctgggggagggaggcggggctcagcaggcacccagact

SEQ ID NO: 22073 - DNA, 201 bp, Homo sapiens
atggtgtaataactgccaccctgcccgggcctgaggtgatgaggccccaagtgcttatgtgcaggatctcatttcaccctaaccctgcgagctggggattrtccccacattacagatgcagacactgagattggttcagcaggccgggcgtcttgctcgtggtcatgcagtagaccagaggcaggaccacagtcacatcag

SEQ ID NO: 22074 - DNA, 201 bp, Homo sapiens
gggagcactcagagcaccagcttcccatcctcggtccctaccccgcagggcaggtgtaggtgttgtgtgagacagtgtgaggacagtgcccacagtccccrtctcaagccagcagcggtccatgatggtgacattttgccgtcatcgtctttacggcatacccgccctgcatctcctgcgagggctccttgcccctcctaa

SEQ ID NO: 22075 - DNA, 201 bp, Homo sapiens
ctttcttcgggagtcgagcggcaggctggctgcacgcgtgtgagcatgcagatacctctctcagtgtgtgcatgtttgtgcatccgtgagcaaggagctgygtgctgtgttttggaaaagcctgcagacaaagcatgttgggtctcactgactgtcctgctaccccatccattcgccccactgctcgccgacagcaggtgc

SEQ ID NO: 22076 - DNA, 201 bp, Homo sapiens
catctcctgcgagggctccttgcccctcctaagaccctccaggtcagtgtgccattcctgtcgcatcagctgcatcagtgcagacagaggtgaccgctctyttggcagacctccctgaggctgaaccctggagaaggctggatgtaggccgaggttccagagtgtggggtttcccgaaggttccctcttccctcaggcctg

SEQ ID NO: 22077 - DNA, 201 bp, Homo sapiens
gcagacagaggtgaccgctcttttggcagacctccctgaggctgaaccctggagaaggctggatgtaggccgaggttccagagtgtggggtttcccgaagkttccctcttccctcaggcctgaactttcccaatcagtaacccagtggagcctggggccctgccagaccagttcctcctgacccctcatatctgagagtgg

SEQ ID NO: 22078 - DNA, 201 bp, Homo sapiens
ttttcttcccccacaccagcaaatgaaataattgcataattagtaataaatttgttcctacactaagtgtggatttttttagtgtgtgttaacaatttatygcacttccttcccctgacccctttcttccactcgcgtactcgactggtattaatgcattttttaacctaaactccctcctccttttaaccagacaggtca

SEQ ID NO: 22079 - DNA, 201 bp, Homo sapiens
taattagtaataaatttgttcctacactaagtgtggatttttttagtgtgtgttaacaatttatcgcacttccttcccctgacccctttcttccactcgcrtactcgactggtattaatgcattttttaacctaaactccctcctccttttaaccagacaggtcattaataaaatgttctccaagagcctgagctttttaa

SEQ ID NO: 22080 - DNA, 201 bp, Homo sapiens
tctgcccagataaggtgtacctcggccccccacgcctcttccaggagctgcaggacctgcagaaggacctggccgtggtggagcagatcacgcttctcatyagcacgctgcacggcacctaccaggtacgtggcctggcctgacctttttggcctgagctccccagtgtgggcagtgcctggattcagaaagctgagtagg

SEQ ID NO: 22081 - DNA, 201 bp, Homo sapiens
aaagtgttttaagcagaagctgtcctgtccctggcagaagactttgggaatcctggccctcagaaaggctaatgtggcttccctgccccttgggccatgcrctcccctccccaccccatgcatcacttccatcctgagaagtgcccgagccccatgttacacctgctttaaaggcagatgaatgtcctgtttgaaccgcat

SEQ ID NO: 22082 - DNA, 201 bp, Homo sapiens
agactatttgtctagggagggcttgggctgggcagagggagttgctggccacagtgtagacagggtcggcactctgtaccagtggatgaggatgtgttggrttctttccttcaagggatcaggggtgttggggcaggaggcaggagtaggtctcttgtctgtgctgacagtggcccctgcccacgctgggccacaccaagg

SEQ ID NO: 22083 - DNA, 201 bp, Homo sapiens
gccgggtcctgggcagtggtgagttgggagccagctcacacctacacataagagctgattgctaaattttaggaattttatgagccggttgttaaacacarccattataaaaaattctgaggccaggagcgatggctcatgcgtgtaatcccagcactttgggaggccaaggcaggcagatcccctgaggtcgggagttcg

SEQ ID NO: 22084 - DNA, 201 bp, Homo sapiens
ggtgaagttgtggagaaactcagtctggtgggagatgcagatgcgtcagagtgggacagagacggacgcccagggagctgggacactgactggaggggagyaaggatggggtcgtcagggaagacttctgggccaggtcctggctcagcgagtgaatggaaattctccattcaggatggcagaggggcagggggagtgcct

SEQ ID NO: 22085 - DNA, 201 bp, Homo sapiens
atcacagttcttctttgtcttctgcaagtcaggtctgggttggaagggtaattgggtaactggaggtggtgggagctgaggcctctcaggaccaggtgttyagagcctccttgcctaagcagtggaggggtctaggctccaaatgaatggcccaagcatctggaaccctgagtttaaatcctcactaccctggtgagggga

SEQ ID NO: 22086 - DNA, 201 bp, Homo sapiens
caagggcagcctcatcctcggagcccttcctgaagccccagagagccccagccccttcctcttggcaccgtctcagtctctgaggtttttggttttctccygctggctctgtcctgtcagcctcacagtgagctccggaggggagctcacagtcacccaccccgaaccccaggactgtgtcttacctttccttccccctcc

SEQ ID NO: 22087 - DNA, 201 bp, Homo sapiens
aaggctcagtgcaagggcagcctcatcctcggagcccttcctgaagccccagagagccccagccccttcctcttggcaccgtctcagtctctgaggttttwggttttctcctgctggctctgtcctgtcagcctcacagtgagctccggaggggagctcacagtcacccaccccgaaccccaggactgtgtcttacctttc

SEQ ID NO: 22088 - DNA, 201 bp, Homo sapiens
caggccttttctcatcctttaaggctcagtgcaagggcagcctcatcctcggagcccttcctgaagccccagagagccccagccccttcctcttggcaccrtctcagtctctgaggtttttggttttctcctgctggctctgtcctgtcagcctcacagtgagctccggaggggagctcacagtcacccaccccgaacccc

SEQ ID NO: 22089 - DNA, 201 bp, Homo sapiens
actgtctaatgaccttcattcctgcgcgtgtcttcagcacccccggggcacttggtgtttgttctctgtctttgctgtggcctctgcctggaatccacgcyttagttggagcttgtcaggccttttctcatcctttaaggctcagtgcaagggcagcctcatcctcggagcccttcctgaagccccagagagccccagccc

SEQ ID NO: 22090 - DNA, 201 bp, Homo sapiens
gttctggaaggattcttgagaagtcagtaacagtcatctcttctgggggactgggggattagggcaaccagggtgggaggttgactaactttttttttttwaattttttgagacagagtcttgctctgtttcccagactggagtgcggtggcacggtcttggctcactgcaacctccgcctcccacgttcaagtgattctc

SEQ ID NO: 22091 - DNA, 201 bp, Homo sapiens
ctctctttcagcactcactcgtctcttcctccctggtggtctggtttgcacgctcactctctgctgatctcagcttctaactctgtatcggtgtctccttygatcggtgccgccccggctcttccaggccttctggcccagggtgggcactggctggagctttagtccctgtgcttggcactgggttccagcagcagcccc

SEQ ID NO: 22092 - DNA, 201 bp, Homo sapiens
ccactgcactccagcctgtgcaacagagtgagaccttgtctcaaacaaacaaacaaaaagagtggggagtcaagtggggccctggatatccacctcatagygttgtgaggatcacgtgaaataacacataaagcactgcatatggttcctggttttagtagagtctcagaaatgacagtgagcattcatttattcctggct

SEQ ID NO: 22093 - DNA, 201 bp, Homo sapiens
tgctcccctcctttatgcggttttccttttccctttgaggaggggagggagagattcatcacatgcctggaatctcagcacactttgcctttcttagttcrgagttaatgtatgtttttttaattcagtgttggcaaggcccagtctggtcatagctgggtttgttaccttgtggctcaggggcaaggatgagaatagaat

SEQ ID NO: 22094 - DNA, 201 bp, Homo sapiens
accagcccagtgacagcacaggtcctgcagagcaggtgccccaatgagggagtctcacccacaggagaggatgcgggtcagccgcatacacgtgcccagcygtgaggcagacacacctgccactgatccgaggagcccaggaaggaacccaggaggggagcgagagaggggagtgagagcggggtgggccaggctctctgg

SEQ ID NO: 22095 - DNA, 201 bp, Homo sapiens
gtgcgtatgtccgcaccatcctccctccagatggcaaaatatctgtgagcagggccagtgtcttatcctctctgtattgtcctgcagtgcaagtacaggcrttgacttggcttctctctctcctttgctttctttctccccaaaatctccccttttttcccacgccagctcttcccttctgcctgaccctgagccttccag

SEQ ID NO: 22096 - DNA, 201 bp, Homo sapiens
tcggactgtttgtgaagtgtcttgctcttttccttgaggtggagggggagggggaaggccccagaatgaggtctgcagatgaagccatttctcaattccgrcatctctttcggtttcttgcttgccttcctcccatttgtcggttttgccgtccagtgggggctgggaggatgcaggggcagcaggaaatggtctcctgcc

SEQ ID NO: 22097 - DNA, 201 bp, Homo sapiens
tgagcgtgtgcatgtctttcctgctcctcactcggtgatatcatgctggtagtttgcaactggccacgttagaatgtttacaccacggaaattggcaaacsctgcaaaccaggattccctgccagttgttaaactttggccaacacagcacagctgggcttctaagattccagttgttaaactttggccaacctcatagct

SEQ ID NO: 22098 - DNA, 201 bp, Homo sapiens
tactatgggctaagagctgtgctcaattgtgtatatatattatatgtatatatatatgtgtgtatatatttaatatttctaataattataaaattgagcamggcaggtttgtagtactcattgatggatgagagaaatgatttgtccaagttttctcctttccttcatccatccatctgtccatccatccatccatttact

SEQ ID NO: 22099 - DNA, 201 bp, Homo sapiens
gactcctctgtagctgagtgaattggggtagttatttaaactcgctgtgtctcggttgtctccgttatgaacagggataataatagtatctaccacacatkcttgttgggagttaaggaaataattcaaggaaggagggcctggtgtgcggacacagaacgctgcgtaacaaccgctgtcaagaccctgactgtgtgccca

SEQ ID NO: 22100 - DNA, 201 bp, Homo sapiens; identical to SEQ ID NO: 3622

SEQ ID NO: 22101 - DNA, 201 bp, Homo sapiens
ggcggactggatgagctcattcctgtcacagggcctttgcatgccctgtctcctgggccttggctcaggtcttggtgtggccacctccgccttgtcacccrgcagcctcacgcctgcctccctatccttccaggaagtagagggaggcctgaagacccgggaatcctccactggctctgccctgtcgccctgtttcaatcc

SEQ ID NO: 22102 - DNA, 201 bp, Homo sapiens
ttccacacactgttgtgttgtggcaaatggcatcaaacagtaagagccacggacacagactcctctgtagctgagtgaattggggtagttatttaaactcrctgtgtctcggttgtctccgttatgaacagggataataatagtatctaccacacatgcttgttgggagttaaggaaataattcaaggaaggagggcctgg

SEQ ID NO: 22103 - DNA, 201 bp, Homo sapiens
cttggtgtggccacctccgccttgtcacccagcagcctcacgcctgcctccctatccttccaggaagtagagggaggcctgaagacccgggaatcctccamtggctctgccctgtcgccctgtttcaatcctctgcctggtgtttacatcccttgtttctgtttttgtttcctgtatctcctctctacacctctgtgtcta

SEQ ID NO: 22104 - DNA, 201 bp, Homo sapiens
taggtaactaggttttgctaaaagaaaaaaacttttttttgaaagccacagcgctcgatagagtcactgaataggtctgatgttctgggtgtatatcaagrggctctggagagagagttgattgactccaggccgaccatccctcccttggtaactcaactctgggcacgctgcccggtgagaggccaggagcactttcct

SEQ ID NO: 22105 - DNA, 201 bp, Homo sapiens
tgcgggcaggttttctgggaagccggggagagccgtatgggatttgttctgggcatgatgggaagctgtgcattatagcattgagagctggatagtgtccygatctgattttcatttaagtgggtcattctggctgctgtggggagagggcatgggaggggcaggtgtggaggtgggagcaggaatggggaggggttgcct

SEQ ID NO: 22106 - DNA, 201 bp, Homo sapiens
catcaaagaaagttctagagtgtctgctccttaagacaggactctatgtacatggtcccagctgtgcccccagcacctagtgtggggtctgccatgcagtrggcatctgggaggtaaatggattggtgatgggatggcacactgtgttaggcaatgctgggtgtaccccgagtcggtaacctgccttttggggtgagagag

SEQ ID NO: 22107 - DNA, 201 bp, Homo sapiens
acctcaactccaccccaccctgcactcaccaggtgggggacctctttgagccttaacatccgtgcctggaaaatggggccggcatttgtgtcttgcatacrtcttggctgttgcaagccttgtgtcagatgagagcaggtatacgagtgctttggaaactccaaagctgtgttttttcaaatgtgatccatggaccagaag

SEQ ID NO: 22108 - DNA, 201 bp, Homo sapiens
tagttaggcagggagatgggttcatatccatcttacagatgaggaagctgagcatacagcatttaagtgactgtcgaaggtcactgctgaagcgagtcagygaaggcgccagcactcagcctgggactccctggccactcagtccttgctttcttctgcacaactgtctccagtgccttttgtattcctgtcacccggcta

SEQ ID NO: 22109 - DNA, 201 bp, Homo sapiens
cagcctgtgaagatgctgggctgccttatctccacacagcttcactgcagcaaaagttttaatggaagaagagtcatttgaaatcttatttgaatgcctgkgttcccctggggcttgaataatttgtttcttttattttgccagtattttttttctttttatctgcagtggctggtttgggaggggatgataatatgagcc

SEQ ID NO: 22110 - DNA, 201 bp, Homo sapiens
ccctgcactcaccaggtgggggacctctttgagccttaacatccgtgcctggaaaatggggccggcatttgtgtcttgcatacgtcttggctgttgcaagscttgtgtcagatgagagcaggtatacgagtgctttggaaactccaaagctgtgttttttcaaatgtgatccatggaccagaagcagcagaaagtgggaac

SEQ ID NO: 22111 - DNA, 201 bp, Homo sapiens
cagagtggaaagaatacatgtaatcttctatgattaattttgaaaagataaagtaaatgatatatatgccatgataagataataacgtggatttatattgyactttcatatctgctatctctttgttttgacaacaccctagtagttaggcagggagatgggttcatatccatcttacagatgaggaagctgagcatacag

SEQ ID NO: 22112 - DNA, 201 bp, Homo sapiens
ggtggcccaaggcagtgagcctgagcgcagggctgggccctcccttgctgcctctcatttggtttagttttccggcccatagtcgtcacactgacgccaayattccttccgggatgactccagctgttgggtcctgagcacagccctggcagagtgtgaagtgtgttctagacctcagcatgtccttgaaccctcactgct

SEQ ID NO: 22113 - DNA, 201 bp, Homo sapiens
aagccttgtgtcagatgagagcaggtatacgagtgctttggaaactccaaagctgtgttttttcaaatgtgatccatggaccagaagcagcagaaagtggraaccttctggaatgcagcctaagcctctcccagagggcagcaggatcagggcaagaaggagacagccctttagaaaggcagctgcccagtgaagcctaag

SEQ ID NO: 22114 - DNA, 201 bp, Homo sapiens
acacgtgcacatgtgcacacaacgaagaagagccacactggtggaggagcagggagtagctgtgagaggtgtgataccctccaatgggctgagacgacagrtggtggaggccagggcatggagacatgggtggtgcaggcctctctgagaaggagaggagccagccctggggaggtgaggggcagcgttccggacagcggg

SEQ ID NO: 22115 - DNA, 201 bp, Homo sapiens
tgttggcaacagtgcagcagcagcgatgacagcaggtagcgcccattttgccatgtgcaggcacggggttgttttacgttcattcatttaacccaatggasagtatctgtgttccaaacatcaaaaagggacagtaaaaatacggtcctataggactgccattgtatacatggtctgttgttgactgaaaggtcattatgt

SEQ ID NO: 22116 - DNA, 201 bp, Homo sapiens
atcgcttgaacccgggaagtgcaggttgcagtgagccaagatcgcaccattgcactccagcttgggtgacaagagtgaaactccatttcaaaacaaaaacraaaacagaaattagctgggtgtggtggtgcacgtctgtaatcccagctatttgggaggctgaggtgggagggtcgcttgaacccgggaggcggaggttac

SEQ ID NO: 22117 - DNA, 201 bp, Homo sapiens
cttgggcccagggcctgcagggtgtgctgtgacctcatctgaagaagcacccacacgggcaggccctgaggggctgcagcagagccacctcgatgcctctygagccccacccggccctacttatgccttccatctgcaccaacaccgatgagaagcttgcacctccccagtcttccctggttttgctcgtagctggctggc

SEQ ID NO: 22118 - DNA, 201 bp, Homo sapiens
gtcgcttgaacccgggaggcggaggttacagtgaaccaagattgtgccactgcactccagcctgggtaacagaatgagattctatctcaaaagaaaaaaaraaaagaaaagaagaagattgagcatggtggctcatgcttgtaatcccagcactttaggagcctcaggtgggaggatcacttgagcgcaggtgttcgggac

SEQ ID NO: 22119 - DNA, 201 bp, Homo sapiens
gcgcaggtgttcgggaccagcctgggcaacacaagagaacatgtctctacaaaaaattttaaaaattagttggatgtgctggtgcacgcctgtagtcccasctactcaggaggctgagatgggaggatcacttgagcctggaagttcgaggctgcagtgagctgtgattgtgccaccgtactacagcttaagtgacagagg

SEQ ID NO: 22120 - DNA, 201 bp, Homo sapiens
tctgccgggtcctgggcagtggtgagttgggagccagctcacacctacacataagagctgattgctaaattttaggaattttatgagccggttgttaaacrcaaccattataaaaaattctgaggccaggagcgatggctcatgcgtgtaatcccagcactttgggaggccaaggcaggcagatcccctgaggtcgggagt

SEQ ID NO: 22121 - DNA, 201 bp, Homo sapiens
caagggtgaatgggccactgttcttgccctcaaggggtctaaagtccaggagagaatcaggctctttaacaactgagtgtgccagagttgttccgccccayggtgccaccttgggcccagctcagccccttccttgcagtgtcccagagagttcttcttctctctacctcagtggagggcatcagagccattttcattcag

SEQ ID NO: 22122 - DNA, 201 bp, Homo sapiens
ttgttgttccagctctttctaatattgctggctagtatcatctgggtgaacccagctctttgccattttctcattctctgagagcttcccattaccttccyaaattaaattcaaattcctgagtaggggattccccacgcaccttgtcaactgtctaatgaccttcattcctgcgcgtgtcttcagcacccccggggcact

SEQ ID NO: 22123 - DNA, 201 bp, Homo sapiens
gggatgggcctcctgagttttccttctgataaggagcaatgcctgattgccggggggaggatagaaggcggccttggagacaagcacatctcacctcccarttcatgactgggatttgggtcccagcatgcctggccttgccccatcccgcccctgctgccatgggcacctgttccctttcctctccccaccaagaggcct

SEQ ID NO: 22124 - DNA, 201 bp, Homo sapiens
agtggtagcattgccgcatttagtgaaaaaaagagaaagtaaaagaaaaatacagccaggcatggtgtctcatgcctgtaatcccagcactttgggaggcygaggcgggcagatcacttgaggtcacgagtttgggaccagcctggccaacatggtgaaatcccatctctacaaaaatacaaaaattagctgggtatggtg

SEQ ID NO: 22125 - DNA, 201 bp, Homo sapiens
tgtattagtactattctgaaatcatcactgagatttaggttaaaaaggcagttgcagcactgtgagtgctgtgtgctccttctgtatgaaacaaggcatayctgcagatatgcaagttggcccatgcatgggagagttctggaaggattcttgagaagtcagtaacagtcatctcttctgggggactgggggattagggca

SEQ ID NO: 22126 - DNA, 201 bp, Homo sapiens
tcccagctactggggaggctgaggcgagaggatcacttgacccaggagttccaggctacagtgagccatgattgtgccactgcactccaacctgggaaatygagaccaaagcagcctcagtacctatcgatgggggctatataaattatacccccacaaaaaacacctacctcaaaacaaaaccaaacctactatgcagct

SEQ ID NO: 22127 - DNA, 201 bp, Homo sapiens
tgtgtctaatgagagttgaaagccagagagacctctcagagaacacaggtacgtggaggagttctggtcctgaccagcccaagcacctggtctttcccccmattccccaccttctttctgcttcaggaggtgggccctgcagagggcctctgaggccagagcttgacaagcgtgcttgggccagaaccgattccttgcttc

SEQ ID NO: 22128 - DNA, 201 bp, Homo sapiens
gctcagaaaggcaggggccatggatgggcagcaattctgagatccagctgtgcgcaaccatctccctgacccagcccgaattctttgcttgcgggggtcartccacccgatgtgggagggtgcggcctgggagagaccaccagggcaccggcagaggagaacgccttgtactgggtccattttgggagcccgggacgccct

SEQ ID NO: 22129 - DNA, 201 bp, Homo sapiens
tcggcttctaccctagaaagacgtccttgtaccatgcaaaagactcctcccttccctccttaccccatctcatttctggcatcagctcagaggccagtttrggggggctcctccagttgcccatctgcagacctgtggaccagtgatgggatgggcaggggacccctgcaggtaattccgctcagaaaggcaggggccatg

SEQ ID NO: 22130 - DNA, 201 bp, Homo sapiens
gatctctgagggtgtgaccccctcctcccaccccccaacaagaagaagatgagcgtctatgccatccctttcgttagattctcaaaggcctctatgattaytccccttgcccaaccccagaaaaggccaagcacagcttctctaggattgtcccgtagaaatgcagggcaggcaggggacttccttctttttccctgctgc

SEQ ID NO: 22131 - DNA, 201 bp, Homo sapiens
tgcccttggacaaccctttgtgccggatgacctggccgccgtgtattgagagcgcacacagaccaggcgctgtgcctgtggtgttcccccaatgcatccgyatggcagccccactttacacaggcggaaactgaggctggttaggggagtgctcagctgcaggacctcgtggccagaccccaggcaggtcagcctccaaag

SEQ ID NO: 22132 - DNA, 201 bp, Homo sapiens
ccttggacaaccctttgtgccggatgacctggccgccgtgtattgagagcgcacacagaccaggcgctgtgcctgtggtgttcccccaatgcatccgcatrgcagccccactttacacaggcggaaactgaggctggttaggggagtgctcagctgcaggacctcgtggccagaccccaggcaggtcagcctccaaagccc

SEQ ID NO: 22133 - DNA, 201 bp, Homo sapiens
tgtggaaatgcccaaagcccggctgctgggctgtgcctgggagccggagccctggtgtggggtgagggtgaggctttaggccagagcctgaagatgtggcycatcagttgctttaggctcctgggtatcttatgttttactaacacagggagcccacaccatgggtgagacataggagagatctgacattctggggcctgg

SEQ ID NO: 22134 - DNA, 201 bp, Homo sapiens
tgagtgtcagtttcctaatctggcagatggacacaagagtggcttggggcctggctgagacacctgcctaatggcaggggctccactggccctttctgctkcttcccatagcagtttcaagatgtccaggctccagagaaagaaataactgagtgcttctggggccaggcccggcctgctcgtggggtccatgtgcaaatg

SEQ ID NO: 22135 - DNA, 201 bp, Homo sapiens; identical to SEQ ID NO: 3609

SEQ ID NO: 22136 - DNA, 201 bp, Homo sapiens
gggaatcctggccctcagaaaggctaatgtggcttccctgccccttgggccatgcgctcccctccccaccccatgcatcacttccatcctgagaagtgccygagccccatgttacacctgctttaaaggcagatgaatgtcctgtttgaaccgcatgtgctttgctgcatggggcttggtgctggagggatgggagacggt

SEQ ID NO: 22137 - DNA, 201 bp, Homo sapiens
gctgggccttgctgaaagagttgcagaatcaagtagacaggaaaggatttctaggcagaggagctgcttggcaaaggctcaggaaattcttggaatttcayactgaggctcccccgtgtggtgtataaggtggtttctgttccactcccctgaggaagttgtgcaggagcacgggatagccagagcctgtggccttcgggg

SEQ ID NO: 22138 - DNA, 201 bp, Homo sapiens
ctgataaagaagaattgctttggctgggcgcggtggctcacacctgtaatcctagcactttgggaggccgaggtgggtggattgcctgagctcaggagttygagaccagcctgggcaacacagtgaaaccccatctctactaaaaaataaaaaaaaataaaaataaaaaattagctgggcatggcggtgtgcgcctgtaat

SEQ ID NO: 22139 - DNA, 201 bp, Homo sapiens
ccctcaaggggtctaaagtccaggagagaatcaggctctttaacaactgagtgtgccagagttgttccgccccatggtgccaccttgggcccagctcagcyccttccttgcagtgtcccagagagttcttcttctctctacctcagtggagggcatcagagccattttcattcaggaccctggtctgatgacattcccagg

SEQ ID NO: 22140 - DNA, 201 bp, Homo sapiens
acttgagcctggaagttcgaggctgcagtgagctgtgattgtgccaccgtactacagcttaagtgacagagggagaccctgtcttaattatatatatgagraaagtgtactgttacttggggaaatagtatattaattaacagacatttatagtatatgctgagtgccaggtgttgggctagatgctttaagcatgtacct

SEQ ID NO: 22141 - DNA, 201 bp, Homo sapiens
agatgggaggatcacttgagcctggaagttcgaggctgcagtgagctgtgattgtgccaccgtactacagcttaagtgacagagggagaccctgtcttaawtatatatatgagaaaagtgtactgttacttggggaaatagtatattaattaacagacatttatagtatatgctgagtgccaggtgttgggctagatgctt

SEQ ID NO: 22142 - DNA, 201 bp, Homo sapiens
ttcctctccagtgagccagggtagccacagtgctctgagggttcctgccccagttgtgggggcggggggcttttttcagtcttccagtggaacaggggccrtgtctgtccttgatcacagctcagaacagtgcctggtgcatagtgggtgctctacacatagttgctgaataaatgaatgtccaataactaatggttccca

SEQ ID NO: 22143 - DNA, 201 bp, Homo sapiens
tgcagggatgaaatcgggcagagaccctgctctcaacaagctgatggtctcctgggggtcatcatagctcgggtgacaggtgctgggatgagggtgctccrggggctggggacacagagactggggcgagcagctccccatgcatgaattcaggagggattcacagtgaggagtgtgagctgggccttgctgaaagagttg

SEQ ID NO: 22144 - DNA, 201 bp, Homo sapiens
ctgggccttgctgaaagagttgcagaatcaagtagacaggaaaggatttctaggcagaggagctgcttggcaaaggctcaggaaattcttggaatttcacrctgaggctcccccgtgtggtgtataaggtggtttctgttccactcccctgaggaagttgtgcaggagcacgggatagccagagcctgtggccttcggggg

SEQ ID NO: 22145 - DNA, 201 bp, Homo sapiens
aggatttctaggcagaggagctgcttggcaaaggctcaggaaattcttggaatttcacactgaggctcccccgtgtggtgtataaggtggtttctgttccrctcccctgaggaagttgtgcaggagcacgggatagccagagcctgtggccttcgggggaggtgccaacatagacagaagtgacccccccaaatacccacc

SEQ ID NO: 22146 - DNA, 201 bp, Homo sapiens
ctgttctgatcagtgggtgccctttcaaggagccaggttgggagagagatggatgctgccagccccaaggaggcccttccaggcttggtctgacatcatcrttatcctcagccacagagcgggagggtgctggctctggcacagctggcacatagtgcttgctctggcctgcacagtggggcccgtgtctcaggtcacccc

SEQ ID NO: 22147 - DNA, 201 bp, Homo sapiens
ccagagcctgtggccttcgggggaggtgccaacatagacagaagtgacccccccaaatacccacccagaatgttctccaggagagagactcaggtgcttcycttaatgcgctgggcctttgggcccctttctctctcgccccattttctgcagggaaaggcatggtctcactcaacgggcactgtgggcctgtggccttcc

SEQ ID NO: 22148 - DNA, 201 bp, Homo sapiens
gaaaggagggtgctgcgtgccaccagctggtgcagtcctgatgtcatctgcagcacctctggccaggctgccacagcccacggtggtgctctctctccccmcttccctcccagttgaccggttcactttccccgccctggaagaggatgtgatttatgacgacgtcccctgcgagagcccagatgcgcatcagcccggtat

SEQ ID NO: 22149 - DNA, 201 bp, Homo sapiens
tccaggagagagactcaggtgcttcccttaatgcgctgggcctttgggcccctttctctctcgccccattttctgcagggaaaggcatggtctcactcaaygggcactgtgggcctgtggccttcctggctgtggctaccagcatcctggcccctgacatcctgcggagtgaccaggaggaggctgaggggccccgggctg

SEQ ID NO: 22150 - DNA, 201 bp, Homo sapiens
ccctttttcttttctgtttgttcactgatgtgtcccaagtactcagaacaggacttggctcatggaggtgcttaataaatgtgggttgaatgaatgaatgrttggatgaatgaatgaatattacctaattgggtctcaggagtgtcatgacacccagtttgcagatgaataaactgaggcttagggaggttaagttgcaca

SEQ ID NO: 22151 - DNA, 201 bp, Homo sapiens
cacagcatcatctgggtgccagcaaaggaaatctgacaaacctcacctgtcaggggccttgtgctgtgtggatcaccctgcttccctaaaaatctttgagktttcttggtagtttcctgctgtccctgaagcttgctggtcttccagcccctgcatctgtggctggtggattctcaaaaaaaatccatgttaatatcaagc

SEQ ID NO: 22152 - DNA, 201 bp, Homo sapiens
taattgagagctgactttgccattgagtaaccctattcaggatgactcaggcatctgggaggaaaagcagcagtggtgtctgaggacagaccgtggacaarttaagtagcttggggcttgtggagttgtgatgtccaggacatgggtggctagagctgacataggcaacagtgggcatgacctgtccatatggattcagga

SEQ ID NO: 22153 - DNA, 201 bp, Homo sapiens
cactgaatcagaatctctgggtgtgggcctgggacataaatatttttaaaaagcttcacaactggaaaccactgtgtgaaatgggtctaaggaagctttgyagaggagaaatggggtctggttttgatgactgaacaggaatttgcttgctggttgtgagagagaattccatgtggagggaacagacagcttaagcaaagg

SEQ ID NO: 22154 - DNA, 201 bp, Homo sapiens
gacgggattgtgaccaaggaatgcaggtggcttctcgaggctggaaaaggtgggggatggcttctcccctggagctgcccctgctgaaacctcgcttttartgagagcacagccctgccgaaacctcgcttttagccctgcgaaccccttgatggccttctgacctccacacctgtgagaacagatttgtgttgtaagtca

SEQ ID NO: 22155 - DNA, 201 bp, Homo sapiens
agggcagcagtgtgtgggtatctgggggaacagcatttcaggcagtgggaacagcaagtgcaaaggccctgaggcagaaacatgcttggggcattcagggwgctggaaggtggtggtgactagagtgagctgtgtggagagaggtaggacatgaagtcgggggggttgtgggggctctgacacgtggggcctcagagatca

SEQ ID NO: 22156 - DNA, 201 bp, Homo sapiens
gagggcagcagtgtgtgggtatctgggggaacagcatttcaggcagtgggaacagcaagtgcaaaggccctgaggcagaaacatgcttggggcattcaggkagctggaaggtggtggtgactagagtgagctgtgtggagagaggtaggacatgaagtcgggggggttgtgggggctctgacacgtggggcctcagagatc

SEQ ID NO: 22157 - DNA, 201 bp, Homo sapiens
ctgactccagctaatgcgatttctggtcttctttccacaggtgtgtagctgggacggtgctggtctgagctggaccttgtctgatggcttcctccaaccckcctccacagcctgccataggtaccgtacccagggcttcctgtccctctcatcctttcttagaagggggccgctgggggccggcggagggccttgctctgg

SEQ ID NO: 22158 - DNA, 201 bp, Homo sapiens
tcccctggcctggagcagtgctcagagccaactcccgccagaggtgccccagaacagctggaactgcactcacacccttatctggggaggacagcacatcrctgaggggtgtggtttgaatcataagtgctggctgctctgaattcagccagagctatcctgggctgtgtggctgagggcccccgggggtcctggggctcc

SEQ ID NO: 22159 - DNA, 201 bp, Homo sapiens
gacgccagggtctcacacctgccccgtgggaaaggctggggtatgtgcctgcctggtgacggtggcagccgcggaggctcgcggatcctgtcccctttgcyggccacatgcttctgactcatcagaggaagaatgtggtctttttgggagagagtttttaaaaatagtccaagtcctcctctggccctgtcccactcctcc

SEQ ID NO: 22160 - DNA, 201 bp, Homo sapiens
gtcctgtgccctaaaggatgtttagcggcttccctggcttccacccaccagatgccagtagtgtcccccctccccacctagtgtggcaaccaaagtgtctmctgccattgccaaatgtcccttgggggacacaacagcccctggttgagaaccatggcctcccatagatctgtaaagctgtaactataaatcaaggtggga

SEQ ID NO: 22161 - DNA, 201 bp, Homo sapiens
agacgccagggtctcacacctgccccgtgggaaaggctggggtatgtgcctgcctggtgacggtggcagccgcggaggctcgcggatcctgtcccctttgycggccacatgcttctgactcatcagaggaagaatgtggtctttttgggagagagtttttaaaaatagtccaagtcctcctctggccctgtcccactcctc

SEQ ID NO: 22162 - DNA, 201 bp, Homo sapiens
ccctcctgcttaacatttgctccttgctgctgcatcccaggcattgcagacgaactatccatgcttttggtcaccctttcaaggagcactaactggtggayggcccccctccaactcctcattgcctgaatctaggctcaagtctgctctcaggagtttctgcagcccccaggtctcccgaagggaagcccagctgctatt

SEQ ID NO: 22163 - DNA, 201 bp, Homo sapiens
ggtggagcgcagtggcgccatcttggctcactgcaccctcgacctcccaggctcaagtgatcctcccactttagcctcctgagtagctgggactacaggcrtgtaccaccatgcctggctaatttttgtattttttgtagacatggggtttccccatgttgcccgggatggtcttgaactcctgagctcaaggaatctgcc

SEQ ID NO: 22164 - DNA, 201 bp, Homo sapiens
ggcactgggaggtggggccaggcttgactgggaggagagggagatgctggcttttccttggtcctgccccccgcagccttgcagtcagaggcagccccaaygagccctctgcagttctgagtgccttcctctcctgtctcgcagagggggagcctcacaaaccctgacagcagaagtgacttgcccagcgtcgatgggcgc

SEQ ID NO: 22165 - DNA, 201 bp, Homo sapiens
ttctaagtctgagagcaaccagtgggcctcaaaggcgattgagggctgcttcccctgccctgcacctcccccccgccccgtcatgctggcagcccgggagyagtctctcacggttctgtgggcagctggagatggggcagaagcgggcgtcagctccacagtgggggcactgggaggtggggccaggcttgactgggagga

SEQ ID NO: 22166 - DNA, 201 bp, Homo sapiens
ccactgcgcctggccctcaagcatctcttgaagacctgccaggaggcactgtggggacacccagggaggagccacagtttctgtcctctgggagctgacaygtgagcaagagtgagaacacaggtttaggggctccaggactgggtttgaatcttgggtcttagtagctgtgtggtcttgggcaggtgcctttgccttgct

SEQ ID NO: 22167 - DNA, 201 bp, Homo sapiens
aatagctgggattacaggcatgcaccaccacacccagctaattttgtatttttagtagaggtggggtttctccatgttggtcaggctggtctcgaactccygatctcaggtgatctgcccaccttggcctcccaaagtgctgggattacaggtgtgagccactgcgcctggccctcaagcatctcttgaagacctgccagg

SEQ ID NO: 22168 - DNA, 201 bp, Homo sapiens
agcagttaaaaattgagcatcctccactcttatgttatttcaccattttccttgaagaagcttccaaatttgggctgggggcttgagctgccatgccaaakaacagctgtattgtataatatagcctagtaggtctataggatatacaataaccacagctatcattataagggtaatagctattttctttctttttgagac

SEQ ID NO: 22169 - DNA, 201 bp, Homo sapiens
ctttcttccagggaaacttctctcctccacccacgcctgtctcgccaccccccacctgactgtcttgaatgttcccatcctgtgactcaagtgaggaacawgggttttggagatggattttggaggcagagggacctggattcaaatcccagccccaccaccgtcaacagcctgcacttcactgtaaactcggaatgacac

SEQ ID NO: 22170 - DNA, 201 bp, Homo sapiens; identical to SEQ ID NO: 3716

SEQ ID NO: 22171 - DNA, 201 bp, Homo sapiens
aaaagcatggaatggggaaagctgtagctgttatggcaggaattgggacacaaggagacagacgctgagcacctagactgccttcaaccctccattcaccrgtgatttcctgggttgttcacttgcttctgatactccccacttacaaaccctgatgaaaacttaaaggcaagatctatttatggcctctcaatccagcct

SEQ ID NO: 22172 - DNA, 201 bp, Homo sapiens
tgggtttgaatccccacttccccgttcaacagctatgtgttcttagaaaaggctcttaacctccttaagcctcaatttcctcatctgtaaaacagtggaartaatacctactacccagattgttaggaagattgtgctttacttgtaacatttgtttaaaaacatgaaatctgttcgaatagaggttaaaataaaaaactg

SEQ ID NO: 22173 - DNA, 201 bp, Homo sapiens
tcgggctgggtgattcctttccactcaacatctcaggtcacttaagggcacttgtctgagcagaatgggctagaaaggcattgtaacagtattctccccayctcccaccaaaaatattcctcccagagagcctccagcagccaggggctcctctcattttcctgcgtgtgatggaaaatgtctttttcacttcattgcagg

SEQ ID NO: 22174 - DNA, 201 bp, Homo sapiens
ttcttaaagaagcaaggtgttagcttcatggggtcttgttttgatctagttcaggggtttccataaaagcagaagccatgacaattgcggacatggttctmtaggagatgagcagggcttgggaactgtagccccaggtgaccagaaactcatgttgatactgacttggttaatgagggtcccgtgcacagcctctctgtt

SEQ ID NO: 22175 - DNA, 201 bp, Homo sapiens
tgcttgagtgtccatcctcgggtgtaccaggagagaggcaatccggcgcagtagctgtgagtgtgggggccagcaggcctgggttgggttgtggctcggcyactgggcattgtgcagtaaaggagactgtgactccctcacctcgtggggttgttgtgaggatcagagggaaggtttgtgaggtgcctaaaatgtggcagg

SEQ ID NO: 22176 - DNA, 201 bp, Homo sapiens
ggggtggggcccaacaatctgtgtgtttttaaattaattttaaaataatggacatataataattgtacatatttatagagtacagtgtgagatttcagtgyacctttacattgtataatgaccaaatcaggataattgccatatttatcactttaaatatttatcatttctttgggatgataacattaaaaatctactctt

SEQ ID NO: 22177 - DNA, 201 bp, Homo sapiens
atatttctccagataaagcagttaaaaattgagcatcctccactcttatgttatttcaccattttccttgaagaagcttccaaatttgggctgggggcttkagctgccatgccaaataacagctgtattgtataatatagcctagtaggtctataggatatacaataaccacagctatcattataagggtaatagctattt

SEQ ID NO: 22178 - DNA, 201 bp, Homo sapiens
tgctgagcagtttcgagccaggcagggaaacacaagactgaaactgtgaaggtttctggcaccactttttgatcctctgaaggggccttggaaatcagacraccccaatcccatcgaggctttctatcttcttgccaaaaggaacttctttaaggtagttctaagagctgtcttaggcagagagttgggtttctctaaagg

SEQ ID NO: 22179 - DNA, 201 bp, Homo sapiens
cagggaagggtggggcttccaggcttggccaccttcagggtggactgatcctccttgaagtctgcgcttcaggagtcccttcagtctgcggcagggagtcrtgccggaaggcagcctggatgggtgcgtggggaagcagccagggggctctgtccactcctcccttctgctcaggaagccactggagtctgtggggctggg

SEQ ID NO: 22180 - DNA, 201 bp, Homo sapiens
gttgacagctgccacaaaggccatgatgagagtcaatggagatgatgacagtgttgcggccttgagcttcctctatgattactacatggtacgtctacccsctctggacatgccccgttttgactgaatgggtgtcttcacttcaggcctcatggctcagcagcccaccatgaccaccccagcccctcatctctgggcctt

SEQ ID NO: 22181 - DNA, 201 bp, Homo sapiens
cccaggtgattacagtgtgcagtcaaggctgagaaccacttctctggagaggccacagttgtacaggccttggaggctttgtaacctctcggtatctggcrgggttaatgtacagaaagactaaacagcgtcagtcaaagcctgctgggagatcagaaaaggagcctggcagctccccacccaccgcgaatctgtgcagcc

SEQ ID NO: 22182 - DNA, 201 bp, Homo sapiens
gtatgcccctgccaagagtgaggcccagttttgtcttttttttttttgagacagagtctcgctctctcacccaggctagagtgcagtggcgcgatctcggytcactgcaacctccgccttccaggtttacttaggccattctcctgcctcagcctcccgagtagctgagactacaggcgcctgccaccatgcccagctaat

SEQ ID NO: 22183 - DNA, 201 bp, Homo sapiens; identical to SEQ ID NO: 3714

SEQ ID NO: 22184 - DNA, 201 bp, Homo sapiens
ggtgtgtgtacaaggatgttccccagccccactggctgagttgccagaggcttccccttaagccccagccagctattgaaatcataattctaaaaccttcyatttatggggcacttcctacatgccaggcactgggctgcatcactcccaagcatcatctcgttgaccctttgagctgggtatcattatctctgtttgtac

SEQ ID NO: 22185 - DNA, 201 bp, Homo sapiens
acagttttaaagacaggattcgtattactgatgtttccttttgcctcgggttcccattaggcttgcctgcccctgtgggagggacccagtggggcacccaragttgctctgcccaggcgaggcctcactgtggctgtgacgcacccttgatgtcagaacgaggtgatgtgtgaaggttaaatgacagaggagtgtggaacc

SEQ ID NO: 22186 - DNA, 201 bp, Homo sapiens
gggcaggccacttacccagcggccccctctgtctccaggtgttcatcggcgtaaactgtctgagcacagacttttcctcacaaaagggggtgaagggtgtscccctgaacctgcagattgacacctatgactgtggcttgggcactgagcgcctggtacaccgtgctgtctgccagatcaagatcttctgtgacaaggtgg

SEQ ID NO: 22187 - DNA, 201 bp, Homo sapiens
gcaggagcaggcatgggaaccagggcattgggactcccagcccctgaccagaaactcttccagtcatcatcttgccgccttcctcctgccttgtgtgggtrggaaattcctttctgccttgcaacagagaattagttcaatgtattttgagaagggaaatttccagaataggaaaggcatctagaaaagagactagcacag

SEQ ID NO: 22188 - DNA, 201 bp, Homo sapiens
cattctgctgccccacactgcctaatggtggcagaagaggcagtttcatgttttcaaagctaataactctgaattcctgggcgttggcctgcggctgcccrttcacggaccttcctctgggatagcctaaatttgactctccttacttgcattcagtttcaggtctgtgcggctgctaaagaacgacccagtcaacttgca

SEQ ID NO: 22189 - DNA, 201 bp, Homo sapiens
ttcagacacccccacataagcacagcttaagagggtgcatgggaatctgcagagccggccaaagggcctcccagctgggcaaagacccgcagcagaagtcratcttcaagtaacgttttcagattccccagcccctgagatgatcctgttcacattatcttccttgcactcaagctggcccttgcttttcagttctgctgt

SEQ ID NO: 22190 - DNA, 201 bp, Homo sapiens
agtatacactacattgttctttgctgtagtcaccctgctgtgaaagcgatctatgttttaacaagccttccaagtcattctcatgcagctaaagtttgagracattattctgtaccattgcatcaccctgaaggagcttgaatcccctctgggccactcacttactgggaccttggacaactctcaacttatctgagcttc

SEQ ID NO: 22191 - DNA, 201 bp, Homo sapiens; identical to SEQ ID NO: 3715

SEQ ID NO: 22192 - DNA, 201 bp, Homo sapiens
cttgggctgcccttggcagtctagcggaaactgtaccaacagcggtgaaaagcctgggctgtgagtctgggttcaaacccctgctgcaccacacactgccygtgtcacctcgggaaagttgccccacctctctgagcattggcttccccatctgtgaaagaggagtgctgatgtttgccttctaggggcctagtgaggctt

SEQ ID NO: 22193 - DNA, 201 bp, Homo sapiens
ggacattttctcgttctctgcaagactcaggttcctttatcttaacagacgaagcaaatgatccttaccttgtagtgtccttgtaagaagcacggcctaaygaacagagaacattcatatgcattatcgtaaatggcagctggcattgttcttaggtccctaacatgggagattctgcctggcccatgtagaaagggaggc

SEQ ID NO: 22194 - DNA, 201 bp, Homo sapiens
ttgtgctgatgcgttatcctcatgatattatttggtgggtgcttttattagactcgtttacaaatgaggaacagtgctaagcactggtggtccctgttgayccagggggtgggatcagtcaggcatttccctgcttttcccatgcctcgttggttgggagtttccattagctccgggctgggcagacagtgagggtggcca

SEQ ID NO: 22195 - DNA, 201 bp, Homo sapiens
aaaacagggcgcctgctgtgttccaaccacatcccctcttccattccagaatcttagtcaacatggacaacaacatcattcagcattacagcaaccacgtygccttcctgctggacatgggggagctggacggcaaaattcagatcatccttaaggagctgtaaggcctctcgagcatccaaaccctcacgacctgcaagg

SEQ ID NO: 22196 - DNA, 201 bp, Homo sapiens
gtcgagtgcttgataaatacacgctcttctttaaaccctcccaacaaactaatgcgggatgggagtgtaaatgcagttttgccgaagaggggacccagacytggttcaggcttgcccaaggtctcacggaagcactgggatcttaaccgggtcttagccgagcagccataggccaccccgcttcctctgtgcttagcctct

SEQ ID NO: 22197 - DNA, 201 bp, Homo sapiens
aggagccttcaacttttctatcccttctgtgctgaccagaggtatgtggcttgcccacacccccttcacacccaataaaagcctgttctcctttactcccycaccccctgccaccaacacacaccccccagattgtaaactcctttagaacagtaacccctgttttttctggcctcagtttctccagaacccagagtaggg

SEQ ID NO: 22198 - DNA, 201 bp, Homo sapiens
gtgaaatgaccagctggctgaggcttcagaggagccttcaacttttctatcccttctgtgctgaccagaggtatgtggcttgcccacacccccttcacacycaataaaagcctgttctcctttactcccccaccccctgccaccaacacacaccccccagattgtaaactcctttagaacagtaacccctgttttttctgg

SEQ ID NO: 22199 - DNA, 201 bp, Homo sapiens
cttgagaccacctcctttggtgttgggttttcttcccaccttctggaaagttgagtgagtactttcttttctgtagcttaactactgagtcccatcctgcygtatgctgcatgtccttaggcaggtgcctctctggaactagacctctgaggtctgtctgcatcctaaattgctaggattctaacagaaggaaatgatacc

SEQ ID NO: 22200 - DNA, 201 bp, Homo sapiens
atctcataacccagcctgggcctgcagctggctcagggccagtcccctccactgccaggaacagtgggtttgggtacatggggacctttctcaaaactaatttttttttttttttttgagacggagtctcgctctgttgcccaggctggagtgcagtggcgcggtcttggctcactgcaagctccgtctcccgggttcaag

SEQ ID NO: 22201 - DNA, 201 bp, Homo sapiens
cctcaatatggtgactaagggagcactgcgtctcccccagatctacatactagttgcttgagtgtccatcctcgggtgtaccaggagagaggcaatccggygcagtagctgtgagtgtgggggccagcaggcctgggttgggttgtggctcggccactgggcattgtgcagtaaaggagactgtgactccctcacctcgtg

SEQ ID NO: 22202 - DNA, 201 bp, Homo sapiens
taccctccagggggcaggcagtgcctggctgcctaccatgggctcctgggcaccagagtacctttgttgtctgctcagaagatcccttgggaaagggaggyagggtcacatggtaactgtcctccagacatcagtcccctggtcagagctagtgagcctgtcctctgcagcccttcctgagtaggtgacttcaccagcctg

SEQ ID NO: 22203 - DNA, 201 bp, Homo sapiens
gagaaagaagcatcccacattccacagatttgccatcccaagaccagcaggtctttagaggccactgtaacattgacattccagaatcctactaaatatcrtcctggggaggcaggaggcaggagtggaaaagcaccgggctggaaatcaagagactctgcataaccctttaccactcacaccgccattgttttcaagtct

SEQ ID NO: 22204 - DNA, 201 bp, Homo sapiens
ggccaaagccactggtcacctctccatctgcagagaccagacatgggtcacaactgggaaggatgggagtgggagacaagtggaagggttgttacatatakgacctcctgggtggggtggagggagaagtggagggtcatgtgtcagaagacccaggttcaaggccactgggaaaccaagccatttgattataaagataat

SEQ ID NO: 22205 - DNA, 201 bp, Homo sapiens
tagtgagctggggacccctggatctgtttcttcatctgcacatggcaatcatgatgggacctactttgaggtcagggttgtcaggataaatgagatgacgyacctaaaacacagtactcaggataggcctggcacacagtgagagctcagtgtgcattgctggagatgtggagctaaccagaaatggcaggccgtgtatat

SEQ ID NO: 22206 - DNA, 201 bp, Homo sapiens
gtctccacaggtagcttgcacgaggccagccagctggtacatgggtgcaccctcagcactaggacagtttcaatatctcatgggcaagttcagggaaatgstagatgctcttcaggatatttttcagccactaaaaatgctgcttgacaagtgtttgttgtgacataggaaggcttatactaggatgataagtaaaaagat

SEQ ID NO: 22207 - DNA, 201 bp, Homo sapiens
aagatgtcactaaggcagtctagtggggaaggcacagtttctagacacagccaagacctgcacagcagcaagctgtctggaagaggactggtcacggcacyggggcagagccctagctccactggtagtgagctggggacccctggatctgtttcttcatctgcacatggcaatcatgatgggacctactttgaggtcagg

SEQ ID NO: 22208 - DNA, 201 bp, Homo sapiens
cctatgaacaaaatgtacttttcacttggtgctttcaccccaaattatgtcacttgtcacctcacaacagcctcagagttaggcaagcagggttattgccytgctttatggatgcggaaactgaggctcagagaagtgaagtgccttctagctgtgaaagtcaccgcagcaggactggaccccaagcctgtcttactccaa

SEQ ID NO: 22209 - DNA, 201 bp, Homo sapiens
aatgcccagagaggatgacctccacctgaaacccaggacctgaggtttgctgcagcttctaggcagctagtactaatcaacaccgacgtcttacagagctktttccctgggacaggcactgggctgagccctttacacaatcgtctcagttcgtgtgcagaaccacagtgtgtgtacatcctattactatgcccattttac

SEQ ID NO: 22210 - DNA, 201 bp, Homo sapiens
agctagtaagtggcagagccaggatctggactgaggcacctgttcagaatccacacctttccccactagctgctccgcctctcaagcagccgggactgagygcctggcagccaggagtgggctgggttccctgttacagctgtcctccgagagactgcacctacccccttttccaggcacggtcccacaacaattcaatgg

SEQ ID NO: 22211 - DNA, 201 bp, Homo sapiens
cctcatttactcaccaggcccaccccagctcccacctccctcatgggctttcccaaagcctccttggggtggggcacgaggcgctgccttaccccttggarctaggtttaggttaagacttgggggtgggggtaaggagggaacctcaggctgcttggagagaccaccacaggactggcggcttctgtctcctgacctcgt

SEQ ID NO: 22212 - DNA, 201 bp, Homo sapiens
tagctgtgaaagtcaccgcagcaggactggaccccaagcctgtcttactccaaagcccccagtccttccacccccccaccccgcctcacatctgacctgayttcttttaaaaaggaacgatgatgatgacgatgagtccacatttattgaggccctcctgtgcgtcacagtgttctaagcgcagtgagcatggtctcctgt

SEQ ID NO: 22213 - DNA, 201 bp, Homo sapiens
atcaatggcatttgatgacccaagaatgacaaacagttccagaagatttggtttttacaatcatttaaaacaatcctctgacctgggccaggcaggcctgrctgaggcggcgccgctgtccaccggctggtattggacacgaatgatgcactagagatgaaatgcttgcgggggcctaagtagtccacgatctcatactga

SEQ ID NO: 22214 - DNA, 201 bp, Homo sapiens
ggggctggaaatgggaagtggctgaggccttttttttaagctgggtgctccctataacaccagctaccttttattgggtacctatttgccataggttttaygtcaatatctcatttaatttaatccccaggctgaccccactgaagcatgatgggaaattacatacagacctgaagtcatgggtgcaaagagaaggcactg

SEQ ID NO: 22215 - DNA, 201 bp, Homo sapiens
caggcacggtcccacaacaattcaatggcagggtcaagaccccagagcctgtctcctagtgcgcttccatactggagagtctgagcatttccttcctttargggtacagctccgcactgtttcttcaggaatatttatacaaatggaccttggtgtacaaggcatgtttagtgtattgacttaggacaatgaggtgtagac

SEQ ID NO: 22216 - DNA, 201 bp, Homo sapiens
tttctgttaggtccctgctccttccccacattgctgagtgaaataatccccagtgctgagtttccccaactaaaatgtctgcctgctccagaaagcctttyctgatctctttcctttgagcccttgtggcttgtctcttgagcgagataatgccttgtatttgtccaagcttctcagcaccagtacccgggtccttcctgc

SEQ ID NO: 22217 - DNA, 201 bp, Homo sapiens
agccacccctattgactctccattatcttactatgttaattttcttcatagcacttattactaactaaaaataactaatttacctacttgtttatggtctrtcttccccaattagattgtaagttccatggaagcagagtcttatctgtctcattttagttgattcccagtgctcagaagagtccctgactggcacactgg

SEQ ID NO: 22218 - DNA, 201 bp, Homo sapiens
ctccctcatgggctttcccaaagcctccttggggtggggcacgaggcgctgccttaccccttggagctaggtttaggttaagacttgggggtgggggtaasgagggaacctcaggctgcttggagagaccaccacaggactggcggcttctgtctcctgacctcgtgtggacgtgggagtcctgggcagctggcatagtca

SEQ ID NO: 22219 - DNA, 201 bp, Homo sapiens
cctgtgagtctcagaacaatactatcctaacacataggtaagtcttagcacagtgcttgcaaaatacaaacgctaactaaacagcagccctcattatttaytgtcattattgtggatataattattatgttacaagtaattggctggtctctgtttatgtttttttaaactttgttttttttttttttttggaatagctgt

SEQ ID NO: 22220 - DNA, 201 bp, Homo sapiens
aatgatagtaattttaattgcaaaatcaaaatgagatcagatagctgagctcgctgctgagagcctgcaagccagacagcccccctgcaagccagacagcmcccccgtctccattcctgtgcctcccaggggatcactgggcaaggactcagtcttcactctcttcatccctgcccttgtcccaggaaggatagggacaca

SEQ ID NO: 22221 - DNA, 201 bp, Homo sapiens
tgcagggagctgagaggaagatgcgcgatgacgagcggaagcagttccggaggaaggtcaagtgccctgactccagcaacagtggtcagtggggatccagrgcctgggtgggctcggctggcgtgaaggggagaaggagaccagaggtgggagggacttgagtggagggacctcggggcacattggcttccttctcccatc

SEQ ID NO: 22222 - DNA, 201 bp, Homo sapiens
taccattgtacttactaaagatatttttaaatgttttggaagaggccagtgaaggcagagcctagggctcttgaaagtcctaatgaaactcagcttgaaaacacacacacacacacacacacacacacacacacacacacacacacacagacacacaccccagatgcctataggccatgtgggctggagtttactgaaaac

SEQ ID NO: 22223 - DNA, 201 bp, Homo sapiens
accattgtacttactaaagatatttttaaatgttttggaagaggccagtgaaggcagagcctagggctcttgaaagtcctaatgaaactcagcttgaaaacacacacacacacacacacacacacacacacacacacacacacacacagacacacaccccagatgcctataggccatgtgggctggagtttactgaaaaca

SEQ ID NO: 22224 - DNA, 201 bp, Homo sapiens
tattgaagagaagaatgttatgaagaaacagatttcgtaaccattaaaacgttcatgcttagggcacacaaagaggaggcttctgatatctgaccccaaayttgattgcagccccatggaattctcacggcagcacttgtggtgctcactgtgtgccaggtgcggctctgagcgcttcccaggcatcaccgtccttaccct

SEQ ID NO: 22225 - DNA, 201 bp, Homo sapiens
atgttatgaagaaacagatttcgtaaccattaaaacgttcatgcttagggcacacaaagaggaggcttctgatatctgaccccaaatttgattgcagcccyatggaattctcacggcagcacttgtggtgctcactgtgtgccaggtgcggctctgagcgcttcccaggcatcaccgtccttacccttctctacagccctg

SEQ ID NO: 22226 - DNA, 201 bp, Homo sapiens; identical to SEQ ID NO: 3717

SEQ ID NO: 22227 - DNA, 201 bp, Homo sapiens
tggcaggcacgagaaccctggggcgcccctgtcgtgcccagggaacatcgtgtgtggggctgactggaaaatgattcctctgtgagcagttgtgtcagggcctccctgtgggtgattagagagtgattgatcactgttaatgaggttgggtggctcatggcaggatttagcaagtcattgggagtatctgggtgtcaacac

SEQ ID NO: 22228 - DNA, 201 bp, Homo sapiens
aatccagggcacaggaatcccttttcctccctggattgaagtgtggttcttgggggagagaatgtatgcccctgccaagagtgaggcccagttttgtcttktttttttttgagacagagtctcgctctctcacccaggctagagtgcagtggcgcgatctcggctcactgcaacctccgccttccaggtttacttaggcca

SEQ ID NO: 22229 - DNA, 201 bp, Homo sapiens
ttgggttcagggagtggggagtttcgtgggaagggagagatgggtttcggtggggattttctcacagccttttaagcccccaggcttgggtctttctcagrtgcgagctgggcgggggctgcatgagggcagagctggctgagggggaggtatgtctggcatgtgcctgggggcctggtctgcacagccagggaaagaagg

SEQ ID NO: 22230 - DNA, 201 bp, Homo sapiens
gtttagtgtattgacttaggacaatgaggtgtagacagtggcgctgagaagagcggccagtgctgacagagcttggcacaggcgcagagcactgtctgtgyccctcctctctttgccatcttgggagctgcgctgtggccccgcagcacaggcggctgtgtgaacctgttctctcttggctctcctcactctctcaccaac

SEQ ID NO: 22231 - DNA, 201 bp, Homo sapiens
cttggcagtctagcggaaactgtaccaacagcggtgaaaagcctgggctgtgagtctgggttcaaacccctgctgcaccacacactgcccgtgtcacctckggaaagttgccccacctctctgagcattggcttccccatctgtgaaagaggagtgctgatgtttgccttctaggggcctagtgaggcttaagggtgagca

SEQ ID NO: 22232 - DNA, 201 bp, Homo sapiens
ctcattctgcagacaaggaaaccgaggctcagtgaggtgaaaggatttgtctgaagccgtatatggctagtgagcggcagagcccagcttcctgcagcagrtgtgggcggcccctcctccaggctcactttgttatgccccacgcctgactccctaggggaacggcagcaattatagccctgctcagagcatctgtttccc

SEQ ID NO: 22233 - DNA, 201 bp, Homo sapiens
agcctgcgtcggggggaccggggttcccatggagccccagaggaggacaatcaccaggtgaccttgccagggtttgccccgctgagactgaccccaggcgwccatcagttgggcataggctttgggatgagacttccagctgtccctctcatggcaacggttataacatatcaagcctacacaccccacagccacacaaga

SEQ ID NO: 22234 - DNA, 201 bp, Homo sapiens
catggtagtccaggtatacctgagtttactggaagctgagcaggcagatgccggcacgtgcacgtgcccaggaaacccctcgcagaagcccaccttggcaygggtgatcagagcggcaggagctgcctgtctctgtgtgccaggtgcctagcaccacatacggcatggaaaagtcattcgggcaatgcttccagaggatgt

SEQ ID NO: 22235 - DNA, 201 bp, Homo sapiens
accctgggctcccccaaagccatccacatcaagtcaggcgagtcacccatggcctacctcaacaaaggccagttctaccccgtcaccctgcggaccccagsaggtggcaaaggccttgccttgtcctccaacaaagtcaaggtgcgttggcctggagcagcttcagaaggggtggaatggggcaagatatacctcctcctt

SEQ ID NO: 22236 - DNA, 201 bp, Homo sapiens
ccagcctgcgtcggggggaccggggttcccatggagccccagaggaggacaatcaccaggtgaccttgccagggtttgccccgctgagactgaccccaggygaccatcagttgggcataggctttgggatgagacttccagctgtccctctcatggcaacggttataacatatcaagcctacacaccccacagccacacaa

SEQ ID NO: 22237 - DNA, 201 bp, Homo sapiens
tgagtatttgagcctcttaggtgagagtaatataaaatgtgtaggatattaaacagggtaacaaaaatccctgtatttacttttaaaaatctgtgttaatwttgagtcaccagctgcaatgccaatgccaaacatatattttatttactttttttgttttttgagacagggtctcactctgtcacccaggctggagtgcag

SEQ ID NO: 22238 - DNA, 201 bp, Homo sapiens
ataatgttttcatttattttaaaattaaaagaaaaaaatcaatataatccaacttggattatattcatctttataccattgtacttactaaagatattttwaaatgttttggaagaggccagtgaaggcagagcctagggctcttgaaagtcctaatgaaactcagcttgaaaacacacacacacacacacacacacacac

SEQ ID NO: 22239 - DNA, 201 bp, Homo sapiens
gagttctggataattagaaagcattcaagtgttagaaaaggacggctgtcagcaaggtcctcatgttcagcagcgcatgtcccgtctggtaaatggtgccrtcattgttcagtacacaactttcacagacacacagaggagccctggctctcagtgctcacttacagtggccctaacttttactcctccccaacatgccaa

SEQ ID NO: 22240 - DNA, 201 bp, Homo sapiens
accccctcaccaaggaaggaattggccagctccacccagccagtcccccatagctccgccctcctcggcgggctaagagttaacagctgcacctgttgagktatacctccagtcgccggcacctgtacctgtagccaatcagcgccagcgctgctgggaacctacctgtcagcaaaatctcgacacccaaacctcaacata

SEQ ID NO: 22241 - DNA, 201 bp, Homo sapiens
ctaccagaatcagcagcaccagggaaatcgctagaaatgtacattctcagccacccagagccagtgaatcagacactccaggggtggggcccaacaatctrtgtgtttttaaattaattttaaaataatggacatataataattgtacatatttatagagtacagtgtgagatttcagtgcacctttacattgtataatga

SEQ ID NO: 22242 - DNA, 201 bp, Homo sapiens
tgagagatggagcctctggtgatgttttcatgccagtagttaagccattaagattcttccagccttagtgcttgagcccagccgcgggcttgccatgtgckcatgggcctcgctgtgtcttggtttgctgtttagagagccagcatggtggagaggcactagtgtgggagtcaggagctgagcaccttcggcctgtccctt

SEQ ID NO: 22243 - DNA, 201 bp, Homo sapiens
aggattggagtgcagagcccacaagatcatgcatgtctacaaaccggagaggcctgagagatggagcctctggtgatgttttcatgccagtagttaagccrttaagattcttccagccttagtgcttgagcccagccgcgggcttgccatgtgcgcatgggcctcgctgtgtcttggtttgctgtttagagagccagcatg

SEQ ID NO: 22244 - DNA, 201 bp, Homo sapiens
tctcatactgaccaggacctgggaaaggtggcttcggaggcagaggcgaaggctgagcagagaagttcaggatggggtttttcctttgggaaagataaaaygggaagatgtcactaaggcagtctagtggggaaggcacagtttctagacacagccaagacctgcacagcagcaagctgtctggaagaggactggtcacgg

SEQ ID NO: 22245 - DNA, 201 bp, Homo sapiens
gtgatagggagctcagaacttgtaccttatcagaaaactgaggttcttttatccttagttttccctggttttgtcacccctcaaggttctctctaattttyattgggccctcattattcagcaggactgtggctcaacaaagccattaaatagaacccccaaattgaggaaactggggcccaaggaagtaaggttattttc

SEQ ID NO: 22246 - DNA, 201 bp, Homo sapiens
attgaagtgtggttcttgggggagagaatgtatgcccctgccaagagtgaggcccagttttgtcttttttttttttgagacagagtctcgctctctcaccyaggctagagtgcagtggcgcgatctcggctcactgcaacctccgccttccaggtttacttaggccattctcctgcctcagcctcccgagtagctgagact

SEQ ID NO: 22247 - DNA, 201 bp, Homo sapiens
tgtaatccagggcacaggaatcccttttcctccctggattgaagtgtggttcttgggggagagaatgtatgcccctgccaagagtgaggcccagttttgtyttttttttttttgagacagagtctcgctctctcacccaggctagagtgcagtggcgcgatctcggctcactgcaacctccgccttccaggtttacttagg

SEQ ID NO: 22248 - DNA, 201 bp, Homo sapiens
ccttagttttccctggttttgtcacccctcaaggttctctctaattttcattgggccctcattattcagcaggactgtggctcaacaaagccattaaataraacccccaaattgaggaaactggggcccaaggaagtaaggttattttccaaggtcaaacagcaagtctgtaacatagcctcaggcttcctgccccactgc

SEQ ID NO: 22249 - DNA, 201 bp, Homo sapiens
accctcatccctgtaacctatttgggaaacaacctataaatcaatggcatttgatgacccaagaatgacaaacagttccagaagatttggtttttacaatyatttaaaacaatcctctgacctgggccaggcaggcctggctgaggcggcgccgctgtccaccggctggtattggacacgaatgatgcactagagatgaaa

SEQ ID NO: 22250 - DNA, 201 bp, Homo sapiens
atcctctggctttggttctccttctggagtggtctggttaccctacctccctcctccccggcagactggtggcatccagagagtgttcagcccaggtcgayggaagaggagtttgaatggctgccttggcttggggccatggtaggagccagaattctagatctaggttcaaactgcagcctgggatttataggttgagga

SEQ ID NO: 22251 - DNA, 201 bp, Homo sapiens
aattctcttacactagtgaggatgaggcctggaagacgtacctagaaaacccgttgacagctgccacaaaggccatgatgagagtcaatggagatgatgasagtgttgcggccttgagcttcctctatgattactacatggtacgtctaccccctctggacatgccccgttttgactgaatgggtgtcttcacttcaggcc

SEQ ID NO: 22252 - DNA, 201 bp, Homo sapiens
tgctcaggaagccactggagtctgtggggctggggtgaagtctccagggagcaatgtctccagctcaagacaaaggcaatggcagcagtccggctaggatrccaggccagagtggtagagccaccccccaagttgtcagctgccacactcatgatcggtctcctcctgaggaatgtcctggggacgctgggcagggtgggc

SEQ ID NO: 22253 - DNA, 201 bp, Homo sapiens
tggaaagagatggctacattggtcggggcctcgctcctctttctcccttcgctctggctctgtgcggagaacgggttgccctggacttgaaggatgctggsacgtgcagggcaccggtggagcagaggtgccccctctggaaggcagcagattcctgatgcccagatgtttgtgtttgaatgttacagcctcaggatcatt

SEQ ID NO: 22254 - DNA, 201 bp, Homo sapiens
agcagcgggtcattgacgtgggtgagagccttctcaagcctccattccagctcccctctctctccccacccccgcatcaatcaggcctttttcttactcasccctgtttccctacctggctctgacctctgtctccaggtcaaacaccgtggggtttgcaaggatttgcatctgttgactagaagttgtggcgtcttttct

SEQ ID NO: 22255 - DNA, 201 bp, Homo sapiens
tgaaccccagaaaatgcacacaggcaggtggactcggaactttagccatgatttcaaagactcctgcactcgctatggccagcctggctaaggaccctgayctaggggctgccttcttcctttgaggcttggggcttggtgttgagagcttaacatcacatgctatttgccctcccaaaggccagcccatctgattttctt

SEQ ID NO: 22256 - DNA, 201 bp, Homo sapiens
gcatttgagactgtgtctttgagattatgatccaaacccaaaaatatataatgctgataagagagaagaatcacatacattctttttcttttctttctttcttttttttttttttttgagacagagtctcgctctattgcccaggctggagaccagtggcgtgatctcgactcattgcaagctccgcctcccgggttcaca

SEQ ID NO: 22257 - DNA, 201 bp, Homo sapiens
cttgtattttttttgcctgtgtttttacttctaagatctttgaaacacttgctgcacttgtatttggagagtggttgtggtctaagcttttttttttttttgcttttttctttttttgagatggagtttcactcttgtccaggctggagtgcaatggcgcaatcttggcccatcacaccctccacctcccgggttcaagcg

SEQ ID NO: 22258 - DNA, 201 bp, Homo sapiens
atctcttcccttaggaaatatcaacatctttatgtacatgtcagagtcatggtgtgatgacgtactttgaagcatggagtcagttttcaaaaaaaaaaaaatgcataacacaaattaaaactctaaaagtgtctgtaatttttacctccagcatgggacatgatgagaacgtgaactacacagcatagcaaactgtgctgt

SEQ ID NO: 22259 - DNA, 201 bp, Homo sapiens
acagaccgtccctggccctccggggcaggagcgcagaggacactctgcaagaacttataggtctcttgactttcacatgtcactgctttggaatgtgactcttttttttttttttcttttaaagataaagttcctgaaaaagattaaagcagagatgtttccagattctcatgagaaaccttctagttagcatagtatttt

SEQ ID NO: 22260 - DNA, 201 bp, Homo sapiens
caagtgatccgcctgcctcagcctcccaaagtgctgggattacagatgtgagccaccacacctggccgggttttacatttttaaatggttaaaaaaaaaaacaaaagaataatctttgtgacacattcaaatttcagtgcccatgaagtttcgtgggaacgggcacgcctgccctttattactgtctgtggctgctgtcat

SEQ ID NO: 22261 - DNA, 201 bp, Homo sapiens
aagttgttttttttaagtttaacatgagacatattgattccaaaatgtatatgaaaaagtaaaagtctaagaataaccaagacaattattaaaaaaaaaaacaaaatgaaaaggcttacttcaagtattattataaagctgtagcaatgcaaacaatgtgttattgatacaaggacagaacaagtcaggaaagtagaatca

SEQ ID NO: 22262 - DNA, 201 bp, Homo sapiens
tttcgccccaagcaatttgtgttaaagaatgagatcgtgtaacatttattgctaggcaaaaactgtatctaggcaagagagggccttctgaggattctctrtctccttgagatagaacatgtggcaacttattttggcaaagtacaagctggtgcattattaacttgatgtgagtcaggatacatgctgtatgagttttta

SEQ ID NO: 22263 - DNA, 201 bp, Homo sapiens
cacaactggggcagtgaggcagggggcagagtgggacctgcgggtccccctgcatgctttcatatgtcctgtgaactaagagtgggttttatattattatyattattattattattattattattattattttgagatggagtctcattctatctcccaggctggagtgcagtggtgtaatctgggctcactgcaaccttt

SEQ ID NO: 22264 - DNA, 201 bp, Homo sapiens
tatgtatgtatgtattttgagacggagtcttgctctgtcgcccaggctggagtgcagtggagcgatcttggctcactgcaaggtccgcctcctgggttcaygccattctcctgcctcagcctcctgagtagctgggactacaggtgcccgccaccacggccggctaattttttgtacttttagtagagacggggtttcact

SEQ ID NO: 22265 - DNA, 201 bp, Homo sapiens
ttgtgatgattgtttatgtcagatacagcaaagtgtattgttctgacaagatccatatattatgacagatttcctgggggtgggcataaggcctgttgaggaaggggcacatttgcccagttcccatggaggctccgtttagatagccccacctgtgcttttctttggtggcacttggaactccagggtatagtttcttac

SEQ ID NO: 22266 - DNA, 201 bp, Homo sapiens
aggatgcctgcgtgaatcccagtctcaacaccagctttgttggggtgggagtggtggtggcggcgtctgtcatcagtggttggccttttaatgtggacttraggtgaaaaacttctggctggtcatcatttttaaagggatgagaggggatgaagtggtgccctccccgaccatggctaaattgtcttcctctcttacaga

SEQ ID NO: 22267 - DNA, 201 bp, Homo sapiens
aaggccttaatttctatttgattaattattataaattctagtcctctggagaaatttctatttgattctttattatatattctggttctctggagaaatayattcttttcatatattttcttgaccatattagttacagttattttaaagtttatatctttcagtgccagtatcaggatcacccatgagtctatttttatt

SEQ ID NO: 22268 - DNA, 201 bp, Homo sapiens
ttcaaactacagaactccaggctgttagagcctcgcagagcagaggatgcctgcgtgaatcccagtctcaacaccagctttgttggggtgggagtggtggyggcggcgtctgtcatcagtggttggccttttaatgtggacttaaggtgaaaaacttctggctggtcatcatttttaaagggatgagaggggatgaagtgg

SEQ ID NO: 22269 - DNA, 201 bp, Homo sapiens
catgaattaaaagaagcaggtgccaggccgggcgcggtggctcacgcctgtaatcccagcactttgggaagccaaggagggcggatcacgagatcaggagwtggagaccatcttggctaacgtggtgaaatcccgtctctactaaaaaaaaaaaaaaaaaaatacaaaaaattagacgggcatggtggtgggcgcctgtgg

SEQ ID NO: 22270 - DNA, 201 bp, Homo sapiens
cgggttcacgccattctcctgcctcagcctcccgagtagctgggactacaggtgcccgccaccatgcctggctaattttttgtatttttagtacagacggrgtttcaccgtgttagccaggatggtcttgatctcctgacctcgtgatccgcctgcctcggcctcccaaagtgctgggattacaggcatgagccaccacac

SEQ ID NO: 22271 - DNA, 201 bp, Homo sapiens
caagcattaattttctaaaaaatccacttgagttcatgtatagcctgaaagaacctaatggagaatttatttcagtcaatactgtaatttatagaagagamtcagtcatgagttgaagttttaatttttttcttaaatttgcataacaaaggaattggccagttttgtggcacattattttaaggatgtgaagatcttata

SEQ ID NO: 22272 - DNA, 201 bp, Homo sapiens
tgattgtgatgattgtttatgtcagatacagcaaagtgtattgttctgacaagatccatatattatgacagatttcctgggggtgggcataaggcctgttgaggaaggggcacatttgcccagttcccatggaggctccgtttagatagccccacctgtgcttttctttggtggcacttggaactccagggtatagtttct

SEQ ID NO: 22273 - DNA, 201 bp, Homo sapiens
gggagccacttgtataaggggatattgttcaaatacccacttatatcgtgtattgattgtgatgattgtttatgtcagatacagcaaagtgtattgttctracaagatccatatattatgacagatttcctgggggtgggcataaggcctgttgaggaaggggcacatttgcccagttcccatggaggctccgtttagata

SEQ ID NO: 22274 - DNA, 201 bp, Homo sapiens
cagtggcttggagccagtgctatcttagctcaaattttcctaaggactaaaatatgcttaaaatggctctgggctgggtgtggtggctcacgcctgtaatytcagcactttgaaaggcagaggcgggcagatcacttgaggtcaggaattggagaccagcctggccaacatggtaaaatcccgtctctactaaaaatacaa

SEQ ID NO: 22275 - DNA, 201 bp, Homo sapiens
attgtgatgattgtttatgtcagatacagcaaagtgtattgttctgacaagatccatatattatgacagatttcctgggggtgggcataaggcctgttgaggaaggggcacatttgcccagttcccatggaggctccgtttagatagccccacctgtgcttttctttggtggcacttggaactccagggtatagtttctta

SEQ ID NO: 22276 - DNA, 201 bp, Homo sapiens
ctttgggaagccaaggagggcggatcacgagatcaggagatggagaccatcttggctaacgtggtgaaatcccgtctctactaaaaaaaaaaaaaaaaaaatacaaaaaattagacgggcatggtggtgggcgcctgtggtcccagccactcggcaggctgaggcaggagaatggcatgaacctgggaggtggaggttgca

SEQ ID NO: 22277 - DNA, 201 bp, Homo sapiens
cagcttttataaagggtggatttgcccaggtgtagatttggttggtactaaattatcccatggtttatattcctggctcttcttaaaaaaaaaaaaaaaaacgctgcttctgccaagtttattggaaacctggaggaaaaaactaatactaagggtcatgtcaggcaatggaatgaagcagggttgctgtttcctctaagc

SEQ ID NO: 22278 - DNA, 201 bp, Homo sapiens
ggagtgcagtggtacaatctcagttcactgcaacctctgcctcccaggttaaagcaattcttatgcctcagcctcccaagtagctgggattacaggtacgygccacttgcctggctaatttttgtattttagtagagacggggtttcaccatgttggccaggctggtctcgaactcctgacctccagtgatccaccctcct

SEQ ID NO: 22279 - DNA, 201 bp, Homo sapiens
ctatattttccttgttctagtcactaagtattggtagtaatcatttatgtactaatcagaaaatagtagtgtctaaccagatgaaggagagaaagttagttgatatcttctgacaattactagcacttcatagagaaagatagcatattttgaaaaacgtgcagattggcatatatttgtgattttacttacattagcaag

SEQ ID NO: 22280 - DNA, 201 bp, Homo sapiens
taatttttttatttttagtagatatggggtttcactgtgttagccaggatagtctagatctgctgacctcctgacctcatgatctgcccgcctcggcctcycaaagtgctgggattacaggtgtgagccactgcgtccagccagctggaaacattcttaagcttctcggcccctcagccacagcttccagttcagcaaacg

SEQ ID NO: 22281 - DNA, 201 bp, Homo sapiens
tccagcctgggcgacagagcgagactccgtctcaacaaacaaaacaaaacaaagcaaaggtagattctgtatgtagcagggagtagtcctattgacagaarggggcgagcaatgggtaaggacccaggagaagtggctgagcgtcgcccacacacagctggagatgagagagctgcctgggggcccgagcccgaccctgct

SEQ ID NO: 22282 - DNA, 201 bp, Homo sapiens
tctatattttccttgttctagtcactaagtattggtagtaatcatttatgtactaatcagaaaatagtagtgtctaaccagatgaaggagagaaagttagttgatatcttctgacaattactagcacttcatagagaaagatagcatattttgaaaaacgtgcagattggcatatatttgtgattttacttacattagcaa

SEQ ID NO: 22283 - DNA, 201 bp, Homo sapiens
aaggtagattctaggctgggtgtggtggctcacgcctgtaatcccagcactttgggaggccgaggcaggcggatcatgaggtcaggagatcgagaccatcytggctaacacggtgaaaccccgtctctactaaaaatacaaaaaattagctgggcacagtggcgggcacctgtagtcccagctactcgggaggctgaggca

SEQ ID NO: 22284 - DNA, 201 bp, Homo sapiens
ttctatattttccttgttctagtcactaagtattggtagtaatcatttatgtactaatcagaaaatagtagtgtctaaccagatgaaggagagaaagttagttgatatcttctgacaattactagcacttcatagagaaagatagcatattttgaaaaacgtgcagattggcatatatttgtgattttacttacattagca

SEQ ID NO: 22285 - DNA, 201 bp, Homo sapiens
ttgcaatgagccgagatcgcaccaccgcagtccaccctgggcaacatagtgagactgtgtctcaaaataataataataataataataataataataataawgatgatgatgatgataatcttctccctcaacatttaatgtctttttctttctctttcacattctggcaagtgtctctgccaagtcagcctcacagattca

SEQ ID NO: 22286 - DNA, 201 bp, Homo sapiens
gctgcagagcagtagtggttaaaataagatcttggaatttatcaaaagggaggtgagctggatgtggtcatccacgaggtcatggatgtggtgtgtatgcytgtggtcccagttactcatggaatgcccaagcgggaggatcacataagcccaggagtttgaggccagcctggccaacatagtgagacctcgtctctgaaa

SEQ ID NO: 22287 - DNA, 201 bp, Homo sapiens
cctgggcgacagaacaaaactccgtctcaaaaaaaggagaactgagcttatgttctaatcttgttgcttatctgcatggccttggacaagcttgtctgagytgattttcctgagaacagggttaaaaggagataacgtgtatctgcagtcatggtgggaggcaccccaaggaggaaagattaagatgagggccacgaggcc

SEQ ID NO: 22288 - DNA, 201 bp, Homo sapiens
attggtgtttagggggttttaataccagttttaacatggaattggtgtttttgcgttccccattctgaaaacgataaagagccaacttggcttagactccygctgttcaaagcaagaatgaactggccatgagctccgtgaaaacactagaggggtgactccgtctgctgggggagacggtgcacaaggacatcacagaac

SEQ ID NO: 22289 - DNA, 201 bp, Homo sapiens
ttgttctagtcactaagtattggtagtaatcatttatgtactaatcagaaaatagtagtgtctaaccagatgaaggagagaaagttagttgatatcttctsacaattactagcacttcatagagaaagatagcatattttgaaaaacgtgcagattggcatatatttgtgattttacttacattagcaagcattaattttc

SEQ ID NO: 22290 - DNA, 201 bp, Homo sapiens
tcagtaccagtggagtaaattataatctagggaatattggagtaatcatctgaggctttaaatactgcgtttttgaagctgacctgtctttaatactcagstaaagaaatggacatgcttccctttagtgacagactgaatctacgtttatagttatcaattggtgtttagggggttttaataccagttttaacatggaat

SEQ ID NO: 22291 - DNA, 201 bp, Homo sapiens
agcacagggcttggcataggacaggcggccaccaggcctcatcagactgagcctgctctggcaagtgggtgaggagcaggtggcacagagctgcaggtggyacagagctgcaggtggcacagagctgcaaggcatccctcctaaagccagtagggtggggagtccgcccacagacccgcccctgggctctgttccgcctcg

SEQ ID NO: 22292 - DNA, 201 bp, Homo sapiens
gcatgggacatgatgagaacgtgaactacacagcatagcaaactgtgctgtgtgtgaaggggcagaattcatacacaactaaactaaataatttggcagcrgagatttcttgtattttttttgcctgtgtttttacttctaagatctttgaaacacttgctgcacttgtatttggagagtggttgtggtctaagctttttt

SEQ ID NO: 22293 - DNA, 201 bp, Homo sapiens
agtgatattggctcgctgcaacctccgcctcctaggatcaagcaatcctccctctcagcctgccaagtaactgggaccacaggtgcacaccaccacgcccrgttagtttttctatttttagtagagacggggttttgccatattgcccaggctggtcctgaactcctgggctcaagtgatctgcccacctcggcctcccaa

SEQ ID NO: 22294 - DNA, 201 bp, Homo sapiens
taactcagtcatgctttcctcagtcaagtctgattgttctcaagatgctttcatgccacttacacagcttctttgggaatagcatttttttttttttttttgagacggagtcttgctctgttgcccaggctagagtgcagtggggcgatctcggctcactgccagctccacctcccaggttcacgccattctcctgtctca

SEQ ID NO: 22295 - DNA, 201 bp, Homo sapiens
tgaggtacaagaatcgctggaaccggggggcgaaggttgcaatgagcggagatcacaccaatgccctccaagctaggcgacagactcaatctcaaaaaaamgaaaaaaaagaaatgtacagagtatttttttttttttgagactgagtctcgctctgtcgcccaggctggagtgcagtggcatgatctcggctcactgcaa

SEQ ID NO: 22296 - DNA, 201 bp, Homo sapiens
ttgaacccaggaggcggaggttgcagtgagccgagatcgcaccactgcactccagcctggacaacagagcaatactccgtctcaaaaacaacaacaacaamaaaaaacaaaaaacaaaaaaacccggaacagcgcctggggtgttcaataaatatttactgaatgactggatgaatggatccaggaaatgaactgaatttc

SEQ ID NO: 22297 - DNA, 201 bp, Homo sapiens
cccaggttcatgccattctcctgccccagcctcccaagtaggtgggactacaggcgcctgccacaacacccggctaattttttgtatttttagtagagacrgggtttcactgtgttagccaggatggtctcaatctcctgacctcgtgatccgcctgcctcagcctcccaaagttctgggattacaggcgtgagccaccac

SEQ ID NO: 22298 - DNA, 201 bp, Homo sapiens
ttgtgattatcctaatgggtaccgtgcaaagaaaatgcttccaccagggcagtgacttaactggttttgaaattgcctagcctgccttaattggaaatgcytaagtctagtttttactctacagctgagccataatacagccaagtattttgacaatttaaatcagatttagatctgctaaagaaacaaaaattataggcc

SEQ ID NO: 22299 - DNA, 201 bp, Homo sapiens
tctttctgaaacaataaaaaattcttgttaaagtttgaaatgaaacaaaatacagtcttccttccatttacacactagttgcatttcttttttttttttttaacttattactattattttttgagacggagtcttgctctgtcgcccaggctggagtgcagtggcactatctcagctcactgcaagctctgcctcccaggt

SEQ ID NO: 22300 - DNA, 201 bp, Homo sapiens
agtggaaacactcatttgtcttcagtggcgtaaccccagctcagctgaggcagtcgagcttggagttaactgtctgggatcaggccctctttggaatgaaygaccgcttgcttggaggaaccagacttggttcaagtaagtctgagacattgagcccaaacgtttatactttgtgattatcctaatgggtaccgtgcaaag

SEQ ID NO: 22301 - DNA, 201 bp, Homo sapiens
aagtgatctaatatgattgggaatgcaaagtaatgggtccaaagagatcactggctggctggaagccttcgttcattcagcactgttttccccagcatctratttcccatactgtgacacaaggcctgggatctttgagatggagatgttttcagtgtctgttcagagtgccatactgtttgcataatgacagatctcttc

SEQ ID NO: 22302 - DNA, 201 bp, Homo sapiens
atggcatagtgattccagtaccataagcaatgttgccctccatgatgtctttctgaaacaataaaaaattcttgttaaagtttgaaatgaaacaaaatacagtcttccttccatttacacactagttgcatttcttttttttttttttaacttattactattattttttgagacggagtcttgctctgtcgcccaggctgg

SEQ ID NO: 22303 - DNA, 201 bp, Homo sapiens
catggcatagtgattccagtaccataagcaatgttgccctccatgatgtctttctgaaacaataaaaaattcttgttaaagtttgaaatgaaacaaaatacagtcttccttccatttacacactagttgcatttcttttttttttttttaacttattactattattttttgagacggagtcttgctctgtcgcccaggctg

SEQ ID NO: 22304 - DNA, 201 bp, Homo sapiens
actagctagtgagcccttggaggatggacgtttcatcttctcctctttcttctctcttcctccccttctactcttccagcccccagaatttagcatagtgstgtgaatatagtgttgcttaataaataaatgtctgtaggaattaagttggcattctggggatggaaagcataaataatttggaggtaatcctttctttca

SEQ ID NO: 22305 - DNA, 201 bp, Homo sapiens
cttacacctcattcccagctgagcctggagcaagccttgtggacctaacagggctatggaaaataggtctggtttgaaaaggtagattctaggctgggtgyggtggctcacgcctgtaatcccagcactttgggaggccgaggcaggcggatcatgaggtcaggagatcgagaccatcttggctaacacggtgaaaccccg

SEQ ID NO: 22306 - DNA, 201 bp, Homo sapiens
ttttagtggagacagggttttaacatgttggccaggatggtctccatctcctgacttcatgatccacctgcctcgtcctcccaaagtgctgggattacaarcgtgagccaccacgcccggccttatttatttttttgagacagagtctcgctctgtcacccaggctggagtgcaatggcgcgatctcagctcactgcaacc

SEQ ID NO: 22307 - DNA, 201 bp, Homo sapiens
gagaaatgcccattaaaatgatgtataacataaccacatttattcaagaatgtattccaatatcaaatagcaaattccaacaatgcaaaaactgcaattakttttgcacttttattatgcttcatagagaatttgcttttgctcttaacacacagagtggaggcaaagaatctttatctagtctgaggctgagctgattca

SEQ ID NO: 22308 - DNA, 201 bp, Homo sapiens
gcaaaataacccaacaccggccagcctcatccttaatagaaatatgcataagatgcgaaggatgggaagccggggaggccgatccagcattaaaagtctcrctagaagccagtatttccaatcacaatcacacctttgtgcagcacccaggctttgtgcgacctgaggtgagccatcagagtacgattcaggtggatgagg

SEQ ID NO: 22309 - DNA, 201 bp, Homo sapiens
tgaaaatgtggtgtggtcagtaaatatttcctaagcttaacatctcctcttggaccaacagtaaaacgcatgactgtccacatttcattctcattcagtayaggtgcattggcccctctaaaagtaaggcaaataccattattacattgaattgcaaactccccgtcagtgacatagggaaaaatgacggtcaagatagaa

SEQ ID NO: 22310 - DNA, 201 bp, Homo sapiens
tatacatcacaacatggcccagaacctgcagcgaacactaaaaaacgtaagccacttaaaacgtcttattttagctttcctatgaaaatctaacaacacayattaaagaccctgatttccaaaaattcacgggatgtgtacatgctggagtactcgaaaccctaatcttctcagttctgtgatatcaggaagccagttttg

SEQ ID NO: 22311 - DNA, 201 bp, Homo sapiens
gattcgagaataatcgcgagaatcaggcctgcttggcactattacaactggggaaaacaaaccagggcgcctccctggttcccagcccagaatgtttctgytgggtaactgctttctaaaggaactgggatctgagggagttcctagacttggagcactaaagacaagcgtggcggggctggcagcgcccgctatgagcac

SEQ ID NO: 22312 - DNA, 201 bp, Homo sapiens; identical to SEQ ID NO: 3755

SEQ ID NO: 22313 - DNA, 201 bp, Homo sapiens; identical to SEQ ID NO: 3757

SEQ ID NO: 22314 - DNA, 201 bp, Homo sapiens; identical to SEQ ID NO: 3758

SEQ ID NO: 22315 - DNA, 201 bp, Homo sapiens; identical to SEQ ID NO: 3759

SEQ ID NO: 22316 - DNA, 201 bp, Homo sapiens; identical to SEQ ID NO: 3744

SEQ ID NO: 22317 - DNA, 201 bp, Homo sapiens
ttgaatatggagaggtgcagcccttcaaaggcatgggaatttaccacccatgactccctctggacttgccctgattttttatgttctgcttcccacaagtrctccaggggaaaacttctgcctagaggctgagactgccttaaggtgttttgtgttgatgtaggggattagataattgagtttctgactttatggatgcaa

SEQ ID NO: 22318 - DNA, 201 bp, Homo sapiens
aactgagactgaagtcgccagtcctgaggaagcaggcttgcccccagtggaaacactcatttgtcttcagtggcgtaaccccagctcagctgaggcagtcragcttggagttaactgtctgggatcaggccctctttggaatgaacgaccgcttgcttggaggaaccagacttggttcaagtaagtctgagacattgagcc

SEQ ID NO: 22319 - DNA, 201 bp, Homo sapiens; identical to SEQ ID NO: 3751

SEQ ID NO: 22320 - DNA, 201 bp, Homo sapiens
cggggctctcactttcccccaaacttctggctacaactagactcaaacttcggcatcttccctctccttgcgttcctctttactctttgctaggatcttastaatccctccatcctgtcctccacctgaccacagagcggcacggtgtgggcagcgccacagcctgtgggcagggccagcagagcccactgcaccactccc

SEQ ID NO: 22321 - DNA, 201 bp, Homo sapiens
catgttagttgcatgttatcttcctagtacatggccttctttataattttgtttttaacacaaagaagttttttgtttgcttgtaggcaaatctccttttyccgtataatttcttttgcttttatgcttcgagacttcttccttatcctgtgataggttaaatatccacattaattttcttctaatttttacttaactttt

SEQ ID NO: 22322 - DNA, 201 bp, Homo sapiens
cagcccttcaaaggcatgggaatttaccacccatgactccctctggacttgccctgattttttatgttctgcttcccacaagtgctccaggggaaaacttytgcctagaggctgagactgccttaaggtgttttgtgttgatgtaggggattagataattgagtttctgactttatggatgcaaacttttccctgtctttg

SEQ ID NO: 22323 - DNA, 201 bp, Homo sapiens
tttatggatgcaaacttttccctgtctttgtagagacatatcacagttgtacactttatatatttttggctctgaatggtaatgactgattaccaaaattytgttataggccagatgctgtggcccatgcctgtaatcccagcactttgggaggccaaggcaggtggattgcttgagctcagcagtttgagaccagactgg

SEQ ID NO: 22324 - DNA, 201 bp, Homo sapiens
aggcctgcgtgctggagaaactgtccctggcctctttcccattgacctggctggtgcttccatttgaatggtgtctctgtcttcctactagctagtgagcycttggaggatggacgtttcatcttctcctctttcttctctcttcctccccttctactcttccagcccccagaatttagcatagtgctgtgaatatagtgt

SEQ ID NO: 22325 - DNA, 201 bp, Homo sapiens
tcagcaacttctcgtgtagttgtgggagcagcttcgatgattgctctcaattggttgttgtcatcttccgatggccgccactacgctcctcatcttcaagrttctcattgcctttgcaaaatttcttgagcccctactgcactgtatgttttgctggaccaaatgcattgtggatgttgcggattgtctttgctgctttat

SEQ ID NO: 22326 - DNA, 201 bp, Homo sapiens
aggactacaggcacgtgctaatttttatatttttagtagagacagggtttcaccgtgttagccaggtctcaatctcctgacctcgtgatctgcctgcctcrgcctcccaaagtgctaggattacaggtgtgagccaccaagcccagcctaacagctactttttaaggcttttagttcatgctgccaagttgccctccactg

SEQ ID NO: 22327 - DNA, 201 bp, Homo sapiens
accatagactgcatggatcagaagctgcccacccagcactaacgttgctcactattaggctattaagtcctttctatcaacccaaaaattccagcaggaarcctggtaaagaaaacgctggcatgtgggttctctgctgcccccaaactctttatccacccctttccctgagttctcactctgtccccgctgtgtttggcc

SEQ ID NO: 22328 - DNA, 201 bp, Homo sapiens
gtcagtgttgagttattcagcaacttctcgtgtagttgtgggagcagcttcgatgattgctctcaattggttgttgtcatcttccgatggccgccactacrctcctcatcttcaagattctcattgcctttgcaaaatttcttgagcccctactgcactgtatgttttgctggaccaaatgcattgtggatgttgcggatt

SEQ ID NO: 22329 - DNA, 201 bp, Homo sapiens
tttaacagctactctttttttttttttttttttttttgagacagagtcttgctctgtcgcccaggctggagtgcagtgtcatgatctcgactcactgcaayctctgcctcccgggttcaagtgattctcctgcctcagcctcctgtgtagctaggactacaggcacgtgctaatttttatatttttagtagagacagggtt

SEQ ID NO: 22330 - DNA, 201 bp, Homo sapiens
acttcgggcgtcgagtagctgggactacaggtgcacaccaccacacccagttgacttttaaatttttcgtggagatgagttctccctgtgtattgcccacrctggtctcaaattcctggcttatggaatcctccctgagccaggtgcctggccagtttttgggttgttttgtttttcttttttgagatggaatttcgcttt

SEQ ID NO: 22331 - DNA, 201 bp, Homo sapiens
ttattaataaaagtaggatccattacaatcaacacatttttgccaaagagaaatgagtttgtttattcctgtaccataaaaatctgtgctttgggattcartgaactcttggaaagcattttctgcatccttctggttgtgttttccctgcacaaagttctcacaatgcttgaagaagtagtagtctgttggcaagaggtc

SEQ ID NO: 22332 - DNA, 201 bp, Homo sapiens
tcaggtggcccctgcccagctggtgacccggcagctgcaggtctcggtgtggcatctgggcacgctggcccggagagtgtttcttggagaagtgatcattyctctggccacgtgggactttgaagacagcacaacacagtccttccgctggcatccgctccgggccaaggtgatgtctggttttggactgagtgccctcca

SEQ ID NO: 22333 - DNA, 201 bp, Homo sapiens
gcctccagctccctggacattgtctgtgtcattgtctgcagagcctggtgctgcaggcagactgaggtggggtgaaagttttctagcatttcctttctacrtccccgtgcccagctccagcagctcttctttctgagccatgcagcgagcccgggagaggttctctggagcccgtagtgggggaaacgggtgaccagaagc

SEQ ID NO: 22334 - DNA, 201 bp, Homo sapiens
agggaagtcactggttatgttctgtttcctaagctggggggcaggggtacatgggtgtgcactttattataatgcttccaaccgtataggtatattttatrtattctgttttacatatttgagattgcatgaatgtgtaatgctcagtaacttaagagtaaatgaactgtgaagaattagagatggagttttgagggattt

SEQ ID NO: 22335 - DNA, 201 bp, Homo sapiens
gggtcttatctagtatattgtgaatattttatagtcctgggaaactttccagttacaattaaaataatcggcatctctaattgatcctaaatgcaaaatawcccaacaccggccagcctcatccttaatagaaatatgcataagatgcgaaggatgggaagccggggaggccgatccagcattaaaagtctcactagaagc

SEQ ID NO: 22336 - DNA, 201 bp, Homo sapiens
gcgtgatcttggctcactgcaacctctgtcccctgggttcaagtgattctctgcctcagcctccctagtagctgggattataggcgcccgtcaccacaccyggctaatttttttgtatttttggtagacatggggtttcaccatgttggccaggctggtctcgaactcctgacctcaggtgatcccaccttggcctcccaa

SEQ ID NO: 22337 - DNA, 201 bp, Homo sapiens
agagtcggaaatggacccgtgggctgggtgtggaggctcacgcttgtaatcccagaactttgagaggctgagacgggtggagggcttgagcccaggagttygagaccagcctgggcaatgtagagagaccccatctctacaagaaattaaaagattagccgggcatggcgacgcctacctgtagtcccaactacttgggaa

SEQ ID NO: 22338 - DNA, 201 bp, Homo sapiens
agatctagacaacaaatagggaaaatcatttaacctcccaagtaggcaaatcagtgcaaaattaaagcaagctgttattttgggaccactttagtaaattytaaaaataatagagctccgtgttggtaaggtgtagggtagcaggcgttcttacaaactgcagggtgagcagaaactgttacaacttttctagagggcaat

SEQ ID NO: 22339 - DNA, 201 bp, Homo sapiens
attatcctaatgggtaccgtgcaaagaaaatgcttccaccagggcagtgacttaactggttttgaaattgcctagcctgccttaattggaaatgcctaagyctagtttttactctacagctgagccataatacagccaagtattttgacaatttaaatcagatttagatctgctaaagaaacaaaaattataggcctccaa

SEQ ID NO: 22340 - DNA, 201 bp, Homo sapiens
aaaaacccagcttattaaaattccacttattacagaagtataaagccagatctagacaacaaatagggaaaatcatttaacctcccaagtaggcaaatcastgcaaaattaaagcaagctgttattttgggaccactttagtaaattttaaaaataatagagctccgtgttggtaaggtgtagggtagcaggcgttcttac

SEQ ID NO: 22341 - DNA, 201 bp, Homo sapiens
tgggcgaggtgtgggggaattcacaagagcaaaacagcaagcatcccttctcagatatggaaagcagactgaaaccgcatcacacacacacacacacgcaygcacccagcaccccccatacccccccaccacccccaccccctgcccagaggcagagatagaaaaccccagctttctggctgctgggagtggtgcttggcc

SEQ ID NO: 22342 - DNA, 201 bp, Homo sapiens
tggcaaagacgggtatccctgctaaagtcactcgccagccagaccgggcagggtggtgggggcccttggtccaaaacacctgcctctcgagggatgcctgyctgtgagcatctcacagctccttgcgcgaatactgacatgttaacaagaggtcaaaattcagggctctttaaggaagcttctaggaagaaacaactgagg

SEQ ID NO: 22343 - DNA, 201 bp, Homo sapiens
actggagtgcagtggtacaatcttggctcactgtaaattccacctcctgggctcaagcagtcctcccacttcagcctcctgaggagctgggactactggcrtgcaccaccatgtctggctgatttttgtatttttggtagggatgttgctcaggctggtctggaactcctgcgttcaagcaatcctctcgcctcggcctcc

SEQ ID NO: 22344 - DNA, 201 bp, Homo sapiens
cagcatgaagaactgaggggcaagttgagaagaatgggctcgtgcagttggtgacttgatggctaatttgcaccttgccacttggcacttggtcacacacrgttttctattactttcctcttttccagagactcagagccttggggcactgagggatgccagttctgcctgttcatctggaacctggatctaaggagggaa

SEQ ID NO: 22345 - DNA, 201 bp, Homo sapiens
tgcaagacagttatttgtcgctgtgacaatcatatatactccacacattcctaaagatgggggtatggtactgcactcattgaaaagctggagcgagtccygctgaaatgaagcaactgtggttcaatcgaatgcccaacgccatcaagccagtggggacaccagtggaacactggaaaccaaagagaaatgaccttcata

SEQ ID NO: 22346 - DNA, 201 bp, Homo sapiens
acctactctatgtacatatgtagaaagctgaaactggatcccttccttacaccttatacaaaaattaattcaacatggattaaagacttaaatgttagacytactcaatttcagtgcacactgctacaaggctacacctattttggatcccaccttatctctttaattctaaggatgcccccctgcggaggggaggatatt

SEQ ID NO: 22347 - DNA, 201 bp, Homo sapiens
agacggccccacccagctagccatgctggtgtgcaactatccactcccttggtgaagacccagcccaccaaaccagagtcctcgcctcactttcaaactayagaactccaggctgttagagcctcgcagagcagaggatgcctgcgtgaatcccagtctcaacaccagctttgttggggtgggagtggtggtggcggcgtc

SEQ ID NO: 22348 - DNA, 201 bp, Homo sapiens
aaaaagtgctggttgtcatatggtttagggataaaaatactgtggtatttttactttattctttaatcacagataggcccaagagatcctcgagtttatgyccaaatctctatatgccaaattagctcctgtttaaactgcacaagtaatcagttggaattaaatgagattagatggttctattagatgattcgcgctggg

SEQ ID NO: 22349 - DNA, 201 bp, Homo sapiens
cctggcgctgtgactttgaaatagttactttcttgtgggtggggtgggcggagggtttgttttaactggctcagctctgttcaggtacccgaacagcccccgcctcagcatcatacacagaccagactggatcaggtcctgtggcttcccctggcggaggcctccctttgctggtggctgacctgctggaagctggccatg

SEQ ID NO: 22350 - DNA, 201 bp, Homo sapiens
tagacagggtctcggggctctcactttcccccaaacttctggctacaactagactcaaacttcggcatcttccctctccttgcgttcctctttactctttkctaggatcttagtaatccctccatcctgtcctccacctgaccacagagcggcacggtgtgggcagcgccacagcctgtgggcagggccagcagagcccac

SEQ ID NO: 22351 - DNA, 201 bp, Homo sapiens; identical to SEQ ID NO: 3753

SEQ ID NO: 22352 - DNA, 201 bp, Homo sapiens
aaggtctggatatttaccaagccccttccctgtgataagcctgaaggccagttttttcctctctagtaagatgaaactgctggaagcatttttttttttttgctttttttttttgagatggagtctcgctctgtcactcaagctggagtgcagtggtgtgatcttggctcactacaacctccgcctcctggattcaagcta

SEQ ID NO: 22353 - DNA, 201 bp, Homo sapiens
gaaggtctggatatttaccaagccccttccctgtgataagcctgaaggccagttttttcctctctagtaagatgaaactgctggaagcatttttttttttttgctttttttttttgagatggagtctcgctctgtcactcaagctggagtgcagtggtgtgatcttggctcactacaacctccgcctcctggattcaagct

SEQ ID NO: 22354 - DNA, 201 bp, Homo sapiens
accacacccagctaatttttgtatttttagtagagacagggtttctccattttggccatgctggtcttgaacttctaacctcaggtgatctgccagcctcrgcttcccaaagtgccgggattacaagtgtgagccaccatgcctggccagttattctttttaacagctactctttttttttttttttttttttttgagaca

SEQ ID NO: 22355 - DNA, 201 bp, Homo sapiens
gtatgcgtggcaattttttactgaatgctggacattgagtatgaaaaactgggataatttgagattcaaaaatattaggttgctagaaaagtccttgtggktggaccgtgaattttatataattataacttggctcaaacacatctttattaataaaagtaggatccattacaatcaacacatttttgccaaagagaaatg

SEQ ID NO: 22356 - DNA, 201 bp, Homo sapiens
ctggcatttcatcaaccaaaaaaactctttcttttaaaaactcaagcaaaacagctaagccaaaacatgttttaaaagtttaaaaagaaaaaaaaaaaaaacactgtaaaatcaaaaggagggaattgtagaaagtaaaaagtttccttttcagtttcctttctggtaataataataatgttaaaaataataatttctttt

SEQ ID NO: 22357 - DNA, 201 bp, Homo sapiens
atagggaagtcactggttatgttctgtttcctaagctggggggcaggggtacatgggtgtgcactttattataatgcttccaaccgtataggtatattttmtatattctgttttacatatttgagattgcatgaatgtgtaatgctcagtaacttaagagtaaatgaactgtgaagaattagagatggagttttgagggat

SEQ ID NO: 22358 - DNA, 201 bp, Homo sapiens
agctgcacacccaaggagcaaagtgcatggcagggcagccctaaccccaggacactcacgcctgcatgctggagattaggtctgccctgttgtgttcccargtccactgtgcccagcactgcccagcaatcctgatgtctttgcctgattaacacagtttttttgctctccacaacaaacatttcacacctcctccagtct

SEQ ID NO: 22359 - DNA, 201 bp, Homo sapiens
aatctcagctcactgcaagttctgcctcccgggttcacgccattctcctgcctcagcctcccaagtagctaggactacaggcgcccgccaccatgcctggstaattttttgtatttttagtagagacggggtttcaccgtgttagccaggatgatcttgatctcctgacctcatgatccacccaccttggccttccaaagt

SEQ ID NO: 22360 - DNA, 201 bp, Homo sapiens
cagctcagtcattctcacaaagatcttgttatggaaggtgctgttatcccatttcacaaatgaggaacctgaggttcacagagtttaaagcgacttgctgmggtcctgagatgactgtagaactctgattcaaaccaggggcctggggagtccataccggggagtccaggcttttcacactatcccacaggcgttttgtac

SEQ ID NO: 22361 - DNA, 201 bp, Homo sapiens
tgtttaaggagacacatcaaaatggtgaaaccataaagaaaaccaagggggtgataaatataaaatccaacgtggttattacctggttacgggcaggactrtgatagggaagtcactggttatgttctgtttcctaagctggggggcaggggtacatgggtgtgcactttattataatgcttccaaccgtataggtatatt

SEQ ID NO: 22362 - DNA, 201 bp, Homo sapiens
ttttcagtgtctgttcagagtgccatactgtttgcataatgacagatctcttctgttaacatcgtgttcctaggttgaactttctttttttttttttttttgagacagagtattgctctgtcacccaggctagagtgcagtggcgcgatcttggctcactacaagctccgcctcccaggttcacgtcattctcctgcctca

SEQ ID NO: 22363 - DNA, 201 bp, Homo sapiens
tattaacttgatgtgagtcaggatacatgctgtatgagtttttatttatgtgctgtcttgaaaccagaacatcaaaaaagtgaattaactgaagtaacttrttatatctgttattcttgatttcagggaagtttaattagcattgacagcacctgtacagagatgggcaattttgacaatgctaatgtcactggagaaata

SEQ ID NO: 22364 - DNA, 201 bp, Homo sapiens
atcaagaaaggggaagtgctagggtagcaatgaccaaaaccaaccaaccaactcgcaggttgctgcagaacaagaggcctgtggcaggtgttggccctgaycttgtgttgagaggttccagaagacatttaagataaagtttctgtcttcagggaaggttttctcttagagaactgagtgccaagttgctaagggccctgg

SEQ ID NO: 22365 - DNA, 201 bp, Homo sapiens
gtccttcaggcttttccttgcttgagagcaaaaaataattactgtgagctgccctggcggcatagagagcaattccaaatcatctctagaaaggtctcagkatcttcttccccatttcaaccaaccatatatatttgaagtctaataataaacattgctgggcagggtgttacatttctcagcattttttcttcttctacc

SEQ ID NO: 22366 - DNA, 201 bp, Homo sapiens
gacattcataaaagagcgtgctagtaaatgacacctttttggtccaatacagtatctctttgcactatggctatttgtctaggggagtgggctgaccactyattaaaaaaaaaatgtagcaaaagcatagcatcagttgattttattgggcaacttatacccatagcaggatgtatgctgtgtgtttctagattattccat

SEQ ID NO: 22367 - DNA, 201 bp, Homo sapiens
ctttgccaacagggaactcttccctgtctgtctctaagctgcacgggccgtttgatatgggtcagcatttagaaaagcgtgctgaactctagcagagcagygttccgccttagctgtcaagatccatctttaaacaggttggcgcttgtttatcaatgtctatggaggaagtgagggtttggtttctaatggcagaacaca

SEQ ID NO: 22368 - DNA, 201 bp, Homo sapiens
tgaggaagggggagcataaaatatgaacctgcttagcctgtttcctgaccgctttgccaacagggaactcttccctgtctgtctctaagctgcacgggccrtttgatatgggtcagcatttagaaaagcgtgctgaactctagcagagcagtgttccgccttagctgtcaagatccatctttaaacaggttggcgcttgtt

SEQ ID NO: 22369 - DNA, 201 bp, Homo sapiens
tgcacctggcctcccatttttctattggattgtttattgttttatttatttaccagaggctttttgttaaacctaatttaaataggtttaaaaattatttrttagttatatgtattgtacgtattttatccatcctagctgtaacttgttttctaacttgtttattatgacttttcttgtagaaagtttaatatcaaatgt

SEQ ID NO: 22370 - DNA, 201 bp, Homo sapiens
accacgactgtcagccggcattagctgagtgtacttatgagctgagcactgtgctctagaggtctccacatgcatcagcacgtttcgtcatcatagcacckccgtgaagtgggtgctgcacctgtctacttcgtagatgaggacatgaagccccagagggcttaagtaacttgcccatcatcagctcaacagcaagtcggt

SEQ ID NO: 22371 - DNA, 201 bp, Homo sapiens
catcttgattctctgactcctttgatagttacctaggattcaatcacaatgatcagtcttttttttcctgtaaggatgtggaaatcagatcaattgagctrgtggaaaaaaacgagtattttgctttgtaactatgaaccattttagatgcgagactagttgaagtagggccggtcacagtggctcacgcttataatccca

SEQ ID NO: 22372 - DNA, 201 bp, Homo sapiens
cctttgatctgatgactgactgctcagagacaatagatgattggatgaaagaaataggggcccctaagaataaacaatgtgtccctttcccatcctcctcrtctcttttcttcattggttttacttttcttgtacttttcccctttcaccagatttagaagccaaagtcaagatttgctgttaggctgaggaaagcaagca

SEQ ID NO: 22373 - DNA, 201 bp, Homo sapiens
tatgatccaaacccaaaaatatataatgctgataagagagaagaatcacatacattctttttcttttctttctttcttttttttttttttttgagacagartctcgctctattgcccaggctggagaccagtggcgtgatctcgactcattgcaagctccgcctcccgggttcacaccattctcctgcctcagcctcccaa

SEQ ID NO: 22374 - DNA, 201 bp, Homo sapiens
gctatctctggggaggggaactgaggacagaggtggaggaaaaagattttctctcttttctgttttttttttttttttttttttttttaagatggagtctygctctgtcacccagacagcgagcgagcagtctgggctcactgcaacctccgcctcccaggttcaagccattctcctgtctcagcctcctgagtagctagg

SEQ ID NO: 22375 - DNA, 201 bp, Homo sapiens
gttcaagtaagtctgagacattgagcccaaacgtttatactttgtgattatcctaatgggtaccgtgcaaagaaaatgcttccaccagggcagtgacttawctggttttgaaattgcctagcctgccttaattggaaatgcctaagtctagtttttactctacagctgagccataatacagccaagtattttgacaattta

SEQ ID NO: 22376 - DNA, 201 bp, Homo sapiens
aagacagggacactggggcaaagagatgaccaagagctaggtgaagcctgctccagagaccaaccacaccctgtccacgccccagaggtgagacgcatttsccatttgcaccgtgatgtgctgtgtggtggctcatcccacgcaccacaggctgggcttgtggcgttctgcatgaggatggcccgtgggtcctcggcacgc

SEQ ID NO: 22377 - DNA, 201 bp, Homo sapiens
cctggctgtaagcaccttgacccaccctaaccacatcaggtccctggctgcatccgcatcttggactcagcctgtgggagggaggcctgcgccaggccccrggaagtggggccctggaaggtggggtccagagatggggatcctaggagtgcgggccccgggagcccagctgaccatctcttccttgcctctgcagtatca

SEQ ID NO: 22378 - DNA, 201 bp, Homo sapiens
aggcaggagaattgcttgaacccgagagatggaggctgcagtgagccaagattgtgccactgcactgcagcctccagtgtgggtgacagagcaagactccrtctcaaaaaaagaaagaaaaaataaaaaaagcatcaactgttagcaaagtatttttagaaaatttagagacatattttgatttttccctttttataagca

SEQ ID NO: 22379 - DNA, 201 bp, Homo sapiens
taggcgtgagctggacaaggactttcatccttgtcttgttctaggaattgggggtgggaggctaccagggctacccttgcctgtccccaggcagagcactsggcacctggggagtagggggaggggttcttgagcagagagaggacccccccgccccaccctggctgtaagcaccttgacccaccctaaccacatcaggtc

SEQ ID NO: 22380 - DNA, 201 bp, Homo sapiens
ttacacctcattcccagctgagcctggagcaagccttgtggacctaacagggctatggaaaataggtctggtttgaaaaggtagattctaggctgggtgtrgtggctcacgcctgtaatcccagcactttgggaggccgaggcaggcggatcatgaggtcaggagatcgagaccatcttggctaacacggtgaaaccccgt

SEQ ID NO: 22381 - DNA, 201 bp, Homo sapiens
ttcccatttgcaccgtgatgtgctgtgtggtggctcatcccacgcaccacaggctgggcttgtggcgttctgcatgaggatggcccgtgggtcctcggcaygccccctcccctgctgcatgtgcacatggcccagagcctggccagggttgtctgaagggctaagggagctcagggatagaagtggtggggtgcaggggag

SEQ ID NO: 22382 - DNA, 201 bp, Homo sapiens
ctttggaagtagaggatgctggtgcccaccttgcaagtggctacactgaggcacagaagtagtagataactttctttttttgtttgtttgtttgtttgtttgtttttttgagacagggtcttactttgtcacccaggctggagtgtagtggtgcaaacacagctcattgtagcttctacctcctgggctcaggtgatcctc

SEQ ID NO: 22383 - DNA, 201 bp, Homo sapiens
gggtttccccgcagccaggtggcaggtccaggccggagcacccaggctgtttcagaacacatgactgagtggggcggagtacccagactttaggcagcatygccctcatatagataccaggaaatcatgcccctcgtagagcagcaggtccaagcagggctgctggctatttttccaaaaagtgaggcagtttaaaaaaaa

SEQ ID NO: 22384 - DNA, 201 bp, Homo sapiens
gctttggaagtagaggatgctggtgcccaccttgcaagtggctacactgaggcacagaagtagtagataactttctttttttgtttgtttgtttgtttgtttgtttttttgagacagggtcttactttgtcacccaggctggagtgtagtggtgcaaacacagctcattgtagcttctacctcctgggctcaggtgatcct

SEQ ID NO: 22385 - DNA, 201 bp, Homo sapiens
tgctttggaagtagaggatgctggtgcccaccttgcaagtggctacactgaggcacagaagtagtagataactttctttttttgtttgtttgtttgtttgtttgtttttttgagacagggtcttactttgtcacccaggctggagtgtagtggtgcaaacacagctcattgtagcttctacctcctgggctcaggtgatcc

SEQ ID NO: 22386 - DNA, 201 bp, Homo sapiens
ggcagggtgacagtgagggctgtaaggccacatagggcaggagggacccagggcagggtgacagtgagggctgtaaggccacatagggcaggagggacccrgggcagggtgacagtgagggctgtaaggccacatagggcaggagggacccggggcagggtgacagtgagggctgtaaggccacatagggcaggagggacc

SEQ ID NO: 22387 - DNA, 201 bp, Homo sapiens
ctgctttggaagtagaggatgctggtgcccaccttgcaagtggctacactgaggcacagaagtagtagataactttctttttttgtttgtttgtttgtttgtttgtttttttgagacagggtcttactttgtcacccaggctggagtgtagtggtgcaaacacagctcattgtagcttctacctcctgggctcaggtgatc

SEQ ID NO: 22388 - DNA, 201 bp, Homo sapiens
ggatgtggctttttggtgactgtgcctcaggatactgttgccacaaccagggacagagtgacagtgagggctgtaaggccacatagggcaggagggacccrgggcagggtgacagtgagggctgtaaggccacatagggcaggagggacccagggcagggtgacagtgagggctgtaaggccacatagggcaggagggacc

SEQ ID NO: 22389 - DNA, 201 bp, Homo sapiens
cctaggaggcagagattgcagtaagccgggatcgtactgttatacgctccagcctgggtgacaagagtgaaactttgtctcaaaaaaaaaaaaaaaaaaaagcctgagttttagtgagaggttgaccaacgtgcctaatgtcacatagtgaatgagagatggagccaggagcagacctgggatttgactctgaattctaaa

SEQ ID NO: 22390 - DNA, 201 bp, Homo sapiens
tttttcctatttcaatgaatagcatggaaaccaaggtgaagtaattgaactgaagggatttctgaatgaaggattcatgtgttcatatgtttagacaaaaytactcattagactagtttttagggagtaatttgctgctgttaaactacctcttcatatgaataattttttaaaagagcagacacatatatacttaaatag

SEQ ID NO: 22391 - DNA, 201 bp, Homo sapiens
ttggaaatattattacttttctaagtcctttcacaagcaactttctcttttcctttattctctattgtctatactttttttattttttattttttgagatrgagtcttgctctgtcaccaaggcttgagtgcagtggcccaacctcagttcactgcaagctccgcctcccaggttcacgccattcttctgcctcagcctcc

SEQ ID NO: 22392 - DNA, 201 bp, Homo sapiens
attctctagctgagctctcggttttggggtggtggtactgcatactaacgtatcaggagacatggtttgacagtgaatactggctttccttccagggacaratcagccatcacttcatggtcaactttgtttggtagtgctaggagccaagaatttacctgtgcggccagatggcaccttgaactcatttgttaaggggta

SEQ ID NO: 22393 - DNA, 201 bp, Homo sapiens
cctttaaactctctgctttttgtgtctgtagaagaattcctgtggcacccaagggtttaaatacgttctctggtttcttcttatcgtttttttttttttttccccacacttagatctgttcacattacaagcggaattgattttctatatatagtttaaggcaggggcctcagttttgcctttcttttttcttacatgggg

SEQ ID NO: 22394 - DNA, 201 bp, Homo sapiens
agatttttctatgctttttggatttctgaagactgaggttttctgcagtgaggactcacttgccccctgcccgtccttacttcctgctgtacttgaatatkggcttcctgccctaggaaggaagtttgacatcggagtaaatctccgtgtcgcaatattcttcaggtttctcaattcaagccaaacatcaagtgcctcctg

SEQ ID NO: 22395 - DNA, 201 bp, Homo sapiens
gtaagagctaaataaatagtagctgttggcacaacagaaagcataacaacaattgtgagtagtacctagaaggatataataatattaattctcggccgggygtgatggctcacgcctgtcatctcagcactttgggaggcctaggcggatggatcatgaggtcaagagatcgagatcatcctggccaacatggtgaaactc

SEQ ID NO: 22396 - DNA, 201 bp, Homo sapiens
tctcaaactgctggaatttcaggcgtgagccacctcacctcacctagttagtttttttagagacagggtgtcactccgtcacccaggctagagtacagggygtgatcatagctcactgcagcctccaacgcctgggttcaagagaccttcctgcctcagcctcccaaatagctgggactccaagtacgcaccaccacatct

SEQ ID NO: 22397 - DNA, 201 bp, Homo sapiens
caaaagctatatggtgtgatttttttttttaaagggtagagtgtcatttgctttcttctttggtttgcaaattcttatacttacagtttattactattttrctctctctgaatcgactttattgttttgatcatccgtaatttctcgtttggaggtggaacataaatatcattttggaattataaaaaagttagctagggt

SEQ ID NO: 22398 - DNA, 201 bp, Homo sapiens
ctttgacaatagtgtgtgtgtcattcttcttgttgaaactgaactgtattctgtagtcagcacttgattagttagggaaagtcctgcctttaaaacctttytgagaaccggtgagctttctgcgcattgtcttttgttaatattctctgttgtcaccttacgtagttcagctgaaacctgtcaccctgtaagggaggggag

SEQ ID NO: 22399 - DNA, 201 bp, Homo sapiens
gggatgagaggggatgaagtggtgccctccccgaccatggctaaattgtcttcctctcttacagagggagacacagctgttggcggggatgcatgctcacwatcgaagctccagtggcagaaagtcctttccagccccaatctatggacagacatgactcttgtcctgcactgacatgaaggcctcaaggttccaggttgc

SEQ ID NO: 22400 - DNA, 201 bp, Homo sapiens
gttagtaacatcaagtcatagatgcttgctgaagtcaccacatttgaacaaaaccaaactgggatggagactataatattaatttctgtttttccttctcyagaaggtcagtgcaccagatattctgaaacctctcaatcaagaggatcccaaatgctctactaaccctattttgaagcaacagaatctcccatccagtcc

SEQ ID NO: 22401 - DNA, 201 bp, Homo sapiens
catgataatgaggtcactttaggcagcctacttcttggtcctgaattgtcacgactactccactacttacttgcttcattgggttttgattcactgttttwggaatggaggaagaaccatgattaggtgggctggttatcaggttcgtcaatattttattttactaaatactccctgctcttttgggagttggcaaacaac

SEQ ID NO: 22402 - DNA, 201 bp, Homo sapiens
gatcgtactgttatacgctccagcctgggtgacaagagtgaaactttgtctcaaaaaaaaaaaaaaaaaaaagcctgagttttagtgagaggttgaccaaygtgcctaatgtcacatagtgaatgagagatggagccaggagcagacctgggatttgactctgaattctaaactctatgttcccataagaaggacaaatga

SEQ ID NO: 22403 - DNA, 201 bp, Homo sapiens
ccatctcatcctgtgacttagaatgccttaaccatctgggaatgcagcccagtaggtctcggcctcattttacccagctcctattcaagatggagttgctstggttcacatacctctgacaatgtaactctcagttcaaagctgaaagcctcaggacccagggagcctctggtctaagtcctggagtccaatggccaatca

SEQ ID NO: 22404 - DNA, 201 bp, Homo sapiens
ggaagctccccaggacaacctggcatcatcaccttctgtgcctccatccacgggcatttggcaatccgtgcagagggtttttaatgtggttcctggacccrcgctccaggatcagctgcaaactgattcaaattcaaccttcctggcctcacacacacaggttctaatttggtggggccagatggggttcaagagtgaatg

SEQ ID NO: 22405 - DNA, 201 bp, Homo sapiens
tggcttccttccttcaaactttcttcatctttactctagaccactattacactgtaaaaatgaaacaaatttgtttacagtcatctttccagggtttgtttattataattgttatgaggacaccccaaatcttatttttacctcgcttcaaaaagtcacaagaaatggtgttaagttgtaacatctttgtaaggaacccct

SEQ ID NO: 22406 - DNA, 201 bp, Homo sapiens
ttcgaattatcaaagcacccagaccttcataggctctcttgcctttaggaagctccccaggacaacctggcatcatcaccttctgtgcctccatccacggrcatttggcaatccgtgcagagggtttttaatgtggttcctggacccacgctccaggatcagctgcaaactgattcaaattcaaccttcctggcctcacac

SEQ ID NO: 22407 - DNA, 201 bp, Homo sapiens
gtggcttccttccttcaaactttcttcatctttactctagaccactattacactgtaaaaatgaaacaaatttgtttacagtcatctttccagggtttgtttattataattgttatgaggacaccccaaatcttatttttacctcgcttcaaaaagtcacaagaaatggtgttaagttgtaacatctttgtaaggaacccc

SEQ ID NO: 22408 - DNA, 201 bp, Homo sapiens
gaattgcttgaacccgggaggcggaggttgcagtgagccgagattgcactactgcactccagcctgggcgacagagcaagactgtctcaaaaaaaaagttyttccccaggagaggactgtgagtggtgtattttccacgtcattgcgtatttgagagttgctttccgtggtcttccttcatgaggaatgatttcactgggt

SEQ ID NO: 22409 - DNA, 201 bp, Homo sapiens
tgtggcttccttccttcaaactttcttcatctttactctagaccactattacactgtaaaaatgaaacaaatttgtttacagtcatctttccagggtttgtttattataattgttatgaggacaccccaaatcttatttttacctcgcttcaaaaagtcacaagaaatggtgttaagttgtaacatctttgtaaggaaccc

SEQ ID NO: 22410 - DNA, 201 bp, Homo sapiens
agtttcactcttgttgcccaggctggagtgcgatggtgcgatcttggctcactgcaacctctgcctcccgggttcaagtgattcccctgcctcagcctccsgagtagctgagattacaggcatgtcccaccaatcctggctaattttgtatttttagtagagacagggtttcaccatgttggtcaggctggtctccaactc

SEQ ID NO: 22411 - DNA, 201 bp, Homo sapiens
atgtggcttccttccttcaaactttcttcatctttactctagaccactattacactgtaaaaatgaaacaaatttgtttacagtcatctttccagggtttgtttattataattgttatgaggacaccccaaatcttatttttacctcgcttcaaaaagtcacaagaaatggtgttaagttgtaacatctttgtaaggaacc

SEQ ID NO: 22412 - DNA, 201 bp, Homo sapiens
tcaatatagtgatacagaaagtacagttttgcacatcttctgccaagccagaaggagctgtctgtctagggagttgatcgtcttagtcttttctttttttwcttcttgagacggagtttcactcttgttgcccaggctggagtgcgatggtgcgatcttggctcactgcaacctctgcctcccgggttcaagtgattcccc

SEQ ID NO: 22413 - DNA, 201 bp, Homo sapiens
tccgcctcctgggttcaagtgagtctcctgcctcagtttccctagtagctgagattacaggtgtgtgttaccacacccagctaattttttgtatttttttrtagagataggggtttcaccttgttggtcaggctggtctcaaactcctggcctcaagtgatctgcccgtctcggcctctcaaactgctggaatttcaggcg

SEQ ID NO: 22414 - DNA, 201 bp, Homo sapiens
aacccaggaggcggaggttgcagtgagccaagatcacgccactggactccagcctgagcaacagagcaagactccgtctcaaaaaagaaaaagaaaaaaamaaaaagatgcaatttcagggaatctaaaaccagaacctttcaggccagtagggcccaattatctatctattgtctgcatggaattacttgcctttctcct

SEQ ID NO: 22415 - DNA, 201 bp, Homo sapiens
cctgaggttgggagtttgagaccagcctgaccaacatgaagaaaccctgtctctactaaaaatacaaaattagcggaggatggtggtgcatgcctgtaatrtcagctactcgggaggttgaggcaggagaatttcatgaacctgggaggcggaggttgtggtgagccaagatcgcgccattgcattcccgcctgggcaaca

SEQ ID NO: 22416 - DNA, 201 bp, Homo sapiens
ccacggtgggcagatcacctgaggttgggagtttgagaccagcctgaccaacatgaagaaaccctgtctctactaaaaatacaaaattagcggaggatggyggtgcatgcctgtaatgtcagctactcgggaggttgaggcaggagaatttcatgaacctgggaggcggaggttgtggtgagccaagatcgcgccattgca

SEQ ID NO: 22417 - DNA, 201 bp, Homo sapiens
tttttgagacagagtctcgctctattgcccaggctggagaccagtggcgtgatctcgactcattgcaagctccgcctcccgggttcacaccattctcctgyctcagcctcccaagtagctgggattacaggtgcccgccaccttgcccagctaatttttttttgtatttttagtagagacggggtttcacgtgttagccag

SEQ ID NO: 22418 - DNA, 201 bp, Homo sapiens
ctttgagattatgatccaaacccaaaaatatataatgctgataagagagaagaatcacatacattctttttcttttctttctttcttttttttttttttttgagacagagtctcgctctattgcccaggctggagaccagtggcgtgatctcgactcattgcaagctccgcctcccgggttcacaccattctcctgcctca

SEQ ID NO: 22419 - DNA, 201 bp, Homo sapiens
tctttgagattatgatccaaacccaaaaatatataatgctgataagagagaagaatcacatacattctttttcttttctttctttcttttttttttttttttgagacagagtctcgctctattgcccaggctggagaccagtggcgtgatctcgactcattgcaagctccgcctcccgggttcacaccattctcctgcctc

SEQ ID NO: 22420 - DNA, 201 bp, Homo sapiens
gtctttgagattatgatccaaacccaaaaatatataatgctgataagagagaagaatcacatacattctttttcttttctttctttcttttttttttttttttgagacagagtctcgctctattgcccaggctggagaccagtggcgtgatctcgactcattgcaagctccgcctcccgggttcacaccattctcctgcct

SEQ ID NO: 22421 - DNA, 201 bp, Homo sapiens
ggggctgggcagccagaggtcccctcgtctcatgcctatgacaggagagggctttgtttgcctttcttggcaagtagggggtgtctgtgagctgccagccrggggccatctgggcagctggcacagagccctgagttcattaaataataatagcccttgtttcctgggtccctactgtggccaagtgctttatatacagcc

SEQ ID NO: 22422 - DNA, 201 bp, Homo sapiens
gctccttgatgtggttttggggtggctttgctccctgggtccctagtgatgtgggagtagccaccgaggcatgtaaggctggccacacagggtgcactgcrtcagcctgtgcccgacaggaagggaagagaaatacgtcagttactctaacaagaagaattgacttccttctctgcagagccggctctggtctcttctctt

SEQ ID NO: 22423 - DNA, 201 bp, Homo sapiens
gttttgataaaatattgaattatcattttatattcacaaaggcaaataactagtgtatgagaatgggataattcactctcactcttgaaaatatatctacycttcaagtgagtaaaaggtctaactctgctaactctgtaaaagattgaaaagaaattgaatgccaagtgtgatacaggagagttggcaaggaaagatttt

SEQ ID NO: 22424 - DNA, 201 bp, Homo sapiens
ggaatgtattgacactttctgcagtgaaatggcagatggtaacaattatgttgaaatatcaaggaggagactatgctttgtatgtttgttttagcttcatyaaaaaaataagattaaccttgatgatttatgtttgcattaattttttctattaaaacgaatatactgtgtcataactaattccacatctaaaagaaacct

SEQ ID NO: 22425 - DNA, 201 bp, Homo sapiens
gtttctgtcttcagggaaggttttctcttagagaactgagtgccaagttgctaagggccctgggagctcagagagggagagatgaggcaggctgagtggcwcaagacgacttccagaacatccatggttggaatagtcttttaatgttttattaaaagcataaaacaatcgtgtggggtagctactactttcatcctcatt

SEQ ID NO: 22426 - DNA, 201 bp, Homo sapiens
gtaaaggaataaagaacggctactccatagacagaacagccctgagggctgctggttgcccatttttatggctatttctcaatgatatgctcaacaagggrtggattattcatgcctcccctttttagagcatgtagggtaacttcctgatgttgccatggcatttgtaaactgtcatggcactggtgggagtgtagcagt

SEQ ID NO: 22427 - DNA, 201 bp, Homo sapiens
tcttcagtagagacggggtttcactattggccaggctgcttttgacctcctgatctcgtgatctgcccacctcgggctcccaaagcgctggggttacaggygtgagccacctcgcccagccaggtctacgcattttgtaagcacatgctgtccatttgaaaggctggttcttgctccagtcgttgcaattaagccatttcc

SEQ ID NO: 22428 - DNA, 201 bp, Homo sapiens
taccttaaagacttaataggatgcagtaacgtcaggcacttccaagagctaacccatcagtccacccttattcatctccaagtgaacgtatgttagtattrtaaaaaacctttactagacactctgccaaataattaaagcagtacttatgctgtagttcaattggctatcccttttaccctggcatttcatcaaccaaaa

SEQ ID NO: 22429 - DNA, 201 bp, Homo sapiens
atggctcatgcctgtaatcccagcactctgggaggctgaagtgggtggatcacctgagttcaggcgttcgagagcagcctagccaacatggtaaaaccccrtctctactaaaaatacacaaattagccaggctcatggcgggtgcctgtaatcccaactactcaggaggccgaggcaggagaatctttgcttgaacctagg

SEQ ID NO: 22430 - DNA, 201 bp, Homo sapiens
catggctcatgcctgtaatcccagcactctgggaggctgaagtgggtggatcacctgagttcaggcgttcgagagcagcctagccaacatggtaaaacccygtctctactaaaaatacacaaattagccaggctcatggcgggtgcctgtaatcccaactactcaggaggccgaggcaggagaatctttgcttgaacctag

SEQ ID NO: 22431 - DNA, 201 bp, Homo sapiens
gaccttgtgatccgctcgccttggcctcccaaagtgctgggattacatatataagctactgcacccggccaacgttttttttttaaagtttccttttttttgttaaaggataataataaatgttaaaaataataatttcttttaaagactttcttcaagcctccttgctttgtgctcataactctttgttaagccctatcc

SEQ ID NO: 22432 - DNA, 201 bp, Homo sapiens
tgtgctggactctgtactaatagcttaactaggctatctcattttatcttcataaccaccatctagggtaggtattgcatgcagcctcattttacatgtawagaaatggaggtttagattaagtcacctgccaaaggttgtatagccaaaagaggactgaactctgaggcagtgattcccagctcttatgagtataggggg

SEQ ID NO: 22433 - DNA, 201 bp, Homo sapiens
atgtacattaaacacagacttttacgtcctctgaccactaaagttatggaatccatattaggaaaattcaagtttggaagtttgaggcttttagaaatatragaagtgttatttaagcaaatttaaaattttacattatcaccgcgagcagaaaatgcaagggtttgtgtagaatattttgtctttttggaagtaatgctg

SEQ ID NO: 22434 - DNA, 201 bp, Homo sapiens
ctttgggaggtcgaggtgggaggatcacctgaagtcaggagtttgagaccagcctggccaacatggtgaaaccctgtctgtactaaaaatacaaaaaaaaattagccaggcatggaggcacacgcctgtagtcgctactactcgggaggctgaggcaggagaatcacttgaacctgggaggcggacgttgcagtgagcaga

SEQ ID NO: 22435 - DNA, 201 bp, Homo sapiens
cggtgaagtattccttagtcaggatgtcttaagggttaaaaagaggtgaaaagtccccattaggggggagattaaacatcacacaaacctccagtagtaamaaagatattcgggccgggcgtggtggctcacgcctgtaatcccagcactttgggaggctgaggcaggtggatcacgaggtcaggagatcgagaccatcct

SEQ ID NO: 22436 - DNA, 201 bp, Homo sapiens
gcaggggcggtaaagcattccttaggactgaagaaagaaaagccgccagggggcgggtcggggtggggcggtgaagtattccttagtcaggatgtcttaarggttaaaaagaggtgaaaagtccccattaggggggagattaaacatcacacaaacctccagtagtaaaaaagatattcgggccgggcgtggtggctcacg

SEQ ID NO: 22437 - DNA, 201 bp, Homo sapiens
cacagcgtgccaagtcgcacggacggtggccgaattcgccttctcatctcatgtttctttggtttgctgaagccattgtccttcaggcttttccttgcttragagcaaaaaataattactgtgagctgccctggcggcatagagagcaattccaaatcatctctagaaaggtctcagtatcttcttccccatttcaaccaa

SEQ ID NO: 22438 - DNA, 201 bp, Homo sapiens
ttcagtcatctagccagagaggtgaagtggttcaacctgatttctttgctcttgaactgcattccgtccatttcgctcacagcgtgccaagtcgcacggayggtggccgaattcgccttctcatctcatgtttctttggtttgctgaagccattgtccttcaggcttttccttgcttgagagcaaaaaataattactgtga

SEQ ID NO: 22439 - DNA, 201 bp, Homo sapiens
caaagactgtgggaggcacttacacagtgtgggcattgtggctggggtttcttccccctaaatccggagggctgtgtttaacgcacgccctggcattcatytacttaagtgtcctgtccctttgcaaggcttactgtatttcagtcatctagccagagaggtgaagtggttcaacctgatttctttgctcttgaactgcat

SEQ ID NO: 22440 - DNA, 201 bp, Homo sapiens
cggcctctggatttgcctcctggggctgcagtaacagagtgccacaacctggggatcctccaacaacagaaatgtatcatctcccagttctggaggctggkaggccgaaattgaggtgtcagtggggccatgcttcctctgctggtgctagggtagaacgctgcctccctcttcctgcttctagtgggtctcagcaattac

SEQ ID NO: 22441 - DNA, 201 bp, Homo sapiens
acagtgagccatgattgcgccaatgcgttccagcctgggcaacagagcgcgactgtctctaaacaaacaaactaaaaacaaaaaccatgacagaacacttmactggccactttacacaataaataggcaaaaacagcatgcatatttttgcaagcataaacactcagatatactaatgacagtcacatgggtataacaatt

SEQ ID NO: 22442 - DNA, 201 bp, Homo sapiens
catctaatgagataatgtagtatcttgatttgctatctaagtcatctaaatattttatctaaattgccagcattgactatgatgtgctggactctgtactratagcttaactaggctatctcattttatcttcataaccaccatctagggtaggtattgcatgcagcctcattttacatgtaaagaaatggaggtttagat

SEQ ID NO: 22443 - DNA, 201 bp, Homo sapiens
tagaaaatctaaaaatgattttgaagaaatttatttaaaaaatttaaaggggatttgagaaacatgtaaaaacatgacaacagcctgggcaacatagcaasaccctatctacaaaaaataaaaaaattagctggatgtggtagcacatgcctgtaggctcagctactcaggaggctgagggaagaggatcccttgagccca

SEQ ID NO: 22444 - DNA, 201 bp, Homo sapiens
ttcaccacgttggccaggctggtctcgaactcttgacctcaagtgatctgcctgcctcgacctcccaaagtgctgagattacaggcatgagccaccgcacmcggcctagaactttcattcttccttttaaatgggtcaaacaggtgttcggccatgaggctttattaggaagaaggcatccttctgaggtttttaccttat

SEQ ID NO: 22445 - DNA, 201 bp, Homo sapiens
tcatctttactctagaccactattacactgtaaaaatgaaacaaatttgtttacagtcatctttccagggtttgtttattataattgttatgaggacaccycaaatcttatttttacctcgcttcaaaaagtcacaagaaatggtgttaagttgtaacatctttgtaaggaacccctagaaagccggcttgtttggtaggc

SEQ ID NO: 22446 - DNA, 201 bp, Homo sapiens
tttcaccacgttggccaggctggtctcgaactcttgacctcaagtgatctgcctgcctcgacctcccaaagtgctgagattacaggcatgagccaccgcamccggcctagaactttcattcttccttttaaatgggtcaaacaggtgttcggccatgaggctttattaggaagaaggcatccttctgaggtttttacctta

SEQ ID NO: 22447 - DNA, 201 bp, Homo sapiens
gtaaatagagttaattttacctgtttttttttttttaacttttttaatatggctactataaaatttaaaattgtatgtgtgacttgcattgtctctctgcyggacagcacagctctagagacagttttaaggtccccgtttggaggagtggggttctcaagggaaaatgaaaccatcttcagaggatgaaactatcttcaa

SEQ ID NO: 22448 - DNA, 201 bp, Homo sapiens
ggagctggtaaaatatttccttggtggtcaggactaaggaaagaaaagctgcggggcggtaaagcattccttggttaggacatacctaggtaagagaaacygcaggggcggtaaagcattccttaggactgaagaaagaaaagccgccagggggcgggtcggggtggggcggtgaagtattccttagtcaggatgtcttaa

SEQ ID NO: 22449 - DNA, 201 bp, Homo sapiens
aaggaaataccggaggagctggtaaaatatttccttggtggtcaggactaaggaaagaaaagctgcggggcggtaaagcattccttggttaggacataccwaggtaagagaaaccgcaggggcggtaaagcattccttaggactgaagaaagaaaagccgccagggggcgggtcggggtggggcggtgaagtattccttag

SEQ ID NO: 22450 - DNA, 201 bp, Homo sapiens
gggccaggtaacctcatgcataagacaaggaaggaaataccggaggagctggtaaaatatttccttggtggtcaggactaaggaaagaaaagctgcggggyggtaaagcattccttggttaggacatacctaggtaagagaaaccgcaggggcggtaaagcattccttaggactgaagaaagaaaagccgccagggggcgg

SEQ ID NO: 22451 - DNA, 201 bp, Homo sapiens
tgtaaggtctggctccagccaatggagacaaaacacagcagcggggacaagctgcgtaaaggataaaaattgcttccctccattgttcaggtgtgctgtcrtcattgttccatctgtaaggagcaccctttctgcagaaagtaaaattgccctgctaaaaaaactttttgtctaaatgctaatttttccttatagtagtaa

SEQ ID NO: 22452 - DNA, 201 bp, Homo sapiens
ctgggtaatttataaacaatagaaatttatttttcatggtcctagacactgggaagttcaggatctcaaggcatggacaggactggtgtctagtggtctgytcctcatagatggctctaagtctcttcctcacatggtgaaaaggatggaagggcaagagggtccagtgctgtgtgcagcctcttataaaggcctgaatcc

SEQ ID NO: 22453 - DNA, 201 bp, Homo sapiens
gcgatcttggctcactgcaaggtccgcctcctgggttcatgccattctcctgcctcagcctcctgagtagctgggactacaggtgcccgccaccacggccrgctaattttttgtacttttagtagagacggggtttcactgtgttagccaggatggtctcgatctcctgacctcatgatctgccctccttggcctcccaag

SEQ ID NO: 22454 - DNA, 201 bp, Homo sapiens
gtcatggtggcaggcacctgtagtcccagctactctggaggctgaggcaggagaattgcttgagccttggaggtggaggttgcagtgagccaagtgccacygccctccagcctgggcaacagagcaagactccatctcaaaaaaaataaattgtatttaatacacacctaacctaccaaacatcatagcatagcctagcct

SEQ ID NO: 22455 - DNA, 201 bp, Homo sapiens
agagggccccagactcttcactggcccaggtgctgaagggtggctttgcccctgaggggttttgaaaggtgacccagaattacaacctctagctgctgatkctgcccaatgaagtcaaaccagcgggaggaaatgagtggctgcagctctgtctattatcagtacgtttctagaagatgtcagcactgtagtcccccttag

SEQ ID NO: 22456 - DNA, 201 bp, Homo sapiens
aatggggttttgctgtgttgcctaggctagtctcaaactcctgagctcaatcggatgcctgccttagcctcccaaagtgctgggattacaggtgtgagccrctgcgcctggtccaggagtacgtctttaaatagaacattcatcagactgcaattacacatgccttagctggggagctcaccaaaattcctctcattttca

SEQ ID NO: 22457 - DNA, 201 bp, Homo sapiens
ttctgtagttgcatgcggatggtctcagtgctgcacttggctctgagacagtctctttatgtgactttaattagttgtccgtattcctcatgagccctgtstcagctgtcacacgatgacaatggacatcaaagcactgctcttcagatgagcagaaacagtcgtctcatgcaatggtctgttcctttcttagggaggaag

SEQ ID NO: 22458 - DNA, 201 bp, Homo sapiens
gcctcagcctcttgagtggataggattacaggcatgcaccaccacacctggctaatttttggatttttagtagaaatggggttttgctgtgttgcctaggstagtctcaaactcctgagctcaatcggatgcctgccttagcctcccaaagtgctgggattacaggtgtgagccactgcgcctggtccaggagtacgtctt

SEQ ID NO: 22459 - DNA, 201 bp, Homo sapiens
caccacgcccagccagatatggctgttataagggacaatttagccaaatgtttataaagtactcagcaatgatagtatgatctataaatgctaaataactrttgggttgaaatataaggagtacacttctatttatttatttttatttatttttgagacagagtctcattctgttgcccaggctggagtacgatggcacaa

SEQ ID NO: 22460 - DNA, 201 bp, Homo sapiens
tttctatattttccttgttctagtcactaagtattggtagtaatcatttatgtactaatcagaaaatagtagtgtctaaccagatgaaggagagaaagttagttgatatcttctgacaattactagcacttcatagagaaagatagcatattttgaaaaacgtgcagattggcatatatttgtgattttacttacattagc

SEQ ID NO: 22461 - DNA, 201 bp, Homo sapiens
attaatgaaattacatgtaagctaaattgtgcaaaaccaatgaccttgtgttaatacacatttggttgtacagctcaaatgaagtaatgcttcctgctatdaatagtgttggttgctactgatgttgtatgtatgtatgtatgtatgtattttgagacggagtcttgctctgtcgcccaggctggagtgcagtggagcgat

SEQ ID NO: 22462 - DNA, 201 bp, Homo sapiens
gcggggtggggagcgagggccctcaggctgggcagagcttctctcctcattctggtcgcgggaccctctgtgtcatcagcgaccctttctgcctgcacccraggtctctttactcttggcatggcatcggcccccttccccaactctgctctgtgctgggcgtgtgtgtagagtctctggggtctaaggggaaataagatt

SEQ ID NO: 22463 - DNA, 201 bp, Homo sapiens
tagtaggggtcaggggatagaaggagaggaagcaggggagctttcgaggctgaggccgggcacggaacctcccagcaaagggatctgactgtgcctggagygggtcacaaagcggggtggggagcgagggccctcaggctgggcagagcttctctcctcattctggtcgcgggaccctctgtgtcatcagcgaccctttct

SEQ ID NO: 22464 - DNA, 201 bp, Homo sapiens
ttcactgtgtttctgctcggcttctcttcatcatccccttttctgtagttgcatgcggatggtctcagtgctgcacttggctctgagacagtctctttatrtgactttaattagttgtccgtattcctcatgagccctgtctcagctgtcacacgatgacaatggacatcaaagcactgctcttcagatgagcagaaacag

SEQ ID NO: 22465 - DNA, 201 bp, Homo sapiens
cgggccccaggcagtgtgtgggacagacagagagacggagccagtctgacactgcggtcaacgtcaccaccagggtaccctgagccccacaaggcctccaygctgatcaccttcatgttgtcttccagaactttctagcctgccttctctgtagatttatgttttctttggttttatagaaaaacagtaagccatcagaaa

SEQ ID NO: 22466 - DNA, 201 bp, Homo sapiens
gccctccggggcaggagcgcagaggacactctgcaagaacttataggtctcttgactttcacatgtcactgctttggaatgtgactcttttttttttttttcttttaaagataaagttcctgaaaaagattaaagcagagatgtttccagattctcatgagaaaccttctagttagcatagtattttctcactagacattc

SEQ ID NO: 22467 - DNA, 201 bp, Homo sapiens
gagtgatattggctcgctgcaacctccgcctcctaggatcaagcaatcctccctctcagcctgccaagtaactgggaccacaggtgcacaccaccacgccyagttagtttttctatttttagtagagacggggttttgccatattgcccaggctggtcctgaactcctgggctcaagtgatctgcccacctcggcctccca

SEQ ID NO: 22468 - DNA, 201 bp, Homo sapiens
atgaagtttctctctgtcacccaggctggagtgcagtggagtgatattggctcgctgcaacctccgcctcctaggatcaagcaatcctccctctcagcctsccaagtaactgggaccacaggtgcacaccaccacgcccagttagtttttctatttttagtagagacggggttttgccatattgcccaggctggtcctgaa

SEQ ID NO: 22469 - DNA, 201 bp, Homo sapiens
gctttttggtgactgtgcctcaggatactgttgccacaaccagggacagagtgacagtgagggctgtaaggccacatagggcaggagggacccagggcagrgtgacagtgagggctgtaaggccacatagggcaggagggacccagggcagggtgacagtgagggctgtaaggccacatagggcaggagggacccagggca

SEQ ID NO: 22470 - DNA, 201 bp, Homo sapiens
agcgcctggcgcgttagagatactggtgaaataaacattgatagaattgaataatggcctgagagatgtgaacttctttgcacaaaattctaaaaactgakcagtcatgaagctggccataattcacacacctgattacactcaatttattaaagtgtttctgaaagctccccaccagctgctattttgtttggcccatgg

SEQ ID NO: 22471 - DNA, 201 bp, Homo sapiens
tataaggaaactaaatattatgtttaattgcgcttaagtgaaattctaaagcaagcatgtgctttgattaatcatgcctatctctaacaccctacccagcrcctggcgcgttagagatactggtgaaataaacattgatagaattgaataatggcctgagagatgtgaacttctttgcacaaaattctaaaaactgagcag

SEQ ID NO: 22472 - DNA, 201 bp, Homo sapiens
cctggccggtgacctcggttgacactgtccctcaggccactcactttgtctctggaccctggggaaagccacagcacctggcccttcatctctttcccaayaaagcaggcctctggttcctcataggaagagaaatggtggctcagacctgtaatccaagcactttgggaggccaaggtgggtggatcacttgaggtcagg

SEQ ID NO: 22473 - DNA, 201 bp, Homo sapiens
aaccttctagttagcatagtattttctcactagacattcagctctacttcttaaattctcctgaagtgttataaggaaactaaatattatgtttaattgcrcttaagtgaaattctaaagcaagcatgtgctttgattaatcatgcctatctctaacaccctacccagcgcctggcgcgttagagatactggtgaaataaa

SEQ ID NO: 22474 - DNA, 201 bp, Homo sapiens
gaaggtgatcagcgtggaggccttgtggggctcagggtaccctggtggtgacgttgaccgcagtgtcagactggctccgtctctctgtctgtcccacacastgcctggggcccgtggcgagaagatgcttctcagaagtcatatcattctgggatttggagagctctaaaaggcaaacacaagggttgatgggtgggaaca

SEQ ID NO: 22475 - DNA, 201 bp, Homo sapiens
gctaattttttgttttttttctttaagtagagacagggtttcaccatgttagccaggatggtctcgatctcctgacctcatgatccgcccaccttggcctyccaaagtgctgggattacaggcgtgagccaccacgcccggcccagaatgcacatttctgttgtgtattttgctgactccctatttggctagaagaggaaa

SEQ ID NO: 22476 - DNA, 201 bp, Homo sapiens
cggctaattttttgttttttttctttaagtagagacagggtttcaccatgttagccaggatggtctcgatctcctgacctcatgatccgcccaccttggcytcccaaagtgctgggattacaggcgtgagccaccacgcccggcccagaatgcacatttctgttgtgtattttgctgactccctatttggctagaagagga

SEQ ID NO: 22477 - DNA, 201 bp, Homo sapiens
gggtttcactgtgttagccaggatggtctcgatctcctgacctcatgatctgccctccttggcctcccaaggtgctgggattacaggcatgagccaccgcrcctggcctgttgtatttataagcaccacctcttatatggcaagccctcttctgggtaccagggacagcgagatgcagaagatgaggccatgtcctcaaaa

SEQ ID NO: 22478 - DNA, 201 bp, Homo sapiens
cgcttgaaccaggggcgcgaaggttgtggtgagctgggtttgggccactgcactccagcctgggtgatggagtgagattctgtctcaaaaaaaagaataawaaaaaataaataggctggatgcagtggctcacgcctgcaatcccagcactttgggaggccgaggtgggcagataacctgaggtcaggagttcgagaccag

SEQ ID NO: 22479 - DNA, 201 bp, Homo sapiens
taatgtgtgtgtatgtttaaatgactttaggagagtacaatttccataacataaaatgtgtcttttcagtctacaatgcaatgattttgagtaaatttacmaagttgtacaaccatctctacactctaattttggaacatttctatcacctcaaaatgatctcttactttttaatcacaagaaatgatactagagaaaata

SEQ ID NO: 22480 - DNA, 201 bp, Homo sapiens
ctgaccatctcttccttgcctctgcagtatcaggtggcccctgcccagctggtgacccggcagctgcaggtctcggtgtggcatctgggcacgctggcccrgagagtgtttcttggagaagtgatcattcctctggccacgtgggactttgaagacagcacaacacagtccttccgctggcatccgctccgggccaaggtg

SEQ ID NO: 22481 - DNA, 201 bp, Homo sapiens
taaatgaccagtcagtcaagtcatgaaccttaagaaccttgaacaggccgggcgtggtggtccatgcctataatcccaacactttgggacgccgagggccygaggtcaggagttcgagaccagcctgaccaacatggtgaaaccccgtctctactaaaaatacaaaaattagccgggcgtggtggcgggcacctgtaatcc

SEQ ID NO: 22482 - DNA, 201 bp, Homo sapiens
tagaaaatctaatccaatatcaacttttaataaaagtagtcattcccaacaattatggtttcataatgtgtgtgtatgtttaaatgactttaggagagtayaatttccataacataaaatgtgtcttttcagtctacaatgcaatgattttgagtaaatttacaaagttgtacaaccatctctacactctaattttggaac

SEQ ID NO: 22483 - DNA, 201 bp, Homo sapiens
caagacttggacccaagactgtgtgttcgccggcctggcgctgtgactttgaaatagttactttcttgtgggtggggtgggcggagggtttgttttaactrgctcagctctgttcaggtacccgaacagcccccgcctcagcatcatacacagaccagactggatcaggtcctgtggcttcccctggcggaggcctccctt

SEQ ID NO: 22484 - DNA, 201 bp, Homo sapiens
aggtggcacagagctgcaggtggcacagagctgcaaggcatccctcctaaagccagtagggtggggagtccgcccacagacccgcccctgggctctgttcygcctcggtttctggccgctgaggctggaggcagccatacctcatttggcacccgagggccaggaagacgggctggcccacgcgggctcccaggagtcctg

SEQ ID NO: 22485 - DNA, 201 bp, Homo sapiens
actatgctttgtatgtttgttttagcttcatcaaaaaaataagattaaccttgatgatttatgtttgcattaattttttctattaaaacgaatatactgtrtcataactaattccacatctaaaagaaacctggtcttctcccttaagattgctgaggaattactcttgttcagacttgtttccttcaaactgtgatcttc

SEQ ID NO: 22486 - DNA, 201 bp, Homo sapiens
atcccccgtgcaccctgcctctcccacacctctgtcatcagctcgaagacaaggcctggaacaagcacagggcttggcataggacaggcggccaccaggcmtcatcagactgagcctgctctggcaagtgggtgaggagcaggtggcacagagctgcaggtggcacagagctgcaggtggcacagagctgcaaggcatccc

SEQ ID NO: 22487 - DNA, 201 bp, Homo sapiens
tctgtccattctcttctatcttcacttctcatacctcactcactcatgctggtgcaccagtccaagctttttttttttttttttttttttttttggtagaratggggttttaccatgttggccaggctggtctcaaactcctgacttcaagtgatccgcctgcctctgcctcccaaagtgctgggattacaggcatgagcc

SEQ ID NO: 22488 - DNA, 201 bp, Homo sapiens
ggaattgtagaaagtaaaaagtttccttttcagtttcctttctggtaataataataatgttaaaaataataatttcttttaaaaactaacttccttcaagyctccttgctttgtgctaataactctttgttaagccctatcctatgtagctgttagatatagagaaataagtacgttctgtgttcttgtacttgaatgaag

SEQ ID NO: 22489 - DNA, 201 bp, Homo sapiens
gaggtcaggagatcgagaccatcctggccaacaaagtgaaaccatgtctctactaaaaatacaaaaaattagccgggcatggtggcgggcgcctgtaatcycagctactcgggaggctgaggcaggagaatagcttgaacccgggaggcggaggttgcagtgagccgagatcacactattgtactccagcctgggccacag

SEQ ID NO: 22490 - DNA, 201 bp, Homo sapiens
ggcattttaattcattcgttcattcatttgtttattaaaaaacattaaggccgggcgcggtggctcatgcctgtaatcccagcactttgggaggccaaggygggtggatcatgaggtcaggagatcgagaccatcctggctaacaaggtgaaaccccttctctactaaaaatacaaaaaattagccgggcgcggtggcgcc

SEQ ID NO: 22491 - DNA, 201 bp, Homo sapiens
cgccaccttgcccagctaatttttttttgtatttttagtagagacggggtttcacgtgttagccaggatggtctcgatctcctgacctcgtgatccgcccrcctcgggctcccaaagtgctgggattacaggcgtgagccaccgcgcctggcctctttttcagtttcaaactgagactggggtgaccttcaaaatcctgct

SEQ ID NO: 22492 - DNA, 201 bp, Homo sapiens
aggcatctttagaaattgaatatggagaggtgcagcccttcaaaggcatgggaatttaccacccatgactccctctggacttgccctgattttttatgttytgcttcccacaagtgctccaggggaaaacttctgcctagaggctgagactgccttaaggtgttttgtgttgatgtaggggattagataattgagtttctg

SEQ ID NO: 22493 - DNA, 201 bp, Homo sapiens
atccctgctaaagtcactcgccagccagaccgggcagggtggtgggggcccttggtccaaaacacctgcctctcgagggatgcctgtctgtgagcatctcrcagctccttgcgcgaatactgacatgttaacaagaggtcaaaattcagggctctttaaggaagcttctaggaagaaacaactgaggaatcaaagagaaga

SEQ ID NO: 22494 - DNA, 201 bp, Homo sapiens
gtgtgaatcctcacagtgctgtgagccctgctgtgggtagaggttgtgactcacttattctttttttattattatttattttttaaaaattgggccaggtrtggtggctcatgcttgtaatcccggcactttgggaggctgaggtgggaggatcacttgagttcaggagttcgagaccaccttggccaacatagtgaaacc

SEQ ID NO: 22495 - DNA, 201 bp, Homo sapiens
ctgctttcggccttctcatcgcccctctgtcgtggtggatcccccttcttaggtctacagggagaggacaggtcggggcacagcatctaaccgtttttatygccaaggccttaaacaagtacggctctgtccagctgcagtagaatttttcctaatttcattgactggttatctgatataacagaccaggagtcacaaact

SEQ ID NO: 22496 - DNA, 201 bp, Homo sapiens
gcgacagagcaagactctgtcttaaaaaaaaaaaaaaaaaaaaaaaaattgggatgacacctggcaaccacccgagcagcaaatgtgtgcaaaatgctcckcgccgtgcctggcagacacggctgccaaccagccatgtgcctgagacaagccctggcagcctcagacctgggccctggcctgcagctgttcctgtccctg

SEQ ID NO: 22497 - DNA, 201 bp, Homo sapiens
tcctgggtttttatttcggtttaactcagtcatgctttcctcagtcaagtctgattgttctcaagatgctttcatgccacttacacagcttctttgggaayagcatttttttttttttttttgagacggagtcttgctctgttgcccaggctagagtgcagtggggcgatctcggctcactgccagctccacctcccaggt

SEQ ID NO: 22498 - DNA, 201 bp, Homo sapiens
ccagttcccatggaggctccgtttagatagccccacctgtgcttttctttggtggcacttggaactccagggtatagtttcttacacaggatgttattccyactccacaggcaccagcagagaggtggccagagggaaggccgcctttctcctgactgcctgtctgtagcacccacagcgtgacccatgctgtgtgggtgt

SEQ ID NO: 22499 - DNA, 201 bp, Homo sapiens
ttactcagctttctgggacatggttgttggtttccaggtggtcgtttccccccggctttgtattaggaaaatgttcgaatagaagcagagcggtgaccccrtgtctgtacagccctcgactatccccgttttggtcttgtccccacccgctccccaccctaagttatatttgtacactttttctgacttcctgcaggcttt

SEQ ID NO: 22500 - DNA, 201 bp, Homo sapiens
tgttgctcttgagcccctgaaatagggctgcaagatgcactaccaaagtgaacacactgggtttcagagacttggaatccaacaaaagtaaaatatttcayggataactttaatgttgatgacattttttaatattttggatatattgtgttaaactaaatatagaattaaaattaatttggccaggcatggtggcttaag

SEQ ID NO: 22501 - DNA, 201 bp, Homo sapiens
agggctataaggccacgtaggacaggaagaacccggggcagggtaacactgagggctgtaaggtcacatagagcagcggggggggacctgggggcagggtracagtgagatctggaaagtcacatagagcaggagggactcggggcagggtgacagtgagggctgtaaggtcacatagacctggggacagggtgacagtga

SEQ ID NO: 22502 - DNA, 201 bp, Homo sapiens
aaaacgtacctggcaagacttggacccaagactgtgtgttcgccggcctggcgctgtgactttgaaatagttactttcttgtgggtggggtgggcggaggrtttgttttaactggctcagctctgttcaggtacccgaacagcccccgcctcagcatcatacacagaccagactggatcaggtcctgtggcttcccctggc

SEQ ID NO: 22503 - DNA, 201 bp, Homo sapiens
gtggacagtaagaacatcgtgttggcctctgccaagccagcacaggccctgcatgcctgagcacaggcaccgtccctccagggcaaacacgtggtgttgcrgggaatggaggaggggggagttcatgctttgctttaaaaaataaataaataaatgcaggctggtgcagtggctcacgcctgtaatcccagcaatttggga

SEQ ID NO: 22504 - DNA, 201 bp, Homo sapiens
ccctcgtcactcttgggtgtgttgggagccccctgtgtggacagtaagaacatcgtgttggcctctgccaagccagcacaggccctgcatgcctgagcacrggcaccgtccctccagggcaaacacgtggtgttgcggggaatggaggaggggggagttcatgctttgctttaaaaaataaataaataaatgcaggctggt

SEQ ID NO: 22505 - DNA, 201 bp, Homo sapiens
agaggatgcctgcgtgaatcccagtctcaacaccagctttgttggggtgggagtggtggtggcggcgtctgtcatcagtggttggccttttaatgtggacytaaggtgaaaaacttctggctggtcatcatttttaaagggatgagaggggatgaagtggtgccctccccgaccatggctaaattgtcttcctctcttaca

SEQ ID NO: 22506 - DNA, 201 bp, Homo sapiens; identical to SEQ ID NO: 3743

SEQ ID NO: 22507 - DNA, 201 bp, Homo sapiens; identical to SEQ ID NO: 3746

SEQ ID NO: 22508 - DNA, 201 bp, Homo sapiens
tgggcaacacagtgaaaccctgtctctactaaaatacaaaaaattaggtgggcatggtcgtgtgtacctgtaatcccagctacttgggaggttgaggcagragaattgcttgaacccgggaggcggaggttgcagtgagccgagattgcactactgcactccagcctgggcgacagagcaagactgtctcaaaaaaaaagt

SEQ ID NO: 22509 - DNA, 201 bp, Homo sapiens
tccctctaaatcctacttttaacattgctggccgggcatggtggctcatgcctgtaatcccagcactttgggaggctgaggcgggtggatcacttgacgtyaggagttcaagaccagcctggccaacatggtgaaaccccatatctactgaaaatacaaaaattaggccgggcacagtggcaggcgcctgtaatcccagct

SEQ ID NO: 22510 - DNA, 201 bp, Homo sapiens
gcccaggagttcaagactagcctgggcagcatagtgagatcctgtctctaaaaaaattaaatgaaattaaaaaattaaaacctagaaaatgaagaaaatcmtaaagagcaatgttaaaaatacagcagcttcacccagagaacaattgttgacattttagtatatattatttctgttcttttgtgagtgtatgtatctatg

SEQ ID NO: 22511 - DNA, 201 bp, Homo sapiens
ctggtgccaaggttaagatgatatttgtctactgactctttcctgtttcaaaaccttatttctttttttccctctaaatcctacttttaacattgctggcygggcatggtggctcatgcctgtaatcccagcactttgggaggctgaggcgggtggatcacttgacgtcaggagttcaagaccagcctggccaacatggtg

SEQ ID NO: 22512 - DNA, 201 bp, Homo sapiens
atgattgcagggtttgtgttccctcttcagctgtctcactctgccagaccaacaaaaactgagactgaagtcgccagtcctgaggaagcaggcttgccccyagtggaaacactcatttgtcttcagtggcgtaaccccagctcagctgaggcagtcgagcttggagttaactgtctgggatcaggccctctttggaatgaa

SEQ ID NO: 22513 - DNA, 201 bp, Homo sapiens
ggaggctgagacaggaggactgcttgagcccagaccagcctgcgcaacatggtgaaacccatctctacaaaattaaaacattagctaggcatggtagcccrcacctgtagtcccagctactcgggaggcggaggctaaaggattgcttgagcctgggaggccaaggctgcagtgagccatgatggtgccactgcactccag

SEQ ID NO: 22514 - DNA, 201 bp, Homo sapiens
tagtatatattatttctgttcttttgtgagtgtatgtatctatgcttgtgggtgcatatctgtatgtgtggatatatgtgtgtgtatacacacatatacayagacttttttgaagtatttaggttgaaccataagaaattggtatttttaggcaaaaaattattgaatagaggcaatttcacatgagtcaggctaatatat

SEQ ID NO: 22515 - DNA, 201 bp, Homo sapiens
gtgatgattgtttatgtcagatacagcaaagtgtattgttctgacaagatccatatattatgacagatttcctgggggtgggcataaggcctgttgaggaaggggcacatttgcccagttcccatggaggctccgtttagatagccccacctgtgcttttctttggtggcacttggaactccagggtatagtttcttacac

SEQ ID NO: 22516 - DNA, 201 bp, Homo sapiens
gttactcagctttctgggacatggttgttggtttccaggtggtcgtttccccccggctttgtattaggaaaatgttcgaatagaagcagagcggtgacccygtgtctgtacagccctcgactatccccgttttggtcttgtccccacccgctccccaccctaagttatatttgtacactttttctgacttcctgcaggctt

SEQ ID NO: 22517 - DNA, 201 bp, Homo sapiens
cagtctcctgagcatctgggactacaggcgtgcaccaccacgcccagctaatttttgtatttttagtagagacggggtttcaccatattggccaggctggyctcgaattcctgacctcgtgatccacccaccttggcctcccaaagtgctgggattacaggcatgagccaccacacccggccagcactattattttaatgt

SEQ ID NO: 22518 - DNA, 201 bp, Homo sapiens
cttgagccctggagtgagaggctacagtgagctatgatcacagcactgcactccagcctgagtgacagagtaaaaccccgtctcaaaaacaagaggggggraaaagaagttactcagctttctgggacatggttgttggtttccaggtggtcgtttccccccggctttgtattaggaaaatgttcgaatagaagcagagcg

SEQ ID NO: 22519 - DNA, 201 bp, Homo sapiens
aatttttttttttttataggacatagtctcactaagttacccaggctggtctcaaactcctggcctcaagtggtctcttctgcctcctggaggaggctgakgtgggaggatcgcttgagccctggagtgagaggctacagtgagctatgatcacagcactgcactccagcctgagtgacagagtaaaaccccgtctcaaaa

SEQ ID NO: 22520 - DNA, 201 bp, Homo sapiens
actaactgataaggagtgtagctggaatatggggaataatcacatcaatccagagtttatagacagagattgaatgtggggcagagtcggaaatggacccrtgggctgggtgtggaggctcacgcttgtaatcccagaactttgagaggctgagacgggtggagggcttgagcccaggagtttgagaccagcctgggcaat

SEQ ID NO: 22521 - DNA, 201 bp, Homo sapiens
aaaaaaaaaaacaaaatgaaaaggcttacttcaagtattattataaagctgtagcaatgcaaacaatgtgttattgatacaaggacagaacaagtcaggaragtagaatcaaaagtccagatacagaccttagcgtatatgaaaacttacatgatcaaggagtgtcttagtccatttcggctgctgtgacagaataccata

SEQ ID NO: 22522 - DNA, 201 bp, Homo sapiens
aaaccgcacagctgctgcaaatgggtgcaagtgtccagcctcacagcaacagccgtgtcacgaggagtcaccattcaaaccccaaacaagcgccggagtgrgggcagcatgggccacagaggtcagcagcgagactcgggcctggacacagtcagtgcacgtgaatctggcctgcagtgtcggctaccagaccaagggagg

SEQ ID NO: 22523 - DNA, 201 bp, Homo sapiens
aaatgcccatctccatggccacaagccaccccagcggggaggaaaaggaggaatgaactgaggaagctaacctggccagccaagccatttgtgcctggccygcagacatcagaagtgtggacagagcctacaggcagcccccaacagagcaggggacggccctgctgcgcctcccctctgtttgcagaggctgaaggaggg

SEQ ID NO: 22524 - DNA, 201 bp, Homo sapiens
aacttcggcatcttccctctccttgcgttcctctttactctttgctaggatcttagtaatccctccatcctgtcctccacctgaccacagagcggcacggygtgggcagcgccacagcctgtgggcagggccagcagagcccactgcaccactcccatctgctctctcggggtctgagggctgtagcagattctctagctg

SEQ ID NO: 22525 - DNA, 201 bp, Homo sapiens
atgtgacccaagaaatgcccatctccatggccacaagccaccccagcggggaggaaaaggaggaatgaactgaggaagctaacctggccagccaagccatktgtgcctggcccgcagacatcagaagtgtggacagagcctacaggcagcccccaacagagcaggggacggccctgctgcgcctcccctctgtttgcagag

SEQ ID NO: 22526 - DNA, 201 bp, Homo sapiens
gatttttgtatttttggtagggatgttgctcaggctggtctggaactcctgcgttcaagcaatcctctcgcctcggcctccgaaagtgctgagattacagrcgtgtcccaccaatgcgacttcttgatttgaagtttttgtagttcatgtgtctaaaggatctctggagacctccttgccactggggtactggttggagaa

SEQ ID NO: 22527 - DNA, 201 bp, Homo sapiens
tttttgtatttttggtagggatgttgctcaggctggtctggaactcctgcgttcaagcaatcctctcgcctcggcctccgaaagtgctgagattacaggcktgtcccaccaatgcgacttcttgatttgaagtttttgtagttcatgtgtctaaaggatctctggagacctccttgccactggggtactggttggagaaca

SEQ ID NO: 22528 - DNA, 201 bp, Homo sapiens
ggaaagcgcaagactggagtccaaaggaacaccgtggacccgacctttcaggagaccttgaaggtacttgctggacagatattcctgtgcagagtcctccygagcccgggtggagcgcctggggcagagtccagtggatggtgctttcaaactcttgactcagttagatataatacagacacctatatgtttcttcgcagc

SEQ ID NO: 22529 - DNA, 201 bp, Homo sapiens
ggctcatttcggtgtctctctaggcctgatactttaaaggaggcttgtgtttcttagattaaaagtttattttctttttcaaaagtatttgcaatgtatgktgtgccagtgtaattggtagctgggacctggaactgtggagagaatgatttgtgctttgatcacagaagagctgtgatggggcatcaggacaaaggcgca

SEQ ID NO: 22530 - DNA, 201 bp, Homo sapiens
tttactcacttgaggtaatagatgagaaggatcttttaaaaggtgaaagtatttcatgatagcattataaaatgcattaacagacaagtatatcatgcctrggaagtgaggtgtatgaaagcacacagctgtctgttgtataaagtcaggcggattcagtgtgttaccaggcatggaagcaaaggactgaaaagagagtta

SEQ ID NO: 22531 - DNA, 201 bp, Homo sapiens
gagttaactccacctacaaaaaaaaactgttttgcaacatttcagttattttgtttgcgaagcatattaccttgttttactcacttgaggtaatagatgaraaggatcttttaaaaggtgaaagtatttcatgatagcattataaaatgcattaacagacaagtatatcatgcctaggaagtgaggtgtatgaaagcacac

SEQ ID NO: 22532 - DNA, 201 bp, Homo sapiens
ccatcaacaaggcaaagctcctaccctggtgagcctacatttacgtgaaggaaagggttaaaaaggcaactgagatgcttcctggtagtaaatttaacagwacagctgtgattaaaaactaagccggatcagaagatgggggtgagattcctttaggcaggttgggcaggagccacactgaggaggcagcatttgccttga

SEQ ID NO: 22533 - DNA, 201 bp, Homo sapiens
atccagccaaatacaactggaaaacagctttttgatcaggttggtctctgaacttgagagttaactccacctacaaaaaaaaactgttttgcaacatttcrgttattttgtttgcgaagcatattaccttgttttactcacttgaggtaatagatgagaaggatcttttaaaaggtgaaagtatttcatgatagcattata

SEQ ID NO: 22534 - DNA, 201 bp, Homo sapiens
gtaacgtcgagaggaaaatctgatggggaaaggaaaatcatctgatggggaaattggcagactgtattgagaagtaacacttcagctgaatcttgcttgasggctggggggcgcacgcggcagcactccacagggaggaacagctgtggtttgttgtctggttttgcttttcccacagctgcttagggactctattcatgt

SEQ ID NO: 22535 - DNA, 201 bp, Homo sapiens
catggatgcagagctggagtttgcaatccagccaaatacaactggaaaacagctttttgatcaggttggtctctgaacttgagagttaactccacctacaraaaaaaactgttttgcaacatttcagttattttgtttgcgaagcatattaccttgttttactcacttgaggtaatagatgagaaggatcttttaaaaggt

SEQ ID NO: 22536 - DNA, 201 bp, Homo sapiens
accatggatgcagagctggagtttgcaatccagccaaatacaactggaaaacagctttttgatcaggttggtctctgaacttgagagttaactccacctasaaaaaaaaactgttttgcaacatttcagttattttgtttgcgaagcatattaccttgttttactcacttgaggtaatagatgagaaggatcttttaaaag

SEQ ID NO: 22537 - DNA, 201 bp, Homo sapiens
agaagaaaagaatactcagttaagcgtaatttgtttcattctgtttttcagatcaatgtccgagttaccaccatggatgcagagctggagtttgcaatccmgccaaatacaactggaaaacagctttttgatcaggttggtctctgaacttgagagttaactccacctacaaaaaaaaactgttttgcaacatttcagtta

SEQ ID NO: 22538 - DNA, 201 bp, Homo sapiens
atctgaagtcccttgagataccggcatccctgccttatggttgaaggcactgagcctggtgaagggatgtgctcaaggctgtggagctcgcacgtggctgkctgtgctgcacgagctggcagtgcctggcaggtactgcacacctcaaataccctgggaagataagagatgagtgaatgtgtggcccctgcccttgggagc

SEQ ID NO: 22539 - DNA, 201 bp, Homo sapiens
gtcattgtaaggaggtgctggcctgtgtgtctctcaccctgtattagagacgcggcttcctacccgcagctgcctccacctcaagagtagaacccctctcrctgcgtggatgagtgagccttagttgtctcagttgctgcagcttctcatttctaagtgatcgtacctgaacatctatgaaaggaagaaatgaagatttag

SEQ ID NO: 22540 - DNA, 201 bp, Homo sapiens
aagagagttattgtgcttgtcattgtaaggaggtgctggcctgtgtgtctctcaccctgtattagagacgcggcttcctacccgcagctgcctccacctcmagagtagaacccctctcgctgcgtggatgagtgagccttagttgtctcagttgctgcagcttctcatttctaagtgatcgtacctgaacatctatgaaag

SEQ ID NO: 22541 - DNA, 201 bp, Homo sapiens
tgctgagtttcatgcaggagagcatcctggagtacaaaggagtaggagtgagattttctaagatttgaaggtagaaccctgaatctgctcaaatttatatyaaaaataagtcgttcatggctttgagataatagcctcagttagtaacaagttatttgagtgcaaaaaaagatgttgcccagtggttggactgagcagatg

SEQ ID NO: 22542 - DNA, 201 bp, Homo sapiens
ggactacaacaaagaagtgcacaagtctgggtacctcagctctgagcggctgatccctcaaaggtgagcacaggatgacccggcctgggcaggagcagtcwtgccgtcctcggcagggagaagtgattgccttagaagcacagtttaaaaacgcaaggacttcgccagtgtcaagtgctccttcatgctagtcattaagtc

SEQ ID NO: 22543 - DNA, 201 bp, Homo sapiens; identical to SEQ ID NO: 3782

SEQ ID NO: 22544 - DNA, 201 bp, Homo sapiens
gtggcgagcaggagagcacttgataatgactgtggcatgaagggaggctaggaacagagcccgttactcatgctaacaggattttttttctaaaaattatrtaatgtctagagttacaggtaaaaaaagaaatggtagttttaaaactgcccaggttccggcatcacagttcctcttcctgtcttggacgcagagggttgt

SEQ ID NO: 22545 - DNA, 201 bp, Homo sapiens
agggcagtgatgtgagccagccccacccagcacccctcttgcccttcctgttttcctaggggacgggccgggccatatggggaggaagggactagaccaaygctgcttaatgttacagacgctgagcagcgagctgtcccaggcccgagatgagaataagaggacccacaatgacatcatccacaacgagaacatgaggca

SEQ ID NO: 22546 - DNA, 201 bp, Homo sapiens
  misc_feature (1)...(201): n = A,T,C or G, or insertion/deletion polymorphism (see Tables 1-2)
gcattccagagtgatggaccagcacaaacttaccagggaccagtgggaggaccggatccaggtgtggcatgcggaacaccgtgggatgctcaagtgagtgntgtgccctgctgttgggatcttgccatctccgtgcactccagcatgtcttttcctgtgactctagttagtgctttaaagggctctgtgtcaggccttgtg

SEQ ID NO: 22547 - DNA, 201 bp, Homo sapiens
aactagccatagtcaagtagaagtatacaaatattccagaagaactaaactataaggtgtttgtaaatatttagatgtgaatgagtataaacaacgcatcwaaaaatcataaaaattgatatttggtaaattttcctttctgccagacttgctggcagttaaaatttgaaacagtgactgtaccgaaagcctttttattca

SEQ ID NO: 22548 - DNA, 201 bp, Homo sapiens
attatatgaaaacttatcagaatgagttttataactagcgtacccatgtttttgttattgtgctgcagataaaatggcgcactgaaatgttactgaattaygtgacaatttttgttacaattctgtgcactttttacaagatttgtggagcttagatagatggctggcctttggcatctgaacattttcctgagcccgata

SEQ ID NO: 22549 - DNA, 201 bp, Homo sapiens
tacataatccattgctgtttgggtgagactctcaaatggatttagacagataatggtgagaaaactggattttttatttagaacgtggctgaacaaggcartgtggaaatagtgtgataacaaggtgcattatataacttgaacaaatcaactgcaaaaagacattttcaaagaaatggaggaaaattgaataatatttac

SEQ ID NO: 22550 - DNA, 201 bp, Homo sapiens
ttttgtttctccctaaagatttttattcttttgaaaatgaccacagtctagtttgaatgccattgtttttcagctgtttcttatttgcaattgctaaaagccaacaaggagcaagttaaatgtccatcacctgaatgggtagacagaagtgacagccacacaatggaatattcctgggcagtaaaaaaagaatgaagtgct

SEQ ID NO: 22551 - DNA, 201 bp, Homo sapiens
aaggtgtgtttcattgcctcagttaaataattaagggtgttggctgctgggatgttgaagtatttgcttacataatccattgctgtttgggtgagactctyaaatggatttagacagataatggtgagaaaactggattttttatttagaacgtggctgaacaaggcagtgtggaaatagtgtgataacaaggtgcattat

SEQ ID NO: 22552 - DNA, 201 bp, Homo sapiens
agtctagtttgaatgccattgtttttcagctgtttcttatttgcaattgctaaaagccaacaaggagcaagttaaatgtccatcacctgaatgggtagacagaagtgacagccacacaatggaatattcctgggcagtaaaaaaagaatgaagtgctggtacatgctacaacatgaataacccttttaaacattatgctaa

SEQ ID NO: 22553 - DNA, 201 bp, Homo sapiens
gtctagtttgaatgccattgtttttcagctgtttcttatttgcaattgctaaaagccaacaaggagcaagttaaatgtccatcacctgaatgggtagacagaagtgacagccacacaatggaatattcctgggcagtaaaaaaagaatgaagtgctggtacatgctacaacatgaataacccttttaaacattatgctaag

SEQ ID NO: 22554 - DNA, 201 bp, Homo sapiens
gtcagttgcataactctgaatatactaaaaaccactgaattatacattttccatgggtaaattttatggtaagttacatttcaatagctgctatttaaagyacatagtgactcaacatgaaaggaaaaatatacagttttgtctctataattacccaattaagtgaaccaaaatagctgcaaagtttttaattcatttatc

SEQ ID NO: 22555 - DNA, 201 bp, Homo sapiens
tgttttctgagcctacaattaaaaccgactctagcatataataagccatcttggccttgtcccttacttttgtttatgtgtgtagttactaagtttactargtagttactaaacttaagtttctgtgtataattacctgcacatttcagtgaagcatgttggtgatgaagtatttatgatatacctagtgaaactgaaatc

SEQ ID NO: 22556 - DNA, 201 bp, Homo sapiens
tgaagcgctattatatcccattatgtgcttggtgcagggacaataaaaataagattggttttgcctttaaggagttctcagtctcctagtgaaagcagatrtgtaagcaattacaatgcagtgtagtgcatgatagaggtcttcacagaagagaagtgtgccctggagaccagggagggcctcccggctggtaagatcctt

SEQ ID NO: 22557 - DNA, 201 bp, Homo sapiens
gtaatgtttgtggaggaactgatcttggacttttccctcctgtcttgggcttttattacagtttgaatttatgctgtaaaaagtgtgattgtagaggtaayctataagtttaaaatattcagaggaaatggatgcttcccaaaggaaaaattgcatacctatatttatttaccaaaatgaggaaaatacctgggaaataat

SEQ ID NO: 22558 - DNA, 201 bp, Homo sapiens
gcatcaacatggcagacaggcaacagcctttcagctaaagaaggaagaaacagaaaaccccaccttaaccactgcagagttacgtgacctccaaacactgccccccacagcatatccccatttttgtccctttccctttcaaagccaaataatttcaaagaggactacatagctgctggcttgggatggtgtcaaaagcca

SEQ ID NO: 22559 - DNA, 201 bp, Homo sapiens
attggacctctggttccattggcatgtgtcccctaaggagggagacccttcagggggtacttacacctctactgtccgatggcactggctgtgtcacacctggcctgtgggctttgaacctagcatttcagagtgggaaaaggcctcaagccatctagtccaaactctacctgcagatcaggtagaggcccagtggcagga

SEQ ID NO: 22560 - DNA, 201 bp, Homo sapiens
cttccagtgattcccaaatttggcctcctcaaaatcacttgtggaagtgacagcttcctgggctgcgggtgtttgaaaagcttctgtggggattctgatgstgaggctgatgtgggaagcactgtggtgtgtgatcactgaggcacacccatcttcattaatgtgtaagccactcggggataggaagggctaatgcctctc

SEQ ID NO: 22561 - DNA, 201 bp, Homo sapiens; identical to SEQ ID NO: 3784

SEQ ID NO: 22562 - DNA, 201 bp, Homo sapiens
ctgtctagtgagggcatccgggatgaccgcaatgaggagaagcgcatcactgaggcagagaagaacgagcgtgtgcagcggcagctgctggtgaggcccamggggctctgtctccagggagcctgcctcgcttttggagcagacaggcttggggagggcagtgatgtgagccagccccacccagcacccctcttgcccttc

SEQ ID NO: 22563 - DNA, 201 bp, Homo sapiens
cttggtctcccaaagtgctgggattacaggcgtgagccactgagcctggccttaaatattccttctgaatacaacgtatttggactccaccgaacggccayttatcagcttgtctgagtccttagttgttcctgtgcttgctcacccactctgaaaggattggtcacccttcccaaagtcaaaaaggaatgttagatgata

SEQ ID NO: 22564 - DNA, 201 bp, Homo sapiens
tcctgaaggcacacccctctcttcatgaaaaaagcatttatgtagatattcagtcatttaataggcccaaattctttcccttttgaacaaatattgacaasttggtagcagcataagcaggagactgtcctgaagtctgaggagtgctgagaactcaccagctgttgcgctgttacctctctcggtagaactaggagaatt

SEQ ID NO: 22565 - DNA, 201 bp, Homo sapiens
tcaaatatgttgagttcactaaaaacagttgctgatgagggaaacctaacaccctgataataaaatgaaaagttgggatttagatgtgttttctcaattgmcaaagcctggtggtggtggtgctggtgctggtgctggtggtagtgctggtggtggttgtggtggttttgagtcttcgctgtatcacccaggctggagtgc

SEQ ID NO: 22566 - DNA, 201 bp, Homo sapiens
ggaccagtgggaggaccggatccaggtgtggcatgcggaacaccgtgggatgctcaagtgagtgttgtgccctgctgttgggatcttgccatctccgtgcrctccagcatgtcttttcctgtgactctagttagtgctttaaagggctctgtgtcaggccttgtgaagaccttgagggaaccgagttaaaagtggggtttt

SEQ ID NO: 22567 - DNA, 201 bp, Homo sapiens
atgggtagacagaagtgacagccacacaatggaatattcctgggcagtaaaaaaagaatgaagtgctggtacatgctacaacatgaataacccttttaaayattatgctaagtcatgggattcagtcatgaaagactgcatattacaaaattctgtctctctgaaatgtccagaataggccattccttagagacagaaagt

SEQ ID NO: 22568 - DNA, 201 bp, Homo sapiens
tgcctgcctgcacgcagcacacagcattgagcccatcctacacaaggcgccttaatttaaaaatactggaaaggttttactgttctagatattgagtgctmccagtgactctgcctgtttcactctccccaattagagataatgctatgttggaatacctgaagattgctcaggacctggaaatgtatggaatcaactatt

SEQ ID NO: 22569 - DNA, 201 bp, Homo sapiens
caaggagcaagttaaatgtccatcacctgaatgggtagacagaagtgacagccacacaatggaatattcctgggcagtaaaaaaagaatgaagtgctggtrcatgctacaacatgaataacccttttaaacattatgctaagtcatgggattcagtcatgaaagactgcatattacaaaattctgtctctctgaaatgtcc

SEQ ID NO: 22570 - DNA, 201 bp, Homo sapiens
ggtggaatcgtgatagcatttgtccttttgtgacagtctcatttcctgtagcataatgtcttcaaggttcatccatgttgcaatgtcagaactcccttctstctcttatttcttatggcaggtatgttttcatttcattttgttttagaggtcttttatgatagatcagaacttaaaagatgtttctgacatttgataaag

SEQ ID NO: 22571 - DNA, 201 bp, Homo sapiens
atgacagtgctgtttccttttgcattccagagtgatggaccagcacaaacttaccagggaccagtgggaggaccggatccaggtgtggcatgcggaacacygtgggatgctcaagtgagtgttgtgccctgctgttgggatcttgccatctccgtgcactccagcatgtcttttcctgtgactctagttagtgctttaaag

SEQ ID NO: 22572 - DNA, 201 bp, Homo sapiens
cttaaagtgcttgtgggctgggggttcagatgttccccatagataaggaattgatttcagggttggccactaggattccttagctcggaactccacacacrcattcttcttaagttattgatgttaggtacacctgtacaaccaccctgcataaagttcattcattcaacaaatagagcacctactttgtgccaggttttc

SEQ ID NO: 22573 - DNA, 201 bp, Homo sapiens
ctgtcctggaagttggagagtgacatgggaagatgtctgtccagccaggagaacacacactggaatgagaaccagaggagcagaatgcatagcaaggcctytgtccatttctcttggcaagctctgttgagtatggcacgtctaggaacgtgatgggatcttggccctccctgttggtttcatagaactaaatgatcagta

SEQ ID NO: 22574 - DNA, 201 bp, Homo sapiens
gatctatgagtatgtatcttcttgctcaggttgtttgagatttggcctttaggagcaccttgaagtgtgagccgtgcattctttgcaggcttccttgctgyctggctcctcgagatgcaccaggttcatcctttgtgttccctgttctagtcctggaatcagccatttctccaaaggcctctgtctggtccctgttattgg

SEQ ID NO: 22575 - DNA, 201 bp, Homo sapiens
gcaagcatttcttaatattaagcattatagttgctatgtggctctgctgttttctttgggacagtgacataaagtagccagatttgagtgtttttcatacrctttagtaaatctgggttttctcaagtgataaatttgaaaactgccttgatgtaagtgggttgttttgttgttgtggtggtgggtttttttgtttgtttg

SEQ ID NO: 22576 - DNA, 201 bp, Homo sapiens
agttgctgcagcttctcatttctaagtgatcgtacctgaacatctatgaaaggaagaaatgaagatttagagaaataattcactttttaaaattggaagatttttttaaatcaagtatttattagtgatattactacttacttattaaatacttttttccccaataacagctgcttcaaatacagcgttgttttttttttt

SEQ ID NO: 22577 - DNA, 201 bp, Homo sapiens
gacagattatcttccaactttaaagagtggataattccattaaccaaccaaaaagaaaagtagtaagataaacattttcttcaaactctgaaaattatcctttttttttttttttgaaacccccactgtcctcccaagtcacagcaacaagttaaaaagatgatgggaggtggggaagagtggaggagcaggaggaattct

SEQ ID NO: 22578 - DNA, 201 bp, Homo sapiens
acagattatcttccaactttaaagagtggataattccattaaccaaccaaaaagaaaagtagtaagataaacattttcttcaaactctgaaaattatcctttttttttttttttgaaacccccactgtcctcccaagtcacagcaacaagttaaaaagatgatgggaggtggggaagagtggaggagcaggaggaattctt

SEQ ID NO: 22579 - DNA, 201 bp, Homo sapiens
gtctaaaactcctgacctcaggtgatctgcccacctcgacctcccaaaatgctaggattacaggcgtgagccaccacacccggccttgtgtgcttcttctsttacattttatgttctctaagatctttgttagaggtattaattttgctgttaggataaagaatattaatatgccagtagattcagaagccaatataattt

SEQ ID NO: 22580 - DNA, 201 bp, Homo sapiens
cagattatcttccaactttaaagagtggataattccattaaccaaccaaaaagaaaagtagtaagataaacattttcttcaaactctgaaaattatcctttttttttttttttgaaacccccactgtcctcccaagtcacagcaacaagttaaaaagatgatgggaggtggggaagagtggaggagcaggaggaattctta

SEQ ID NO: 22581 - DNA, 201 bp, Homo sapiens
cagggagactcagatggcttccgaccacacacaccagttctcagagctcctaagggtccgaaaccacaggcgccccagatccaactggggagatattaaarggcgtttgggagaggagactggctttcggaagttgcctttcagcttcgcttcctactaggcccatgaagcggtgccctgtacaccagcaaacttgctggc

SEQ ID NO: 22582 - DNA, 201 bp, Homo sapiens
actgcagtctcgaactcctgagctccagggttcctcctgctcagcttcttgagtaactgggactataagcatgcatcaccatccccagctaactttttttwaaaaaatgttgtagagatgggatctcttctacgttgcccaggctggtcttaaactcctgggctcaagtgatcctcctgccttggcctcccaaagcactgg

SEQ ID NO: 22583 - DNA, 201 bp, Homo sapiens
ccagtttctgggccgggcggacgggagaggcttcattggagaggggaggcacctgctcgaggtgttggggcagttcctggggaacagggttcttctcacamgcagaagacgataggaataggaggaggttttcgccgctctttgttacttgttgacccttttgtggagcgttaggaaaacaccattttgatgcttttctct

SEQ ID NO: 22584 - DNA, 201 bp, Homo sapiens
gtgggacctgcgagtctcaagggccagatttgcctttcagagctgtcctggaacttacccaagatagggacagtcagacttgcacccaagcattgctggtscccaaggtttcatcggggcttcacccacttctgttgtcagaggtgtgcatcctcacacaggtgacactggcaggcagtcattttgggaggacatggtaag

SEQ ID NO: 22585 - DNA, 201 bp, Homo sapiens
aaagggcgttttgttcctgtggccttgtggaaaaggcagaaggctctgaggcatctgaaatttggagaaagtaagcagcgtttccgctctgactcctcggmcgcttcccccacgtgaccttcccaggagccccgctgcctttttgcctcccgcggctgcctcctgccatctctgcggccagatgagccttgggattggcct

SEQ ID NO: 22586 - DNA, 201 bp, Homo sapiens
ccccacccaggaagttcatgggctctcagggcttggcatcacctctcaccctaggatttctggaacagatgaaaagactgaagctaaatagattcttctcsgatgtgttgatgagcccgctcagccggttcctcgttaggtctcagaagttgctgtgggatatatcgcactgtttttttgttttagccaccctgtccctct

SEQ ID NO: 22587 - DNA, 201 bp, Homo sapiens; identical to SEQ ID NO: 3787

SEQ ID NO: 22588 - DNA, 201 bp, Homo sapiens
gatcttcgaggcctttgtctctgggcggttgctgtggtgctgagcctgttgtcagccctggagcggctgctccgtcaggcagctcaggctggcagcaggcyagggtggccctcaggataccaagtccatcctggagcttcaagtacccgtgaagtgtgttgacccctcactttcctgccagagtctaaatctccctgtgcc

SEQ ID NO: 22589 - DNA, 201 bp, Homo sapiens
gggcaacagagcgagagaccctttctcaaaaaaaaaaaaaaaaaaaaacagcggagcagcaaactaagtcccttttccatcgagggaggtctctgaagcaragctgagccagcctctcagctctgccctggtggggcaccccatagcgcccagaagcagtgagggctaaggcggcagagtgcagcatggccatgcatgatt

SEQ ID NO: 22590 - DNA, 201 bp, Homo sapiens
cccctcactttcctgccagagtctaaatctccctgtgcctctttttccctgcaccaggcaacagctggaaacagagaagaaaaggagagaaaccgtggagrgagagaaagagcagatgatgcgcgagaaggaggagttgatgctgcggctgcaggactatgaggagaagacaaagaaggcagagagaggtcaggcgccctg

SEQ ID NO: 22591 - DNA, 201 bp, Homo sapiens; identical to SEQ ID NO: 3790

SEQ ID NO: 22592 - DNA, 201 bp, Homo sapiens
actttcctgccagagtctaaatctccctgtgcctctttttccctgcaccaggcaacagctggaaacagagaagaaaaggagagaaaccgtggagagagagraagagcagatgatgcgcgagaaggaggagttgatgctgcggctgcaggactatgaggagaagacaaagaaggcagagagaggtcaggcgccctggggctg

SEQ ID NO: 22593 - DNA, 201 bp, Homo sapiens
ctttcctgccagagtctaaatctccctgtgcctctttttccctgcaccaggcaacagctggaaacagagaagaaaaggagagaaaccgtggagagagagaragagcagatgatgcgcgagaaggaggagttgatgctgcggctgcaggactatgaggagaagacaaagaaggcagagagaggtcaggcgccctggggctgg

SEQ ID NO: 22594 - DNA, 201 bp, Homo sapiens
aagtacatttacattgttacatagccatcaccaaggtccatctccagaactttatcttcccagattgaaactctgtacctattaaactctccctccccatycccaccaccagcccttggcaaccaccattctactttctgtctctatgaattcgacaactttagatacctcatgcaggtggaatcgtgatagcatttgtcc

SEQ ID NO: 22595 - DNA, 201 bp, Homo sapiens
tcacctccggggcccacgtggtgatactgcacagggagggaggcaggcgctgtcacaggagctcctcagagaacctggaaatgagatattgaggactctcrgttcgctcctactccaagtgtgctggatgcagcattggtaaagaagcacggaaaagccaggcacagcggctcacacctggaatcccagcactctgggagg

SEQ ID NO: 22596 - DNA, 201 bp, Homo sapiens
gcaggggagaccacttaacttttcaaatgattctcattccttatgaagaaaagggcagttctgagccattggccaaatgataagcatttcccaaaatgctrtgtttttggtgtggagagccagcctgtccccttgaccacctgggtgcagggactctccccggcacctgacggacagtgggacctgcgagtctcaagggcc

SEQ ID NO: 22597 - DNA, 201 bp, Homo sapiens
gataacaggccctgacaaagggttgcccaaacagcagtgtgtccctaggaagacaggttaagcatcaattactatgaggctagcacgagttaagcattccrcatgcacgatctcatttaatccttacaagtctatgtaggtggggctactagtatgttcactcaacaaattgggaaacagagtttggaacttcgcccaaag

SEQ ID NO: 22598 - DNA, 201 bp, Homo sapiens
atatctcaccatgacccaccttttattgataggagaggaaccagtatcacctgaggatcaaactctagtagtcagtatatcagattttgctcatatttttmagttagaagtcacttctgcaacctaattttgttttccatttttgcctgagagatcaattttaaactgcctgtgtggacagttgtcatttcagatactgta

SEQ ID NO: 22599 - DNA, 201 bp, Homo sapiens
atagcttctgggctgtatgggtcccctcctcaccggtcggctgcccggcccctgcctgcctgcacgcagcacacagcattgagcccatcctacacaaggcrccttaatttaaaaatactggaaaggttttactgttctagatattgagtgctaccagtgactctgcctgtttcactctccccaattagagataatgctatg

SEQ ID NO: 22600 - DNA, 201 bp, Homo sapiens
gaccctcaaagcctaaaatacttactggctggctctttagagaaacaaatggaccaactcctgcttctagcataaaaataattattgttaagcatttattmtaaccttgtatatattttatggctggactaatatttggaagcagatccaccccattggttccagtttttaaaaaattgttctcaaagaacagaatgtgtt

SEQ ID NO: 22601 - DNA, 201 bp, Homo sapiens
tgtaaccgtagtccaaataccaagataagaaaattaacattagcagtctctagacctcattcccattttaatcagttgtctcactgatgtcctatttctgycccgggaccctctctggagccacacagttagttgttagacctccctgtctccttcgatgtgggatagttccagtctttttttgtcatgaccttggtattt

SEQ ID NO: 22602 - DNA, 201 bp, Homo sapiens
gatgtagattgtgtttctagaaagaatagtttcttttgctgaatgtaacatcctttgattatttcttttccctttcttaggggaaagtggtgtctaagaaktccagtttacttccctgttagataacacacaatgtatgttatttccagtgtagaagaagttggttcttaattagagacactcaccaaaaagggccttaaa

SEQ ID NO: 22603 - DNA, 201 bp, Homo sapiens
ggcctataatttttgtttctttagcagatctaaatctgatttaaattgtcaaaatacttggctgtattatggctcagctgtagagtaaaaactagacttargcatttccaattaaggcaggctaggcaatttcaaaaccagttaagtcactgccctggtggaagcattttctttgcacggtacccattaggataatcacaa

SEQ ID NO: 22604 - DNA, 201 bp, Homo sapiens
ttagcagtctctagacctcattcccattttaatcagttgtctcactgatgtcctatttctgccccgggaccctctctggagccacacagttagttgttagrcctccctgtctccttcgatgtgggatagttccagtctttttttgtcatgaccttggtatttttgaagagtactggccattgactttggaaagcccttcag

SEQ ID NO: 22605 - DNA, 201 bp, Homo sapiens
tgtctcaccatcctcatactatttccatttttacattttattttcatgtcttgtctaaacagagttcacatttgcattgagtgttgcttgtcgtatttttkatttcagaagcaatttgcccagtttctactattttcgtaattataatttaatatcactacataatccattttttatgtgtctttggacatttcaccattt

SEQ ID NO: 22606 - DNA, 201 bp, Homo sapiens
ctttgcacggtacccattaggataatcacaaagtataaacgtttgggctcaatgtctcagacttacttgaaccaagtctggttcctccaagcaagcggtcrttcattccaaagagggcctgatcccagacagttaactccaagctcgactgcctcagctgagctggggttacgccactgaagacaaatgagtgtttccact

SEQ ID NO: 22607 - DNA, 201 bp, Homo sapiens
ttactgtggtatttgagaaattgtgatttttaaaaactttttacgtgtattaattggaattctataaggagccaatttctgttctccatttattcagttayattaatatggactcatggatatgtgtttcggtctttgggttatgatctatgagtatgtatcttcttgctcaggttgtttgagatttggcctttaggagca

SEQ ID NO: 22608 - DNA, 201 bp, Homo sapiens
ggatatgtgtttcggtctttgggttatgatctatgagtatgtatcttcttgctcaggttgtttgagatttggcctttaggagcaccttgaagtgtgagccstgcattctttgcaggcttccttgctgtctggctcctcgagatgcaccaggttcatcctttgtgttccctgttctagtcctggaatcagccatttctccaa

SEQ ID NO: 22609 - DNA, 201 bp, Homo sapiens
caaggacacttataaaccctgtggccaccttctctgtagaccctgttcatgtcctatatgtgatctcttaggaaaaaggaaatccttgggctttaattttscaactttggtcaagaattaaaagttctttaactcaaaagtgagtcataattttcatgtttaacctttttgttttgatactgcagttatgcttatgagtgg

SEQ ID NO: 22610 - DNA, 201 bp, Homo sapiens
cctgccgcccgggcactgttggtcatagcatgaccttggcatcagctgtgagccggtaaacatggaaatgtaggcccctcccaacctgagtcagacccttrgcctggggtccaggaaactgttttaacaagcccctgggtgattttttttcacatgttcaagtttgagcgcctcgagggcctgtgaatggctgcatataag

SEQ ID NO: 22611 - DNA, 201 bp, Homo sapiens
aagaggaaaaactttctaggcacaccagagagccggaggcctaaattttctaaggtcagaacctgttttgagagtcctgtgtagagacaggagccggagasgggatcccagccccttgaagtttcaggatgcggcacgctggctcacagtgctatgtgctgtgggcggagcctccggagcttggatcctagcttctctgtt

SEQ ID NO: 22612 - DNA, 201 bp, Homo sapiens
ttgagagtcctgtgtagagacaggagccggagacgggatcccagccccttgaagtttcaggatgcggcacgctggctcacagtgctatgtgctgtgggcgragcctccggagcttggatcctagcttctctgttggtgccagcaggctgctcttgtgttttgggagaaagtgctccagaagcaacacatgcctacctggtg

SEQ ID NO: 22613 - DNA, 201 bp, Homo sapiens
tccaggaaggcacagcccctgagaagctctggggatggttcccactggagactgcacaccaggctttaagcagctcctctccttcacagacccgctggccygtccttcccccactgtggcttctccatctgtggaggtgccttctggggacgtgtctcccggctctccagggctgctgctgcctagtacctccttgcctct

SEQ ID NO: 22614 - DNA, 201 bp, Homo sapiens
atctggagttcccctttaatgctctgaaacctgtaaagaaaattacatctcgaagataaaagaacaaactcattgcatgtctgtttgaatgccaggtgtgttttttttaatggggattggtgattctagagcatagcactgtaaaagaaaggatgtatacaaaagctttgacatttagaaccatggtctggccagtgtcct

SEQ ID NO: 22615 - DNA, 201 bp, Homo sapiens; identical to SEQ ID NO: 3783

SEQ ID NO: 22616 - DNA, 201 bp, Homo sapiens
catgactgactgcgctaattccccagaagggccatgtcaggcttacatgtttgccctcagcctacagagtccaccccactgccttgatctagttgatgtgrtcataacgaaacctgtattgctcgtcagtattgaagctgttggtaggccatagattgcttgaccttcctgctacttctaaaatgaaggtttttgtgggat

SEQ ID NO: 22617 - DNA, 201 bp, Homo sapiens; identical to SEQ ID NO: 3786

SEQ ID NO: 22618 - DNA, 201 bp, Homo sapiens; identical to SEQ ID NO: 3788

SEQ ID NO: 22619 - DNA, 201 bp, Homo sapiens
ctgtttgcttgtgtttgtttgcagtctctctctgccatggccttggcaggctgctggaaggcagcttgtggaggccgttggttccgcccactcattccttytcgtgcactgctttctccttcacagctaagatgccatgtgcaggtggattccatgccgcagacatgaaataaaagctttgcaaaggcacgaagcagcacg

SEQ ID NO: 22620 - DNA, 201 bp, Homo sapiens
tgtttgcagtctctctctgccatggccttggcaggctgctggaaggcagcttgtggaggccgttggttccgcccactcattccttctcgtgcactgctttytccttcacagctaagatgccatgtgcaggtggattccatgccgcagacatgaaataaaagctttgcaaaggcacgaagcagcacgggtgtgtgcttgtgt

SEQ ID NO: 22621 - DNA, 201 bp, Homo sapiens
ctttgcaaaggcacgaagcagcacgggtgtgtgcttgtgtgtggggtgggagggctaccgccgactcgtctgggctctatgctgtcctctggccaggtttygtgaggggccgtggtgtccctgggggtacactggtaagttggagctgaccaacccaagacatggtgctccatgggtcacctaacctcctcgagatggttt

SEQ ID NO: 22622 - DNA, 201 bp, Homo sapiens
gctgaggcaggagaatcgcttgaacccaggaagcggaggttgcagtgagctgagattgccactgcactcaagcctgggtgacagagctagactccgtctcaaaaaaaaaaaaaaaaaaaagggctcctgctgtttgcaaactattggctgctactctgtgggtagttgcacggttatttaaaattaaacgcgtattgaatg

SEQ ID NO: 22623 - DNA, 201 bp, Homo sapiens
ggctcaatgtctcagacttacttgaaccaagtctggttcctccaagcaagcggtcgttcattccaaagagggcctgatcccagacagttaactccaagctygactgcctcagctgagctggggttacgccactgaagacaaatgagtgtttccactgggggcaagcctgcttcctcaggactggcgacttcagtctcagtt

SEQ ID NO: 22624 - DNA, 201 bp, Homo sapiens
ctgaggcaggagaatcgcttgaacccaggaagcggaggttgcagtgagctgagattgccactgcactcaagcctgggtgacagagctagactccgtctcaaaaaaaaaaaaaaaaaaaagggctcctgctgtttgcaaactattggctgctactctgtgggtagttgcacggttatttaaaattaaacgcgtattgaatgc

SEQ ID NO: 22625 - DNA, 201 bp, Homo sapiens
ccaagtctggttcctccaagcaagcggtcgttcattccaaagagggcctgatcccagacagttaactccaagctcgactgcctcagctgagctggggttaygccactgaagacaaatgagtgtttccactgggggcaagcctgcttcctcaggactggcgacttcagtctcagtttttgttggtctggcagagtgagacag

SEQ ID NO: 22626 - DNA, 201 bp, Homo sapiens
gcaggtgggtgggttgggggagaggtctggctcaagctgccacatcccactggaagcttctgggatgtctcatgatcctctgccaataccagctgtactaytgaagtagacatccccaaagagatgggtttgactttgtacacgagtcagtgcagctgctggattcatagagggaggacctctgattgactttcacccact

SEQ ID NO: 22627 - DNA, 201 bp, Homo sapiens
catagagggaggacctctgattgactttcacccactttgctccctccaccccgaactgttcagtgctgatctgacagcccccggtcaggaactggttttamatctaattatatatgtgccccttgcaatggggtcgcagtgcctgaaacacgacctcctgcagctagtatatacagcgggcaccatggaaagatccagctc

SEQ ID NO: 22628 - DNA, 201 bp, Homo sapiens
gacgtgtctcccggctctccagggctgctgctgcctagtacctccttgcctctgttccagcccccattcccgctgccgatctgtattaggctgttctcacacggctataaagaacaagctgagactgggtagttaaagaaaagaggtttaattgactcacagtcccacatggctgggggaggcctcaggaaatttacaatc

SEQ ID NO: 22629 - DNA, 201 bp, Homo sapiens; identical to SEQ ID NO: 3781

SEQ ID NO: 22630 - DNA, 201 bp, Homo sapiens
agaggtaaatacattaatcttggccaaacaggtcatgtccttttgcgttttcctgatggcaggttctgccccctgccgcccgggcactgttggtcatagcrtgaccttggcatcagctgtgagccggtaaacatggaaatgtaggcccctcccaacctgagtcagacccttggcctggggtccaggaaactgttttaacaa

SEQ ID NO: 22631 - DNA, 201 bp, Homo sapiens
aaggattataaatcagcagaggtaaatacattaatcttggccaaacaggtcatgtccttttgcgttttcctgatggcaggttctgccccctgccgcccggrcactgttggtcatagcatgaccttggcatcagctgtgagccggtaaacatggaaatgtaggcccctcccaacctgagtcagacccttggcctggggtcca

SEQ ID NO: 22632 - DNA, 201 bp, Homo sapiens
ttagccatggacttgaattgtagatgcaggcagccggtggagtttgataagaggttcctggcaggccgggccgagcactcctggtcagctgatgaaagggytgtgcctgcgcctctgtctccttgaatctgattgtgttgagattgctggcgagacctgggggttgtaggcacaaggcaggttctctgggactgacgcttc

SEQ ID NO: 22633 - DNA, 201 bp, Homo sapiens
gtgagataaggggatcaggatccagagagactattaaaatatgtgagtccatctgttgtgatctgaggtttcattagagaaaacctgtctgctagtacaayaaatggagacttagtaaggatgtttttatataaaggattataaatcagcagaggtaaatacattaatcttggccaaacaggtcatgtccttttgcgtttt

SEQ ID NO: 22634 - DNA, 201 bp, Homo sapiens
ttggaggcctataatttttgtttctttagcagatctaaatctgatttaaattgtcaaaatacttggctgtattatggctcagctgtagagtaaaaactagrcttaggcatttccaattaaggcaggctaggcaatttcaaaaccagttaagtcactgccctggtggaagcattttctttgcacggtacccattaggataat

SEQ ID NO: 22635 - DNA, 201 bp, Homo sapiens
acaaaggagtaggagtgagattttctaagatttgaaggtagaaccctgaatctgctcaaatttatattaaaaataagtcgttcatggctttgagataatarcctcagttagtaacaagttatttgagtgcaaaaaaagatgttgcccagtggttggactgagcagatgtcctggtttcctggggactctgctagaccatgt

SEQ ID NO: 22636 - DNA, 201 bp, Homo sapiens
ctgtcacccccacagcaccccagggctgctcgaggcactgccccacctcagtctgtaaactttgggcagaagaagttcaagttttcgacatcgaactttcwtgtaaaaaagaagaggcccaaagtttgaggcggtgggattccttatcttgtgttgactttcacgggtcatcttcaccccaggcggtttctgctgtgaact

SEQ ID NO: 22637 - DNA, 201 bp, Homo sapiens
gctttagtcttctgcatgagcacacctgacgggcagcgatgcacccaccgcactgttccctggggggctgtgggctcccatggttctgtgtgtgctggccrtaacccgccctgctgagtttcatgcaggagagcatcctggagtacaaaggagtaggagtgagattttctaagatttgaaggtagaaccctgaatctgctc

SEQ ID NO: 22638 - DNA, 201 bp, Homo sapiens
cacatgatgaacttgggaatgctaataaaagccagagtctggccagtcatggcattgcattggttaagtaggattagccctgtggggccttcattagggcsgttagtttgaaggctgtcctggaagttggagagtgacatgggaagatgtctgtccagccaggagaacacacactggaatgagaaccagaggagcagaatg

SEQ ID NO: 22639 - DNA, 201 bp, Homo sapiens
cagtgagctgagattgccactgcactcaagcctgggtgacagagctagactccgtctcaaaaaaaaaaaaaaaaaaaagggctcctgctgtttgcaaactmttggctgctactctgtgggtagttgcacggttatttaaaattaaacgcgtattgaatgcagactctaaggctccatggcagcagttcatattatgcaaca

SEQ ID NO: 22640 - DNA, 201 bp, Homo sapiens
ggaaagtcatcctagttcatgagggcaagtttcccatggtgagtctgcgacatcagcataatcctagattctggattgatctgatcagaagctacctgaawttaagaggcagaaggaaactacctctggaaagagaagggagaggctcctgactgcctcctgactaccgtctctgccctgattgtccacagtcagcctgat

SEQ ID NO: 22641 - DNA, 201 bp, Homo sapiens
agagcaagaaaatgctgaaatctcttcatcagtaggctactacgtactctgtgacgctactgccttttcagaacacttattaaaaatttgactagagcagmagctctggactagactgtttcagaatgtttgtgcgtgcgtgtgtgtgtgtgtgtgtgtgtgtgtgtttgatgataagtccatctcttgaaaagctgaaga

SEQ ID NO: 22642 - DNA, 201 bp, Homo sapiens
tatattttatggctggactaatatttggaagcagatccaccccattggttccagtttttaaaaaattgttctcaaagaacagaatgtgttttgttagccartgttgagcacatcatggactctgagcatggactcagaaactactgaggagaggcatcgtggtgctgaggtaatgttttaaacaaagctggtgtttgggtg

SEQ ID NO: 22643 - DNA, 201 bp, Homo sapiens
actacgtactctgtgacgctactgccttttcagaacacttattaaaaatttgactagagcagaagctctggactagactgtttcagaatgtttgtgcgtgygtgtgtgtgtgtgtgtgtgtgtgtgtgtttgatgataagtccatctcttgaaaagctgaagaatattttcataataagccccaagcagaagccattgtaa

SEQ ID NO: 22644 - DNA, 201 bp, Homo sapiens
tttccttggtgggcagaacagtacagtaacatgtaaatgctatgtgtcatacttacagtaatgtaagatacatgataaggaatgcatgtacaaatatgackttatactattttaacttatgtaagaaagattatatagcatccctctgtatccacaggggattggttccaagacctctgaggataccaaaattctccaatg

SEQ ID NO: 22645 - DNA, 201 bp, Homo sapiens
cagcattggtaaagaagcacggaaaagccaggcacagcggctcacacctggaatcccagcactctgggaggccgaggcaggcgaatcccttgagctcaggwgtcttgcccagcctggggaacatggcgaaaccccgtctctaccaaaatttaaaaaattagctggctatggtggtgcacgcctgtggtctcagtcaggtgg

SEQ ID NO: 22646 - DNA, 201 bp, Homo sapiens
ctctttggcagaggagggtcttagagataagttaaacacactaagcctttctgtgtgtagattatattagagccatcccacaaatcactgagaagagcatmgtaggttgcacatatttgaatatgacatttcttaaggctgttagagaggatccagttagttttggtttggtttggggtttttttgctgccttagtaaatg

SEQ ID NO: 22647 - DNA, 201 bp, Homo sapiens
gactgggaaagagcctaggtaacgtcgagaggaaaatctgatggggaaaggaaaatcatctgatggggaaattggcagactgtattgagaagtaacacttmagctgaatcttgcttgagggctggggggcgcacgcggcagcactccacagggaggaacagctgtggtttgttgtctggttttgcttttcccacagctgct

SEQ ID NO: 22648 - DNA, 201 bp, Homo sapiens
acgtctgctgcacattaagaatttagccttgacattttaagtttagcctaatggtggtgctggaggaagtagtaaggagaacagtttagaaaaggaggtgygagtggcatgtagtgttacttttcatcatttaaattactcaaaaagttccttaaagtgcttctggcttctctgggaaatgagttcctgcttccctgtggt

SEQ ID NO: 22649 - DNA, 201 bp, Homo sapiens
cattctaaccatatgcttgctggaaaccataataatgtaaaaagtcgtcattgggttttcaattgcaattacattgatataattttgtatataaaacagtrtgttactgggagcagcattgttcatgtaagaaagatgttcgcttcatataatacatggaaacaaagttatattttcaatgttagccattactgtgacact

SEQ ID NO: 22650 - DNA, 201 bp, Homo sapiens
cattgttcatgtaagaaagatgttcgcttcatataatacatggaaacaaagttatattttcaatgttagccattactgtgacactccaaaaaaggctggtyatggggagaaagaagagctttaaaaaaacctacagacaattcacttgcctcttgggcttttctgctttgcctgccttgaccgaattagagtatctgcatt

SEQ ID NO: 22651 - DNA, 201 bp, Homo sapiens
ccttcccaggagccccgctgcctttttgcctcccgcggctgcctcctgccatctctgcggccagatgagccttgggattggcctcttgtgggagagtttcytggcatcctggggacttgaaaaggggctcttttaccttctctccttctgtatttgtagggtcttgggtttatttttcttgaactttccttgtgcctggtt

SEQ ID NO: 22652 - DNA, 201 bp, Homo sapiens
tttccctttcaaagccaaataatttcaaagaggactacatagctgctggcttgggatggtgtcaaaagccaggcaagatgattttaagtcatagaatgatygagctggaagatgctcacagattaaatggtctccagccactcaatatcagcagcaagggagaggaacagggttggcctgagtgaggctggggccacccct

SEQ ID NO: 22653 - DNA, 201 bp, Homo sapiens
tgaaacccccactgtcctcccaagtcacagcaacaagttaaaaagatgatgggaggtggggaagagtggaggagcaggaggaattcttaacagtaagtttyggggtccagggcccgattggcatgtggccccattccaggtcactggggtcatttccaaatttgagttctccaggattgatagcatcatcccatgaggact

SEQ ID NO: 22654 - DNA, 201 bp, Homo sapiens
gcactaagctggttgaggtttgctaagtcaatggtaatgttttacagagcttggctgttagccagcatttgtggaaaacgaccaatgtctgtcatagctartgctataatttattcagttggcatattgtttatggagacagtgagataaggggatcaggatccagagagactattaaaatatgtgagtccatctgttgtg

SEQ ID NO: 22655 - DNA, 201 bp, Homo sapiens
cagtaggtagggtggtgggcctggaaacaatggcaaaatggcaaatttgtgggttatttttgaagtatttatttagcaacttactatcccaaagtaggaawctttttaaagggcttttggactgctgtggccctctcaaagggtggtccagaggtgtgggttatcctctctcatggtgggcggggccgatagtgggctcag

SEQ ID NO: 22656 - DNA, 201 bp, Homo sapiens
ttttctgtttacaagacagtcgtgagactaagcagctcaggactcctgtaatgcacaacagaggcttgaaaatgtgaaatctttgctgtgacctagggtcrggattctacctttgctgtatcagaatgtcccatttctggaggtctataagatgcaggttcctctgggcacccctgtgcattgacacccttccgtcccaga

SEQ ID NO: 22657 - DNA, 201 bp, Homo sapiens
cagaggtgtgggttatcctctctcatggtgggcggggccgatagtgggctcagtcctggtagaggaaggcagaatagagcagaggctgcctctcctccccsctgcctctgagattccaccccagctgcctgcaggtaccagcacatccatccatagctacttcgcaggcagcccagccagtgctcgactcctggctcgagg

SEQ ID NO: 22658 - DNA, 201 bp, Homo sapiens
cagatatttttgttctcagcatccccacatctcaggttcccccaaaaccctctctggagttctcaaagggagtggtgctgctttccacaaatgacctgcaygagtccatctccatttgcaaccacgcggattcctgccagaccccagggcacagatctatttcacttgggcaagtcagggacctgtgccagctgtgcccaa

SEQ ID NO: 22659 - DNA, 201 bp, Homo sapiens
ccaggcacagcggctcacacctggaatcccagcactctgggaggccgaggcaggcgaatcccttgagctcaggagtcttgcccagcctggggaacatggcraaaccccgtctctaccaaaatttaaaaaattagctggctatggtggtgcacgcctgtggtctcagtcaggtggctgaggtgggaggatcacttgagcctg

SEQ ID NO: 22660 - DNA, 201 bp, Homo sapiens
gccccagtgcctgtcaggtgactgtggagctgatggggagagtgtggtggaatggaacccagtcaccacgctgggatcttcgaggcctttgtctctgggcrgttgctgtggtgctgagcctgttgtcagccctggagcggctgctccgtcaggcagctcaggctggcagcaggccagggtggccctcaggataccaagtcc

SEQ ID NO: 22661 - DNA, 201 bp, Homo sapiens
gctgatgttgagagagaacgcttatcagaacagggatctctgaggaaaaagggagcttaaatgtgtgtccctggaatttcttctagcccttcctttccttrgtgacatggccactgctatgggcgggaattagagaagagccctgaccagtggtgttgatgtctttgccaagtatactgtcaggtcagtgtcataaattga

SEQ ID NO: 22662 - DNA, 201 bp, Homo sapiens
ttggccaggctggtctcgaactgctggtctcaagtgatccacctgcctcagcctcccaaagtggtaggattataggcatgagccaccgtgcccagcctagygtcatgtatttatactgttatttccacctcctaaaagtcaacaaggacacttagctcaagaaggctgatgttgagagagaacgcttatcagaacagggat

SEQ ID NO: 22663 - DNA, 201 bp, Homo sapiens
tttgaaacagtgactgtaccgaaagcctttttattcaggttaaaagttgtactcccatttcctaaaataaggactgaactgagaaactctagctacagctrcttggttttccatagagttaagttggctccttagatgctgaagtctgtagttatgaccttgctttcattagtaattagcacctgggcaggtactaaccaa

SEQ ID NO: 22664 - DNA, 201 bp, Homo sapiens
tccacagggacaggcagttccgctttcacatacagggcatttgccttctttctgctgaggataaacagggaaagtcatcctagttcatgagggcaagtttsccatggtgagtctgcgacatcagcataatcctagattctggattgatctgatcagaagctacctgaatttaagaggcagaaggaaactacctctggaaag

SEQ ID NO: 22665 - DNA, 201 bp, Homo sapiens
tttaataggcccaaattctttcccttttgaacaaatattgacaacttggtagcagcataagcaggagactgtcctgaagtctgaggagtgctgagaactcrccagctgttgcgctgttacctctctcggtagaactaggagaattagatatgcctgaaacattgttcaggtgagaaagctgatctattgaatatggaaatt

SEQ ID NO: 22666 - DNA, 201 bp, Homo sapiens
gttagccagcatttgtggaaaacgaccaatgtctgtcatagctagtgctataatttattcagttggcatattgtttatggagacagtgagataaggggatyaggatccagagagactattaaaatatgtgagtccatctgttgtgatctgaggtttcattagagaaaacctgtctgctagtacaataaatggagacttagt

SEQ ID NO: 22667 - DNA, 201 bp, Homo sapiens
catcctttgattatttcttttccctttcttaggggaaagtggtgtctaagaagtccagtttacttccctgttagataacacacaatgtatgttatttccartgtagaagaagttggttcttaattagagacactcaccaaaaagggccttaaaaactagcagctaataggtatcaggagcattattttcatacgccatcag

SEQ ID NO: 22668 - DNA, 201 bp, Homo sapiens
gatgaagtatttatgatatacctagtgaaactgaaatcacatggtatacaatcaagacttagacttcaggagtttattagataaattcttgttcaaggtcmctttctctttattttgcctgccctgaggtaaggagatgagaaggatgtagattgtgtttctagaaagaatagtttcttttgctgaatgtaacatcctttg

SEQ ID NO: 22669 - DNA, 201 bp, Homo sapiens
atccctcaaaggtgagcacaggatgacccggcctgggcaggagcagtcatgccgtcctcggcagggagaagtgattgccttagaagcacagtttaaaaacrcaaggacttcgccagtgtcaagtgctccttcatgctagtcattaagtcactgaccagcgacctgaaacatagccagggaaggcgagctgccattcctcat

SEQ ID NO: 22670 - DNA, 201 bp, Homo sapiens
cagacccctgggccagctggctgagaggcagaggcaggcagccagaggaggctcaggtgtggcactggatgctttagtcttctgcatgagcacacctgacsggcagcgatgcacccaccgcactgttccctggggggctgtgggctcccatggttctgtgtgtgctggccataacccgccctgctgagtttcatgcaggag

SEQ ID NO: 22671 - DNA, 201 bp, Homo sapiens
ttgctgtatcagaatgtcccatttctggaggtctataagatgcaggttcctctgggcacccctgtgcattgacacccttccgtcccagaagtctgccttgyctgttttcctgcctttcctaggatttctttgtccctgttcctagtaagtcagacccctgggccagctggctgagaggcagaggcaggcagccagaggagg

SEQ ID NO: 22672 - DNA, 201 bp, Homo sapiens
cctggaggcagaggttgcagtgagctgagatcacgccactgcactccagcctgggcaacagagcgagagaccctttctcaaaaaaaaaaaaaaaaaaaaamagcggagcagcaaactaagtcccttttccatcgagggaggtctctgaagcaaagctgagccagcctctcagctctgccctggtggggcaccccatagcgc

SEQ ID NO: 22673 - DNA, 201 bp, Homo sapiens
taccccttaacaaatgagttcaaggtgccatctggccgcacaggtaaattcttggctcctagcactaccaaacaaagttgaccatgaagtgatggctgatytgtccctggaaggaaagccagtattcactgtcaaaccatgtctcctgatacgttagtatgcagtaccaccaccccaaaaccgagagctcagctagagaat

SEQ ID NO: 22674 - DNA, 201 bp, Homo sapiens
cttgaggacgtgacctccctgggcagaggtaacaacgtgtgcaaaggccctgtggtgggaggaagtagtgtgagtttggggtttcacatgaagcccaatgyggctagagaggaagacaggtcaggccatgccttgtaagccattcttgggtgttttttagtttaacttggggttttgactgggaggtgacatgatcagatt

SEQ ID NO: 22675 - DNA, 201 bp, Homo sapiens
ggagatcgagaccatctaactaacatggtgaaaccccgtttctactaaaaatacaaaaattagctgggcgtggtggcacatgcctataatcccggctactygggaggctgaggcaggagaatcgcttgaacccgggaggtggaggttgcagtgagccgagattgcgccactgcactccagcctgggcaacaagagtgaaac

SEQ ID NO: 22676 - DNA, 201 bp, Homo sapiens
caaagtgctgggattacaggcttgaatcatcgcacctggccgtttcatttttaccacactgccacaggccacttcattttttggcattcccctaaagggtmaagttcagaaatgctcttcaaggtcttggggcaccgctatttcaaacattcaatttagaagacagtatacttcaaatggagcgagataaaaattagatta

SEQ ID NO: 22677 - DNA, 201 bp, Homo sapiens
ctgaggcaggagaatcgcttgaacctgggaggtgaaggttgcagtgagctgagattgcaccactgcactccagcctggcgacagagtgagactctgtctcaaaaaaaaaaaaaaagactttattcatcagcaagcggagtgacctgcacagagggcgaggcagaccttgttctctggaagcttagtgtctggtacctgggc

SEQ ID NO: 22678 - DNA, 201 bp, Homo sapiens
ggggaaggtggggagtctggatttgttgttacatgttaataagtttgtgacaatcgttgatgaaaaaagtccttgccttctttcattactacatccactgccccccaaaatattaaaggaccagactccttaaactacgttatttttaaatccaaataattcagtagctttttgttttccctagtatatgtacacaccgta

SEQ ID NO: 22679 - DNA, 201 bp, Homo sapiens
tttgatctactatagtctgtatgtgaatttctgactgcagatgttttgtaagtccattcctgattcagaacaccctgtctaaagtacagctccatctctgtctgtgccgtgccccactttactgcactcatagaactcggtctccacctataacgctgtcaggtgcttgtttatttgtgctttttgtcttttctggcagca

SEQ ID NO: 22680 - DNA, 201 bp, Homo sapiens
gcaacctggaaccttgaggccttcatgtcagtgcaggacaagagtcatgtctgtccatagattggggctggaaaggactttctgccactggagcttcgatwgtgagcatgcatccccgccaacagctgtgtctccctctgtaagagaggaagacaatttagccatggtcggggagggcaccacttcatcccctctcatccc

SEQ ID NO: 22681 - DNA, 201 bp, Homo sapiens
aacattatatatcatgggattttaaattagacatctatgtatatgtaaatagtcgaacttgtctgggactcggtttagatgatgttcaacaaatgtccacrgcaagttcgactatcactgcttttctgtttacaagacagtcgtgagactaagcagctcaggactcctgtaatgcacaacagaggcttgaaaatgtgaaat

SEQ ID NO: 22682 - DNA, 201 bp, Homo sapiens
gagctttagggagcctctggcctccctgcacccttcagatgaagaaacaggcccagatcaggagttaatttggaattttaggatttactttaagcaaatgytctgtatacctgagttgtcatttctaatgtattcaaccctctttggcattaaatatgatagaagccatgtatttgaaggatggtagcattttttaaagtt

SEQ ID NO: 22683 - DNA, 201 bp, Homo sapiens
cagcattgagcccatcctacacaaggcgccttaatttaaaaatactggaaaggttttactgttctagatattgagtgctaccagtgactctgcctgtttcmctctccccaattagagataatgctatgttggaatacctgaagattgctcaggacctggaaatgtatggaatcaactatttcgagataaaaaacaagaaag

SEQ ID NO: 22684 - DNA, 201 bp, Homo sapiens
tggagagagagaaagagcagatgatgcgcgagaaggaggagttgatgctgcggctgcaggactatgaggagaagacaaagaaggcagagagaggtcaggcrccctggggctggcactctacactgggtcatgcatttccacagagtagcaggggccacacccacccacccactcaccaggaaggaaaccaagaacgtgtcc

SEQ ID NO: 22685 - DNA, 201 bp, Homo sapiens
ggggctgaaggcagctggtggggaaggggctgggctgttgccagggtcacccattgaaggtgggtgtgggcatccaggaagagatgccgggggtgcacaawggaccctgctggccatggagtgggggtggcggggactcaggtgtcacgttggagactgcttgccaacacacatgaacactcattcacaactggactccgt

SEQ ID NO: 22686 - DNA, 201 bp, Homo sapiens
tgctgccttagcctgccaggacagagggaggtgacagtctgttctcatagccaggaggataggacttctgggtgagaagtcctcttattaatttgctttcyaaaggccaaagaagcccaggatgacctggtgaagaccaaggaggagctgcacctggtgatgacagcacccccgcccccaccaccccccgtgtacgagccg

SEQ ID NO: 22687 - DNA, 201 bp, Homo sapiens
ttcattccaaagagggcctgatcccagacagttaactccaagctcgactgcctcagctgagctggggttacgccactgaagacaaatgagtgtttccactrggggcaagcctgcttcctcaggactggcgacttcagtctcagtttttgttggtctggcagagtgagacagctgaagagggaacacaaaccctgcaatcat

SEQ ID NO: 22688 - DNA, 201 bp, Homo sapiens
gcaatgaggagaagcgcatcactgaggcagagaagaacgagcgtgtgcagcggcagctgctggtgaggcccaaggggctctgtctccagggagcctgcctsgcttttggagcagacaggcttggggagggcagtgatgtgagccagccccacccagcacccctcttgcccttcctgttttcctaggggacgggccgggcca

SEQ ID NO: 22689 - DNA, 201 bp, Homo sapiens
gcgctgcgggcgccgagtgtcgggcgcggcaggaggacgaggcagggcgggcgggcgctctaagggttctgctctgactccaggttgggacagcgtcttcsctgctgctggatagtcgtgttttcggggatcgaggatactcaccagaaaccgaaaatgccgaaaccagtaagttgcccagtttctgggccgggcggacgg

SEQ ID NO: 22690 - DNA, 201 bp, Homo sapiens
tcccagagaatgcactttcccagtgctacatacccacacataaccgcacacacacgcggcacgtgcccttcctccatctgtcctggagaatgcacattccyagtgccgagatgctgccatccctgttctgctacatttgttcttttagaaaagttctggacctttgtgaaggatggtttggagaagaaaaccaaacgaagg

SEQ ID NO: 22691 - DNA, 201 bp, Homo sapiens
agaggctgaccgtatggctgcactgcgggctaaggaggagctggagagacaggcggtggatcagataaagagccaggagcagctggtaggaatggcctgastttcaagatgctgaattatagagaggctgcttctgaggatggaaaatgtgacacctgccttgtaataattgtcatgactggaagctgtaaactgatctgc

SEQ ID NO: 22692 - DNA, 201 bp, Homo sapiens
aggatcttttaaaaggtgaaagtatttcatgatagcattataaaatgcattaacagacaagtatatcatgcctaggaagtgaggtgtatgaaagcacacakctgtctgttgtataaagtcaggcggattcagtgtgttaccaggcatggaagcaaaggactgaaaagagagttattgtgcttgtcattgtaaggaggtgct

SEQ ID NO: 22693 - DNA, 201 bp, Homo sapiens
ttgatctactatagtctgtatgtgaatttctgactgcagatgttttgtaagtccattcctgattcagaacaccctgtctaaagtacagctccatctctgtctgtgccgtgccccactttactgcactcatagaactcggtctccacctataacgctgtcaggtgcttgtttatttgtgctttttgtcttttctggcagcaa

SEQ ID NO: 22694 - DNA, 201 bp, Homo sapiens
tgatctactatagtctgtatgtgaatttctgactgcagatgttttgtaagtccattcctgattcagaacaccctgtctaaagtacagctccatctctgtctgtgccgtgccccactttactgcactcatagaactcggtctccacctataacgctgtcaggtgcttgtttatttgtgctttttgtcttttctggcagcaaa

SEQ ID NO: 22695 - DNA, 201 bp, Homo sapiens
gatctactatagtctgtatgtgaatttctgactgcagatgttttgtaagtccattcctgattcagaacaccctgtctaaagtacagctccatctctgtctgtgccgtgccccactttactgcactcatagaactcggtctccacctataacgctgtcaggtgcttgtttatttgtgctttttgtcttttctggcagcaaag

SEQ ID NO: 22696 - DNA, 201 bp, Homo sapiens
cgtattaaggaattgttttaaattatgttggatgtgataatggtattgtgatttttttttttagtgctttagagcaatatactgaagtttttacaagtgaaataatgaatgagggccttaaaatatgccagcaaaaaaaaaaaaagtgaaagtggtagagtagaagaaagaatggtgttgaagctgaaaagagagtgtgga

SEQ ID NO: 22697 - DNA, 201 bp, Homo sapiens
gtattaaggaattgttttaaattatgttggatgtgataatggtattgtgatttttttttttagtgctttagagcaatatactgaagtttttacaagtgaaataatgaatgagggccttaaaatatgccagcaaaaaaaaaaaaagtgaaagtggtagagtagaagaaagaatggtgttgaagctgaaaagagagtgtggag

SEQ ID NO: 22698 - DNA, 201 bp, Homo sapiens
tattaaggaattgttttaaattatgttggatgtgataatggtattgtgatttttttttttagtgctttagagcaatatactgaagtttttacaagtgaaataatgaatgagggccttaaaatatgccagcaaaaaaaaaaaaagtgaaagtggtagagtagaagaaagaatggtgttgaagctgaaaagagagtgtggagg

SEQ ID NO: 22699 - DNA, 201 bp, Homo sapiens
aaggaattgttttaaattatgttggatgtgataatggtattgtgatttttttttttagtgctttagagcaatatactgaagtttttacaagtgaaataatgaatgagggccttaaaatatgccagcaaaaaaaaaaaaagtgaaagtggtagagtagaagaaagaatggtgttgaagctgaaaagagagtgtggaggatca

SEQ ID NO: 22700 - DNA, 201 bp, Homo sapiens
ttctgcctcccagatgcagtggacagtagggagggcttagcacagaactcttcccaacctggttttaaaatgaccctcttttgaatgtgaatgcccagaargttcccttctagttctaaggtcatgattttcttgctgataataatgagcacagatgggactggtttgtccgctttttgtgtttgttaagcagccttggtc

SEQ ID NO: 22701 - DNA, 201 bp, Homo sapiens
tgtgataatggtattgtgatttttttttttagtgctttagagcaatatactgaagtttttacaagtgaaataatgaatgagggccttaaaatatgccagcaaaaaaaaaaaaagtgaaagtggtagagtagaagaaagaatggtgttgaagctgaaaagagagtgtggaggatcatggtactacttattctctctactttt

SEQ ID NO: 22702 - DNA, 201 bp, Homo sapiens
cccaggctggcagtgatgggtcggggtggtgacccagtcagtgtagcaataacagtgtgggaggggaggctgtggcagaggagacaggaagcccaaatagmagcagaggcagtccaggcaagcatcggggatggggagcagcagtgaggctggagaggacatcatgaaaggtggctacctggaagagcaggcagctctgag

SEQ ID NO: 22703 - DNA, 201 bp, Homo sapiens
tgggtgcagcgcaccagcatggcacatgtatacatatgtaactaacctgcacaatgtgcacatgtaccctaaaacttaaagtataataaaaaaaataaagaaaaaagaaaggaaaaactcttcacaggcttctaaatttgcagagacaaccatgcattccaggtgaatagtgatgtttaatctataggcctttagttccct

SEQ ID NO: 22704 - DNA, 201 bp, Homo sapiens
aaagaaaggaaaaactcttcacaggcttctaaatttgcagagacaaccatgcattccaggtgaatagtgatgtttaatctataggcctttagttccctatsttttctgagcctacaattaaaaccgactctagcatataataagccatcttggccttgtcccttacttttgtttatgtgtgtagttactaagtttactaag

SEQ ID NO: 22705 - DNA, 201 bp, Homo sapiens
ccccgctgcctctgagattccaccccagctgcctgcaggtaccagcacatccatccatagctacttcgcaggcagcccagccagtgctcgactcctggctygaggtttgtgctaatccaaccaagaatattgatggtgtgatgagagacttgaaaagctgtaaacaatagcctgtacgtgtagacacttgagctaaatgct

SEQ ID NO: 22706 - DNA, 201 bp, Homo sapiens
ccctagactgaggaaaaaccaaaggaaatgggaacagattaaggttgcagatgccttgcagccaaccacttggcttaacctaggacaggtgggaactattkgataatagcatataacacattgtgcctcttgggttagcttcatattattttaattgaactaataagaattgatttgcgaatctctcttagccaatccaag

SEQ ID NO: 22707 - DNA, 201 bp, Homo sapiens
cctcctgaacgtcaccgataaggcggggacgccagcatctaatgggactgctgggaggattgagtcccatatctgaagtcccttgagataccggcatcccygccttatggttgaaggcactgagcctggtgaagggatgtgctcaaggctgtggagctcgcacgtggctgtctgtgctgcacgagctggcagtgcctggca

SEQ ID NO: 22708 - DNA, 201 bp, Homo sapiens
ttgtcattaaacccatcgacaagaaggcacctgtaagttccaaaggattctattcaggggctactgtttttcattcttatacttgtcagggtaacggacargttatactgtgacgagtagccagtgatagtccaaactcctcatgaggttacattgagggccagagatcctgtgggccaggcaattgctgcaggggagacc

SEQ ID NO: 22709 - DNA, 201 bp, Homo sapiens
gagttgtaaagggagccgtgccttcctcagcccctcctgaaagaaagacctgctttcaagaagcttatattgcagggggaaagacacatgtctaatacatygtcagggggtggtgagcgtgctactgtaaattttcacctaggctttggcaagagctagaattaactttcattctttactgactctttgaagcgttaaaac

SEQ ID NO: 22710 - DNA, 201 bp, Homo sapiens
ggttaaaaaggcaactgagatgcttcctggtagtaaatttaacagtacagctgtgattaaaaactaagccggatcagaagatgggggtgagattcctttargcaggttgggcaggagccacactgaggaggcagcatttgccttgagtgggcactgctggtttgaggaggtggagttctgtcacccccacagcaccccagg

SEQ ID NO: 22711 - DNA, 201 bp, Homo sapiens
ttagcctaatggtggtgctggaggaagtagtaaggagaacagtttagaaaaggaggtgtgagtggcatgtagtgttacttttcatcatttaaattactcaraaagttccttaaagtgcttctggcttctctgggaaatgagttcctgcttccctgtggtgtcaggagaatcgcagggtaggagacacggcccctaggatac

SEQ ID NO: 22712 - DNA, 201 bp, Homo sapiens
atgtctgtccagccaggagaacacacactggaatgagaaccagaggagcagaatgcatagcaaggcctttgtccatttctcttggcaagctctgttgagtrtggcacgtctaggaacgtgatgggatcttggccctccctgttggtttcatagaactaaatgatcagtaacttaaataacattcaacagtctgtagcagaa

SEQ ID NO: 22713 - DNA, 201 bp, Homo sapiens
tggaagttggagagtgacatgggaagatgtctgtccagccaggagaacacacactggaatgagaaccagaggagcagaatgcatagcaaggcctttgtccrtttctcttggcaagctctgttgagtatggcacgtctaggaacgtgatgggatcttggccctccctgttggtttcatagaactaaatgatcagtaacttaa

SEQ ID NO: 22714 - DNA, 201 bp, Homo sapiens
agaagggccatgtcaggcttacatgtttgccctcagcctacagagtccaccccactgccttgatctagttgatgtgatcataacgaaacctgtattgctcrtcagtattgaagctgttggtaggccatagattgcttgaccttcctgctacttctaaaatgaaggtttttgtgggatgttggaaaggactgctttggaggg

SEQ ID NO: 22715 - DNA, 201 bp, Homo sapiens
cattgagtgttgcttgtcgtatttttgatttcagaagcaatttgcccagtttctactattttcgtaattataatttaatatcactacataatccatttttkatgtgtctttggacatttcaccatttctctctcactatggtttctaaggttgcttcaaaccttctgattcaaagctctttctctcttcccttctctgact

SEQ ID NO: 22716 - DNA, 201 bp, Homo sapiens
ggaagattttaaaccccgtttcaggccccctccctaggctgtaggaaaccacccactctgaagcccggcgggggaggagtgctgcagccagctgccgaggragcgctctgcggcgaggccgtttccctgagtcacggagagggcgggaggctgcgcccgtctgcccccgccacgtcctcctgtgaggggctcagtcgaaac

SEQ ID NO: 22717 - DNA, 201 bp, Homo sapiens
acacaatatttatcagttcagtttgctgtcttatgtgggtgcaattcatcacaccccaaaataatagttacatcaaagatgactggccacagatcaacatracagatacaataatgaaaaggtttgaaatattgtgagaattaatgaaaacgtgacacagagacactgaagagagcacatgctgttggaaaatagtgccaa

SEQ ID NO: 22718 - DNA, 201 bp, Homo sapiens
tacttcctttaaataagccttgaggatggaggtcggacctatagaagtaaaatcttggaggttgaaatttcttcattttccctgaaaggagtagtagaatyggcagggcagactgttacctatctatctatttggttcactgagttctcaagtatttttcaattcttactgatttggggacagaaatttcctatattcatt

SEQ ID NO: 22719 - DNA, 201 bp, Homo sapiens
actgtcaaaagaagtgattccccatgcaaagaaacaatttagggtcatatttgacagactatttttttaaggaattttctgttatctccaaggcagagcarttatcaactacagggaaaagaattctacctacatcccttttcctagctccttaattaagcattactattacatgttagaaggtgatatgtttcagtacct

SEQ ID NO: 22720 - DNA, 201 bp, Homo sapiens
caggcacatgccacaagcaactccaacagccaagccgagtgtactgggatgagccaaatattccataaccaaggatttggagggcatcttaaaggaaaggmaaacagttatcactatccggcagtaacaacttacagaggtataggcttatcagagaaacattttgactatacacttaatggtcatccagaaaaaaggcaa

SEQ ID NO: 22721 - DNA, 201 bp, Homo sapiens
aaagggacaagtaaggaaaccttgaaacttaagcaataaaataagataacctgatgagttgggaacaatcctgtccttttgagaaattactccccaagatwaaaaaatagaaaataaacatattactgttagtttttttccaaaaagtaaatagtaactttggatattagaaaataatatatatcaaagcacgatgtaagc

SEQ ID NO: 22722 - DNA, 201 bp, Homo sapiens
tatagctgtcataggagatctgttaacttggttgatcatttttttggcatgtttataattacagctatgtggtttgactttatatgtttttatataaactrtgtactaagtctcctgtttaggtgtgatacctgtgtatttaacaactaattctgtactgatcaatcatgtggtgtttccaacctgagaaagctgattaaa

SEQ ID NO: 22723 - DNA, 201 bp, Homo sapiens
ttataaagaaaggacactgtatgaatctctaatcttttattcagatataaggaggtaagtatatcatatagcagataaacctgggagagtgaaaaatagcyttatataccttctttttattcttggacaactcaatcatattttgagtcttaatttcccaatttataataggatcactgataattaaaattaatgtaaagc

SEQ ID NO: 22724 - DNA, 201 bp, Homo sapiens
tttttgtttttttttgttttttttttgtttgtttgtttgtttttgagacggagttttactcttgtcacccaggctggagtgcaatggcacgatcttggctyactgcaatctccaccccccaggttcaagcgattctcttgcctcagcctcccgagttgctggaattacaggtgcctgccaccacaaccagctagttttttt

SEQ ID NO: 22725 - DNA, 201 bp, Homo sapiens
tagttacataaattcaaaagtagaatcgttttatttctctttggcctgcaaaacattatctcaatatggcaagtacctagagtttgactttgtctgtggtmggtttcttagatgtgagaaaatgagactgggattacatttgtaagccactgcaccagtgcactttctgcatatcagcaagaaagctgttaggttttctta

SEQ ID NO: 22726 - DNA, 201 bp, Homo sapiens
aggctggagtgcagtggcaccatctcggctcactgcaacctccgcctccggggtcaagcaattctcctgcctcagcctccccagtagctgggactacaggygcacactgccatgcctggctaatttcttccgtatttagtagagacagggtttcactgttttgcccagggtggtctcgaactcctgagctcaggcaatcca

SEQ ID NO: 22727 - DNA, 201 bp, Homo sapiens
tgaacacaggtatgctttcagagggatccattggctatttatagtcagtctttaataaattatggcccatcagttttgggaaggaacaaaaagatcagagraagttgcctgaattctcactcttctaatatcctcccccctaccctacctcttgagacaaaaacctctccgttagtcacagtggttattttttatgtcgga

SEQ ID NO: 22728 - DNA, 201 bp, Homo sapiens
ctcctggattcaagcgattctcatgcctcagcctcccgagtagctgggattacaggcacccgccaccacacctggctaatttttgtatttttagtagagtyggggtttcgccatgttggtcaggctggtcttgaactcctgacctcaaatgatctgcccaccttggcctcccaaagtgctgggatcacaggcgtgagccac

SEQ ID NO: 22729 - DNA, 201 bp, Homo sapiens
tgagattatttacttttctcttgcctggcttatgtgcagcattggatattttaaaccaaaatgttctcatttagtttatgggatgtttgtgattagagagrcaactcaaattaggtatatacattcattctgttttagtgtatatgtataggtagagaagaatttaacaacttaggtttctatttggaaatactaaattaa

SEQ ID NO: 22730 - DNA, 201 bp, Homo sapiens
cacaccatccctagctcctggcaaccactaatttattctccatctctataattttgtcactttagaaatgttacataaatggaatcatacagtatgtgacyttttaagattggcttcttttttttcactcaccataatgttcatgaaagtttgttcctttttattaccaagtattccatggtatggatgtaaccaaaacca

SEQ ID NO: 22731 - DNA, 201 bp, Homo sapiens
tggtggcttacgcctgtaatcccactactttgggaggctgaggcaaaaggatcacttgatgcaaagagtttgagaccagcctaggcaacacagcgagaccytattaaataaatacacaatattttttaaaaagataagggagggtgagaacagccaaggtaactgagttgacctacgtaacagggtgaaagctttttaggt

SEQ ID NO: 22732 - DNA, 201 bp, Homo sapiens
tggaaaatgagcagtggtcagggtcccagccaacaactattccacagaactctgaggacacttctggatccatgattgcatttctggatgcttggaaattygatttgactactatttccactaccagagtagcatctctgaaatcctaatacttttgtgttcctagctccctgttcaaagtctagttttaggcaagatcag

SEQ ID NO: 22733 - DNA, 201 bp, Homo sapiens
taggactgtttttatattattaattctaagtccttgtttcttgacccagtttctggcaatcttgtaagataccagagaatactacatcagatttgggatayttggacaggagtctctgatgaagaatagccacactagcgagtatttgaggtccatcctaattgattaagataaggcagggctgagtttggtggcttacgc

SEQ ID NO: 22734 - DNA, 201 bp, Homo sapiens
tcaatccaagtttagttgctgtggttgcttttgttaaagtggggtggcaaatgaatgtggagagttgaggggtgctgttcttaagtgtgaggggaaaacgsgggcttattttcatattaaactgcatctgaaatatctttctgcagacaaatgtttataaaccacacagagaatcaagtacagctgctctttattttccac

SEQ ID NO: 22735 - DNA, 201 bp, Homo sapiens
ttaaataatttattcctattaatttgctttcttcccaaatatccccttaaagaaacctgcctcagctcagtcgtctgaagggctaattccataatgacagrgaatgcagtggtttgacatgacactgatatcagtgacctattagacactttaccattgaagaccatttttatttacatttccccattggcatagcataca

SEQ ID NO: 22736 - DNA, 201 bp, Homo sapiens
gcattcacattaaatcttcacacctctgagatagatactgtcatctcaaatgtttcatatgagaaaacataaacacagcctgtgttctctagatcagtggwccacaacctttttggcaccagggaccagttttgtggaagaaaatttttccactggttgggggtgggagtgggggtgggatggtctcagatgaaattgttt

SEQ ID NO: 22737 - DNA, 201 bp, Homo sapiens
ggtcctttacagacgcggttacttgagatgaaccttatgcatgcgcctcaagtatgtgttttaatgctttttaggcatgtttccaacattgttttagtaaytgtgcagcgcctctcagattgttatgcaaagctactgaggggcctactccttattaaagaaaatgtagctattataatattcttttgtactttaacagtt

SEQ ID NO: 22738 - DNA, 201 bp, Homo sapiens
agaatccgcgcgtcaggttctccaacagtcagaagggcttgtgtgagggcagggaagattttaaaccccgtttcaggccccctccctaggctgtaggaaaycacccactctgaagcccggcgggggaggagtgctgcagccagctgccgagggagcgctctgcggcgaggccgtttccctgagtcacggagagggcgggag

SEQ ID NO: 22739 - DNA, 201 bp, Homo sapiens; identical to SEQ ID NO: 3817

SEQ ID NO: 22740 - DNA, 201 bp, Homo sapiens
ctgtaaatgaacttatttttataccctttaactacattgtccaactgaaggatctcttgtcatcaaagcttggacctacagcaaatgaatgtgaatatatraagatttctcttttcctagactgtttagactgatagcagttaataaatgagtgcctatttgagcaagatactgttggaattgaagattctataaaaatcc

SEQ ID NO: 22741 - DNA, 201 bp, Homo sapiens
caaaagaatagcttattctgcccaaatacttgtccagtcactaggatcatttcacttttttgaataccatttgctttggggagggaagtattgccagaccrtgaattcattattacctctgatcagttttaaacttcatttgaaaagtggttccttctcgttttctccctccctcaggctgcatcctagcatgcccagttt

SEQ ID NO: 22742 - DNA, 201 bp, Homo sapiens
aggaaatttgagggccagtgcaatggtttgccaaggtcacacaactagttagtggaaggatccaggcattctaattcctttctttcactaatacatttggmctgctctacagaattacttctgtctgatactatccactttgaagagtagctagcatatagtagccatttacttttggctcaattaaaagcaaacattttt

SEQ ID NO: 22743 - DNA, 201 bp, Homo sapiens
ttggaaaatagtgccaataggcttgctcgatgcagggttgccataaaccttccattcgtaaagattcatctgcactgcaaagtgcagtaaaatgaggtatscctgtaatacgtaaactgtgctatctaagttttgaattgtctttcctcttatcagtttcatgttatataagagcttgggatatccatatttaaatgtgct

SEQ ID NO: 22744 - DNA, 201 bp, Homo sapiens
ctgtaatacgtaaactgtgctatctaagttttgaattgtctttcctcttatcagtttcatgttatataagagcttgggatatccatatttaaatgtgctgyagaaatgaaggaaactttaaatattagcttataatttttcaaataaccctcttgttctggaattttaccatctctaaaatggaattagactgaatgtttt

SEQ ID NO: 22745 - DNA, 201 bp, Homo sapiens
ttgagaggtttgagggtaggtaattttccaaacaagcaattagaaattggcctttactgatattattattattttatttttattttttatttttaattaatttttttttttttttgagacagagtctccctctgttgcccaggctggagtgcagtcgtgccatcttggcttactgaaacctctgcctcctgggttcaagcg

SEQ ID NO: 22746 - DNA, 201 bp, Homo sapiens
gtgcctggcctaattttataattttaaatgtctgtaaagtaagcaaaatgactagttgaattgtacattaaatatatctaatccctaagagtttataatgraaagggatcaaaactttttcaattgcgataaaactcacataacaaaattaaccattttaaagtgaacaatttagtggtatttagtgcattcacagtgtcg

SEQ ID NO: 22747 - DNA, 201 bp, Homo sapiens
tgagaggtttgagggtaggtaattttccaaacaagcaattagaaattggcctttactgatattattattattttatttttattttttatttttaattaatttttttttttttttgagacagagtctccctctgttgcccaggctggagtgcagtcgtgccatcttggcttactgaaacctctgcctcctgggttcaagcga

SEQ ID NO: 22748 - DNA, 201 bp, Homo sapiens
tcatacctgtaatcccaacactgggaggtcgagctgggaggattacttgagcccaggagttcgagaccagcctgggtaacatagggagaacctgtctcttaaaaaaaaaaaaaaattagccaggcatggtggcgcctgtagtctcaggtactgaggaggctgaggtaggaagatcacttgagcctgggaggtcgaggctgc

SEQ ID NO: 22749 - DNA, 201 bp, Homo sapiens
aaattaggctgaatttattcttatcacttttgatgttagtttatggtggactgaattaacaccttacattcctgaccaatattcattatgaaatttgtacwtaatatgaacttgggataatacttagctataactgttttatgattataactattctcttacacactgacattgtaatttaagttgatgtatttttgattc

SEQ ID NO: 22750 - DNA, 201 bp, Homo sapiens
taggattacaggtgtgagccaccgtgcccggctatgtatattttgtacttagagcatatatcaattcagaccctattttctttggaaatcctggtccgtakttagagttcataaaatttacagttagaaaggcagatttggggctgggggtagtggctcatgcctgtaaactcagcactttgtgagccaaggtaggagcat

SEQ ID NO: 22751 - DNA, 201 bp, Homo sapiens
atcacttgatgcaaagagtttgagaccagcctaggcaacacagcgagaccctattaaataaatacacaatattttttaaaaagataagggagggtgagaacagccaaggtaactgagttgacctacgtaacagggtgaaagctttttaggtatcattatccttttctgtgaacagtcatatgggaccatttgtggtattaa

SEQ ID NO: 22752 - DNA, 201 bp, Homo sapiens
cttgagcccagggggcagaggtttcagtgaatcgagattgcacctctgcactccagcttggatgacaaagcaagaccctgtctcaaaaaaaaaaaaaaaagaaaagaaaagaaaagaaaatggataagccagttataaaaattgacagatgtttgttcaaatatgtcatcaccaaggtctaactgggcaccttaaattgaa

SEQ ID NO: 22753 - DNA, 201 bp, Homo sapiens
aagtggagggatagcttgagcctgggaggtcgaggctgcagtgagctatgatcgtgccattggactccaacctgggcaacagagtgagactctcaaaaagaaaaaaaaaaaaggaaaacttacagtttgtagaaattaaagctttgtcactctatatggataaacctcaaatgccttgcaaaaaaagcaagttgcaaaaga

SEQ ID NO: 22754 - DNA, 201 bp, Homo sapiens
taaagctttaaaattgatagctatctataaaaggctaggaaaactacagaacacttagattactgctctctcactgcctattatgtgtgtgtgtgtacacwatatatatatataatgattcctgagactttatagaaagttctgaagtattttttgtcttggaagaattttacattacaagtaaaaccaaaatgtttttgt

SEQ ID NO: 22755 - DNA, 201 bp, Homo sapiens
ttctagccttgcagggtgccagattatcaattaccgtacagatgcaaaacaaaagtggttacttctgactggtatatctgcacaggtaacattttaactakttttttatgaagaagaggtttagaacacggttgtgcccagaatgcagtttgattttgaaattaggtctttctatactcaatcctgttgaatttcacttat

SEQ ID NO: 22756 - DNA, 201 bp, Homo sapiens
ggtagcttaggattcttacagcataacttactgcttttaggtatatagctctatgaactttatgagcccactggaatgttttctccaattatcggaaaggmtaattatcaattaaacttaaggagtctaaggaccctctactcagaaaaatagatgtgagatcctgtctcaaaagaaaagttaaagtcaggaagaagttaa

SEQ ID NO: 22757 - DNA, 201 bp, Homo sapiens
ggacttaagctgtgacaggtgaaactcagtgccttagatgaaggcttggtagagacttagaaacatagaattcttacagggtagcttaggattcttacagsataacttactgcttttaggtatatagctctatgaactttatgagcccactggaatgttttctccaattatcggaaaggataattatcaattaaacttaag

SEQ ID NO: 22758 - DNA, 201 bp, Homo sapiens
aggtgacagctttgttttcaattattgttaagaaaactattcattaggcttattttcagttgggatttagaattccatggaagtcatactatctgtttaargtgtgtttattagaggtaatgtagtttttgcttaaaacgtagatgtagattgtttgcttagtcttagctgttacctctttaatggttgctgctgtatcga

SEQ ID NO: 22759 - DNA, 201 bp, Homo sapiens
agagggcgggaggctgcgcccgtctgcccccgccacgtcctcctgtgaggggctcagtcgaaacaggcagcggtcgcagggaaacgaagcggcacccgtcrtgcctcaaggtggcccaaaagcctcttcactcccaggagacgccgcatttccttaaaacgagctctccatttctggcagcaatcagccgacccttcccca

SEQ ID NO: 22760 - DNA, 201 bp, Homo sapiens
ttaacttggtttcttgaaatttatttaaatatgaaccttttctaaatgttaactagctttctttactgtaggtcttctccatgccttttatattcactcartacttatttctctttacagagagcatataatggtagtatgttttcctgagcacattattccttatgtggaatagtgactgagaaacagccaaaggatgtt

SEQ ID NO: 22761 - DNA, 201 bp, Homo sapiens
ttatcgcgctttttaagcaaccaacttatatttgggagtattcaatataacagttttttaattacataaatgtttttcagtcattctcaaaagtgtgcctrtgcttaattgtaattacttgtttctttaaggtctcttttattttctgggatccattgttaactttagccaggacccagatgtgcactttaaatatattca

SEQ ID NO: 22762 - DNA, 201 bp, Homo sapiens
gccagttctagttagaatccgcgcgtcaggttctccaacagtcagaagggcttgtgtgagggcagggaagattttaaaccccgtttcaggccccctccctrggctgtaggaaaccacccactctgaagcccggcgggggaggagtgctgcagccagctgccgagggagcgctctgcggcgaggccgtttccctgagtcacg

SEQ ID NO: 22763 - DNA, 201 bp, Homo sapiens
ttgcactagcaaggacttattttcctttaaggcttgaaatgtaaagaataataaatttttacccataaaatgagttaaataatgcactttcctcagtcatytataattttcaaataactcatctgaagtaatggaatataccttggcaataaaaacacttttacagagggttaaaaatgttaaataacaaaatggacattt

SEQ ID NO: 22764 - DNA, 201 bp, Homo sapiens
atcaccaatgttctacaaaatcctgatttggctctgagaatggctgtacgtaataacttagccggtgctgaagaactctttgcccggaaatttaatgctcwttttgcccagggaaattactcggaggcagcaaaggtggctgctaatgcaccaaaggtaaagagttatgaaaatgaagttgtcatgacattaatccattgt

SEQ ID NO: 22765 - DNA, 201 bp, Homo sapiens
gggacttaagctgtgacaggtgaaactcagtgccttagatgaaggcttggtagagacttagaaacatagaattcttacagggtagcttaggattcttacakcataacttactgcttttaggtatatagctctatgaactttatgagcccactggaatgttttctccaattatcggaaaggataattatcaattaaacttaa

SEQ ID NO: 22766 - DNA, 201 bp, Homo sapiens
ctcccaggagacgccgcatttccttaaaacgagctctccatttctggcagcaatcagccgacccttccccatcagtatcacgtgcacctggaagtacgtgsgtgggacctaaagcgcccacggaagtgacgtcggtcgccccgagtcgcatgatgtggcaaaatgaaaaaaaaaaagtggggggagaaagagaagactggc

SEQ ID NO: 22767 - DNA, 201 bp, Homo sapiens
attaaaaggagtataccttaaacaacttgcaagtgaaccctaaatgtcatttagatatcatagcttcttcagtgtcattttctgtaggttatcaagattgmagtcctcaagaagttttaaattatgtggagttgtctttcagagctcaattaagtgggaatgttaatttttgatactgactgtgttaagaatgaatagatg

SEQ ID NO: 22768 - DNA, 201 bp, Homo sapiens
attgctgagtgttctagacattctcactcaaaaggaacatcagtaaggaaaacaatcttacctaccttatttgaagaggtggaagcaaatttaaccttctsttagccaatacggtcacttgaagttcttttttttttttttgccaaagtcttgctctgtcactcaggctggagtgcagtagggcggtcttggctcactgca

SEQ ID NO: 22769 - DNA, 201 bp, Homo sapiens
atgctctttttgcccagggaaattactcggaggcagcaaaggtggctgctaatgcaccaaaggtaaagagttatgaaaatgaagttgtcatgacattaatycattgttaatattctgtttcttatattactagaaaaggaaccagcttcctacagataaactgtttttagattacatttgggttacattttcctttagtag

SEQ ID NO: 22770 - DNA, 201 bp, Homo sapiens
catttccttaaaacgagctctccatttctggcagcaatcagccgacccttccccatcagtatcacgtgcacctggaagtacgtgggtgggacctaaagcgyccacggaagtgacgtcggtcgccccgagtcgcatgatgtggcaaaatgaaaaaaaaaaagtggggggagaaagagaagactggcgaaagtgatgagtcta

SEQ ID NO: 22771 - DNA, 201 bp, Homo sapiens
cctccaggaaccttcaggtttttttttgtttgttttttttttgagacggagtctcgctctgtcgcccaggttggagtgcagtggcgcgatggaaccttcgrgttttactaagcatccttaccctaattatctaaatctttgagacgtaaattatttgatgtggctaaaaatcctcctgctagaatttaggtccaatccttt

SEQ ID NO: 22772 - DNA, 201 bp, Homo sapiens
tcctccaggaaccttcaggtttttttttgtttgttttttttttgagacggagtctcgctctgtcgcccaggttggagtgcagtggcgcgatggaaccttcrggttttactaagcatccttaccctaattatctaaatctttgagacgtaaattatttgatgtggctaaaaatcctcctgctagaatttaggtccaatcctt

SEQ ID NO: 22773 - DNA, 201 bp, Homo sapiens
tatatttaacaaggtgttttccctgtcattgttaccgttgtggctttttctctttgagttattgtccagtagaactttcttcaatgatggaactgtctacyagctacatagggatattgagcacttgaaatgtggctgatgtgactgaaaaactaaatttttgctttaatttctttttaatttaaatgtaaatagccacat

SEQ ID NO: 22774 - DNA, 201 bp, Homo sapiens
ccgtctcatgcagcacatttatgacattgaaaaccaccagtaatagataacattgagatttgaaatttagttttacttaggtataatgacagaccaagtayaaggctttggttgagagaccagcttttaaatattgaaagacaaatatagtgtaaaaggcgcaatggaatttgtatagtgaaggagattctctagtcccag

SEQ ID NO: 22775 - DNA, 201 bp, Homo sapiens
gtcatcttcagacctcacttcttgcttcagtacttttgcctttttttcatgcacacatacaccaaaataactgactgcatgttacttttcctctgcagcayattgcagtctttgtggaaaagccttttacattttagtgaattttcagtagtacagatggaactgaattcattgacatgcttacctgtaatttttcttttt

SEQ ID NO: 22776 - DNA, 201 bp, Homo sapiens
gctgggggaggtgccatgcacttggtttcaagctacccagaaagctgaggcaggaggatcacttgagcccaggaggtcaatgttgcagtgagctatgatcrcaacactgcactctccaaccttgacaacagagcaagactcctactttctgaaaatattagaagtcaagatctgagctttagtgtatttgcttctaagatc

SEQ ID NO: 22777 - DNA, 201 bp, Homo sapiens
cttgtgagacctgtctttaagctgctgttaacctaagtgctgtaaatttttctagtgattaagctgctttctttcatactgtagcataaattcttctgcaktaagctttgaagttacacaaaattctaaattttgcttccagtatgccctttattttcacttctctcatacctttttagtggttagatgtttcttccctaa

SEQ ID NO: 22778 - DNA, 201 bp, Homo sapiens
gaggtgaacatgggaaaaaaaaaacaagctgggggtctaattgccttataacattcactattcgtcttagtgtccttttttgatgtatgaatttactcacyctatcttcagcagttactagctgtctctctgtagaacatttttaaatggttttagaggatccttttcgtcaaagcaaaaaacatgattaaaatcagagtc

SEQ ID NO: 22779 - DNA, 201 bp, Homo sapiens
gtgtatttatgagggtgaaaataatctatgtatttttttatttaaaaaactttgataaattttatttcaaaatagtatttttctcaaaatcagttcttgtractcaaatattcatgactagtattgtagattcccttttatttggttggttcctgactttaatgatgtctatgcctgtttcccctggggaagctgcatgta

SEQ ID NO: 22780 - DNA, 201 bp, Homo sapiens
aaaaaaagcttttagcttatctcttctttgaaaattttaatttaaatgatacaactaggaggcttttttccccttgcaaaaccagatttatattggaaagyttccattgtttttcttggtttactagttcagtatgtggggtctaatgtttttgactttcactatttctttgaataggatgcaatgcagtatgcttctgaa

SEQ ID NO: 22781 - DNA, 201 bp, Homo sapiens
gaggctgaggccggagaatcgcttgaaccctagaggcaggttgcagtgagcccagattgcatcaccactgcactccagcctgggcaacagagggagactcyatctcaaaaaaaaagaaaaaaatcttgccctccaaattagaaatattgtccatttcatagccatatgttagtccttgatagtgaaaatcttggagaaaat

SEQ ID NO: 22782 - DNA, 201 bp, Homo sapiens
tcatttacagatccagtgttttatggtgtataagtatttggggttaacacatttacctaagatttgagtacttactgcagatgaggaactgtgttagactytagggacaaggtggtaaacaagatggactacaccttgcattcatgcttccattgatgagttggcaaaggctgtacacttgttattccaaccattgatgtt

SEQ ID NO: 22783 - DNA, 201 bp, Homo sapiens
atttggctcattgcctcatttggtaaatggtctgtatcatttgaattgcaaaatgtaccacaattgtttatatctatgctgtgatgttctttgattctagyagtactgtcgtttgtttatcgtgaaatattttttatattatgagaaaagtaggagacagcaaactaacatctgactttatgccttgaatgattatttagc

SEQ ID NO: 22784 - DNA, 201 bp, Homo sapiens
tgaaaacagaataagtaatcctagattatctgtaagtgataaagataacaaaaatattttatatgtgtataggtaagatgactagtgtgttgatccatacttttttgatgttcatttagtaggaaaaacatgacatactaaaatttttacatagatagatgcagacagattctagaaatgatcgtaacagctattagtgca

SEQ ID NO: 22785 - DNA, 201 bp, Homo sapiens
gaaaacagaataagtaatcctagattatctgtaagtgataaagataacaaaaatattttatatgtgtataggtaagatgactagtgtgttgatccatacttttttgatgttcatttagtaggaaaaacatgacatactaaaatttttacatagatagatgcagacagattctagaaatgatcgtaacagctattagtgcag

SEQ ID NO: 22786 - DNA, 201 bp, Homo sapiens
tataaggataagagaaaatacaaaagaccaagtgcatcagtgttatatcttactaataagaagtatagaactgcaaatgagatggggttttatacctaaawaaaatagacaacatattttaaaagttctaaaaatagaagagttgttataatgagtcttaaattctcctgagataagtataaataaaatattttggaaacg

SEQ ID NO: 22787 - DNA, 201 bp, Homo sapiens
atcaaactcctgggctcaagtgatcctctcatctcagcctcccaaagtgctgggattataggtgtgaaccaaggtgccaggccaaatctttgttgtttttkttttttttttttttttttacaagtaaaataccctgaggctgaaggtcattgctaactgatgcagcgtgtttttcttactgctttttttctggggatctaa

SEQ ID NO: 22788 - DNA, 201 bp, Homo sapiens
gccaccacacctggctaatttttgtattttttgtagagatggagtttcatgttgcccaggctagtctcgaatgcctgggctcaagcaatcctttgccttgrcctcccaaagtgctgggataataggtgtgaaccaccgagcccaactaataaggattattttaattggcatctttggtctttgacctctgagcttctacca

SEQ ID NO: 22789 - DNA, 201 bp, Homo sapiens
ccctgggccacagagcaagaccctgtatgagaaaaaaaagaattggaagtcctaaagtgtaatttccttttctcctcacttccccaacaaaaacaaacttwaaaaaaaaaaaggcatttcatagtgtctgaggcagttaagcacccagagaccactaatctagtatcagtagttgaaagaaattcacacccagagtttcag

SEQ ID NO: 22790 - DNA, 201 bp, Homo sapiens
cctgggccacagagcaagaccctgtatgagaaaaaaaagaattggaagtcctaaagtgtaatttccttttctcctcacttccccaacaaaaacaaactttaaaaaaaaaaaggcatttcatagtgtctgaggcagttaagcacccagagaccactaatctagtatcagtagttgaaagaaattcacacccagagtttcagc

SEQ ID NO: 22791 - DNA, 201 bp, Homo sapiens
gaggccggagaatcgcttgaaccctagaggcaggttgcagtgagcccagattgcatcaccactgcactccagcctgggcaacagagggagactccatctcaaaaaaaaagaaaaaaatcttgccctccaaattagaaatattgtccatttcatagccatatgttagtccttgatagtgaaaatcttggagaaaatggtatc

SEQ ID NO: 22792 - DNA, 201 bp, Homo sapiens
aaaacatcataactgaagaattccaaggaaaaatctataggaaaacaaattctttctcattgtgaagatatcaatttgaaaagaggattaagctcacactmatatcttgctgaatgtgggttacctttttttttccaggttggtgaccgttgttatgatgaaaaaatgtatgatgctgctaagttgttgtacaataatgtt

SEQ ID NO: 22793 - DNA, 201 bp, Homo sapiens
gaatcgcttgaaccctagaggcaggttgcagtgagcccagattgcatcaccactgcactccagcctgggcaacagagggagactccatctcaaaaaaaaaraaaaaaatcttgccctccaaattagaaatattgtccatttcatagccatatgttagtccttgatagtgaaaatcttggagaaaatggtatctttaggtaa

SEQ ID NO: 22794 - DNA, 201 bp, Homo sapiens
catgtaaaattctacatgcacattaatttttttaaatgcttttttctttagtagaagtaagtcatttagtcgatcataaaatattcctgttcttttgaaawttttttttaatagctgacaaatgacactgattggaaggggaactcaaatgtagctgtttaccctcagtgtatttatgagggtgaaaataatctatgtatt

SEQ ID NO: 22795 - DNA, 201 bp, Homo sapiens
actattcgtcttagtgtccttttttgatgtatgaatttactcaccctatcttcagcagttactagctgtctctctgtagaacatttttaaatggttttagwggatccttttcgtcaaagcaaaaaacatgattaaaatcagagtctcacatctgattccttcagcctgcctgagttggggggatgggagggtgaagaagcg

SEQ ID NO: 22796 - DNA, 201 bp, Homo sapiens
ttcatatgagaaaacataaacacagcctgtgttctctagatcagtggtccacaacctttttggcaccagggaccagttttgtggaagaaaatttttccacyggttgggggtgggagtgggggtgggatggtctcagatgaaattgtttcacctcagatcacaaggcattcgttagattctcataaggagtgagcaacctag

SEQ ID NO: 22797 - DNA, 201 bp, Homo sapiens
gagaatcgcttgaacccgggaggcagaggttgcagtgagccgaggtcgtgccactgcagtccagcctgggtgacagagcaagactccgccttaaaaaaaawatatatatatatatatacatatatatatatataaccattatatatcaggctactgacacaaataataatatatacacttattatggttttgtctcctttt

SEQ ID NO: 22798 - DNA, 201 bp, Homo sapiens
ctttaacagaagagctatgtttgtgtgagcctctcttgttagcgtagaacaaattctcatatgttacacagatttgatacctcatagaagaaatttaaagyttccttttgtttgtctttttttcaggaagcaaaactaacagatcagctaccacttatcattgtgtgtgatcgatttgactttgtccatgatttggtgctc

SEQ ID NO: 22799 - DNA, 201 bp, Homo sapiens
tctgtcaggcaagtatttatttctctttgatatcaatttgtacttgactctttgaaggaatttacttccagccaggattagaggtgaatttagggtcttaygtctacataatttgacatgggagctcaatactaagatgcaactatcacattcatcctctgatgccagtgttgagagtgaacttattagattccttgttaa

SEQ ID NO: 22800 - DNA, 201 bp, Homo sapiens
taagagaaaaatatgtagtggtgttgaaattgtataaaatgaaaatacaggttgagtgtccctaatctgaaaatccaaaatgcaccaaagtccaaaacttyttgagcaccaacataacgctcaaaggaaatgcttgttggagcatttcagaaatcggattttcagattagggatgctgatcaggtaattataatgcgaata

SEQ ID NO: 22801 - DNA, 201 bp, Homo sapiens
aattccataatgacagggaatgcagtggtttgacatgacactgatatcagtgacctattagacactttaccattgaagaccatttttatttacatttcccyattggcatagcatacataaaggattcttgttaataaaaggttttaacattcaggctataagtaacataatttcatatttctttgcaagtattaccatgtt

SEQ ID NO: 22802 - DNA, 201 bp, Homo sapiens
tttttgaatctttcaagagttttgaaggtaattaggagtttttgagtttttaaaaaaagtacttaaggtagccaagaagaggtatgcttatgatcaggctrttggaaattttgtttttctaaaaatttggttctatgggacattttaattttttaagttttattcaatatatgtcaaggcccttttatgttggattctaag

SEQ ID NO: 22803 - DNA, 201 bp, Homo sapiens
ggcttattttcatattaaactgcatctgaaatatctttctgcagacaaatgtttataaaccacacagagaatcaagtacagctgctctttattttccacgrcagatgtgtagctcactactaaatcttgtggtggttggagtaatagcttttcatttcttttaaagaggagacaagaattgttaaatgatcccaaagattc

SEQ ID NO: 22804 - DNA, 201 bp, Homo sapiens
cagagtttcagccaacctatggacagctgaattaagcagcccaggaggttgaagctgcagtgacccatgattgtgccactgaattccaccctgggccacasagcaagaccctgtatgagaaaaaaaagaattggaagtcctaaagtgtaatttccttttctcctcacttccccaacaaaaacaaactttaaaaaaaaaaag

SEQ ID NO: 22805 - DNA, 201 bp, Homo sapiens
atgcgcctcaagtatgtgttttaatgctttttaggcatgtttccaacattgttttagtaattgtgcagcgcctctcagattgttatgcaaagctactgagrggcctactccttattaaagaaaatgtagctattataatattcttttgtactttaacagttcactattaaaccttaatctgtaatacggatattgaattac

SEQ ID NO: 22806 - DNA, 201 bp, Homo sapiens
ctgtgtagctgaattttgaattatgtgtagccattaaagtgataatgatgattgctagcctggataatgttttaatcagggaaaagatagaaattatatamttagagtaatttttcaacacaattatacatattgtatagatttgtgtagaaagacctctctatgtaaatttaaaggtctttttcctacttcattcttttc

SEQ ID NO: 22807 - DNA, 201 bp, Homo sapiens
ctggaggtcagtggcaccatcacagctcactgcagccttgacctactgggctcaagccatcctcccacctcagcatcctgagtagctgggactacagccaygagccaccacacctggctaatttttgtattttttgtagagatggagtttcatgttgcccaggctagtctcgaatgcctgggctcaagcaatcctttgcct

SEQ ID NO: 22808 - DNA, 201 bp, Homo sapiens
aaatatatattttttcgccgggcatggtggctcaggcctgtaatcccagcactttgggaggccatggtgggtggatcacctgaggtcaggagtttgagacyagcctgaccaacatggagaaaccccgtctctactaaaaatacaaaaatcagctgggcgtggtggcaggtgcctgtaatcccagctacttgggaggctgag

SEQ ID NO: 22809 - DNA, 201 bp, Homo sapiens
tttatagattaacaatgtggtatagtagacagaacagggagggctttaggggttgttgaaacaaatgctgtccaatagaaaaataatatgagccacatactttttttttttttttttgttttttgagacagagtctcactctgtcctctgtcacctagactagtgtgcagtggtgcgatctcggctcacagcaacctccac

SEQ ID NO: 22810 - DNA, 201 bp, Homo sapiens
ttttttttttccaaattctggataatcttataacattgaaccaggggtatgaaagacagtgactaaatatttactccagatggtaaagatttgaaacttcytaacttgatgttaatagatggattcattcctttaagattgacctaagagattgatctctacagggtgtttagtgtgatgtttggatcactttcgaagagc

SEQ ID NO: 22811 - DNA, 201 bp, Homo sapiens
tgagaatctaatgccgtggctgaaatgacaggaggtagagctcaggcggtgatgactgctcattggctgctcaccttcttctgtgtggcccagttgctaayggaatactggtctgcggcctgtggttcgggatccctgctctagattatggggaagccgaagtactattttctcattataaaaacagaatcctacctttta

SEQ ID NO: 22812 - DNA, 201 bp, Homo sapiens
tggtatagtagacagaacagggagggctttaggggttgttgaaacaaatgctgtccaatagaaaaataatatgagccacatactttttttttttttttttkttttttgagacagagtctcactctgtcctctgtcacctagactagtgtgcagtggtgcgatctcggctcacagcaacctccacctgccaggttcaagtga

SEQ ID NO: 22813 - DNA, 201 bp, Homo sapiens
ccttggacatgtctttttcactaaacttaaaattacttctagctttcgatttaaaaagagaggtagaacacatagaggcaattgtagttattatattggcytaatattgttgtgtctcaggtaatagggaggcctgaggaaagggaaagaaacgggagaacagctggttggtggagcagtcagaacacacacaatatttat

SEQ ID NO: 22814 - DNA, 201 bp, Homo sapiens
cttttgatgttagtttatggtggactgaattaacaccttacattcctgaccaatattcattatgaaatttgtacttaatatgaacttgggataatacttakctataactgttttatgattataactattctcttacacactgacattgtaatttaagttgatgtatttttgattctggataatttttttttttttccaaat

SEQ ID NO: 22815 - DNA, 201 bp, Homo sapiens
ctctaattgcttaggggagaagggtattactggaaagacggggtgggtgacttttcatagtataaccttttgtaagattttagtgctttactgtatgcacrtgataactattcaaaaaaacaagcccctttttttggacccagtttattgactccatattcttataacagcaaaataaaaattcttttaagttaaaaaaaa

SEQ ID NO: 22816 - DNA, 201 bp, Homo sapiens
tgtgtatggcctcacagttggaactgttggatgttataagcagatgatttaaatatcccgtgaaaagcagtccattcgggcatgtttctagagatcataattttttttttttttttttttgagatggagtcttgctctgtcgcccaggctggagtacagtggcatgatcttggctcactgcaacttctgcctcccgggttc

SEQ ID NO: 22817 - DNA, 201 bp, Homo sapiens
taatgaaaacgtgacacagagacactgaagagagcacatgctgttggaaaatagtgccaataggcttgctcgatgcagggttgccataaaccttccattcrtaaagattcatctgcactgcaaagtgcagtaaaatgaggtatgcctgtaatacgtaaactgtgctatctaagttttgaattgtctttcctcttatcagtt

SEQ ID NO: 22818 - DNA, 201 bp, Homo sapiens
ctcctgcctcagtctcccgagtagctgggattacaggtgcccaccaccatgcccggctaattctttttttttttttttttttttgtatttttagtagagayggggttttgccatgttggccaggctggtcttgaactcttgacctcaggtaatccacccaccttagcctcccaaagtgctggaattacaggaatgagccac

SEQ ID NO: 22819 - DNA, 201 bp, Homo sapiens
actggtttatagccatctaggactgtatagatgcattactgtcaaaagaagtgattccccatgcaaagaaacaatttagggtcatatttgacagactattyttttaaggaattttctgttatctccaaggcagagcaattatcaactacagggaaaagaattctacctacatcccttttcctagctccttaattaagcatt

SEQ ID NO: 22820 - DNA, 201 bp, Homo sapiens; identical to SEQ ID NO: 3815

SEQ ID NO: 22821 - DNA, 201 bp, Homo sapiens
gtgacagtggtggtgtttgtggaggaaaactgtattgctagaggacaagggtgacagaaagacttgatttttttttttccatgctttttcttttctggggkgtgtgtgtgtgtgtgtgtgtgtgtgtgtgtgtgtattttgtaccatgcgaatttattatattacctttggaggaaagggggataaaactagtctggccaa

SEQ ID NO: 22822 - DNA, 201 bp, Homo sapiens
cctttaagattgacctaagagattgatctctacagggtgtttagtgtgatgtttggatcactttcgaagagcgtttaacatttctccttcttacactttcraagagcgtttaacatttctccttcttaaagggaattcttcgtactccagacactatccgtcggttccagagtgtcccagcccagccaggtcaaacttctc

SEQ ID NO: 22823 - DNA, 201 bp, Homo sapiens
gatgaagaatagccacactagcgagtatttgaggtccatcctaattgattaagataaggcagggctgagtttggtggcttacgcctgtaatcccactactwtgggaggctgaggcaaaaggatcacttgatgcaaagagtttgagaccagcctaggcaacacagcgagaccctattaaataaatacacaatattttttaaa

SEQ ID NO: 22824 - DNA, 201 bp, Homo sapiens; identical to SEQ ID NO: 3823

SEQ ID NO: 22825 - DNA, 201 bp, Homo sapiens
gcagccagctgccgagggagcgctctgcggcgaggccgtttccctgagtcacggagagggcgggaggctgcgcccgtctgcccccgccacgtcctcctgtraggggctcagtcgaaacaggcagcggtcgcagggaaacgaagcggcacccgtcatgcctcaaggtggcccaaaagcctcttcactcccaggagacgccgc

SEQ ID NO: 22826 - DNA, 201 bp, Homo sapiens
agaaaattgttgacatcatctgtggcatgcagcaaaagttgatgtaaaaggaacagaaagacctatggagataatgggatgtaataacagaaaacatacakaaacaattggttctgaaatcagttaagagcagaactggaattcatactctgtggaatgaatcagcaatgtggaaggagtaacaagattttttaaaaagat

SEQ ID NO: 22827 - DNA, 201 bp, Homo sapiens
gcaagaatccatctcaaaaaaaaaaaaaaaagatttttagaaaccaaaataattggaatggaagctcttttcaatgaaagaaaacttttgtaatttgaaaraaccaaaattaaaagggcttagtgtttggaacaggcctgaagaagttgtaataccatgaatttaaaaaaacaaaacaaactcgggaggccaaggcacaag

SEQ ID NO: 22828 - DNA, 201 bp, Homo sapiens
tgagagcctggtgcaatctgagtacgtccagcatcttgaattaaacttacagtcagtcccagcatttttgcatgggccaataatgcaatcagggtttcttmatcaggagctttgaccaccaccttgggctggccacagtattcccattgtttgagcatttcaggatttcttctttgaatctgcttgtaggctgaaacagca

SEQ ID NO: 22829 - DNA, 201 bp, Homo sapiens; identical to SEQ ID NO: 3819

SEQ ID NO: 22830 - DNA, 201 bp, Homo sapiens; identical to SEQ ID NO: 3810

SEQ ID NO: 22831 - DNA, 201 bp, Homo sapiens; identical to SEQ ID NO: 3812

SEQ ID NO: 22832 - DNA, 201 bp, Homo sapiens
tgatggttcccgatgattagatttagattatacatttccacccagagtactgcttcagtggtggtttgtttttctcttggtattatatccggaagcacgcrgtgttcatttgtcccctttgtcagtttttatcaagttgtaacatgtctttattacataattattaccctcttggagatattaaacagtctataagtagtc

SEQ ID NO: 22833 - DNA, 201 bp, Homo sapiens
tagcaaggaattaggacatacttcgataacttttgtccctgggacttcaataatgtgctatatttgtaacaaactctttattttaaaggttaaacagctaycactggtgaaaccgtatttgcgttcagttcagaaccataacaacaaatctgtgaatgaatcattgaacaatctttttattacagaagaagattatcaggt

SEQ ID NO: 22834 - DNA, 201 bp, Homo sapiens
tggccaacaactatttaaactttataagaaagagtgtcaacatagtatttgatagagggtgtatgttctaatgtatttcatacctaaagaatgtctgaatrtgtctttttttttcccccaagatggggtctcgtctgtcacccaggctggagtgcagtggcgtgatctcggctcactgcaacctttgcctcctgggttcaa

SEQ ID NO: 22835 - DNA, 201 bp, Homo sapiens
ctgtgtagatgggaaagaattccgtcttgctcagatgtgtggacttcatattgttgtacatgcagatgaattagaagaacttatcaactactatcaggtaytaacgagacttttatatgacctgagatcttttaccatagatattcttatctttaactgcacatttctcttgttcaggatcgtggctattttgaagagctg

SEQ ID NO: 22836 - DNA, 201 bp, Homo sapiens
agatatcattaccaaggtgtgtactttcttcagaagataaaggattcagaaggagaaagctcattaggaagtaactgacttatgtatggattttcccattrtaggttgccaatgtggaactatactacagagcaatacagttctacttagaattcaagcctctgttgttaaatgatttgctgatggtgctgtctccacggt

SEQ ID NO: 22837 - DNA, 201 bp, Homo sapiens
tatgaggcatattttaaacatttatgttaggctttaacaagataatgtttggggctgattttaagttaagaagtatcaaatctacagtgagagatgaagtracaaataattataaatcctgctaaagatgacaaagcattctaattatttcattacttgatgaatctgagagtttttgatttatgggtcttcaaacgttat

SEQ ID NO: 22838 - DNA, 201 bp, Homo sapiens
taatgcatagtaatagtcagtctgattacagtcaagtctttaggaatgggaccctttctatatttttaagatagtctgtgtataattgtgttgtcagatgmcattttccttctggtaacattctcaagacctaatacaaatgctatatgcatttcttacaccaaattatataattaattttcttaataacaaagaccaagt

SEQ ID NO: 22839 - DNA, 201 bp, Homo sapiens
cagaagtgatttagtttattggaaaccatgtggccaactgaatgttatagagctgactctagtaaaacagaggcttatcaggctggctctggtacaagccratattgctgatttaatttggctcacatgtgctgggcacctgctctgtctgcctggccctgagcttctgcaggcatgtgcctggccatttccttcatctag

SEQ ID NO: 22840 - DNA, 201 bp, Homo sapiens
ttgctattaggtacataagttatggataaaatgtttactgaatgatgaaatgaatgaatagatgaagaatgctccttataggccctgaaaatgctgacttkacatcttcctgatatgttttttatggttataggtcttaatatcgtcctagtcttgaaatgcagtgaaacatcaatgtctttttgatagccacacgtgctg

SEQ ID NO: 22841 - DNA, 201 bp, Homo sapiens
acatttttaagtacaagagtaaagcaaagctaagaaaaagattagaatatgggacttgtgaaacccacagggatggcttgtcatctaactcctctttctckcccatgtgaggtaagaccacaagtaaccatctcttatgcacagactccagttctagtccctgggtgttcagcatccagtctgaaccacagatgaagacag

SEQ ID NO: 22842 - DNA, 201 bp, Homo sapiens
acagcgagagtcctacagaacacagggacctcccaccagctgccttgtctacacttcatcaccccccacacacacacccactttgcactctggcctgaccrtgtgatttgtacacaggtgtccaggaggctgtggtgagctgcttgaacaaacagactcgggagcctgctgaggagaacctgtgcgtgaccagccgccggc

SEQ ID NO: 22843 - DNA, 201 bp, Homo sapiens
tgtttggtgttagtattagcacaaaatggcctcaaacgatgagtagagaagtaattgcttgtcttctttttttctggaagagattgtatggaattgaatatatttattctttaaatggctgctaccatgccccagtgaaattttctggatctggagatttatttttcagtatgtaaccttatgaacttatggaacaccatt

SEQ ID NO: 22844 - DNA, 201 bp, Homo sapiens
tatagagctgactctagtaaaacagaggcttatcaggctggctctggtacaagccgatattgctgatttaatttggctcacatgtgctgggcacctgctcygtctgcctggccctgagcttctgcaggcatgtgcctggccatttccttcatctagtaagaggggatccccattgcacagtagagtcagctgggaagttta

SEQ ID NO: 22845 - DNA, 201 bp, Homo sapiens
cagttgaaaagtgaaagcagccatagaccataagtaaatgaatgggtatgtctgtgttccagaaaactttatttacagaaacaggactggattttgcactygggccattccctttgataatatcagcctatctcagataaacgaagcaagaaaaaggaaagagattttgccaactaatgaaccaaaactaatgaaaagagc

SEQ ID NO: 22846 - DNA, 201 bp, Homo sapiens
gagctgagctatggtcaaaccacataacctcaatgagtctgcctttctcatcaacctcagctctatgtcaccaatgtgatacttagcctatcacaccttayattattggacatatttcttacgtctgtcatgtctcccagctagatctaggtcctggggatagaagaggctgcataagtatttttaagtgatttaaaacag

SEQ ID NO: 22847 - DNA, 201 bp, Homo sapiens
caatgtgatacttagcctatcacaccttatattattggacatatttcttacgtctgtcatgtctcccagctagatctaggtcctggggatagaagaggctrcataagtatttttaagtgatttaaaacaggactaggtggcagggccttgacttggaaggcctcttgaattgttttcatctctcatttctattctaattgt

SEQ ID NO: 22848 - DNA, 201 bp, Homo sapiens
cagcaagttctgatggtcaaaggttaggtaaaaattaatccacactgcagacccacccaacaggtggcaaggaaggtgatgccaaggaaggacagggatgycgggaaggggaggactggcccccttgaggagtgggaaaggaagacggagggaaagggaaggactcatgtcaaagagacacaagtcagcatctgtttcctc

SEQ ID NO: 22849 - DNA, 201 bp, Homo sapiens
cagatggggattagacaggccaagacaggaacataggtgagaattagacatctctccatgtgtgactgcccaacaggttgtttttgcctgctggccaggtkgagccaatttattaagacaggggcattgcagagccagctgaatgggataccagcgttttagtactcaaatcagttcccccaaaatttggagtctagggtt

SEQ ID NO: 22850 - DNA, 201 bp, Homo sapiens
ctcaattttttttcaatttttttctgtttttcacaatggataatttatgtggaacttcaagtttactgacactcctgccagctctaatcttctgttaagaytgtctagtaaatttttcatttcatttttcatattgttaagctctagaagtttttatagtttctacttgtctactgatacacgccatctgttcatttatta

SEQ ID NO: 22851 - DNA, 201 bp, Homo sapiens
caacaggttgtttttgcctgctggccaggtggagccaatttattaagacaggggcattgcagagccagctgaatgggataccagcgttttagtactcaaakcagttcccccaaaatttggagtctagggtttttcaaggatagtttggtgggttagggaatgggtacagctgattggttagggatgcaatcctagggttgt

SEQ ID NO: 22852 - DNA, 201 bp, Homo sapiens
gattttaacctgatgcacgtacatcttcagttgggcaaaatctcaagaggaatttatgcagattttgggagctctttttctgtgtagcaccctcaactccrgaattctgctcaatagtgtccagttgcctccgcctcttcaaactctcttctttgtctcatcaatttgtctagactattgtgctctgtttgggatatccct

SEQ ID NO: 22853 - DNA, 201 bp, Homo sapiens
aagaaatcagcattcaaataaaacaaacttactgcgttacagactttgagttgtctgtagtatttaatggatagacaagacacttattttcagagcaaaarctggttggagaaagggggaaaattgttcaaatgtcatgcaacacattcaaagaactgtagaacaaccccgttttctgagccatcggcaatttcaccttgg

SEQ ID NO: 22854 - DNA, 201 bp, Homo sapiens
aatgctctggatgatcaacaattacattccactcttgctggtcagaactcaaaggccttccagccctatttgaagtttggaaaatataaagctcacagctycctggttgctctttgctaaaccttgcagattttaacctgatgcacgtacatcttcagttgggcaaaatctcaagaggaatttatgcagattttgggagct

SEQ ID NO: 22855 - DNA, 201 bp, Homo sapiens
tgactgctgatgctaatgccagtctcttgattaaagtggtatcttctgaccttttccattgcagaagttaagttccaaagttttcctttggaattaatacktcttttgtgaggaggtcccctgggactgtggcaaatatctcattcctcattgaacttacctgcatgaacttgtggcctcctgtcttatccaatgggctat

SEQ ID NO: 22856 - DNA, 201 bp, Homo sapiens
gggctcagaggaaagaaagcagtatagtaaaagaatgctggggaaaccagcctcccaaatattttggccaagagcccaaccatgaagctaaacacctgaakcctaggagctgaaagaaaccatagcagtcatgcttaccaccctccttatctagggacacaatcctttagccaaaaccactggggcagatgtctttcagat

SEQ ID NO: 22857 - DNA, 201 bp, Homo sapiens
agggattcttctgatatattaacattgttttccatcttgctattccatttatgaagtgaaagagtttctatggcttaataaaaaaactttttggaaagttytatctgtttaatttttcctttgaaattaagtgtaagcttcacaaaaattgatgagtttgttttcccaaagagattcagtgaagtaaacaaggcagagcaa

SEQ ID NO: 22858 - DNA, 201 bp, Homo sapiens
agattcagtgaagtaaacaaggcagagcaaatctaaaatagaaaacattttcaaattttattatttttagtgatgtatagtttttttaatatactcatgcscatcattatgtgcttcttctgccaattctgtgggataactttatttccattttataaatgaggaaattgaggctcatagaaagtcatacaactggaaaaa

SEQ ID NO: 22859 - DNA, 201 bp, Homo sapiens
tgatgactttttgcgagccttcccaggcactggagtttttctgttaatctgccgcactaggtcataaaagatctcattaacatttattttgaattttgtakaagaatctaagaatgcacagttgttccattgtcttgctagatttttgaccttcttccttccctacagctctttcatcttccaagtcatacttattaccaa

SEQ ID NO: 22860 - DNA, 201 bp, Homo sapiens
atattctggttttgttcacttgaaagatctatgcagaaagccagattagacagagaggaaggtgatcgatgaatatctaagctaccaaagtagcagaaacwcacagcagaagagaaaataatagcaaactcagagctaagagcactaactcataattcatgcactgataacaagagaacacttatttcctgcagaggacaa

SEQ ID NO: 22861 - DNA, 201 bp, Homo sapiens
ctacctttaaaaaaaaaagtgtatgactgttattaattatagcatttgatagcctggccagtgtgtgttgaaaagatttggtaaacgtatgtggaggaggrgaattaagtaagcaatgaaagccagatgctgaaaatgaaggaaattccaagcaatttctgcagctttgttctaacatactttttaaactaaacttttatt

SEQ ID NO: 22862 - DNA, 201 bp, Homo sapiens
aaactagtacttctagtttaaaagaaaacgtgatttttaaaaattcaggacttaaattttattagatgtttttatttaactaaagtcttaatacttaagcktcagtctgggcgtggtggctcacacctgtaatcccagtactttgggaggccaaggcagatggattgcttaagatcgggagttcaagaccagcctggacaa

SEQ ID NO: 22863 - DNA, 201 bp, Homo sapiens
tttacatgcaccttagagcttgcatagcactgtagttgggagcagcctccggagccagaatgcctggctctgccacttgctaataattgcatgaccttggrcaaattatggaagtcctctctgcctttgattgttaaaatggaggcaataactgcatatacctccagggtttttgaaaggaataaatgaggcagtatatgt

SEQ ID NO: 22864 - DNA, 201 bp, Homo sapiens
cagcacattgatttagacctactctgtcactttcagctatctgaccttcaagaggccatacaccttttgaatcctcaattttctcatctctgaaataggawcatagtaggcactcaaaaaaattcattatcttctcctttcttttcattttcaaactagtacttctagtttaaaagaaaacgtgatttttaaaaattcagg

SEQ ID NO: 22865 - DNA, 201 bp, Homo sapiens
tgattttgccatttaatattatgcactaaaaatcttttacatccctgagacaccaaaataaaagaaccagcacattgatttagacctactctgtcactttyagctatctgaccttcaagaggccatacaccttttgaatcctcaattttctcatctctgaaataggaacatagtaggcactcaaaaaaattcattatcttc

SEQ ID NO: 22866 - DNA, 201 bp, Homo sapiens
ccatcttcttcagttctagttccttcttatacccagagataaccattgttaatgctttgctacatacacttccagatagttttctatgaatttatatacayataagaagatatacaaatagataaagctttttccctttgtaaatgggattttattttgtatattgttgggaaatttgattttgccatttaatattatgca

SEQ ID NO: 22867 - DNA, 201 bp, Homo sapiens
cattacccagggaggagtttgattgtcgggaaagatggaaagtagtatatggaagacagatgttaatcccttcacaactttgcctaagattaaccataagmagttaggaccatttttgcttgtgagctgccagtgagaattttccatcaaagttaatgagtaatttgtgtgtctaaaagccatatcatccacccagtcctt

SEQ ID NO: 22868 - DNA, 201 bp, Homo sapiens
tggcaaagtatcccccaagtaaggatacaaggacaagctttaatagaaaagagagggacagatggaggttaagtaagttataggcattacccagggaggartttgattgtcgggaaagatggaaagtagtatatggaagacagatgttaatcccttcacaactttgcctaagattaaccataagaagttaggaccattttt

SEQ ID NO: 22869 - DNA, 201 bp, Homo sapiens
aggcgtgagccaccgtgcccggccaggattgaaccttttatgttatcatgtatgtatggcaaagtatcccccaagtaaggatacaaggacaagctttaatwgaaaagagagggacagatggaggttaagtaagttataggcattacccagggaggagtttgattgtcgggaaagatggaaagtagtatatggaagacagat

SEQ ID NO: 22870 - DNA, 201 bp, Homo sapiens
cattgtctctcacctttactaattttgtaaggttatatgaggttttattgagtaactcttataatgtaacttttactaatctagtatcgctaagtagaatrtaatacctgtttttatttttcattaattagaaaagagactatacctactggtgcttgatgatggacatttattttatttcaaatgaattaaagtactagg

SEQ ID NO: 22871 - DNA, 201 bp, Homo sapiens
aagattttcaaggcacagatcaggccctccatgcagcctcttggagcaccccagcctggaatgatcactctctgctgacttcctgaagcacctactctagmccagagttgggcaaacattttctgtaaagtgccagataggaaatagtttaggcattgttggctataaggcccctgttgcgggtattcaactctgcagttg

SEQ ID NO: 22872 - DNA, 201 bp, Homo sapiens
agggaaagagagaaaagctctaaagagcctggagtttcctcagaattagatagcctcaggtggctccagtttaaaaataaataaataaataaataaataamtaggctgggcatggtgattcacacctgtaatcccaatgttttgggaggctgagatgggaggattgcttgaggtcaagcatttaagaccagcctgggcaac

SEQ ID NO: 22873 - DNA, 201 bp, Homo sapiens
atgtgtttaaaaaaataccatagcattttcagtgggacataacaaaatgacatttcaagtcttagtcactgggcctttgtctctgagaggtcaccccctgsttaagataaatagctttcccaggccgttgttagtcccactgaacaccagttagggagccactttttttcttgtatgtagtcagaattatcagatcacatg

SEQ ID NO: 22874 - DNA, 201 bp, Homo sapiens
aaactcaattctctgatttcccaccagccagctgtcaagccaacaggcaagacctctcactgggcacagccaggagtttcttgggtcgaccatacacattkaaacatttgtagaaggttgctaattgcaacaataaaggggaccaaagtataatggcctaatctcatccaagagtcaaaacagattttccccctaaaaatg

SEQ ID NO: 22875 - DNA, 201 bp, Homo sapiens
ctgtgacccttttgttgactcacagacaagaacagttgttgagcttaatgttgtcgcatttgctccagataaactcaattctctgatttcccaccagccarctgtcaagccaacaggcaagacctctcactgggcacagccaggagtttcttgggtcgaccatacacatttaaacatttgtagaaggttgctaattgcaac

SEQ ID NO: 22876 - DNA, 201 bp, Homo sapiens
gcagatacacttatgcatgagcaaggaagcaattcacagtgatgatctacagctgcagaagcctgaaaatgatttacaaaaattgttacatcattaaaaawttgtttgaaaatatacatttcttgttgtaggcacccactgtatacatgactataaacattgttccttatgtaaacagaaaaggaaacatataataagaaa

SEQ ID NO: 22877 - DNA, 201 bp, Homo sapiens
actgcttgtattatttcccagctggctagattcctttctttgggacttggagggtacagatcatagtcctcctccaatcacatggaggcacatcccatggkgacactcctcctgctagtcaccagagttgttctgtatgatgatctgaatggtggaccagggcattcccctcttcaaatacagaagttaagagggcaactc

SEQ ID NO: 22878 - DNA, 201 bp, Homo sapiens
cagaatctggaagataccgtgcattcacttgagcctgtggcatggctggtatgtgtgtgtgccacgcagttgctttcccctaaagggaacatgaggtgacmacagacttcatgggctctgccaccttttagcctgtgtcctaagcactcacaccatagtaatgaactggtctgtgaattgcagaatataagggcctgaagc

SEQ ID NO: 22879 - DNA, 201 bp, Homo sapiens
atccctgcccagcaaggtaagggatgtgtggcctgccctgctgtccaggggcacgtacagaactgggcgcatctttcagtgggcaagactgtaacacttakttgttactcagtgttttgaaaaccaattagcatcagttcaaacttttagtcaaatccacttaagtttaattgaaaccagggctttggaattctagcccag

SEQ ID NO: 22880 - DNA, 201 bp, Homo sapiens
cccttccaaatacaacgatttcctttcaattaaaatataagatgtgaaggttttgggccccttttttgccaccctgtgctccttgttcattgaagtatcaygttccagcattggtggcattagcctcgtggcatttttttaagcatttcaagagtctaggtagcagcctctcttctgtgggggagttgccctcctcaagga

SEQ ID NO: 22881 - DNA, 201 bp, Homo sapiens
tcacgccagcactatagaactaggagactcacatggaattgtggagatgaatgagaaaatgatgtcaagtatcaggactctgagaagtaggttgagacagscagagcctcattatgatgctttggagctgagcactgcagaatgggtgggattcaaataggcagaaaggaagagaaatgggcactcaaggtgaggaagatt

SEQ ID NO: 22882 - DNA, 201 bp, Homo sapiens
cctgtttcactagctctgagtcagggcctgcgggtgtcagtgggaaggttgttttccacggctgtggttattatgcatcttattctccttctttgttccarcttccaaggctgccctaggtcacaaaagaaatgaaccagaatcagaaggcaaacagcaaagactggagtcctagattcaagacctcaagagcccagcagt

SEQ ID NO: 22883 - DNA, 201 bp, Homo sapiens
ctcgaactcctgacttcaggtcatccgtccaccctggcctcccaaagtgttgggattacaggcatgagccactgtgcctggctttgtggttcttttttttwaaaaatgtttaatttctcagacttacaaagaagaaaggtgatttggactccagctgagtcactttttaaatgatggccttcctaagtggactagatcaat

SEQ ID NO: 22884 - DNA, 201 bp, Homo sapiens
agaagggcctaagttctatcaagaaggagttcacaaagtggaaacacaggtcacatcacttacacaccttcacacacacacctgatccagtcactttcaartaaagcatgtgacaagcccacggtcacttcctgcctcaggatcgttgacccaatttcataaggttttcaacagctgaataaaggcaaaatatgttttatt

SEQ ID NO: 22885 - DNA, 201 bp, Homo sapiens
gctcagatctgtatcctgtgtccaactgtcacttccttgttagattttaatttcccacatgtgaactgataggtgttatcaaggaaaacaactctgagccygatcagctttattgtattgaactcctagacagtaaaatccacgttaaaatctagctgggggaatacttgacattgacttcagcaaaaatggaagatgaag

SEQ ID NO: 22886 - DNA, 201 bp, Homo sapiens
ttccaggaaaggaatggagaattcctggaattgaggatcctccccttttcagaccatatagggtaacttccagacattgctacggcatttgtaaactgtcrtggcactggtgggagtgtcttttagtatgtgaatgtattataattagtgtataatgaacaataaggacaaccagagcttgctttcattgccatcttggtt

SEQ ID NO: 22887 - DNA, 201 bp, Homo sapiens
ggctcactgcaacctccacctcccgggcccaagcaattctcctgcctcagcctcccgagtagctgggattacaggtgcctgccaccatgcccggctaattkttgtatctttatagagacagggcttcaccatgttggccaggctggtctcagactcctgacctcaggtgatctgcctgcgttggcctcccaaagtgctggg

SEQ ID NO: 22888 - DNA, 201 bp, Homo sapiens
aggttggtctcaaactcctgacttcaggcgatccgcccacctcagcctcccaaagtgctgagattacaggcatgagccactgtgcccgattttaaactctratttttctcacatattattcagtttattcccttctcttttctcaccctactgtcatgccaccactcacatacacaaacatacaccaaatcaaacaggtaa

SEQ ID NO: 22889 - DNA, 201 bp, Homo sapiens
atccttgagtaaagatatttcctaataagttagattctcatttatgtggaatgatttaggcgtggttctaagtaaatttagagggatattttggataagtmttatctcaaaactttaatgctccagctatattttaagaatgccttaatattatagattttacaagtaattttaaaattcctaaagtgattcaattgaaga

SEQ ID NO: 22890 - DNA, 201 bp, Homo sapiens
ctcctgcagggcggccaatcttcatggagagctgactgagagcacccagctgctgatcctaggtaaacacttcaaagctggctgcctctgctgcaccctgytgggagtgactatctaacccaccctctacctcctttgtgccctaatccaattaaggacataaaaggtaaaattgatatcccttcacttcttcccaattta

SEQ ID NO: 22891 - DNA, 201 bp, Homo sapiens
ggatcattatatttttgattattctcctggggcaccttacagtgctgaagatgcctcatagcctaggcttgacacttgaggatttgagaaatctatgaaamgaagtggtgctgtcagatgttttgaggagtgatgtcctagaacctttgaaaaattttgcttagagacctcaatatgagttgcataactagcatgatttat

SEQ ID NO: 22892 - DNA, 201 bp, Homo sapiens
ttatttcctctcagtaataaacatttgtctgtgtcataagcataattttaatggctatataatagcctatattaagaatattatgtaatttacctagaccractcacatgtttgaattgttagcagtttttcattaaacaactttttgcgtacatgtgctttcagcttacaaaatgcagcctcacattcttcccaatcctg

SEQ ID NO: 22893 - DNA, 201 bp, Homo sapiens
gacagggacactcaatctttttcttttcaagtagttgtattggtggctgcttcaaaattatcatttgttttattttaatttccaggatcattatatttttkattattctcctggggcaccttacagtgctgaagatgcctcatagcctaggcttgacacttgaggatttgagaaatctatgaaaagaagtggtgctgtcag

SEQ ID NO: 22894 - DNA, 201 bp, Homo sapiens
ttaagtagactatttgcaaggaaaagcaaattttcaaatcattttctgttcatttagatcagaaaagcaaagagaaagaaagatggtctgaaacaagtgtmatatcctcacttttcatttctgaaaggaataatttggctttatttgtatctgctacgtggagtgagtagtctttcttccttttttcccaaaattttatgg

SEQ ID NO: 22895 - DNA, 201 bp, Homo sapiens
taatttcattccatgtaaagaagaaatggtacatgaaaagtattgagtttccaatattttaaatctttatcaaagtcagggaaaatgttatgcatttaaastacattccaatattaagctgagaactacaaatgcagtgatagcattgtaagctgtgatggcatctgagtccctgggatgtggccttttaagtagactatt

SEQ ID NO: 22896 - DNA, 201 bp, Homo sapiens
ggcttatttaaagacgctagataggaaatgaggaccttgagaaaacgcactcacacttgctcctgccctttcctggcagcaggacacaattcccaggcccmtgtgccctccctgccatgtccaacaggaatgatgtgaatgagtttcatgtccctgaaatagacagggattgaaagtccatcagtgggaaaacaaggaact

SEQ ID NO: 22897 - DNA, 201 bp, Homo sapiens
ctttatttcctctcagtaataaacatttgtctgtgtcataagcataattttaatggctatataatagcctatattaagaatattatgtaatttacctagamcaactcacatgtttgaattgttagcagtttttcattaaacaactttttgcgtacatgtgctttcagcttacaaaatgcagcctcacattcttcccaatcc

SEQ ID NO: 22898 - DNA, 201 bp, Homo sapiens
agtcatttaaccccatatgcctccatttatcacctgtgaagtgaggtaatcactacctcatagggttcttctgaggtttaagttaatctgtgtaaagtacstggtatgcaggaagtgctatgtatataaatttttgttgtgattaggccttttctagcatcattcattttcctagagaatctttaagggagttaagatgtc

SEQ ID NO: 22899 - DNA, 201 bp, Homo sapiens
tttgcaatggtatttcctgcttggatcagagaactaattatagtaaatggtgccctttcaaagaacttgccccatcctaaagcatatcctggcataaagawataaaactgttttagtgttgttttatagatacaatttattaatgttattttgcatttgtattaaaaatttgtataatgtaatcatttagtgtttatttta

SEQ ID NO: 22900 - DNA, 201 bp, Homo sapiens
acacggagaagcctgcagtcacagtcgatataggaagcaccatcaaaacagtgcagggagtgaatgtgacaatcaactgccaggttgcaggtgagaaattmatgttcatttgttcacacgttaatggagccctgtgctaggttggggatacaaagacaaattagacacaaattctactctcagggatatagtgctagtagg

SEQ ID NO: 22901 - DNA, 201 bp, Homo sapiens
actttttcctttccaatttgaatgccctttatatggttctcttaactaattggtttggctaagacttgcagtactatgttgaagaaaagtggtgaacatgsatattcttgtctggttccagatctaagaggaaaaaatttcagttattccccattcagtattatattagctgtggatttgtcatatatggcctttatattc

SEQ ID NO: 22902 - DNA, 201 bp, Homo sapiens
gtaaaacatgcattctacatgaagagatctttgaacctaacttgaaaaatcagtttaggtcacttttgtgtggtcatatataaaaacatttgtggaaagcytcattctcactccccacgtcaacaccctttagggctagaaagtgcaggggctgctgttccccatatcctgtgaatagaacatctgtgtgaataggaagcc

SEQ ID NO: 22903 - DNA, 201 bp, Homo sapiens
catatcttcatgttaaacctcaaatttgaaccccttgaacttaattagggattttaaagtgacttccaatgtgtttagagtacttataaactgttttttttgcactatccttaaagtacatatgagttggtatttaggaggcagtgaccataattagcaacataataggccacactgcttgtggtagctggtgatgctctt

SEQ ID NO: 22904 - DNA, 201 bp, Homo sapiens
cctttttaaaaaggcttatatgagaagggggatgggggaacaagaagctaacaagttgtttgaccctagagaaaaatcttttaatttttcatgtcatttcrcctcttctcaggttgttaaatgacagttgaaactataacatcaggattttaagaagtggaagtttagatggtgtattatgcgttaatgagagacaaataa

SEQ ID NO: 22905 - DNA, 201 bp, Homo sapiens
aattttaaagtaaaggagcgataaatcaaatgcatgcccctttttaaaaaggcttatatgagaagggggatgggggaacaagaagctaacaagttgtttgrccctagagaaaaatcttttaatttttcatgtcatttcacctcttctcaggttgttaaatgacagttgaaactataacatcaggattttaagaagtggaag

SEQ ID NO: 22906 - DNA, 201 bp, Homo sapiens
ggctttggttcagcagaagagaaatgaaatgggatgtagacagggctgtgagcgaaggttctttttttgtgttggggtaaagggcgttatttcttttgcaraggctctcacccaaaatcagagcaaaacttagcctgagttcctgaggcatgctggctcggagctgctgctggcttttgtttttcctccaagctgatctgt

SEQ ID NO: 22907 - DNA, 201 bp, Homo sapiens
gtagaatatcctgcctgtaacatggttaaaacaaaattaaatccacttaacttacagaaggttaagcttgggttatatgaatatgatctcatggggacccwacttccccaaggtgttcaatgaatgagtcttttcattgtattttgtagtcatgtgcatgaagttctgtattttattcccagctgataaaggcctattaaa

SEQ ID NO: 22908 - DNA, 201 bp, Homo sapiens
agatggcaaagaagtagtacagcttttgtgatgaagtcttgcaagaataacaaatgaaaggaaaatgtctcagagaactggtgaagacaaagggtacaggrtaaatagagctgactattggtcaaatgctgactcaggaggctggaaatagatgtaaaggaggccttgcaagaaggtcagcagggagttaaaaactcctgc

SEQ ID NO: 22909 - DNA, 201 bp, Homo sapiens
gcatggagatggccagtgtttccctccctacctccctggaacagcccatggaactcacagccatttagaccaaatggcacaaaattcctccctctaaattmacttagctggatgcctgtttcactgctccaagtgtagatgaaagtagcttaggaggggaggattgcagggaggagattataggaatgtcaccaaaatgtc

SEQ ID NO: 22910 - DNA, 201 bp, Homo sapiens
aggtcacacctctccatccctttagggttgatctctggcgtcttgtctgtttggtgcagccatattttcctgaatgttcttggtgcttgtgaaagagcaayaatgtctgtgcattgaggaattaggtaattattttattcttcaaagggtggttttctttgtgcttgtccttcttcagagggccttccagggattctaagc

SEQ ID NO: 22911 - DNA, 201 bp, Homo sapiens
ttcctatccacagagttgagttgagttgagttttccatcttcaattcagcatccatccctccagctcctccctcacctcaactaccaaaaaaaaaaaaaaraaagaaaaagaaagatttcctaatgctacttgcataatttattgaattattcttcggtttgggcccaatttgtagaaaatagaaaagagttatctgaccc

SEQ ID NO: 22912 - DNA, 201 bp, Homo sapiens
gttgactgtgtatgtgtgagtgtttttctaggtgttctattggtgtatatgtctgtctttacaccaaggtgtctttacactggcatatctttacaccagtrccatactattttaatttctgtagcttataaaatgttttgaaatcaggaactgtgatgccttcagctttgttctctctcaatattgttctgaacattccag

SEQ ID NO: 22913 - DNA, 201 bp, Homo sapiens
attatagttgcaagatattttaagaactaagagaagttcccccagttctataaataatacatctgtggaactgggttttaaaaatattttatatgtattgktattttattctggtagcatcattttatatattaatgctttcttttcctaattcaattgtatgaattcctccttttttacagtgcttagcacacagcagac

SEQ ID NO: 22914 - DNA, 201 bp, Homo sapiens
cctaaagacaatattttctttcagtggttaagaagggttgatagagagaggccttctgctgccagaactctcattagaaagcagccttgccaagtgctgcrtcctcctcagccacctcactaacccaagccctttaatagctgaggcctggagaggagacagcactgtcactgcctgctgatggcctctttcctggggtgg

SEQ ID NO: 22915 - DNA, 201 bp, Homo sapiens
cacacagagacatgcacataaatatgtacataaaattacaggggcctgtactacatgtgctgagaataccaattctgaacacaaagtttttataaaataagctacgtatttagttgaaagccttgaaaaacagattagtgacagaaaaggcagatggctgacaattttgttcatttactttggttataattaatttatttt

SEQ ID NO: 22916 - DNA, 201 bp, Homo sapiens
tttttttcaatttttttctgtttttcacaatggataatttatgtggaacttcaagtttactgacactcctgccagctctaatcttctgttaagattgtctrgtaaatttttcatttcatttttcatattgttaagctctagaagtttttatagtttctacttgtctactgatacacgccatctgttcatttattatgagtg

SEQ ID NO: 22917 - DNA, 201 bp, Homo sapiens
gacatctgaaaaacacttctcttatactataacttcagctgttatatgacttcaattttacaaaaaactatcaagcatttcctcagcacctacttttttttcatttaatttcatatagcttgacctcttgttttaacatttggaaaaaatattttccaagtaccctgtatatgcgtgtctctgagcaaatataactctagt

SEQ ID NO: 22918 - DNA, 201 bp, Homo sapiens
gaaaggagagagttaagaaacacgtctgaaaggtcacagagtcttctctttaaaagcatacttcagaatgcctattttattatacactaacaaaatccatrtatactagcagcaaatgatttccaatttccaattttcttttatattagcttacaatggctagagcagaaggtgctgccttttaacacaatcatattttaa

SEQ ID NO: 22919 - DNA, 201 bp, Homo sapiens
atctattcattctgttttgcaaaatttgaagcattgttactcaacctcttttctaattctttatcttcttaataacccagttgttagtatacttctaaatrttcaagatccagaagtaaatgctctcctaaattatataaagagataggtgtccatggcattaaatgtaatattttgattatacaaaatgctttaatttct

SEQ ID NO: 22920 - DNA, 201 bp, Homo sapiens
gggaagctagattagccatctggaaagtacttggggtgcctggattcagagcaagggagatggcttgtgatgaatatttcacgtgggcaacagagagagaygcctgatgggctctccctggcccacagcaagatgcctgccattgagtttgccccgtcccgtagatctggtgtcttgccaattctgcctctcagattcatt

SEQ ID NO: 22921 - DNA, 201 bp, Homo sapiens
ataaagagataggtgtccatggcattaaatgtaatattttgattatacaaaatgctttaatttctgatttcactacctttggattttttatcattccaacrtgagtcagaatgaagttcaccttctatattaccagaggtggggagcctattattagaaaaatatgtttggtcagttattttcataaacaaatgaaaccat

SEQ ID NO: 22922 - DNA, 201 bp, Homo sapiens
catacaacaaaagccaacttatgtttacagtgggagagactccttttcagggaccaggatgctcacaaaccctttgtagagcagctctctgaatgtctcartgtcaaatagggaagctagattagccatctggaaagtacttggggtgcctggattcagagcaagggagatggcttgtgatgaatatttcacgtgggcaac

SEQ ID NO: 22923 - DNA, 201 bp, Homo sapiens
tctcttctgggtttagccatccagtggagctactgggcttctggctggtactgaggagaggctgtgaagagtcttgtgatgtgatttgtcttcaggtctckcagccatgaataccagtacctgctctggtggcagtagaaggggagtgaagtggactctgtgagggtccttggttgtagttttgtttagtgtgctggtttt

SEQ ID NO: 22924 - DNA, 201 bp, Homo sapiens
ctgactcagaaagttctcatggagattaaatgcaatcattcataaaaaatgtttataattgtggctggcatgtagcaggcactcaatatttgttagctatyattattgagagaataatacatacaacaaaagccaacttatgtttacagtgggagagactccttttcagggaccaggatgctcacaaaccctttgtagagc

SEQ ID NO: 22925 - DNA, 201 bp, Homo sapiens
gacttccttcaaaaacatgaaataaatgaatttttttaaatgactgtagtttctacaggatacagttctcctgttttccacttttcctttgtaaaatacakgaattaccagcttcaggcttctactcctaattgagcactctctaggtctagaagctcagctattatagttattttaaagaagattattatcacagaaaaa

SEQ ID NO: 22926 - DNA, 201 bp, Homo sapiens
ttccttggtgttgggcctacatattattttccactggagattggttttctaagtataggaaaaagaagaaaacaaaaaacagcaacagcaaccaggaacarttgtttcatttttagaactccaggtaaaatggctaacgtttcacacctgaggtgaaatagtatcagggtttaaaatatccctatagtccaggggccagga

SEQ ID NO: 22927 - DNA, 201 bp, Homo sapiens
aatgtgagtcttcacatgctgctctgtacatctgagtggaagctgcaagttagttttgtctcctatctgccatttttcccctcaggattattagaatttcraagcttggaggagaggccacaaggagctgagactcagagctctgcagggagtgggaggtgccagttgctgctgggatctctgagagggcacaataaggca

SEQ ID NO: 22928 - DNA, 201 bp, Homo sapiens
gtgcagtgacaccaccatggacctcgtggcatgtagatgcctagatgccgccaggagcttgtggtgagactgcttctcctgagtaccttgaataaggtgayacagggccaggcaaggtggctcacacctgtaatcccagcactttgggaagctgaggagggaggatcacttgaggccaggagttcaagaccagcctgggca

SEQ ID NO: 22929 - DNA, 201 bp, Homo sapiens
tgtcttcacatgctcttcaaaagcacaaagagacaaataagggctgaattcacccttttataatggcattaatccaacccatgaggacagagccctcatgrcctgatcacctcttactactgttacaatagcaattaaatttcaacaggagttttggaggagacaaatatctgaaccatagtagcctccttggttaagttt

SEQ ID NO: 22930 - DNA, 201 bp, Homo sapiens
tgccactggaccgaaccttccttcagtgctgacgtctcctctgggaacacagctggtcctggatcctgggaattctgctctccttggtgagtctaaccctyggaaacattgggcagaaagccaggactggacaggatttatggatgggtgactgtttgcaggtgggaaggaggcagcagtcgggggtggccaacaggaaat

SEQ ID NO: 22931 - DNA, 201 bp, Homo sapiens
attcagagaataaaaacatctcctgtttgctcaggaatggcaaatgtaataaaaatgccacagacaaggccacattgtgtgtacaatttctagagccacamagacagtaaaccagtgcaccagcaatgtgttccttatggctttactaaggcttacttcttttcctctccttctaggctgccccatcaaaggtcaccctgt

SEQ ID NO: 22932 - DNA, 201 bp, Homo sapiens
tgtgagcacaccctctgccacatattgtggaacctacagcaataaataaaacctgtgttttgtggtccctgatgcttacagaggagtgaaggcaagcgatsgatacccggctacctagaattgggagaaagttgcaatttacttcaaatgtatgcatggagaccctgcttagtaggttataagatataatctgaacataaa

SEQ ID NO: 22933 - DNA, 201 bp, Homo sapiens
ccctctttatacagagtccagatgctcagcaccaatcttgttaaatctctcctgccatccaccctccaacctgctttagcaagggcactgctgacatcttkccacttgctggcagatagtggctcttgcaggattaattctcttgtttatattaatccagatatggttcagctctatcacagactaaatgccctttgttca

SEQ ID NO: 22934 - DNA, 201 bp, Homo sapiens
catcctctcagatctgggccatccagtctttgtggctgtgttgcatgtgtttgtatttattcttttcaattgctgctctcatcagatgattcagtagatgstagaaaagccaacatcaccccacactgacttcatctgtccctgccaggattatgttgtcatactgtactccagtcacacatgctacccccttgcatatct

SEQ ID NO: 22935 - DNA, 201 bp, Homo sapiens
tatgctatattcttttctacactgctcctcctcccatgacagattactggtggtctgtggacagactggcaacctgctcagcctcctgtggtaaccggggrgttcagcagccccgcttgaggtgcctgctgaacagcacggaggtcaaccctgcccactgcgcagggaaggttcgccctgcggtgcagcccatcgcgtgca

SEQ ID NO: 22936 - DNA, 201 bp, Homo sapiens
aggaatgcaagtgaacttaaagaataatatgaaactagatgcttgaagaaaatacttatttcttcctgtgggtgggaggtcactcccaggtgatactcctmctaacatggaatcctagggaaatggctaagtctaaggaatttcagccttttaatccctaagcctgttccctgttttccttctcttctgggcctaggtgtt

SEQ ID NO: 22937 - DNA, 201 bp, Homo sapiens
actcgataatgtaacctctccagggaaggaattgggagcatatgattcttttttctcattcaacagataatgtgctaggggccttggagagttgaaacacwatttaaaaaaaaaatagtttttcaatccctgtcctttaagagatttggggtagagagaggaaaataatgtttacagaatacttactgtgttccaggctat

SEQ ID NO: 22938 - DNA, 201 bp, Homo sapiens
ccccgtctctactaaaaatacaaaaattagccgggctgcagtggcagaagtctgtaatcccagctacttgaggctgaggcaggagaatcacttgaacccarggggcggaggttgcagtgagtcaagatcacaatcatgctactgcactctagcctgggtaacaaagtgagactccatctcaaaaaacaaacaaaccaaaga

SEQ ID NO: 22939 - DNA, 201 bp, Homo sapiens
catggttcagtcaacaaagccagaatagattagggcagatgcactcaatcgtaaaacagtgtgcctttgtaggaaagggcacccagaggaatgtgcagcayggtgggagaggatgtggcccctgcctcgccagctatactaatggcattaatcaccaaggaggcaggtgttgccaccagattgctctcacatcctaagaga

SEQ ID NO: 22940 - DNA, 201 bp, Homo sapiens
acgcagaacatccacatatgacaagattttaaaatgaatataaaatattctatatagaaagttgtgtgatatacatatagatagatattttttaaagaatwcttttaggtacagtccttgggaagaattttcttgagaaaagacatttgcaacccatatctgtgaaatgacagaatttatgattcccatggaaattttgtt

SEQ ID NO: 22941 - DNA, 201 bp, Homo sapiens
gaagaagtagcattttaaatggaaaggaaaagatgaataaaagccaagcaaagaggggaaaaaggcactaatgccctcactctctgatgcctagaccagaycccctgtcctccttgcaccaggcttctgcagaagccaggccccagaacctcagagaaagactctaagtgtatcccaggccaccactcatagccaaccttg

SEQ ID NO: 22942 - DNA, 201 bp, Homo sapiens
ggtgttagtattagcacaaaatggcctcaaacgatgagtagagaagtaattgcttgtcttctttttttctggaagagattgtatggaattgaatatatttmttctttaaatggctgctaccatgccccagtgaaattttctggatctggagatttatttttcagtatgtaaccttatgaacttatggaacaccattatagt

SEQ ID NO: 22943 - DNA, 201 bp, Homo sapiens
ggaccatacagtaagagaattttacccagttgagggtttcctctctgaagaagtagcattttaaatggaaaggaaaagatgaataaaagccaagcaaagasgggaaaaaggcactaatgccctcactctctgatgcctagaccagatcccctgtcctccttgcaccaggcttctgcagaagccaggccccagaacctcaga

SEQ ID NO: 22944 - DNA, 201 bp, Homo sapiens
accttgtcaaaaatctattgccgtttctctgagggtctgtttctggactctattctgctatgtgtctgtcccttcatcaatactccattttttttattacygtggctttaaggtaaatcttaaaatgtggtagtgtgatttctccaactttgttcttgttttcaaattcattttggctattctattctgggtctttgtctt

SEQ ID NO: 22945 - DNA, 201 bp, Homo sapiens
taagtacgatataaatgttagtattactattgttattggtgaccatgtgtgatgtcagctggattgtggtcacgtcacagtttttagctcatgcatggctragggtgctctgcccagcccaagttcaagggctagccagatccaggcagagagacaggaccacagtctagtaggctggactttaggcagaactccagcact

SEQ ID NO: 22946 - DNA, 201 bp, Homo sapiens
tttttttcgtatagacgcccaattcttccagtaccatttgttgaaaaagacagccttttctcttttgaattgtctttaaaccttgtcaaaaatctattgcygtttctctgagggtctgtttctggactctattctgctatgtgtctgtcccttcatcaatactccattttttttattaccgtggctttaaggtaaatctta

SEQ ID NO: 22947 - DNA, 201 bp, Homo sapiens
agaggataatagtacctatctcaggaagctgtggacaggaataatgcatttaaagcaactagcacagaatctggctcatttaagtacgatataaatgttartattactattgttattggtgaccatgtgtgatgtcagctggattgtggtcacgtcacagtttttagctcatgcatggctaagggtgctctgcccagccca

SEQ ID NO: 22948 - DNA, 201 bp, Homo sapiens
ctattcctttcatgtttagtaaatcttgcttgtaaaattatgagaagagattttctttgggggaagatttttcattaccgctgaattttttttttttttttaagtctacatgcagtatagcctagtgcccaaagaatgagttttggaggcaaactgtctagattcagtctcaggtctgacctcctaactgtgtagaaagtc

SEQ ID NO: 22949 - DNA, 201 bp, Homo sapiens
aaggtgtaagtttgataggtagcttgaattttttttcgtatagacgcccaattcttccagtaccatttgttgaaaaagacagccttttctcttttgaattrtctttaaaccttgtcaaaaatctattgccgtttctctgagggtctgtttctggactctattctgctatgtgtctgtcccttcatcaatactccatttttt

SEQ ID NO: 22950 - DNA, 201 bp, Homo sapiens
ttaatactttgttctattgaccttaagagagagtataatataataattaggcatgcaggagccaggccgcctaagtttgaatgctgattctcttgtttackagctgtgtgactttggacaggttacctaacctctcagagtctctgttagctgatcctgtaaaatggggaaacttacagtacctttatcactagtaaataa

SEQ ID NO: 22951 - DNA, 201 bp, Homo sapiens
tcaatccatattcccaccagaattatacttgttctctttgcttcatatccttgccagtgcttgatattgtaagaccttttaatttattttcctatctgtgrgtgcattcctagaatatacccaacttgctcataatatattatattgtttacatcttgttttggtttcctaataatttgtttaggacaatttgcctctatg

SEQ ID NO: 22952 - DNA, 201 bp, Homo sapiens
cacaagataagtttacattttttggaaatgcaagtttagatgtacattttaaaattttaaatattcagtaacagactagaaatatcatctatagcttccamactaacagagaaaatctggagaataaagacagccttaccaatttaatagaagctaggaaaagagagaaaagaatcaaaaaggatggtagacaaaaaatac

SEQ ID NO: 22953 - DNA, 201 bp, Homo sapiens
gtaaaacgtctctccatgtgtgtttgcttgatgttttcttgtgatttttgaatttttgacagaaataacacagaagtgtgctatgttcttcttagtacctyatatcaggagacagatgatgatgatgtgtctcattactggtgatgttcactcttatcacttggttaagatgatggccagccaggtgtttccactgtaaaa

SEQ ID NO: 22954 - DNA, 201 bp, Homo sapiens
caatcaagggacactgtgacagtccccaagttctgtctttcttgctttagtgaccaacgagtctatgtgccctaaaacctaaaatcttgcttctcaaaaaktaatctggggtccagcagcatcaacgtcagcctggttcctgtgagaaatgaatatcaagtttcatctttggcctgcagaatcaaaatcttcagtttaaca

SEQ ID NO: 22955 - DNA, 201 bp, Homo sapiens
tcctgggcttttgtctgctttctccatctttgctgaaagcaccttaaagatggtaagcatggtttccacttctggatctgtcacaatgcttagcaatgaawgcttaaatgagaaactaagttgaacatgtcacaaatgcccttctcctcagtctccaaaacctatggctactttctctgactgactttaggaagctgcctc

SEQ ID NO: 22956 - DNA, 201 bp, Homo sapiens
ggaaggttcgccctgcggtgcagcccatcgcgtgcaaccggagagactgcccttctcggtgagtgcagcggacactggctcagacctccccaccctaggargagccctccctgttagcgaagtcagtggccagcccttcagtagcactgtgcagggagagatgccagccaaggagctgttcttccctctaggcacaggctt

SEQ ID NO: 22957 - DNA, 201 bp, Homo sapiens
tgaaatgtgggtttaaatgagctatgttactttctggaggaagcaatcaagggacactgtgacagtccccaagttctgtctttcttgctttagtgaccaaygagtctatgtgccctaaaacctaaaatcttgcttctcaaaaagtaatctggggtccagcagcatcaacgtcagcctggttcctgtgagaaatgaatatca

SEQ ID NO: 22958 - DNA, 201 bp, Homo sapiens
tctaatatctcctttgatcttttactttatcttttctaggcctcttttaagggttttctagaatacagtggttttaagggaggagtagcaaatccatctgygatcgctgggtataactgcttttctgactttgtctatttccctctctctgtaacccttcgtgattcactcctccagtccttagagactgagcagggtaga

SEQ ID NO: 22959 - DNA, 201 bp, Homo sapiens
aagttccatgtcacctggacactggtaaagttttaggagaaatataagtggtggcctctacccctggagaatttacagttttcctgggaagagcaaatggrcatgcactgaaaaggaaaattactttcaaagctgtaaggacattaggaggggccaacaattggcccaaaaagagctgattgttttgaagatggaaagtac

SEQ ID NO: 22960 - DNA, 201 bp, Homo sapiens
cttccctctaggcacaggcttatcaggcctctccaccttgctgaaaatatcctcagactatgccacctctctcagctttgtttattcctcaccccactaayggccagccaggtttcccaagtccctaacggggtctgttcagggagcaagagcttcccaggccctggcaagccatagacgccccccatcctacagtaatca

SEQ ID NO: 22961 - DNA, 201 bp, Homo sapiens
aatgggaaccagaacttagaagttttaattaaatcaagctctgtgtaggtgaacaggcacattagtatttttggacagtgggatgtcatagaaaagtgtgytagagtgagggaaggctgaagacactttatataattggacctagttttggtgttattctgctatttgccatgttctgtaaaggaagtaggtttagatgca

SEQ ID NO: 22962 - DNA, 201 bp, Homo sapiens
tctaggcacaggcttatcaggcctctccaccttgctgaaaatatcctcagactatgccacctctctcagctttgtttattcctcaccccactaatggccarccaggtttcccaagtccctaacggggtctgttcagggagcaagagcttcccaggccctggcaagccatagacgccccccatcctacagtaatcaactgac

SEQ ID NO: 22963 - DNA, 201 bp, Homo sapiens
aaactaagtaagtcacagtccagatttaggaggaatttgctccccttccctgctacatgcctctcctgaaagccagatgtggcgccgcttggctaggacgwagccataggttcacctttgacccgtttgcctgccaggcatttggaacacttagtatccttctttgcatgtgaacaagtgttgccctggttgtctctttca

SEQ ID NO: 22964 - DNA, 201 bp, Homo sapiens
ccaggcatttggaacacttagtatccttctttgcatgtgaacaagtgttgccctggttgtctctttcagatacaactgggtaaccccgctgtgacccaggyagctgttttttaaccattttgttagataaattttctccatcactaaaaccaaagagtgggatttttttgttctagattacatgagcaacagtctcgcgat

SEQ ID NO: 22965 - DNA, 201 bp, Homo sapiens
tgttctagattacatgagcaacagtctcgcgatttccccaagctctctccttctcttcgagaattaccacagggtgcacacatgcaacaagaatccctgcmtgtttgtatatggaccgaggatttcagagtgttcctagtttacaggttggctttgtgagaaaagtccatcggtcacagtctcacttttggaacctaacat

SEQ ID NO: 22966 - DNA, 201 bp, Homo sapiens
gactgtcacgcggtcacgccaagagatggaactttacctgtttctgagagattgaccaaaatgtgcagcaggaagtataccgagcactaccagacaaaacsttgacttcagtgaggcccagattactttccaggtcaggaggtgacacaaatttggatctgacttccctagaacaactgtctctcctgtcacatgcttgga

SEQ ID NO: 22967 - DNA, 201 bp, Homo sapiens
ttctttgtgctccaactgtatgccagacatagtgctcagtgctttaaaggcattatcttgtttaattttccctcaagatcgtaggaactagtaggtactaytgtagttaccacatcttagatagaaagctgagggacagaggttggacccacatagaaacactggaaatggtctgaacacaggcagcatgccccagagctt

SEQ ID NO: 22968 - DNA, 201 bp, Homo sapiens
agattgaccaaaatgtgcagcaggaagtataccgagcactaccagacaaaaccttgacttcagtgaggcccagattactttccaggtcaggaggtgacacraatttggatctgacttccctagaacaactgtctctcctgtcacatgcttggatctcctttaggaagtaccaacactgcagttacaaaacaacaaatttat

SEQ ID NO: 22969 - DNA, 201 bp, Homo sapiens
cctagctggagactcctttctggagcttctactaacccctccttatttccagtgacataatgtatatgcttcataatcaaacaggcatgagctccctttgycagggggaatatcgtctttctcctacctggaaaagcctgcttctcataggtcacattcatctcaagacagctctggttccaggccctcgaggcttattgg

SEQ ID NO: 22970 - DNA, 201 bp, Homo sapiens
atcataaataatgtatagtataatgtagcacatatatacacatttatatattacattatacattataatatacattatatatagatgtaatgtagcatatmtatacatttccatagatattatatatatagtgtatattgaagtacatagcttctgatgtatagtaaaataatttgacagaaggttcttagaacttttaaa

SEQ ID NO: 22971 - DNA, 201 bp, Homo sapiens
tcatctttaaagcctactgcttttcaaatccagagtattgtcaatttcctattggtttccttcagcattattctccttcacttgtgtttcttttctttctratttctcaaaaccttaaactaactctctcagttttctctatctccttttgaaaactctgggaatacatttcctaatagagtttccttctgtatactcagc

SEQ ID NO: 22972 - DNA, 201 bp, Homo sapiens
acctctttctctgtcccttcgggttcgctctccttccagggcccgggcggccatccacgaagcacagcccgcacatcgcggccgccaggaaggtctacatmcagactcgcaggcagaggaagctgcacttcgtggtggggggcttcgcctacctgctccccaagacggcggtggtgctgcgctgcccggcgcgcagggtcc

SEQ ID NO: 22973 - DNA, 201 bp, Homo sapiens
cgtcctccggcaccttcgtctctccttctcttctccactctggctctttcctttgcccctctctcctggctgcatctcactctgggttttctctctccccwcctctttctctgtcccttcgggttcgctctccttccagggcccgggcggccatccacgaagcacagcccgcacatcgcggccgccaggaaggtctacatc

SEQ ID NO: 22974 - DNA, 201 bp, Homo sapiens
atttaaaattttctgtcccagggaggaaaaaactcttaggatgtttatctcattttcaatagtgtatttcataaggaaatggacacttgatcctatctttwgaggcagcaataaacatagcaaaacaaattgaaagtccagcttcacatgtggttgtttttgtttgtatttattagcaggaagttctttggcataattgcc

SEQ ID NO: 22975 - DNA, 201 bp, Homo sapiens
agctgctttgctgaagatggtgagaggctgccgcatttaccagtggtatacccaggaacaatgtggcagatgtggccattcagataaatggctatgagagyagactgggggtgacatctgtcagtacattaattattagagatgatctggccatcatctggataactggctgacttagtatcccctccctcccttaccatg

SEQ ID NO: 22976 - DNA, 201 bp, Homo sapiens
gaactatcagaaaaacacttgcttcaggcatgcaatcttgacagtctacacattttaaggcaagagcatgtttgtactcagcaatgggttctgcactccaycttgggaaagaagaacagaaaagacagcctgcttttggtgtaggcccagagacagcatcaggcctcagatgagtttcccacgtaactcttcctatatccc

SEQ ID NO: 22977 - DNA, 201 bp, Homo sapiens
ttccattagcaaccttaattcccccttgccacataatattacacattcacagatttaaggacatatttggcaggggagagggatacattagtctacttacsacagtgtgctttgttcatcttttgcatagtgtcagttcaagtctgttgctcatttttaaaaaatgtgttgcttgactttctcttgttgagttttgggagt

SEQ ID NO: 22978 - DNA, 201 bp, Homo sapiens
cgagtaatttcttctatgatcttgaccaccacaaggagaacaaccctggaactatttttaacaagaaatttatacctagaaatctagacaaaccacctaayatatcaaactccttggagtaaaaataactttgcagatcatctaccctactaatttgtttctcaagaggctcatatctgaattataacagccagcaggaat

SEQ ID NO: 22979 - DNA, 201 bp, Homo sapiens
aaacagcacagaacaaaacagacaaaatccatttatcttcctaggagccatggaaaaaacaaaccagagcaggagaacaggaaatgggtataggctgccasccacaggtgatgcaggggagctgcaattttcagtaaattaataaagaaaggactcactgataacatggcatttaaacaaggatctaagggaagtgaaaag

SEQ ID NO: 22980 - DNA, 201 bp, Homo sapiens
gaaaaagggttcatttagtggaaggtttttaatgtgaagatgctaatcagttaatattaaatagagacaaactgcaataaaacccaaaatatggtattagrgaagaaacacaacaatagaggacaccattcatgatgcgagtaatttcttctatgatcttgaccaccacaaggagaacaaccctggaactatttttaacaa

SEQ ID NO: 22981 - DNA, 201 bp, Homo sapiens
tcaacagcacatatttaatgggcacctgctatatgctgaggaactgttctaggtgctggaaacagcacagaacaaaacagacaaaatccatttatcttccyaggagccatggaaaaaacaaaccagagcaggagaacaggaaatgggtataggctgccagccacaggtgatgcaggggagctgcaattttcagtaaattaa

SEQ ID NO: 22982 - DNA, 201 bp, Homo sapiens
ctggcagaaactcactctgtataaaggaggtaattctagaaaagaaaaagggttcatttagtggaaggtttttaatgtgaagatgctaatcagttaatatwaaatagagacaaactgcaataaaacccaaaatatggtattagagaagaaacacaacaatagaggacaccattcatgatgcgagtaatttcttctatgatc

SEQ ID NO: 22983 - DNA, 201 bp, Homo sapiens
gctcaaagattttgaggtaaagtacgcttataataaaacacaggcctctatgttataaagtacaaaatacatatggattttttaaagaaagcacaaaacaytaaagaaatttccacctgcccctggctgctttgggctatcctcacaagccactcaaggatatattcattcaacagcacatatttaatgggcacctgctat

SEQ ID NO: 22984 - DNA, 201 bp, Homo sapiens
gagaaacatggtgtattgggaagccaacaagtggctgtgcctggcagaaactcactctgtataaaggaggtaattctagaaaagaaaaagggttcatttartggaaggtttttaatgtgaagatgctaatcagttaatattaaatagagacaaactgcaataaaacccaaaatatggtattagagaagaaacacaacaata

SEQ ID NO: 22985 - DNA, 201 bp, Homo sapiens
atacacaacctgatgattatacatactgacaaaatgcaattgattcgtttaccttagcactgatgatgtctcatgacaaaatgattgatatcaataaagcycaccatatgcatgcacctcaccacaatctatagcagatgctgaacaaactgcctcacttatgtttctctactctggaagaatcttccatcttatatttac

SEQ ID NO: 22986 - DNA, 201 bp, Homo sapiens
aaatattataacaatgatagcaataataatgatggcaggtaccgcatggtattttgtttccaacacctgtacaagctagaggctagcagggaaaaacacarttaagaactctggagtgagactacttagggtcaaatcctagatctcttacaactagctatgtgaactcggccaagttacttcaattgccctatatataaa

SEQ ID NO: 22987 - DNA, 201 bp, Homo sapiens
aagcataagcaaaaaggaactccaaagaccaattctttctatttttctctcttgtgtatgagaaatattataacaatgatagcaataataatgatggcagstaccgcatggtattttgtttccaacacctgtacaagctagaggctagcagggaaaaacacaattaagaactctggagtgagactacttagggtcaaatcc

SEQ ID NO: 22988 - DNA, 201 bp, Homo sapiens
ataagaaaggattttcttacagccgtgctgtgagaagttttgcgttttctctatatcttagtctttaaaactatggaaaggaattgagtatgataatgcarttaccccaggtaaaaatcttctatgctttcaaacatgtgcgtagccatcaataagaaaaggattccttgctatctgagagtgaaaagtagagggtaaggg

SEQ ID NO: 22989 - DNA, 201 bp, Homo sapiens
acagaataaacaaaatacaaattaagcattggccttattttatacatacggtgcatattcaaacttgactgacaggcagttacctgtaactctgtgaatgrcagtttcagtgtaaaagtaggcactgaaatcaaaccagcaataggtttagttacaaatgagagtggaggaaataagtgcttccagggacacattactcct

SEQ ID NO: 22990 - DNA, 201 bp, Homo sapiens
taggccttgggaaggcacatcccaggcacacctagaaacaccttatgtgaaaatggatagtgtcaggcactttatctttaacttaatagaagttgacaatrtaactgacccatggtggagtgaagtgaaaccacatgtgggctggattgaccctcccttgatctagaaaagaaaaagtgctgttttccagctcacccttgc

SEQ ID NO: 22991 - DNA, 201 bp, Homo sapiens
accttataagtgctctggaaaacagcccaagttctacagcaaccaagcaaacagccaataaagaaacagccatctttaagatgataggaaatttcctggtwttttcgttcatccttgccccaccccctccccccatgtggcatggttttgatcttaacaacgtggcagccactacttgtgaaatctgcagaaggaacacag

SEQ ID NO: 22992 - DNA, 201 bp, Homo sapiens
gcatggttttgatcttaacaacgtggcagccactacttgtgaaatctgcagaaggaacacagacctgcagacacctgggaaaagagattatgggtggagaytgaccctctatgcaactgacgctctaaagtcccaaggacagccttgagtgagactctgggaaattaagacactcaaaagcagctatgtatatggagaagg

SEQ ID NO: 22993 - DNA, 201 bp, Homo sapiens
taggcattgaacattaaagacaaacactttaaaacaactatcttaaatatgctaaattgggagctgaaagtactagaactgaattgaaaattttactggcrggattcaacagcagatttcgcaggcagcagaaagaattttcaaacttgaagatagataggccaataaaaatagaagaaaataaacaaacagagtctaaaa

SEQ ID NO: 22994 - DNA, 201 bp, Homo sapiens
tctttttgcctcataaatcacaaacttggagttcaagaagctggctactggtaaacaccaatgagtaccaaaaaaaaaaaaaaaaaaaaaaacaaacaccmgctagaaaccttctctctctaacaaaaggactaggaaaggggaagcatagcaagacagaaaacctttagaaaattctactctatgctagccaaatgccac

SEQ ID NO: 22995 - DNA, 201 bp, Homo sapiens
ttgggttttctttttgcctcataaatcacaaacttggagttcaagaagctggctactggtaaacaccaatgagtaccaaaaaaaaaaaaaaaaaaaaaaamaaacaccagctagaaaccttctctctctaacaaaaggactaggaaaggggaagcatagcaagacagaaaacctttagaaaattctactctatgctagcca

SEQ ID NO: 22996 - DNA, 201 bp, Homo sapiens
agcagatttcgcaggcagcagaaagaattttcaaacttgaagatagataggccaataaaaatagaagaaaataaacaaacagagtctaaaagagttgtgasacaccctcaagtgaaccaacatatacattttgagagtctcagaagaagaaaggagttgaaagattatttgcagaaataatggccaaaaactttccaaatt

SEQ ID NO: 22997 - DNA, 201 bp, Homo sapiens
acctcccaacaggggtctccagacacctcctacaggagcatctgggccagcaacaggtcagtacccacctgggacagagctcctagaggaaggggcaggcwgccatctttgctgttttgcagacttcactggtgatacatccaggtaaggggaaaacctaggcaactagggcctggagtgatcccccagcaaactgcagca

SEQ ID NO: 22998 - DNA, 201 bp, Homo sapiens
acccttttatgcacagggtaatgtgttcacaagtaccggggattgagatgaagatatcttcgggggccattgttcagcccatcaccacctgctatattgtsagtgaagcacttagtccccactagcacaagctccttgagattgggaacctgtcttccactacccttttgcctctctatatctaatatatcaatgtatata

SEQ ID NO: 22999 - DNA, 201 bp, Homo sapiens
acagctcacataccattgccttgtgcagaagggtctcccatttccaggcagccacgtgtcctctgtgctttctcctaatcatttggcagagcccctccctyctccttgctccttgcccatcttggagctgtggtttagtaaaacactcaaagaatcaaatactgatgaataagcaaaacactaagtatgaagcctctggca

SEQ ID NO: 23000 - DNA, 201 bp, Homo sapiens
tagcaggactggacagagcaccattgttttgatagctttctgttttcacaggtgctacagagtcactttatgagtcttcaccatgacccatgtcatagaaracaaatatagctatagttttgctgaatccaggtttaaagttccttgttcaaacaaaaacataatttctaaatcggtccaaagcaaagttcaacgtcttga

SEQ ID NO: 23001 - DNA, 201 bp, Homo sapiens
aagaccgacagtaggtaaattatataatacacaacctgatgattatacatactgacaaaatgcaattgattcgtttaccttagcactgatgatgtctcatsacaaaatgattgatatcaataaagcccaccatatgcatgcacctcaccacaatctatagcagatgctgaacaaactgcctcacttatgtttctctactct

SEQ ID NO: 23002 - DNA, 201 bp, Homo sapiens
tattctaggcactgcagcagatacagatagaaataagacagcccttgtattaaggacatgcatttttagaattattttgacattgcttggcatattgtctscagattttgctactatgcagaatccttcaatagatccctgactgagtatttctttccatatgtctctctggtttgggaaatgagaatgaatatctttact

SEQ ID NO: 23003 - DNA, 201 bp, Homo sapiens
aacctctgccacatggaggtatgaagaaacggctatggaaacatacagcaataaggcagttacctctggaatctggacaggctttcttgagcagacgcctratttgggatttgaaggatgagtaggagtttgccaaataaagaatagggaaagagtattctaggcaaaaaataatagcatgtgcacagagggccaattaag

SEQ ID NO: 23004 - DNA, 201 bp, Homo sapiens
gtctagaccaagaatgcccagccttcattatctcctcctatttgctctaatccttgggagggtgggcattttctactggttaagagaaaatccagcacagytcagcaaacatttataaaattcttactgtgtcataggttctggagaaacaataaagtctaggacatagaccctgggccgcgcactaacagcttattagga

SEQ ID NO: 23005 - DNA, 201 bp, Homo sapiens
gaaaggaatatctttacatcacctgttacatcaatcttgaatctgtgagaaatgagctttgatgatatcactttgcggctgggcacagtggctcacgcctrtaatcccagcattttgggaggccgaggtgggtggatcatctgagatcaggagttcgagaccagcctggccaacgtggcaaaaacccgtctctactaaaaa

SEQ ID NO: 23006 - DNA, 201 bp, Homo sapiens
cagagcgagactccgtctcaaaaaaagaaggtgggtaataacaaacttcgctgagctaaaggagcatgttgtaacccaatgcaaagaagccgagaatcacrataaaacagtagaggagctggtaaccagaatagccagtttagaggaggagcacaatgacctgatggagctggaaaacacaacacgagaaattcacaatgc

SEQ ID NO: 23007 - DNA, 201 bp, Homo sapiens
ccctagaacaactgtctctcctgtcacatgcttggatctcctttaggaagtaccaacactgcagttacaaaacaacaaatttattctcttacaagtttgarggccaaaagtccaagatcaaggtatctatcaatcaggaggatcacatcacctccaaatcacctccaaaggttctaggagagaatccacttctggtggccc

SEQ ID NO: 23008 - DNA, 201 bp, Homo sapiens
ttgaaaccagggctttggaattctagcccagtcaatggtcatgccagaatctggaagataccgtgcattcacttgagcctgtggcatggctggtatgtgtktgtgccacgcagttgctttcccctaaagggaacatgaggtgacaacagacttcatgggctctgccaccttttagcctgtgtcctaagcactcacaccata

SEQ ID NO: 23009 - DNA, 201 bp, Homo sapiens
tgggtcaataaatgtcattcctcacataagaagaactaaagacaaaaaacacaagtatctcaatagacacaggaaagccctttaataaaattcaacatcamcttcatcttaaaatctctccaactagatattgaaggaacacacctcaaaataataagagccatatttgacaaatcagcagttgctattatagagaatggc

SEQ ID NO: 23010 - DNA, 201 bp, Homo sapiens
tgggactgtattggcccagtgatcacaaatgtccccagcagcattttgacatcaacaagggtaaaggttatatgtttatttgcctcagggctaaaatgttyatttttcctagatattcttttccatgtgtgagcatgtgtgaccatggaaaggaatatctttacatcacctgttacatcaatcttgaatctgtgagaaatg

SEQ ID NO: 23011 - DNA, 201 bp, Homo sapiens
ccttgaaaaccagcacaagacaaggatgccctctctcaccactcctaggcaatgtagtattggaagttctcgccagggcaatcaggcaagagaaagaaagmaagcatattcaaatagagaggaagtcaaattatctttgtttgcagatgatatgaccctttatctacaaaatcccatcgtctcagcccaaaagtttcttaa

SEQ ID NO: 23012 - DNA, 201 bp, Homo sapiens
tctccatcactaaaaccaaagagtgggatttttttgttctagattacatgagcaacagtctcgcgatttccccaagctctctccttctcttcgagaattaycacagggtgcacacatgcaacaagaatccctgcctgtttgtatatggaccgaggatttcagagtgttcctagtttacaggttggctttgtgagaaaagtc

SEQ ID NO: 23013 - DNA, 201 bp, Homo sapiens
attttgcaatctatccatctgacaaaggtctaaatccagtcaagaggaacttaaaaaaatttacaagaaaataactccattaaaaagcaagcaaaggacaygaacagacagttctcaaaagaagacattcatgtggccaacagtcatatgaaaaaaagctcaacatcactgatcattagagaaatgcaaatcaaaaccaca

SEQ ID NO: 23014 - DNA, 201 bp, Homo sapiens
aagacatattaaatggagtcctttgagttataataaaaagatgctagttaactccaagccacctgaacatataaagactctccaataaaggtaaatagacrggcagacattaaaaccagtattattttgtttcatagctccactttttattttctataggatttcaaagaaatgcataagaagtaattataaatctgttag

SEQ ID NO: 23015 - DNA, 201 bp, Homo sapiens
gaagccataggttcacctttgacccgtttgcctgccaggcatttggaacacttagtatccttctttgcatgtgaacaagtgttgccctggttgtctctttsagatacaactgggtaaccccgctgtgacccaggtagctgttttttaaccattttgttagataaattttctccatcactaaaaccaaagagtgggattttt

SEQ ID NO: 23016 - DNA, 201 bp, Homo sapiens
aagtattaatcaaaagtaaagtagactggaaaattcaatcatggtatgttcataaaataaagtgctatacatcaatgaaaatgaacttcagttatatacayaatacacagtaagaaaacaccaaatacaaaacaaacatgaaatatggttcatttatgtaaatttcaaaaacaggcataaactaaactgttttaaaagtta

SEQ ID NO: 23017 - DNA, 201 bp, Homo sapiens
aatgcaggcctgacattcaccagggatataagaggctggaaaactgcccttgccaagctgtgcaaaatgaagaagagatctttgatgtgccaggaactttytgacttgatttggtgatggtcagagtcaatcagcttaatttacttctgcaaatgaaataataatggctctgttttcttggatttcaatgcccccgggagt

SEQ ID NO: 23018 - DNA, 201 bp, Homo sapiens
aatcaaaagtaaagtagactggaaaattcaatcatggtatgttcataaaataaagtgctatacatcaatgaaaatgaacttcagttatatacataatacayagtaagaaaacaccaaatacaaaacaaacatgaaatatggttcatttatgtaaatttcaaaaacaggcataaactaaactgttttaaaagttaagtctca

SEQ ID NO: 23019 - DNA, 201 bp, Homo sapiens
cttatgcttcaagaggctatgagtccccctgtgcacctcatcctctgtcctcagcagtagttaaatggataatagatgggcttggagttggcactggtgcrgtgctgagagcctggggggatgtggctcagctctcaaatgcccctttactacctatctgtaggactttcatacaatacttaggcaactgctttctgtttt

SEQ ID NO: 23020 - DNA, 201 bp, Homo sapiens
aagtcttgggtagacatttgagtttattatatcaaaatatgtttgatggctctgtagatgtgtataatattgtacatgtccagtgcaggcttggcaaaagycttcagaagacaaagccttatgcagaaaaaagatccatgtctaaaattgctttcctagtctctgattggaaaaatctcataacaagtaaaatgagggaat

SEQ ID NO: 23021 - DNA, 201 bp, Homo sapiens
tagtaaggttcatatttaccgactaaaatctcatcagcctcaccagggctgaccaaacaggattcatggagccagcaccttgatagcatatggcccttttyttttccttcaaagtagatgtgatagggagacacgcatttgcctatttcagtcaggctaaaaagctttatttgtttcagctgcagtttcaaaagtatattt

SEQ ID NO: 23022 - DNA, 201 bp, Homo sapiens
ctctcagaaaatcctaaggcagttgggaaaatgaggactatgagaaaatatgaaagattccctgacaaatgtgcttaggagtagtaaggttcatatttacygactaaaatctcatcagcctcaccagggctgaccaaacaggattcatggagccagcaccttgatagcatatggccctttttttttccttcaaagtagatg

SEQ ID NO: 23023 - DNA, 201 bp, Homo sapiens
ggtatgcctgtattatgaaggcagcttctcaaaggcctgttagttgcttctcctgggtcttgagttccaagaactccacatccatggcaggcctgcccttsgaagcatctctaccctattctcatctgcacgaggaatagcaggctgggaggccctgggaacaggaccaagacccaaggctcagatgggccaagagaggtt

SEQ ID NO: 23024 - DNA, 201 bp, Homo sapiens
aggttatcctgtgacccttttgttgactcacagacaagaacagttgttgagcttaatgttgtcgcatttgctccagataaactcaattctctgatttcccmccagccagctgtcaagccaacaggcaagacctctcactgggcacagccaggagtttcttgggtcgaccatacacatttaaacatttgtagaaggttgcta

SEQ ID NO: 23025 - DNA, 201 bp, Homo sapiens
gcaactgtacaggacggcatagtgtgcattatgtttagttctctcatttctagatttatctttcttacctttgcctttttgctccattcactcatttgttyttgtgaattttatggttatttatatgctataaatctttttattatttaatgaaaggttaagcataagcaaattaatgaatatctaaatcttttgaggatg

SEQ ID NO: 23026 - DNA, 201 bp, Homo sapiens
actgatcttactccctttctactctcacctgttctgaggaaataatctgattaaaacccctcaccctagattgagaccaagcctaccacctatatgtattygcaatagcaccataacagccagcgtaatgccttatgctcagttgatttggtctaatttaagtataatcagcaacttcatgtgttactcctcccaagggta

SEQ ID NO: 23027 - DNA, 201 bp, Homo sapiens
tagactagagagatgctcattgatgacacagtgctattcagcctagacttcaactctggtgacaacaaatcctagtaatgcgatttgcggcaagttgtgtwatctttctgtttcaggtttatttttgtgaaatagacacaattgtagctaattttcaaggttattacaagaattgtgtgagaagctatgtatctaaaaata

SEQ ID NO: 23028 - DNA, 201 bp, Homo sapiens
aaaaaaacaatgccattaaaagatgggtaaaggacatgaacaggcacttctcaaaagaagacatttatgtgaccaaagagcatatggaaaaaaagctcaayatcactgatcattagagaaatgcaaaccaaaaccacaatgagatagcatttcacaccagtcagaatagctattattagaaggtcaaaaaataacagatgc

SEQ ID NO: 23029 - DNA, 201 bp, Homo sapiens
tacgcttaataaatatcaatggaacagaatagagaacccagaaataagactgcacacctacaactgtctggtctttgacaaaaacaagcaatggggaaagkattccttattcaataaatggttctgggataactgtctagccatatgcagaaaattgaaactggatcacttccttacaccacatgcaaaaattaattcacg

SEQ ID NO: 23030 - DNA, 201 bp, Homo sapiens
ggtaaattcagatgtacttacactgtctctctgttttcttccattgatggataggaatctgccatagcctgttccttaatagctgggcctgactgggccartgggagtctcttttgtttctctagtgggactgtattggcccagtgatcacaaatgtccccagcagcattttgacatcaacaagggtaaaggttatatgtt

SEQ ID NO: 23031 - DNA, 201 bp, Homo sapiens
caggaatcaggaactcagtagatcaagtacaaagtgaatctacagatccagagttggtgtcagagtcagggcatgaagcctggggcactgtgcctagcagraaagaagtcagagggaggtacacttggaaataatgagcatttatgccccaaggcaattctggagtagtgggtgaaggaccagagacatagcaggcaaggt

SEQ ID NO: 23032 - DNA, 201 bp, Homo sapiens
actactgtcatcccccttggtaaattcagatgtacttacactgtctctctgttttcttccattgatggataggaatctgccatagcctgttccttaatagytgggcctgactgggccaatgggagtctcttttgtttctctagtgggactgtattggcccagtgatcacaaatgtccccagcagcattttgacatcaacaa

SEQ ID NO: 23033 - DNA, 201 bp, Homo sapiens
ccattagatggtttagattcttgacttcaagaaaggcaatataggaaaaaattatttaaaatgtttgccatcttagctcaaataataaaggacagaaatargactcttaaaaattagcacctggcaaaagtttattcctatgaaaccacgtcctcctctataatttaaccacagaggctgccgaagttcctaccctttggt

SEQ ID NO: 23034 - DNA, 201 bp, Homo sapiens
ttactactgtcatcccccttggtaaattcagatgtacttacactgtctctctgttttcttccattgatggataggaatctgccatagcctgttccttaatrgctgggcctgactgggccaatgggagtctcttttgtttctctagtgggactgtattggcccagtgatcacaaatgtccccagcagcattttgacatcaac

SEQ ID NO: 23035 - DNA, 201 bp, Homo sapiens
agcacctgaagagttttaataaacgttagaaatcagacttacttattctctttttccctttcagagtgtttatccagccattagatggtttagattcttgrcttcaagaaaggcaatataggaaaaaattatttaaaatgtttgccatcttagctcaaataataaaggacagaaataggactcttaaaaattagcacctgg

SEQ ID NO: 23036 - DNA, 201 bp, Homo sapiens
cagttctagttccttcttatacccagagataaccattgttaatgctttgctacatacacttccagatagttttctatgaatttatatacatataagaagawatacaaatagataaagctttttccctttgtaaatgggattttattttgtatattgttgggaaatttgattttgccatttaatattatgcactaaaaatct

SEQ ID NO: 23037 - DNA, 201 bp, Homo sapiens
tttagcaaaaaatttatgtaagaatttgtccaagaccctgaagtaaataagacgagaacacaataaatcagactgggagcacctgaagagttttaataaaygttagaaatcagacttacttattctctttttccctttcagagtgtttatccagccattagatggtttagattcttgacttcaagaaaggcaatataggaa

SEQ ID NO: 23038 - DNA, 201 bp, Homo sapiens
gaagatgtcttctcaagctggaggtattctgactgttccaatttgtgtgtttgtgtgcatgtagtgcctacattttttagaacactttttaaaaatagtcrttttctgttagaagagtactagattttagagttcttgctatcagctttgtgtctgaatcctcctttctatatttctgacacctagtataatgtttgacac

SEQ ID NO: 23039 - DNA, 201 bp, Homo sapiens
atttcaagtcttagtcactgggcctttgtctctgagaggtcaccccctgcttaagataaatagctttcccaggccgttgttagtcccactgaacaccagtkagggagccactttttttcttgtatgtagtcagaattatcagatcacatggagaataccaaaggccctagagggcaagtccaatctgcttagccaggcttt

SEQ ID NO: 23040 - DNA, 201 bp, Homo sapiens
cctagggatccaaagacccccaagttaagagcctttgttctaaagtgacctccatgggatgcgtatcctcttgttttactgaaatagcagatgttggctasatgttggctaaaggcctgctgcttttgtatttcacagacagttgttgctaggtgtatttactgtgacagggtcaggctccatgaactctggggaaagttt

SEQ ID NO: 23041 - DNA, 201 bp, Homo sapiens
gtatgcacacactgttagaaaatcatgccagtagatttgcttagcacagggttgccacaaaccttcaatttgtaacaaatgcaggatccatgaagtgcaawaaagcaaagtacaataaagtgaggtatgcctgtattatgaaggcagcttctcaaaggcctgttagttgcttctcctgggtcttgagttccaagaactcca

SEQ ID NO: 23042 - DNA, 201 bp, Homo sapiens
ttttcagtgggacataacaaaatgacatttcaagtcttagtcactgggcctttgtctctgagaggtcaccccctgcttaagataaatagctttcccaggcmgttgttagtcccactgaacaccagttagggagccactttttttcttgtatgtagtcagaattatcagatcacatggagaataccaaaggccctagagggc

SEQ ID NO: 23043 - DNA, 201 bp, Homo sapiens
tatttactgtgacagggtcaggctccatgaactctggggaaagtttaacaatctccatgagcacatagcaagagaatatgagggaggactctgcatacctragtctgctttctgttcagtcatcctaggtttaacctgcagaaaatgaagccagggtaagaaaggatggagttggttatttggatgactttagcaagaaaa

SEQ ID NO: 23044 - DNA, 201 bp, Homo sapiens
gatttaaagtgaaagatgtacaactttttctttgtcttgaacacttagatgccactgtaggattattaattagcctaattttaatattgctgcatctcagrggatagggaggtggccccaggagaggaagcaagatgggcaaatggccattcagatgagcagtcagaatacaaacatttatcaattaagttcatcttttta

SEQ ID NO: 23045 - DNA, 201 bp, Homo sapiens
tggagctatttaagggtcttcagttctaaagtctactgccacattcctagcatattatgccaaaatatctttcatatgattaatctgagaggagcttgackttctcttactggttctacactaccattagccatttgctggcagaatgcccacagaccacaggaaatctaaccatcccataaagaaaacgtatcagtgagt

SEQ ID NO: 23046 - DNA, 201 bp, Homo sapiens
ctgtcatccaggctttgttcttccatttatagagcacaggcagattagatgtaacgtaattcttaagggacccaggattgttggaactagagatgaccatyggcttcactttaaagtcaccaggtgcattatcccctaacaagagagtcagcctgtcctttgaagctttgaagccagatattgacttctctctagttatca

SEQ ID NO: 23047 - DNA, 201 bp, Homo sapiens
gctatagataggtatctttaaatgtaagtatctttatatacacagctatgtatgtctgaaggcaaattagtgagaatgtcctgtcttgcctcttcactcamactgagctctgctgaaatgattccagacaaatgtctaggttattcctaaagatctccagggaagtagatatgacagcctcttaatatttttaaatattaa

SEQ ID NO: 23048 - DNA, 201 bp, Homo sapiens
ctggagggcacatgaaaataaagcttaacagagaaagtaggcccaagtgcctggggatgggggcacccgacgcaagtctcacttcacactcctgcaaagtyggggaggatgcagtgctgggaaccatcttgaggaggagagtcatttacttaaaataccaaaacccacgggaaaaggcaggtttgcctagggggagaggtg

SEQ ID NO: 23049 - DNA, 201 bp, Homo sapiens
tcttaaagagtaagacttgaaagttgaaatcactccttgatccatgggctgcagaatggatgttatgttcgcagaaatgaaaataagaatctccttatacwtctccatcagaagtcttgggtagacaggtgcattgtcaataaccagtaatattttgaaagaaggctttttctctgagcagtaggtaacaaaatagtgatc

SEQ ID NO: 23050 - DNA, 201 bp, Homo sapiens
tgtgtttgtcacagaaaacagaacctaaaggtcttaacattttaacttcattggtttacctttgactgcctttaggtcctatttttcttaggaaaggtggraagaaccaacacaatttattgaacagaggggaatcataggagactctgtagaggttttatgtctgtactaagatgatattgcattatcaatttaaaaaca

SEQ ID NO: 23051 - DNA, 201 bp, Homo sapiens
caactactgacaatggaaccagctgcactgccaggttgaaaagcctaaataaccttcatatataacatttcttccatgaccccatcattggcttagttccstttcactatatgtcaacccaagcaatatagatttaaataggtccactttgccctggcacttggctttgtgggagagagaagaggaggggtgagaatgaat

SEQ ID NO: 23052 - DNA, 201 bp, Homo sapiens
tttgtatttctctgataattagtgatgttgagcattttttcaaaagtttgttggccatttgtgtatcttcttttgagaattgtctattcatgtccttagcscacttatggataggattatttgcattccttatagattctggatattagtcctttgccagatgcatagtttgtgaagattttctcccactctgcgagcttc

SEQ ID NO: 23053 - DNA, 201 bp, Homo sapiens
gttttatgtgagtgaggaaaaagcagacagtcaggaatggttctcctgccgaacataaataatgtttgtttaagcagaatgcttaggagagcctgagagaytgcatgatcaacattcagaccagaaagcagaaagcctgggaaacctgcctccctctccggaacttcatgatggccagggtggctatcgttagaatgttac

SEQ ID NO: 23054 - DNA, 201 bp, Homo sapiens
tttctggaccccttggcagatgattttggttgtaggcttaaggccaaatgcggctgtagccaagccccttcagggactgggctgtttctgggcttgaaccmagaagcaagtttggcagagcagatctgtcagctgggtattggtctgcactctcaaaatgaccctcctaggtcatgggctctgctaggctttcacagactc

SEQ ID NO: 23055 - DNA, 201 bp, Homo sapiens
atatgtcaatcacacatttttagaagggggcaacttcatgtataatttggttttcttattgggtacatctgtcccattctaaacttttcatactttccagmtattttttaaaaaatagatgaaactagggagaggaaatcttacacatatgtgaatcacacctggctttggctcagtttagaaccactttaggcctaggaa

SEQ ID NO: 23056 - DNA, 201 bp, Homo sapiens
tgtgaatagtgcctcaataaacatatgtcaatcacacatttttagaagggggcaacttcatgtataatttggttttcttattgggtacatctgtcccattytaaacttttcatactttccagctattttttaaaaaatagatgaaactagggagaggaaatcttacacatatgtgaatcacacctggctttggctcagttt

SEQ ID NO: 23057 - DNA, 201 bp, Homo sapiens
tacaaaggacatgaactcatcattttttatggctgcattgtattccatggtgtatatgtgccacattttcttaatccagtctatcgttgttggacatttgsgttggttccaagtctttgctattgtgaatagtgcctcaataaacatatgtcaatcacacatttttagaagggggcaacttcatgtataatttggttttct

SEQ ID NO: 23058 - DNA, 201 bp, Homo sapiens; identical to SEQ ID NO: 3860

SEQ ID NO: 23059 - DNA, 201 bp, Homo sapiens
gaagcaaggccagaggtcaggcctttgtataattttgtttcgcattctccagacaccctaattttggaagcaggggagggagaagacagcctgctaaagarcagtccctgaccatctgctgagaatgaattgtagtgtctgtatgcacaaatgtctataccaggatagttcttaggatttttgctgaagactactaaagaa

SEQ ID NO: 23060 - DNA, 201 bp, Homo sapiens
ccatgatgtcaccacaattcacaaagaattacagttaatgccatgtgaagtgaggccaaattcaacactttccctcttgggtacttcacagtctgagagamagaagcaaggccagaggtcaggcctttgtataattttgtttcgcattctccagacaccctaattttggaagcaggggagggagaagacagcctgctaaag

SEQ ID NO: 23061 - DNA, 201 bp, Homo sapiens
ttaaaactctttaaatataaatttccagaaaaattttcggaggtacacgtgtgagttccagccatcatagtagaatagctactttgtggtgacttactgarcagacacattccagtaagatccacatttgtaccagggcagaataccagctgctatcctgtcttctcaacaaaggactcttgtgtttaaacaaaaactgtg

SEQ ID NO: 23062 - DNA, 201 bp, Homo sapiens
agaactgaactcgtactgagagtgatatattcaagccatcacatccaggttgagttgttggttgcaccacaatgtcatgctgcctcttttgtggtttaggkttccacatcacatagattcttggtataaataatgatgttccagggtaagaagtggccagggaagtgaacatgtggatcaaaaactgagatgcagcactat

SEQ ID NO: 23063 - DNA, 201 bp, Homo sapiens
agagctaaggaaggatgttttcagaattctaaacatttctctttaatttgagtagaatgcagaggagatgatttgctactccacagcaatttcagaaaagyatttttcatttctaacagaaccctaccagaggtcatttcccaaagagccaaccatgcttgctggtattccattggctactttagcagggtagagggaagt

SEQ ID NO: 23064 - DNA, 201 bp, Homo sapiens
cttttctcttaggattttgtgactcctgtttgattggttcattgttaattctgattaataagaatttaaattcccaacttccagaagactacttttccttytaaaaagatcgtaactgatttgcttttggcttattcatttagattcagggattcttctccattaaaataaataaattttgaatatcccttatactaagat

SEQ ID NO: 23065 - DNA, 201 bp, Homo sapiens
tccagcagctcacctttcatctggctctggaaatttggggatcattaaaaatcagccagctcacttttctcttaggattttgtgactcctgtttgattggytcattgttaattctgattaataagaatttaaattcccaacttccagaagactacttttccttttaaaaagatcgtaactgatttgcttttggcttattca

SEQ ID NO: 23066 - DNA, 201 bp, Homo sapiens
tcagctggatttaaactagactatagcaggaaagaaaaagaattcatttctatgcatgtgagtggggggttagtggaatcttaatctttctgaatgggaaratgtatgcagtcctttcttttcatctcagcgcctttgagtgaatttgcttttgtctaaaatgaaaggagaaacagctcatttttccattgtcataatagt

SEQ ID NO: 23067 - DNA, 201 bp, Homo sapiens
gtttcagctggatttaaactagactatagcaggaaagaaaaagaattcatttctatgcatgtgagtggggggttagtggaatcttaatctttctgaatggkaaaatgtatgcagtcctttcttttcatctcagcgcctttgagtgaatttgcttttgtctaaaatgaaaggagaaacagctcatttttccattgtcataat

SEQ ID NO: 23068 - DNA, 201 bp, Homo sapiens
ggaccattcactggtaaaatggtaggatacatgatactgccattgccacttctcccgcagtgcagtccctcacacagcctaaaaccatcagcactaccatrtactcttgttcgaagctgcaagggaccagaaagcaccgcactgtcacattacttctactttcctgttgactcctgcagattcgtaactcgggctccgctg

SEQ ID NO: 23069 - DNA, 201 bp, Homo sapiens
gttagttttctttgggaaaatgtacatgggaatcatcttggcccagttatttgaccagcttattgggaggtcccagaaatcggagtgaaaattaaagttgmttgtcttctcccacagccttctagggtccagctgacaaatggagggagtaactgagtttttccaatatgaattaatcattcctctcagccagctgcttgg

SEQ ID NO: 23070 - DNA, 201 bp, Homo sapiens
gcactaggtcataaaagatctcattaacatttattttgaattttgtagaagaatctaagaatgcacagttgttccattgtcttgctagatttttgaccttsttccttccctacagctctttcatcttccaagtcatacttattaccaacaagaatcattggaacatcatcagtgtctttaactcaaagaatctgttctctc

SEQ ID NO: 23071 - DNA, 201 bp, Homo sapiens
attgagatattgttctcccttgctctgtggcaacagaactcagaagataatgatagtgaaagcttatgcaaggaccattcactggtaaaatggtaggatamatgatactgccattgccacttctcccgcagtgcagtccctcacacagcctaaaaccatcagcactaccatatactcttgttcgaagctgcaagggaccag

SEQ ID NO: 23072 - DNA, 201 bp, Homo sapiens
catcttcttcacctgtaagagaataaccaagtcctagggtatgggtgaaggtagtaaccacacagtaacccaatcattttggaaaatgcaaggccttaatsaagtcataaatctggatggagctacttttcatgctgagaaatatatcaagttcttctaccagatgcccaggatcatgggagacgttagcataccccctgc

SEQ ID NO: 23073 - DNA, 201 bp, Homo sapiens
acataccccctttaaaaaaaaaaagaaattgcaatttccattaagtaccagttttatttaaaagcaaataaattgtttttaagtaagtaatcgtttttatracataaatttgtgttttcagtttgattcttaaaccatcaacatttgaattacctagttcgctgggcatgggcccagaagtttgccttttagcaagcatct

SEQ ID NO: 23074 - DNA, 201 bp, Homo sapiens
atgtgaaacatcaatttcattccttacagaatctaatcttggtgtgcgtgatagataagtatacacagagaggggaatttctgacctaggactctcctcamaagtatggtatgacccaagtatgatccacattctagagttcattaaaaggccatctcatctgtggattgaaattacttccttagctccaggcagcctgca

SEQ ID NO: 23075 - DNA, 201 bp, Homo sapiens
gtggtttgagacttggtttctttcttctttaatatacttttgttttgaaataacttcaattttacaaaagagttgaaagtggaatacaaagaactttttckacctcatccattcgggagtaagttgctgacataatacctcattgcccagtgcatattccttcaaggtttctcagttatcccaataatgtctttagtagca

SEQ ID NO: 23076 - DNA, 201 bp, Homo sapiens
agtttaaaaaggattttgctgaccatctgctgttctctacccatgagaacctatcaaagcaaatcttacaaaatagatcaggccagaggtagggtaggccmaaggagaaaatgatgataacaataattgtattcgtgttctagaaacataacctagtaatatgtctatatctgtttaagagttcgaactcttttatccttc

SEQ ID NO: 23077 - DNA, 201 bp, Homo sapiens
tccaagtgctctgttcagggttggcgtggggttttatacattggaatgatcccatggtttgtgtcctgtctcttctgattcttcccttggggtgggctgtrggcatgagcagtggcctgtcaacacttgggaagggccacgtgtatagtgtgtttactgaagttgtgggcatgctcacttgaggcgtttttcccttatcag

SEQ ID NO: 23078 - DNA, 201 bp, Homo sapiens
aggcagaccctactgccttggttccaagccaactttgtaggagacagaggacagggcacctcagtcagaaaagctgtttccaaatcctcagcatctgattsctcataaataaaggctcttggccctgcctgcttcttgaagtagagggatcgggtaagttaagatttcccttagggaccaggtcctggaagcagaaataaa

SEQ ID NO: 23079 - DNA, 201 bp, Homo sapiens
tacaattgaccatccgtcttgactggtgattctcgttgaggttgtgaaaattcatggcattcacagagttgttcatgtggttattaacagtgggcgtaagktaaattcccatttggtctatttgtctatttttctcataaggcctttgtatatcacaaagtcaggaaacacttggtgctttatgtcaaggatcaaatggaa

SEQ ID NO: 23080 - DNA, 201 bp, Homo sapiens
gcatctatttactataccaggcactgttctaggtactgaggacacagtaataagccaaacaaattgatgtttgtagtcctttgcagtgtgattccagtggrggcacttagagtctgatgggaaagttcaagtaagaaaagcacgatggaaatggcaagagctgggggcttttcaggtctcagcttggccaagattgctttg

SEQ ID NO: 23081 - DNA, 201 bp, Homo sapiens
gctttaagaacatatgcaacactgggtaatttggaaaaaagagatttaattgactcacagctcttcaggggtggggattgtaagtaggaaacttacaatcrtggcagaaggggaagcaaacacatctttcttcacagatgtcaggagaaagaagaatgagaactgagtgaagggagaagccccttataaaatcatcagatc

SEQ ID NO: 23082 - DNA, 201 bp, Homo sapiens
atccctgctaagagcggcaaggctcttgttgaccctaaatctcatgcaaaaaggtgaaggaattacttctttctccaacactgaggttaagactgggacamtataatataatatcacgctggtatgaaaactgtgtttggaatacaggacccaggcctggagtctaaaggcagagctcacagtgttcacatgtaaccctct

SEQ ID NO: 23083 - DNA, 201 bp, Homo sapiens
attagaatgtgcaaactgatatagtagctttcatatgctcttaaagggtaccaccacaggaaagtccatttaagatgctggtaggtttaacaaagttggartgttggcactattgaattggacaacagttcttcagagctgactcagagctgcaatgcacttagtacattaaagcagctgacatgatgactttttgcgagc

SEQ ID NO: 23084 - DNA, 201 bp, Homo sapiens
tttatcagagactaggattgcaacccctgccttttttgttttccatttgcttggtagatcttcctccatccttttattttgagcctatgcatgtctctgcrcgtgagatgggtttcctgaatacagcacactgatgggtcttgactctttatccaatttgccagtctttgtcttttaattggagcatttagtccattgaca

SEQ ID NO: 23085 - DNA, 201 bp, Homo sapiens
cctctgagtacagaacatcctctctgagtgatcttttgaaggttctagaaaaaaattcaatggagacaaagcagaatgaaaacacaggtacacattaaatrtaaaagccttcattctcaacaagcagtacttgatactggagaaaaagttctgacccaggaacatactgagtagaatcctttccttggtttctcccctacc

SEQ ID NO: 23086 - DNA, 201 bp, Homo sapiens
tatagtttcagctggatttaaactagactatagcaggaaagaaaaagaattcatttctatgcatgtgagtggggggttagtggaatcttaatctttctgaatgggaaaatgtatgcagtcctttcttttcatctcagcgcctttgagtgaatttgcttttgtctaaaatgaaaggagaaacagctcatttttccattgtca

SEQ ID NO: 23087 - DNA, 201 bp, Homo sapiens
gtactataatcttgaacacttttggtgctaaagctgccaattttcctgattttgtgtaattttttgaggttcacaaatagaaacaagtgtacaaatattcyattcacatgctttctaaatgtttttattttacctttgactgaaaggggtcaaagctgagtataaaggtgctttgatattggaacacactctccttgcgtc

SEQ ID NO: 23088 - DNA, 201 bp, Homo sapiens
tgtatgttcaagtccttgtctgcaattcttgtaggtagataggcgcaaaagtagcattacagaatcacgtggtaattgcatgtttaatttttttaggaacrgccatactgttttctgcagggctgcaccattttacattcccaccagttctgcctcctactcatgcctactcttagtttatgaagccctctagagcatagc

SEQ ID NO: 23089 - DNA, 201 bp, Homo sapiens
aaactattatttctaacacttatggtttactctttaacaagaaggaaaactttgaagaggaaactttcactttctatgctccccattttcccctcttcctracccccagtaatcaccatctattttctttctctatgaatttgactatttggggtgcctagtataatgaaatcatataatatttgtcctttttttgtctgg

SEQ ID NO: 23090 - DNA, 201 bp, Homo sapiens
ggacaaaacgaaacttctgctgcaaacatgagcctcctctcttctttagccaaaagttcaccagggttcaaacaatttcttaatggattccagcaagattytgtggggctataagaaatgtttctggtttgcagcgtagaggaatgtgtcttgcacagtaccagcactggaatcaggacccacctggattcaagccccaga

SEQ ID NO: 23091 - DNA, 201 bp, Homo sapiens
aaacacagatggaagtggatggtatgttgaaattcaaagttctggggcagtctggttcttgacattatgctcacatgtctcctacttagtaaatacaactyagggatttaggccaattcatcagttctatcagatccaagtgtgtttaaaaatagtgtcccagggataaaagtcctagcaataaatgagaatcatggataa

SEQ ID NO: 23092 - DNA, 201 bp, Homo sapiens
acaagtgccagggcaactttgaggtcctcagctacaggtgtgcacagatctggcaaaaaataacttagctctaatcatattctgactctttctgtctccarccaattttcaaattcccagggaagagagtctggcctagtctaagtgtctctattactgaattaattagccatggccaggggatggagtgactaacacagt

SEQ ID NO: 23093 - DNA, 201 bp, Homo sapiens
attcttttggttacaagcaatagaaatttagtctgctcaacctaagatcaaaaggatgaatcattgaaaggataaagattaatgacaagaacatcaactawgtatttagcaaaataagtattgggcaactagaaccaaacagaaagctcaaaggccaggcctcaagaagcacaagtgccagggcaactttgaggtcctcag

SEQ ID NO: 23094 - DNA, 201 bp, Homo sapiens
ttaaacaaaaaatttaaagtactttatttggattatttattcatttttgttcgtctctttttatttggattattcatttttgtttgtccctttcaccattwctaagtgcacttcagtccctgtgctaaatttccctcccttgtggccagatgatcacaggaacattccatttacttaaaagtagttgtattatttaaaaaa

SEQ ID NO: 23095 - DNA, 201 bp, Homo sapiens
catcatatatttttcactaggataagaaaggattttcttacagccgtgctgtgagaagttttgcgttttctctatatcttagtctttaaaactatggaaargaattgagtatgataatgcagttaccccaggtaaaaatcttctatgctttcaaacatgtgcgtagccatcaataagaaaaggattccttgctatctgaga

SEQ ID NO: 23096 - DNA, 201 bp, Homo sapiens
ttttaagaacctttaaacaaaaaatttaaagtactttatttggattatttattcatttttgttcgtctctttttatttggattattcatttttgtttgtcyctttcaccattactaagtgcacttcagtccctgtgctaaatttccctcccttgtggccagatgatcacaggaacattccatttacttaaaagtagttgta

SEQ ID NO: 23097 - DNA, 201 bp, Homo sapiens
tggatgaagaatgtctcttagcagtaatactggatgtagtctctgcttttaccagctgcataatctaggactattatataagtaaaaatctctcttgtgawgcttgaaagtgattagaatgtgcaaactgatatagtagctttcatatgctcttaaagggtaccaccacaggaaagtccatttaagatgctggtaggttta

SEQ ID NO: 23098 - DNA, 201 bp, Homo sapiens
tcaattgtccttggaacctccttataaaaagtagtccaaaccttgcccaacagtctaaatgttgtatcattctgtcttcatgaaattgttgacataaggtwctttttccttctcttcagtttatgttttctcaaccttgtactcttaagaaccattaaggacttgtctcacataccccctttaaaaaaaaaaagaaattgc

SEQ ID NO: 23099 - DNA, 201 bp, Homo sapiens
tatctttgttctttttatttaggatcactttggctattcaggctcttttttggttgcatatgaattttagaatagttttttctaattctgtgaaaaatgakgttgatagtttgataataatagcattaaatctgtagattgccttgggcagtatggccatactaatgatattggttcttctaatccataagcacggaatgc

SEQ ID NO: 23100 - DNA, 201 bp, Homo sapiens
gtttctctcttccttctttccacccctctcagactttctgagaaacatttccatattcccatctaaactccaaaaactgatgtagagtttagcatccatcrctttttcttggccctgtttcttcaatattcttattttccccctgcatccgagatgtttaatccacttgttaaattaagtagcacagaaatagggctattt

SEQ ID NO: 23101 - DNA, 201 bp, Homo sapiens
tattacaaatctgctgtgaaattcatgtacattaatctttgtatgcacacatagtttcatttctcttggttaaacacctaggagtgaaatgacttgctcgwatcataggtatatatttaacattttaagaaacagccaaactgttttccaaagtagttgtactactttacattcccgccagcagtgtaagaaagttctgag

SEQ ID NO: 23102 - DNA, 201 bp, Homo sapiens
taagttgctttaggcagtatgaccattttaacaatgttgattcttcttatcgatgagcatggaatgtttttctatttgtttgtgtcatctctaatttcttkcagcagtgttttgcagttctctttgtggagatctttcaccttctttgttattcatttataagatacaaatacttctttatacgtttgacccatatttgac

SEQ ID NO: 23103 - DNA, 201 bp, Homo sapiens
aatagggaatccttcccccatttcttgtttttgtcagtttatcgaagattagatggtagtaggtatatggccttatttctgggttctctattctgttccaytggcctatgtgtctgtttttgtaccagcaccatgttttttggtgaccatagccctgtaatatactttgaagttgggtagcgtgatgcctccagctttgtt

SEQ ID NO: 23104 - DNA, 201 bp, Homo sapiens
agtaaggggggaaaggagagttggagttttttaagccatgtgtcagagctcattcttcttcattaagtctggagtgttgagatccccagtaggtgagactrttccagaactggctgttttagttatcggacaccctggtattgatttcacctcaagccactgctacaactctccaaagggaatgttgcctgagcaacacat

SEQ ID NO: 23105 - DNA, 201 bp, Homo sapiens
tgaacttctttattttagaatcactatgagaaactctcataactgttcatcacagcctggtcacaagcagggtggcagcaattgtttattttcaagttcartaactcttttgggtcactcaggtgccatttagcatgctggaaaagttagcctgttcatattttttcatgatagctttactttcagtctcccttattctgg

SEQ ID NO: 23106 - DNA, 201 bp, Homo sapiens
cctcggaaacattgggcagaaagccaggactggacaggatttatggatgggtgactgtttgcaggtgggaaggaggcagcagtcgggggtggccaacaggraatcactaaattgcctacagaatccagactcaccagtggaaacttggctgactttccatatgaggtgaatgcagttgttagtctggactctgtggcttgt

SEQ ID NO: 23107 - DNA, 201 bp, Homo sapiens
gaaaaatatttaaactttacacttctgttttcacaccgagagttgaagatataccaacacataggtccttctagaccctgcccactcagatttcagagagkcccaaacgggttttcatctcactggtggctgcataaacctccagccatcttaagaagccacagaaaactggctcagagaaagatgttatttgttttgcgc

SEQ ID NO: 23108 - DNA, 201 bp, Homo sapiens
gagcatcgccagtggccaagccacttgtcccatttctcagtcacaacccctccccattcattccactgactactaacagcatagattaatgttaccaggtktttttttttttacttacggaaaggaaattatacagtatgtactcttgtgtctgccatctcttactcaacattatgtttatttcatgtagtttcattttca

SEQ ID NO: 23109 - DNA, 201 bp, Homo sapiens
tttaacttgcacttttatgtaagagagactgtttctttcctaaaaccttatgaaccaacctctgctagcttccaacttttcctctgcagcttcctcacgtstctcagccttcatagaattgaagagaggtagtagggcttgctctggattaggcactagattaagggaatgttatagcaggtttgatcttctaaccagacc

SEQ ID NO: 23110 - DNA, 201 bp, Homo sapiens
cacaggatgctggtgggtctgacatctggaacacatgccttccaaggtctccataggggttacctctatcctatcaaccaggagaggggaaaacagaatayggaggatggttgagaaggcttttaagggccacgcctggaaggagcatacattaagacttttcacaatcctttagtcacatggccacgcacaactacaaag

SEQ ID NO: 23111 - DNA, 201 bp, Homo sapiens
taatctgaatgaagtgagaatgctttttatgtgtgtttttaagaacctttaaacaaaaaatttaaagtactttatttggattatttattcatttttgttcrtctctttttatttggattattcatttttgtttgtccctttcaccattactaagtgcacttcagtccctgtgctaaatttccctcccttgtggccagatga

SEQ ID NO: 23112 - DNA, 201 bp, Homo sapiens
ggtattattctttctgaagcaattgtgaatgggagttctctcatgatttggctctctgtttgtctgttattggtgtataagaatgcttgtgatttttgcayatttattttgtatcctgagactttgctgaagttgcttagcagcttaaggagattttgggctgagacagtggggttttctaaatatacaatcatgtcatct

SEQ ID NO: 23113 - DNA, 201 bp, Homo sapiens
ggagtaatttgtaatttgggatctgctgccatctactccttatttaccatggcttaggattaaattggataatcttcagtcatatttctaattatttcaaytctctctattattaatatgcttatcaagttgttgaccctaaaatactagtctttccaaaacttgaagtacaaggtttaaaagtatattaaaaatttgaaa

SEQ ID NO: 23114 - DNA, 201 bp, Homo sapiens
gagtcaataaatctctctgttggctatttttgtctcttgatgaccaagccctccctaaaacacataaattattcatcttaaatgtcttttttatcttttartatatttgtgccttgctctcatttccttcaggctgtgaaacagagcctgttgatgtgagctaaattttgctgtattctaggctaggagtaatttgtaatt

SEQ ID NO: 23115 - DNA, 201 bp, Homo sapiens
gtgaacctatgtgaggtgatattgttacaattttatagaggaggaaaatgaggttatgagagattttgtattgttgatttattcattcaacagatttttaytgagcatctactaatgctagacattatgctaaaataccagaaatgcaactatgagtacaggatgcaatgggaacatacagaagaagtgaaacactgtaat

SEQ ID NO: 23116 - DNA, 201 bp, Homo sapiens
tatgtgaacatttcacatatgttaccacctttaatccttgtgtgaacctatgtgaggtgatattgttacaattttatagaggaggaaaatgaggttatgasagattttgtattgttgatttattcattcaacagatttttattgagcatctactaatgctagacattatgctaaaataccagaaatgcaactatgagtaca

SEQ ID NO: 23117 - DNA, 201 bp, Homo sapiens
ccatcatgtctttaagaagcttataattgtgtagtgatgagattcaaacaaaaataactataatcagcagtacgtggtgtgggctttaattttgtatccawtcagatacaaatttgaagtccagcttctgatcttactatctgtgtgatcatggactaatttactaggttcttttagcttcaattttttcatctgtacaaa

SEQ ID NO: 23118 - DNA, 201 bp, Homo sapiens
aggttacctcctattctgctatcttggtgacatcatccccacagaagacagttttgaaactgaaagggaatttgaaattttgtagtttaatatttccatttacatttaagatatctgaagcctaagtgggttcaatcaatttttaaaaaagttctgccgtgtgggtctgaattaggttcaatggggacatgaacgtaagtg

SEQ ID NO: 23119 - DNA, 201 bp, Homo sapiens
ctcaacctgaagaaagagacaggtggctccagagcaagacttgtaacgaattctccccagggagagaaataccgaaagtttagctcactctttcctcccayaaagcacactgaatgttaacagcttgcttctgtccaagctggtgtcttttcaattaagtattgttaaatccataccatttggaatgatgcttcagacagc

SEQ ID NO: 23120 - DNA, 201 bp, Homo sapiens
atttttcatcacacatcacaatccaatcaagaaatggttccttgttgtcgcacagaataagagaagatgacatttcaaaattatgatattttttctgatcrgctcatgaggtacccacttatcaagctttatcatctttccaatttgcttcaaatgctgaatgtccacagattggttgccattgagttattttgcaacttc

SEQ ID NO: 23121 - DNA, 201 bp, Homo sapiens
tccaatatggaggtctggagttctagaaaaactagaaaactctataagaagtatagaggtaaagttgggtactaacattttttaaaatcatttttaatctrctaatgcctaatcttagcatttccaactgttaaaattatcaggtatttcaaacagtgagacaactgaatctgtttcattcccatagtaagtagcattttg

SEQ ID NO: 23122 - DNA, 201 bp, Homo sapiens
tttcctgtcctcctcctccatctgaccactgggacaatccttcaagaaggctacagtctgctttgccactcagtatctccttcctgacaaatctttgccaycttcttcgttctttagacaacattatacctgttgtttccagagaagcatctctgatctactgccctactcaagggttgtgggcagcattaatcataaccc

SEQ ID NO: 23123 - DNA, 201 bp, Homo sapiens
atattaaaggcaatctgttgaagacattatactgaaaggactatcatattttaaagacaagatcactgtctccataggtttttgaaacatttttaaaaacyatatagctgtattaattagagcacttattttctacaataatagtgaccttaaatttctttaaaaaaattacaataagctacaagtatcaaagaagcaaag

SEQ ID NO: 23124 - DNA, 201 bp, Homo sapiens
atattagagtattaaagaaattttagaaaacacagaaaaatttaagagtccaaaaaggaaagaaaacagcttgttcaaagtcgttctctccaaactcaacmacagctgacattttattaatttccttaatgattcccttttatcctgctttatttcctctcagtaataaacatttgtctgtgtcataagcataattttaat

SEQ ID NO: 23125 - DNA, 201 bp, Homo sapiens
atagactggatacccaatgaatgtgttaagtgactgcaaattggaaaacattatacaaaaagcgtgttaaccaggaagcactgcccaggactcactttccscattggagtgcttattgtacattgtctcattagattttttgagcagtatgttcagagcagtttctggcttcgttagaagctgggcatgacctttatggtc

SEQ ID NO: 23126 - DNA, 201 bp, Homo sapiens
ttgtgatgtttcccttccagcctcatcagtgaaatctagaaccaagtcccttcagcccctgtactcctagatagggagtaagacaaaacccctgacagggrttggcatgaatgagctacccctctgtgcagggattaatggtggtgccagtagagccctttctgcagaaccatcacccctcaacacacacctgatcactat

SEQ ID NO: 23127 - DNA, 201 bp, Homo sapiens
cccaatcctgcctcgctccccaccaccacaatattaagttcagctctggtcattggtttcctgtcctcctcctccatctgaccactgggacaatccttcargaaggctacagtctgctttgccactcagtatctccttcctgacaaatctttgccatcttcttcgttctttagacaacattatacctgttgtttccagaga

SEQ ID NO: 23128 - DNA, 201 bp, Homo sapiens
aataactttgataagaatcagggaggccaccatttttgtgtctttcacagtgccttgcttagtactagtatagactggatacccaatgaatgtgttaagtkactgcaaattggaaaacattatacaaaaagcgtgttaaccaggaagcactgcccaggactcactttccgcattggagtgcttattgtacattgtctcatt

SEQ ID NO: 23129 - DNA, 201 bp, Homo sapiens
aacagccaagtctgattttctctgaaatattctgatagctttaggctatctgaaatatggccagacctggtggctcacgcctgtaatctcagcactttggkaagctgaggtgggcagattacttgagccctggagttgaagaccagcctaggcaacatggcaaaaccttgtctctacaaaaaaatacaaaaattagccatg

SEQ ID NO: 23130 - DNA, 201 bp, Homo sapiens
ttgccctctcctcaatctctgccttttcaaattccttctgtatttaatattcagatcattcctatgagttgttcaccaggcattatgctgttgtgtgttcyattctgattcgtgtggatttgttcaagtaaataataactttgataagaatcagggaggccaccatttttgtgtctttcacagtgccttgcttagtactag

SEQ ID NO: 23131 - DNA, 201 bp, Homo sapiens
agatataccccacagtggcatggccacaccaaacccaggttccccgatcataccctgtctgcagagtagataggcagtggcaccccatgctttggtggttkcttcatcttagatcttcatcatatgaaggtttacctcaatttgttacttataagacatgaaaacccattttagagtaagtaggaggaatatcttaaccta

SEQ ID NO: 23132 - DNA, 201 bp, Homo sapiens
gagccctgtgctaggttggggatacaaagacaaattagacacaaattctactctcagggatatagtgctagtaggaaagccaaagcatgaacctcagtcgytctgaaagtagaaagtgctacagaaatttagaggaagaaagattaattctgactgggacagataggtaaaattgatctttttatgtgtatgtttttcttt

SEQ ID NO: 23133 - DNA, 201 bp, Homo sapiens
aagaattgcacaacagagtttttgtactttgggccaagaagtggcacacttcacgtctgttcatgttccatctgctagaactcagttccatgctcatagcyaactgcaaaaaggctggaaaattatctagctgtgtgcacaggaagaagaggaaaagggtttggctgatagcaagtcactctctgccatggcttctaaaat

SEQ ID NO: 23134 - DNA, 201 bp, Homo sapiens
ttgaagtacaactcatttttgatggcaaagactaggggaaattattttgaagtatattcgtgacttacaatgttaaaggaatggaaggaagacccattggwtccatccattcagggtcaacaaacgttcattaagcctgggttaaatggcacttactaactgttacagaaaaacaaacctataaatatatgatgggtaaaa

SEQ ID NO: 23135 - DNA, 201 bp, Homo sapiens
atagtgtgtcaaacaggcccagagatgcatagataaaggagacccagatcccatcttcagggagtttgtaatctataattacaacagcagtgtagtatgargtagaatgaagtgctataactgataaccaaatagtatgcaaggacagtacattcctgccaggaggtcttagggttgcaatgagtggaattttgataagag

SEQ ID NO: 23136 - DNA, 201 bp, Homo sapiens
tatcttgtttaattttccctcaagatcgtaggaactagtaggtactactgtagttaccacatcttagatagaaagctgagggacagaggttggacccacayagaaacactggaaatggtctgaacacaggcagcatgccccagagcttgtgcttttaacctgcccctctgtccacgccctccagcccccacaactcatact

SEQ ID NO: 23137 - DNA, 201 bp, Homo sapiens
atgtatcattatcaggatgacagcatgtatcacttccttgtctctctgggtcatagccattcataatgtagaatcaatagtggtagtagaattaataataytttttaccgctacctgtgccttactttgtacatattttgtctcttttaatctttacaggggccctggcaatgaagatggttgtcattaattgattagtga

SEQ ID NO: 23138 - DNA, 201 bp, Homo sapiens
aggagttattcttgaattaaggccctaaaacatcaataattcaggatcttctcatctctcttactttctccccatcattccctaccctgctccctattctstctcattctctttcttttacccttctttctatttgtatatctgaactttgaaaacatctttacccatgctacctttttttctttcttagcttgatttaaa

SEQ ID NO: 23139 - DNA, 201 bp, Homo sapiens
ctgattttaattatttgagtcttctctatttttttctttgttagcctaactaatggtttgttgatgttgtttatcttttcaaaaactcaacttttcgttttgttgaccttttgtattagtttttagtctcaatttcatttatttctgctcacatcttcagtatttattttctgctactaatttagggtttagtttgttctt

SEQ ID NO: 23140 - DNA, 201 bp, Homo sapiens
taacaatattaattcttctaatccatcaacatggaatagctttccatttttttggtggcctcttcaatttctgtcatcaatgttttagttttacttatacrgatctctcacttctttggttaaatttattctaaggtattttttctttagtagctattttaaatgggattgctttcttgatttatttttcaaattgatcac

SEQ ID NO: 23141 - DNA, 201 bp, Homo sapiens
ggcaacagtcatcaccctctctgaaagagcagaggagcaaaaccttggcaactcacataatgagcccttgtccaaaggaaggcaaaaaaaaaaaaaaaaaaattcctccttttgtatagctaatacaaacacaagctgccaagaagggtcaaccatcatgggtcgttgattacccatattaaccctgatggctgcctttac

SEQ ID NO: 23142 - DNA, 201 bp, Homo sapiens
tgagaggagtctccctctgtcacccaggctacagtgcaatggcgcaatctcagctcattgcagcctccacctccccggttccagcgattctcctgcctcgscctcccaggtagctgggattacaggcacacaacaccaagcccagatcatttttgtatttttaatagagacagggtttcaccatgttggccaggctggtct

SEQ ID NO: 23143 - DNA, 201 bp, Homo sapiens
gaagaatctaagaatgcacagttgttccattgtcttgctagatttttgaccttcttccttccctacagctctttcatcttccaagtcatacttattaccarcaagaatcattggaacatcatcagtgtctttaactcaaagaatctgttctctcaagtcttgcaaatcattaaatgtggactgtgctttgatggaataaac

SEQ ID NO: 23144 - DNA, 201 bp, Homo sapiens
gagaagagaggagcaagaactagagttttccaaggatttactaggctttctactcaatgttcccttcttttttttttttcttttttctttttttttttttktttgagaggagtctccctctgtcacccaggctacagtgcaatggcgcaatctcagctcattgcagcctccacctccccggttccagcgattctcctgcct

SEQ ID NO: 23145 - DNA, 201 bp, Homo sapiens
ataattatatcaaggagagaagagaggagcaagaactagagttttccaaggatttactaggctttctactcaatgttcccttcttttttttttttcttttwtctttttttttttttttttgagaggagtctccctctgtcacccaggctacagtgcaatggcgcaatctcagctcattgcagcctccacctccccggttcc

SEQ ID NO: 23146 - DNA, 201 bp, Homo sapiens
ttagggaatctgaaaaatctttaggaatagtagagaattgtaaagcaaatagatttagaaaggggactgtgttgtagggaatggcaaacaaaagaataatmactccctatgtatgtatactgtttgagtaaaagcaaggaagatttccattttagaagtgaaaaaactgaggaccagaaaatatgcttgatctcctgaaag

SEQ ID NO: 23147 - DNA, 201 bp, Homo sapiens
actctctctgcctgaaaggccaattaaaaaggtgaagtacaggccaggcgtggtggctcacgcctgtaatcccaacactttggaaggccgaggcaggtggrtcacctgaggtcagaggtttgagaccagcctgaccaacatggagaaaccttgtctctactaaaaatacaaaaattagccgggcgtgatggcacatgcctg

SEQ ID NO: 23148 - DNA, 201 bp, Homo sapiens
gtagggaatggcaaacaaaagaataataactccctatgtatgtatactgtttgagtaaaagcaaggaagatttccattttagaagtgaaaaaactgaggascagaaaatatgcttgatctcctgaaagctgtatgtttggtcatgccagaaatgggactaaattccacatctcctgagatcccattcaatgttattgctac

SEQ ID NO: 23149 - DNA, 201 bp, Homo sapiens
tgtaatcatggctgactacagcctcaacctcctgggctcataaagcttatgtaactgatgcacttactggggaaattctctcaaattaaaaaaaaaaaaaatgtgtaggtgggcaacagaccccccacctccttctaccatacttttcctgcctcaacttccaccctagactagtatgccaacaaaaatcagagaatgtga

SEQ ID NO: 23150 - DNA, 201 bp, Homo sapiens
agtgtaaatgggaggacaccgtagatcattactgaatgtgctcaggatgctctttgagaagtcagacggcattcttttttcttttttttttttttttttttgagacaaggtcttgctctgtcgtccaggctggaatgcagtggtgtaatcatggctgactacagcctcaacctcctgggctcataaagcttatgtaactga

SEQ ID NO: 23151 - DNA, 201 bp, Homo sapiens
agaatcctatctcagttgctaaggaataaatttcatatataataaatatggagtgatagtactggactttgggttacaagtataaacatgctttaacttakgttcttatgagtatgacagatttgagagcaaatacggtataatttgtaaattataccgtatttgaaaagcattgtaacttatacgtagaaataatgactg

SEQ ID NO: 23152 - DNA, 201 bp, Homo sapiens
cccctttatcagagtcaaaagtgtaaatgggaggacaccgtagatcattactgaatgtgctcaggatgctctttgagaagtcagacggcattcttttttcytttttttttttttttttttgagacaaggtcttgctctgtcgtccaggctggaatgcagtggtgtaatcatggctgactacagcctcaacctcctgggctc

SEQ ID NO: 23153 - DNA, 201 bp, Homo sapiens
gatccctgcccaatcctgcctcgctccccaccaccacaatattaagttcagctctggtcattggtttcctgtcctcctcctccatctgaccactgggacartccttcaagaaggctacagtctgctttgccactcagtatctccttcctgacaaatctttgccatcttcttcgttctttagacaacattatacctgttgtt

SEQ ID NO: 23154 - DNA, 201 bp, Homo sapiens
tacccctttatcagagtcaaaagtgtaaatgggaggacaccgtagatcattactgaatgtgctcaggatgctctttgagaagtcagacggcattcttttttcttttttttttttttttttttgagacaaggtcttgctctgtcgtccaggctggaatgcagtggtgtaatcatggctgactacagcctcaacctcctgggc

SEQ ID NO: 23155 - DNA, 201 bp, Homo sapiens
ccaggcatggtggtgtgtgcctatattcgcagctactcaggagtctgcggctggagggttgcttgagcctgggaggcggaggctgcagtgagctgagatcwtgccaccaaactccagcctgggtaacagagcatttcaaaaaaaaaaaaaaaaaaaaaaaaaatatatatatatatatatatatatgactgtgactaagaa

SEQ ID NO: 23156 - DNA, 201 bp, Homo sapiens
ctttgatgatatcactttgcggctgggcacagtggctcacgcctgtaatcccagcattttgggaggccgaggtgggtggatcatctgagatcaggagttcragaccagcctggccaacgtggcaaaaacccgtctctactaaaaatgcaaaaattggtcgggtgtggtggcgtgcccctgtaaccccagctactcgggacg

SEQ ID NO: 23157 - DNA, 201 bp, Homo sapiens
cagatggaaatgcagaaatcacccgtcttctgcgtagctcacggtgggagttgtagacaggagctgttcctattcggccatcttggctcctccctcctccrtggaattttattgccaaaatatcatttttgtttctttaaaaggagaagactttttagtgcaaaaggaagattttgtgacagtgagcaattgttatatatt

SEQ ID NO: 23158 - DNA, 201 bp, Homo sapiens
tatgtatgtatatatatatatatatatatatagaaacgtagtctcactcttgtcgcccaggctggaatgcaatggcgtgatctcggctcactgcaatctcyacctcctgggttcaagctattctcatgcctcagcctcccgcatagctgggattacaggtgcccaccaccatgcccagctaatttttgtatttttagtaaa

SEQ ID NO: 23159 - DNA, 201 bp, Homo sapiens
agcctcccaaagtactgggattgcaggcgtgagccacagcgcctggcccgggaaaacacatatttttacttagaaggataattaagcaaacataaattatwtctgtactgtaaagttactacagcaaactttttgacttctttgagaaaaagcaactaaccactgcagaactttggaggaaagggagtgattaaagatcac

SEQ ID NO: 23160 - DNA, 201 bp, Homo sapiens
agctcagactaattcaaagaatgtgtaacgaacaagactttgcaccattcttggaaacttacacacaaaaatacctccttatacatataaataaatctcgrgaagcatattgaacaaagaaagttacagaatatgagagccagactaaaaaagaaacaaacttccttaaatatctccaagggcttattttgttatcagtat

SEQ ID NO: 23161 - DNA, 201 bp, Homo sapiens; identical to SEQ ID NO: 3846

SEQ ID NO: 23162 - DNA, 201 bp, Homo sapiens
aatctgttttctaaagaggctgtatcattttactttcccaccagtaatgagtgaaactgctaattttccatatcctcaccaacacttgttgtctttttttwttattattattatggccattctagtggatatgaagttgtatctcatggtggttttgacttatatttcccaaatggactatttcattttaacaatgcattt

SEQ ID NO: 23163 - DNA, 201 bp, Homo sapiens
gaacttgagccctctgttctgtcaaactgttctgtcccatgcctgccttgggactcctacactgaaattattatcttttttctggaaatttccctgtctcycatctgatccctgtttctctgcacccacccagactccaatcatcttcaagaccttggtgaggaaatccctagtgtactataagcattacattattgttac

SEQ ID NO: 23164 - DNA, 201 bp, Homo sapiens; identical to SEQ ID NO: 3840

SEQ ID NO: 23165 - DNA, 201 bp, Homo sapiens
tgctggatcatatggtagttctgtttttcaaatttttttagaaatctttatactgttttctacaatggctgaatcaatttacattcccacccatagtatcmaagggttcccttttctctacatccgtgccaatacttaccttttgtctttttgataacagcaattctataaggtgtaaggtgatattatagtactgaatgc

SEQ ID NO: 23166 - DNA, 201 bp, Homo sapiens
tcccttccatacaatgttgccagattaaccttctcaaaacacctctttcatcatgtcacccccctcttcagtggcttcccactgccttatggaccaattamaaacctcttgtctgaaaattaaaggtctccaaactaaccctcaagctcctgacacttagaacttgagccctctgttctgtcaaactgttctgtcccatgc

SEQ ID NO: 23167 - DNA, 201 bp, Homo sapiens
tatctcttcaacatactgatttcatttccttcgagtatatacccaggagtgagattgctggatcatatggtagttctgtttttcaaatttttttagaaatstttatactgttttctacaatggctgaatcaatttacattcccacccatagtatccaagggttcccttttctctacatccgtgccaatacttaccttttgt

SEQ ID NO: 23168 - DNA, 201 bp, Homo sapiens
tccagagatatggaaattgaagctagagaaagagctagacttgaccaaagtcataacccagtcttctgacctgaaactctgtttttatgtttctacttagyagccttaaaacgaccatgctcttttaaattttcaggcttcttacttccatcccacctgatccttggatttagcgctgtcatttacaataaaataaggaat

SEQ ID NO: 23169 - DNA, 201 bp, Homo sapiens
cacagaatcccatagagacagaattaagccaaagttttagacatttcaaataaaattacttacagattctattctggaagtaagacctctcaaaaggccayacttcttttctctgaaagaaaccctcaatctcctgaaagagtttgatattaaatatttttaaatcctattttatggaagttgctcctttccccccaaaaa

SEQ ID NO: 23170 - DNA, 201 bp, Homo sapiens
ggtcttcctcaagaggaagttctattttgggaactgggaggaggtagcccttatccaacgaatgttactagcttctgagctatctgggttaatgaatggarattccaaacattgaggaggggctgggaatggtgggaagtaatcactgaattgttgggattaaactcaaactggtgccatattgaagtgctcctggaggtg

SEQ ID NO: 23171 - DNA, 201 bp, Homo sapiens
gcactccatttttctgctgaggaatctctgccaaaaccaaacgttcttgtcaagttttggaacccattagccttagtccatccatctttcttcgtgcaacrtaacagacagttgttctaaatcacccctcagtcacatgagaacttagtcttctctgaatcacacaacataattaccatcatccccagcatgctctgattt

SEQ ID NO: 23172 - DNA, 201 bp, Homo sapiens
gtgatcacatttatgctttgaaaacgtcactcttgctatggtgtggagaatagagtgtagagaagacaatatggggtttccaacaggaggaaggaactctytttcaaatgatcacatttgagtgtatcatctatatcctgctagaaacgctatttcttagtccattccggctgctaaaacaaaataccgtagactgagtag

SEQ ID NO: 23173 - DNA, 201 bp, Homo sapiens
ttattatgttgccatctatctcattacttaagtctggtaatgattgttttataagtttgggagctccagtattatgtgcatagttaggattatgatattttcctgttggactagtccttttatcattatatatgtctctctttgtcttttttaactgctgttgctttaaagtctgttttgtctggtataagaatagctact

SEQ ID NO: 23174 - DNA, 201 bp, Homo sapiens
gaaggccctgtgggagaaacaagcttgacatgtttgaggaacaaaacaacaaaaaaaaagtctggctggagtacacagggaaagggggggtgtcgtaaaakataagattacagaggtgtacaacgcttctcttgctctgctatacattcacctagctagaaccatgcttggttcatgattggcatttaataaatttatgtg

SEQ ID NO: 23175 - DNA, 201 bp, Homo sapiens
acaattattatgttgccatctatctcattacttaagtctggtaatgattgttttataagtttgggagctccagtattatgtgcatagttaggattatgatattttcctgttggactagtccttttatcattatatatgtctctctttgtcttttttaactgctgttgctttaaagtctgttttgtctggtataagaatagc

SEQ ID NO: 23176 - DNA, 201 bp, Homo sapiens
acattctcttttaacactcattcgctgcacttggcctctcttgagcctcacagcaacctagtgaggaaaccaagtcacaaggctggtaaatgtgaaagggkccctgtgtgcttcaaactcattttctttttcactatgcagtatggctttcccaagacttctttactatctgctcttaactgttaaactgtgaagacatct

SEQ ID NO: 23177 - DNA, 201 bp, Homo sapiens
caaagattgcaccattgtactccagcttgggtgacaagaacaaaactccatctcaaaaaaaaaaaaaaaaaaggaaaaaaaaagaaagcctttgtgatacygggcagcctgtaaatcttgggtaggattgaaatacaattagtcctctacttacaataaccaacaacaaattttttactttattttggtgaaacagcaata

SEQ ID NO: 23178 - DNA, 201 bp, Homo sapiens
aacaatacaaggagtctggagagaaatcccatgtccaaaataatgggaatttattaagtaagtttataaaattatatatatatatatatatatttccttcrtttagcagatgattgatacatgaggcagattgaccatcctatatagtatcttccctctcctagcttataatgtcatttggaagataaaagactagataga

SEQ ID NO: 23179 - DNA, 201 bp, Homo sapiens
gaatcctatctcagttgctaaggaataaatttcatatataataaatatggagtgatagtactggactttgggttacaagtataaacatgctttaacttagrttcttatgagtatgacagatttgagagcaaatacggtataatttgtaaattataccgtatttgaaaagcattgtaacttatacgtagaaataatgactgg

SEQ ID NO: 23180 - DNA, 201 bp, Homo sapiens
ccatggaaaggaatatctttacatcacctgttacatcaatcttgaatctgtgagaaatgagctttgatgatatcactttgcggctgggcacagtggctcaygcctgtaatcccagcattttgggaggccgaggtgggtggatcatctgagatcaggagttcgagaccagcctggccaacgtggcaaaaacccgtctctact

SEQ ID NO: 23181 - DNA, 201 bp, Homo sapiens
gacggggtttcaccatgttagctaggatggtctcgatctcctgacctcgtgatctgcccacctcggcctcccaaagtgctgggattacaggcgtgagccamcgtgcccggccaggattgaaccttttatgttatcatgtatgtatggcaaagtatcccccaagtaaggatacaaggacaagctttaatagaaaagagaggg

SEQ ID NO: 23182 - DNA, 201 bp, Homo sapiens
ggctgtagtgcagtggtgagatctcagctcactgcaagctccgcctcccgggtttacaccattctcctgcttcagcctcccaagtagctggaactacaggygcccaccaccacgcctggctaatattttgtatttttagtagggacggggtttcaccatgttagctaggatggtctcgatctcctgacctcgtgatctgcc

SEQ ID NO: 23183 - DNA, 201 bp, Homo sapiens
gctgttgatcctttccttaagcttaaggatttaaatgccaacttaaaacataaatagcctcaggattgaacctttttttttttcttttgagacagagtctygctctgttgcccaggctgtagtgcagtggtgagatctcagctcactgcaagctccgcctcccgggtttacaccattctcctgcttcagcctcccaagtag

SEQ ID NO: 23184 - DNA, 201 bp, Homo sapiens
ttgcagaatataagggcctgaagcaactgggtggtataattgatccactgtgaaatctatatgcacacagcatgcagattcatcgtagcatgctctggggtgtgtgtgtgtcattccacatgcgtaaaatcaattagagcatttcattgttcagccctgcctgggtctcattattagccaacattgagtcacagccttgat

SEQ ID NO: 23185 - DNA, 201 bp, Homo sapiens
cttctatcataggacatatttttcaacaaaaattccttgaacaaattgtacattcaaagcagactttccaacgcctcctgggccaagaatgactagcttayactcatgcatgatgcaaacttgtcgaaacctagtacctctcacgctgtcaccgggttcccgcagccagtgtcactccctccgggttgctactctcggcac

SEQ ID NO: 23186 - DNA, 201 bp, Homo sapiens
aataaactaatgcaaagccttgtccatttctcatgtacaaatccctccttgctatacattgttccgttcctgcagtatccaagattgcaagcatacactgytgtgcatctacttcaacttgctttctataagaatcttctatcataggacatatttttcaacaaaaattccttgaacaaattgtacattcaaagcagactt

SEQ ID NO: 23187 - DNA, 201 bp, Homo sapiens
ttgcaaatcattaaatgtggactgtgctttgatggaataaactaatgcaaagccttgtccatttctcatgtacaaatccctccttgctatacattgttccrttcctgcagtatccaagattgcaagcatacactgttgtgcatctacttcaacttgctttctataagaatcttctatcataggacatatttttcaacaaaa

SEQ ID NO: 23188 - DNA, 201 bp, Homo sapiens
ttaccaacaagaatcattggaacatcatcagtgtctttaactcaaagaatctgttctctcaagtcttgcaaatcattaaatgtggactgtgctttgatggrataaactaatgcaaagccttgtccatttctcatgtacaaatccctccttgctatacattgttccgttcctgcagtatccaagattgcaagcatacactgt

SEQ ID NO: 23189 - DNA, 201 bp, Homo sapiens
actggagtttttctgttaatctgccgcactaggtcataaaagatctcattaacatttattttgaattttgtagaagaatctaagaatgcacagttgttccmttgtcttgctagatttttgaccttcttccttccctacagctctttcatcttccaagtcatacttattaccaacaagaatcattggaacatcatcagtgtc

SEQ ID NO: 23190 - DNA, 201 bp, Homo sapiens
aacaaaatttctgatcctgcaccaggcatatataataataacacaactattttatcataatttcctatctaaaaataatatgcatttatcaaacgttaatrtttttgcatgccttttaaaaacacaggattttaggttgattgcatacaatcttattttgcagtttgctccctattaggacataagacactgctttaaagg

SEQ ID NO: 23191 - DNA, 201 bp, Homo sapiens
catacagcagaaagccatcagtgtggtgcttacacagaggccatgactatctgggtcttcacagagagctatccaacagctatctgaagatttttttttcytcaaggcatggcaggattttatttttgagatgtggacattctcttaaaacagtgtaattgaaacaagttctcttttaatttttattaattaatttttaat

SEQ ID NO: 23192 - DNA, 201 bp, Homo sapiens
ttaaagaaagatagaataggaaaggaagttgcctctgtccagaagtaattgtccacttttcaattatctgcccctctgcctgtaattctatcattataatraaagcttgacttatggtcttagcatctgtctttcccctttaaactggaagcatcataaaggcaggtacaataattgactttttactatagctgagtactt

SEQ ID NO: 23193 - DNA, 201 bp, Homo sapiens
gatgggaggtctcatcgatttgctcatttaaccaataacattaactatctaaaaggtgttctgatggaccctgcaagtaatacaaaactgactcagatgcrggccctacatcaggaggtatacactctagcagtgcccttgacaggtagaataactgtaatacaactgagaaaatggtcagtgtctggagcaagtatggat

SEQ ID NO: 23194 - DNA, 201 bp, Homo sapiens
aagtggaataaaccaaacatacagcagaaagccatcagtgtggtgcttacacagaggccatgactatctgggtcttcacagagagctatccaacagctatytgaagatttttttttcttcaaggcatggcaggattttatttttgagatgtggacattctcttaaaacagtgtaattgaaacaagttctcttttaattttt

SEQ ID NO: 23195 - DNA, 201 bp, Homo sapiens
ctggcaagttgatgctgattattggtggggaggctgcagtttcacacatgaactttccttaagactctctgggtattctcatgacatcgtggctggcttcsccaccaccgtgagtgggcaaagagagagcatcaaattggaagcattatcctttttgtgacctagccttggaagtcacatagcatcacttctgcctcattc

SEQ ID NO: 23196 - DNA, 201 bp, Homo sapiens
aaatgtaaagttattctaagatagattatgtaattcttaaattagtttgcttaaactttaaaaggagccagattattgaagtacgtacagaaaaaaagaaraaaattatcttttttctagtacttcgtaatgaaacaactttctcttccctaattttcctcagagaaatagctgaaaacaagatattactattatttatca

SEQ ID NO: 23197 - DNA, 201 bp, Homo sapiens
ttgataatcttggctctcactatttttacggagccaaaacctcacagcgtgcaggcagacttccaggagaagtgtggctgtatctactatttcctgagccrtgcaagttactgtttgatagacagcccccgattctcatggtgtgatttatcatacatgtttctggttaatttttggctttcaaacatatttttgctcttt

SEQ ID NO: 23198 - DNA, 201 bp, Homo sapiens
caggtgatagaataggggacccagatggtcactagacatcatatatttttcactaggataagaaaggattttcttacagccgtgctgtgagaagttttgcrttttctctatatcttagtctttaaaactatggaaaggaattgagtatgataatgcagttaccccaggtaaaaatcttctatgctttcaaacatgtgcgta

SEQ ID NO: 23199 - DNA, 201 bp, Homo sapiens
tccacaattattatgttgccatctatctcattacttaagtctggtaatgattgttttataagtttgggagctccagtattatgtgcatagttaggattatgatattttcctgttggactagtccttttatcattatatatgtctctctttgtcttttttaactgctgttgctttaaagtctgttttgtctggtataagaat

SEQ ID NO: 23200 - DNA, 201 bp, Homo sapiens
tctttatatacacagctatgtatgtctgaaggcaaattagtgagaatgtcctgtcttgcctcttcactcacactgagctctgctgaaatgattccagacaratgtctaggttattcctaaagatctccagggaagtagatatgacagcctcttaatatttttaaatattaagtctatcagtcagtactaagggcacagcca

SEQ ID NO: 23201 - DNA, 201 bp, Homo sapiens
ggagcaggttaattaccatgtatttgcatggttttgaaggttccttttggagttgatgtccaattttcttccactgtggtctgagagagtacttgatatarttttgattttcttaaatttactgagacttgtttcatggcctgtaacatagactatcttggagaatattccatgtgctgatgaatagagtgtatattctgc

SEQ ID NO: 23202 - DNA, 201 bp, Homo sapiens
aaaccaaccttaaatattttggaccaaaccagaataagatgaggcaatctagtctgcccccttggctcatctttaattagaggtaccttgagaaggacagmtgtaagcctcttgataaaatggaatcagatgctcagatcaggcctacaactgcaagattttcccaaaactaagttaattgatgtcctagaaatatttcta

SEQ ID NO: 23203 - DNA, 201 bp, Homo sapiens
ggtgcaacaggagattatatcccgcacctggctcggagggtcctacgcccacggagtctcgctgattgctagcacagcaatctgagatcaaactgcaaggrggcagcgaggctgggggaggggcgcccgccattgcccaggcttgcttaggtaaacaaagcagctgggaagctcgaactgggtggagcccaccacagctca

SEQ ID NO: 23204 - DNA, 201 bp, Homo sapiens
tatataacctcccctaagatagacattgctctcatgttaaagtcagatgggacatgtcttttctaagtcacttgatgaaggcttgatttgtacactgatayaacaaaattgggagcaggctctcctatctttcagagtctgcatgcattctgcatttggacagtctctaaaaggctattacgatgtatgagtggcaggcgc

SEQ ID NO: 23205 - DNA, 201 bp, Homo sapiens
ttatagacaagcagagctaagagtctagtttgtgcatcatttatattctagatcttatctggggctcgctttgaaaacacaaatcaagttggctacttgtsatattccataagcttatatatgtgaaaagagatggaaactaagacctaaaataagtttgaggattatctatagatctcaatgcgtttgtatctctaccaa

SEQ ID NO: 23206 - DNA, 201 bp, Homo sapiens
ctgacctcatattacttaaaatccatagcactccatgagccaaaatctttatagcttgtagaatcaagttgatgctgaatttttttaatgagaatctagawtcttcaaataatttgaagctttattttcttgcttttagtgataacagaagcagcattgcgaaaaaacacacaaaaaaaattttaagaaagaatattttca

SEQ ID NO: 23207 - DNA, 201 bp, Homo sapiens
ttcagagaagaaagttctagaatagagattaaattcttagaagcttcatgtacactgatggtatttgaaactaggaatcattgatgaacacattggaagayagcacaaagccaagtcctgaggcactgcaatattttaattttttttttgagacagagtcttgctctgtcacctaggctggagtgcagtggcatgatgatc

SEQ ID NO: 23208 - DNA, 201 bp, Homo sapiens
ttaattttttggtgatacaagggttgcactggaacaggaagtggatgaggagcaagaagtaatgaaggcttaagccttcattagtagtcacagctactcaygaggctgaggcaggaggatccctttagcccaggagttcaagaccatcctggggagcatagcaaaaccctgtctcttataagaaagaagaagaagaaggag

SEQ ID NO: 23209 - DNA, 201 bp, Homo sapiens
tactggatgtagtctctgcttttaccagctgcataatctaggactattatataagtaaaaatctctcttgtgaagcttgaaagtgattagaatgtgcaaastgatatagtagctttcatatgctcttaaagggtaccaccacaggaaagtccatttaagatgctggtaggtttaacaaagttggagtgttggcactattga

SEQ ID NO: 23210 - DNA, 201 bp, Homo sapiens
aatagtgaccttaaatttctttaaaaaaattacaataagctacaagtatcaaagaagcaaagtcatctagagtagtctacataggagctctttggactttsttttattatggtaaaatagtggtgcttttaggatttacattattgtactctccaatacaaagtatgagtgagggttagagtatacagtacaccattttca

SEQ ID NO: 23211 - DNA, 201 bp, Homo sapiens
aggtttttgaaacatttttaaaaactatatagctgtattaattagagcacttattttctacaataatagtgaccttaaatttctttaaaaaaattacaatwagctacaagtatcaaagaagcaaagtcatctagagtagtctacataggagctctttggactttcttttattatggtaaaatagtggtgcttttaggattt

SEQ ID NO: 23212 - DNA, 201 bp, Homo sapiens
cagcgcaccagcatggcacatgtatacctatgtaactaacctgcacattgtgcacatgtaccctaaaacttaaagtataataataataataataataataaataaaataaaataaaataaaaattttaaaaaaataaaaaataaagaaatttgaaaagtctgcccatttccttcccaacagatattaaaggcaatctgttg

SEQ ID NO: 23213 - DNA, 201 bp, Homo sapiens
acagcgcaccagcatggcacatgtatacctatgtaactaacctgcacattgtgcacatgtaccctaaaacttaaagtataataataataataataataataaataaaataaaataaaataaaaattttaaaaaaataaaaaataaagaaatttgaaaagtctgcccatttccttcccaacagatattaaaggcaatctgtt

SEQ ID NO: 23214 - DNA, 201 bp, Homo sapiens
tacagcgcaccagcatggcacatgtatacctatgtaactaacctgcacattgtgcacatgtaccctaaaacttaaagtataataataataataataataataaataaaataaaataaaataaaaattttaaaaaaataaaaaataaagaaatttgaaaagtctgcccatttccttcccaacagatattaaaggcaatctgt

SEQ ID NO: 23215 - DNA, 201 bp, Homo sapiens
caccagttagaatggcaatcattaaaatgtcaggaaacaataggtgctggagaggatgtggagaaatagaaacacttttacactgttggtgggactgtaawctagttcaaccattgtggaagtcagtgtggcgattcctcagggatctagaactagaaataccatttgatccagccatcccattactgggtatatacccaa

SEQ ID NO: 23216 - DNA, 201 bp, Homo sapiens
accatcactggccatcagagaaatgcaaatcaaaaccacaatgagataccatctcacaccagttagaatggcaatcattaaaatgtcaggaaacaataggkgctggagaggatgtggagaaatagaaacacttttacactgttggtgggactgtaaactagttcaaccattgtggaagtcagtgtggcgattcctcaggga

SEQ ID NO: 23217 - DNA, 201 bp, Homo sapiens
tcttcagtgtttctttagaaaacactgggaatcaaataaatgtaaagttattctaagatagattatgtaattcttaaattagtttgcttaaactttaaaakgagccagattattgaagtacgtacagaaaaaaagaagaaaattatcttttttctagtacttcgtaatgaaacaactttctcttccctaattttcctcaga

SEQ ID NO: 23218 - DNA, 201 bp, Homo sapiens
gctcaccatcactggccatcagagaaatgcaaatcaaaaccacaatgagataccatctcacaccagttagaatggcaatcattaaaatgtcaggaaacaayaggtgctggagaggatgtggagaaatagaaacacttttacactgttggtgggactgtaaactagttcaaccattgtggaagtcagtgtggcgattcctca

SEQ ID NO: 23219 - DNA, 201 bp, Homo sapiens
agttggtggctatagattgtttttaaaatagtttggatacagtcattgacttatataggctatcctcagtaaaagagaaaaacaaactaattatccatcawcttggtcaactgatcattcttccaatggcaagctctgttttcttttgtgctggcaagaaaactaagttgtttccttctatcagagcttccctagtcttca

SEQ ID NO: 23220 - DNA, 201 bp, Homo sapiens
cacgtgaaaaaatgctcaccatcactggccatcagagaaatgcaaatcaaaaccacaatgagataccatctcacaccagttagaatggcaatcattaaaawgtcaggaaacaataggtgctggagaggatgtggagaaatagaaacacttttacactgttggtgggactgtaaactagttcaaccattgtggaagtcagtg

SEQ ID NO: 23221 - DNA, 201 bp, Homo sapiens
tgtaattaataaaataaccccacctaagaggccaatgtatcataagttggtggctatagattgtttttaaaatagtttggatacagtcattgacttatatrggctatcctcagtaaaagagaaaaacaaactaattatccatcaacttggtcaactgatcattcttccaatggcaagctctgttttcttttgtgctggcaa

SEQ ID NO: 23222 - DNA, 201 bp, Homo sapiens
tgtcagtggatctaccattctggggtctgcaggatggtggccttcttctcacagctccactaggcagtgccccagttgagactctgtgtggggcctccaawcccacatttcccatccatactgttctagtagaggttctccatgaggtctctgttcctgcaacagacttctgccttgatttccaagcatttccgtacatcc

SEQ ID NO: 23223 - DNA, 201 bp, Homo sapiens
tggaggtacaggcattgggtaaatacacgcattctaaacgggagaaattagcccaaacaaaggggttacagaccccatgcaagtcagaaacccagcagggyggtcattaaatcttaaagctccaaaatgatctcctttgactccatgtgtcacatccgggccacactgatgcaaggggtgggctccaaaggccttgggcat

SEQ ID NO: 23224 - DNA, 201 bp, Homo sapiens
ggaaagggagtgattaaagatcacagtgtaaccttggaatgaaaatataaaggcttacaattttttgcttctcctctgccagtacctgatttgacaggccwttttgttgctgaggagtaaataagcagttctttttaggggggcattaataacttcttaatccagtaaggtcctatttaagacacagaaagatgctatgta

SEQ ID NO: 23225 - DNA, 201 bp, Homo sapiens
agacaaagagatactgagaatggctggaccactcacagcagatttcattgtcaaggtgagccctatttagatacctccttttcaagccacatcccaaatgrtgttacttataatttcctgagcagagagcgatttttggttctgacatatgtttggaaagcccgtttgttacccaggaaatgtttaatctgagggtgttga

SEQ ID NO: 23226 - DNA, 201 bp, Homo sapiens
atagatttgatgccaaagtctgagctgcttttcacactctcccagttttgcaatacagtcacaaaaattaaagagcaagtaaagtatacctgagggcaaargaagttcattaacttttcttttccctttcttcctgggattggtatcagggatggacctgcttatttgccccacttgattatgtcccatgtctactcaatt

SEQ ID NO: 23227 - DNA, 201 bp, Homo sapiens
gtggttgccctaggaacatctttctctcatcttcacgtgtttgatcatatagatctggaaaccaaaaccctccaggggactaaaggtgaaaacagtctcarctccacaggaactttccttgtggacaattctagtgtggacttccagaaatttccagacaaagagatactgagaatggctggaccactcacagcagatttc

SEQ ID NO: 23228 - DNA, 201 bp, Homo sapiens
gtcaagtttatgtttttcctgtaaaggcaactcctagatttctgttttatctgtgatctctcttgtttatatttctctggcataactaatgcctatattasgttaaaattgatttcttataggttgggatttttctccaaatgcctaaatcccaatggtatattaaaacgatcctcctgggtgtgtgtttgtactatgtcc

SEQ ID NO: 23229 - DNA, 201 bp, Homo sapiens
ttttttcatggatataaggttaggtaaaaaatttttaaaaaggatgaaaaacatatactattaaagtcccaatagttaacaccagggtttaccttttaaargcaaaatctcaccattgaatctcctccgttttaataccttcagtggttcccctttgtgtattacaaagttcaaaattagtaggtatttcactcacctact

SEQ ID NO: 23230 - DNA, 201 bp, Homo sapiens
ttgataaagacaataaatagctttagaatgttcctaatgtatcatttttctggttttatccagaactcttgaccttgaaaaaataatgaaatagcaaaaamttaattttttgaagtaatgaaaatagcaaatgattaatttaactgaactaagatttcatttggtttcaatttctgtatctgtgaaataaatgttcatagg

SEQ ID NO: 23231 - DNA, 201 bp, Homo sapiens
taaaacttctgatctcatccagtacttagtttttgcggatggccaaaccttgatgtaaggtattcaaggttacatagaaagaaagtagcagagaggagtaytgaccttccaactcccagcctctcaggtgatccttttcctcattatggccagatcctccatgctttgctactcacgaaatagcaaagtgcttgtatgtct

SEQ ID NO: 23232 - DNA, 201 bp, Homo sapiens
ggtctagaaagatggttctctgtttgttgttttaacaacaggaactgtaagtcctaggaaaatatgatcttgagagtaaatcacatttatcagattttttwaaatataatgatcacaagaaattaagataattggcaactcctgaagtctcagttcacaagtgtctgataacctctactttaccagctgtgagacattgcc

SEQ ID NO: 23233 - DNA, 201 bp, Homo sapiens
gggtctagaaagatggttctctgtttgttgttttaacaacaggaactgtaagtcctaggaaaatatgatcttgagagtaaatcacatttatcagatttttwtaaatataatgatcacaagaaattaagataattggcaactcctgaagtctcagttcacaagtgtctgataacctctactttaccagctgtgagacattgc

SEQ ID NO: 23234 - DNA, 201 bp, Homo sapiens
ctgcagcagctatataatgactaagatcacggttatgatgatgttgatgttagctgagagaaactcttaagctctccagaaatcagctttctcatccatgraaggaaaagatggaattctagaattctgtatgggtctagaaagatggttctctgtttgttgttttaacaacaggaactgtaagtcctaggaaaatatgat

SEQ ID NO: 23235 - DNA, 201 bp, Homo sapiens
tgttttgtttaggaagcagtatctctgtaataatcccttggcatttgaacagagcttttgtacattatttcagttggtgatcctaactttgtgcataggcwttcctaaattcatttggcaggtaaggaaactaagaccctaagagagcaagaggtttatgcaagtggaagaacaaaatctatatcccagatcttcaggctc

SEQ ID NO: 23236 - DNA, 201 bp, Homo sapiens
tattacatttttatattaaaatatattctaatacttatattttgttctttcatacttgacccagtttctgagttcataattgatatagttctgaactccckaaacacagtgctgtaactattttatagtttatattgggaggacatatttatttaaatcctctcttatcatttgtctatagcttttctcagacgtcatttt

SEQ ID NO: 23237 - DNA, 201 bp, Homo sapiens
ctaatgacatctaagctaaaaggaaagggcctgaggccttagaatggaaatttttacttagagtaataatttaaaactccttcttgagctgtgtggtctaygactagatctgtctccaaactataaaatataaagtaccatggtaatatttttaatgaaagattttatttgactatgaaaagtgttatgtatagcaagtag

SEQ ID NO: 23238 - DNA, 201 bp, Homo sapiens
tggctagccatatgtagaaagctgaaactggatcccttccttacaccttatacaaaaatcaattcaagatggattaaagacttaaacgttagacctaaaascgtaaaaaccctagaggaaaacctaggcattaccattcaggacataggcatgggcaaggacttcatgtctaaaacaccaaaagcaatggcaacaaaagcc

SEQ ID NO: 23239 - DNA, 201 bp, Homo sapiens
tttcaatgccatccccatcaagctaccaatgactttcttcacagaattggaaaaaactactttaaagttcatatggaaccaaaaaagagcccacattgccmagtcaatcctaagccaaaagaacaaagctggaggcatcacactacctgacttcaagccatactacaaggctacagtaaccaaaacagcatggtactggta

SEQ ID NO: 23240 - DNA, 201 bp, Homo sapiens
agagaagaaagaatcaaaagaaatgagcaaagcctccaagaaatatgggactatgtgaaaagaccaaatctatgtctgattggtgtacctgaaagtgacgkggagaatggaaccaagttggaaaacactctgcaggatattatccaggagaacttccccaatttagcaaggcaggccaacattcagattcaggaaatacag

SEQ ID NO: 23241 - DNA, 201 bp, Homo sapiens
ttagagaagaaagaatcaaaagaaatgagcaaagcctccaagaaatatgggactatgtgaaaagaccaaatctatgtctgattggtgtacctgaaagtgayggggagaatggaaccaagttggaaaacactctgcaggatattatccaggagaacttccccaatttagcaaggcaggccaacattcagattcaggaaatac

SEQ ID NO: 23242 - DNA, 201 bp, Homo sapiens
ataactagaataaccaatacagagaagtgcttaaaggagctgatggagctgaaaaccaaggctccagaactacgtgaagaatgcagaagcctcaggagccsatgcgatcaactggaagaaagggtatcagcgatggaagatgaaatgaatgaaatgaagcgagaagggaagtttagagaagaaagaatcaaaagaaatgag

SEQ ID NO: 23243 - DNA, 201 bp, Homo sapiens
ggatcacagttcctcaccagcaacggaacaaagctggacggagaatgactttgatgagctgagagaagaaggcttcagacaatcaaattactccgagctaygggaggacattcaaaccaaaggcaaagaagttgaaaactttgaaaaaagatttagaagaatgtataactagaataaccaatacagagaagtgcttaaagg

SEQ ID NO: 23244 - DNA, 201 bp, Homo sapiens
gtgcgcgagccgaagcagggcgaggcattgcctcactcgggaagcgcaaggggtcagggagttccctttcctagtcaaagaaaggggtgacagacggcacytggaaaatcgggtcactcccacccaaatactgcgcttttccgacgggcttaaaaaacggtgcaacaggagattatatcccgcacctggctcggagggtcc

SEQ ID NO: 23245 - DNA, 201 bp, Homo sapiens
tctggggcaagggagtgaagcctggcctactctagaagaaagtctccacagacttcatttgagaatcactgggcatttaattgaacaccaaggttttccasttgttgatattctttgcaatagagaactacaagtagaccccctctacaataatgtaatacaagtactttaggtacttgagtgcctccagagaccttaaaa

SEQ ID NO: 23246 - DNA, 201 bp, Homo sapiens
ttttttttttacaaaattgaactattttaattaagggttttagtttacatttggccacctcaaagtagttgtaacattgggttggtcaatttaaatactgkggctccttgttggatggacacaatctttacatccaaacgttaatgcatacaaagcaacatggcattgttaaacaaaacagcaatacttactgaatattgg

SEQ ID NO: 23247 - DNA, 201 bp, Homo sapiens
gagattattggtgtctttctagaaatgtagcccttactttccccattccttgcagtcttagaagggcctaagtttttttttttttttttttttttttttttacaaaattgaactattttaattaagggttttagtttacatttggccacctcaaagtagttgtaacattgggttggtcaatttaaatactgtggctccttg

SEQ ID NO: 23248 - DNA, 201 bp, Homo sapiens
ggagattattggtgtctttctagaaatgtagcccttactttccccattccttgcagtcttagaagggcctaagtttttttttttttttttttttttttttttacaaaattgaactattttaattaagggttttagtttacatttggccacctcaaagtagttgtaacattgggttggtcaatttaaatactgtggctcctt

SEQ ID NO: 23249 - DNA, 201 bp, Homo sapiens
acaacgtgatttcctccctgcaatattcctttaatgtgccctgtatttttcggtgggatcccctctgttctggggcaagggagtgaagcctggcctactcyagaagaaagtctccacagacttcatttgagaatcactgggcatttaattgaacaccaaggttttccagttgttgatattctttgcaatagagaactacaa

SEQ ID NO: 23250 - DNA, 201 bp, Homo sapiens
gttgtcatgaggaatacatggcataatacatttaaagagcttagcagagtacctgactcatgataagcgctcaataaatgttagctgcagcagctatatartgactaagatcacggttatgatgatgttgatgttagctgagagaaactcttaagctctccagaaatcagctttctcatccatgaaaggaaaagatggaat

SEQ ID NO: 23251 - DNA, 201 bp, Homo sapiens
tgaggaatgaaggctggaggaaggagatttagtgcagttgctttcccctgatgacaacaacgtgatttcctccctgcaatattcctttaatgtgccctgtrtttttcggtgggatcccctctgttctggggcaagggagtgaagcctggcctactctagaagaaagtctccacagacttcatttgagaatcactgggcatt

SEQ ID NO: 23252 - DNA, 201 bp, Homo sapiens
ttcatcctacgaagtgaggataataacaatacttacctcataaagttgtcatgaggaatacatggcataatacatttaaagagcttagcagagtacctgastcatgataagcgctcaataaatgttagctgcagcagctatataatgactaagatcacggttatgatgatgttgatgttagctgagagaaactcttaagct

SEQ ID NO: 23253 - DNA, 201 bp, Homo sapiens
ataggagtagatttaagagggaaatttatttttataaatgtattagtctcatagatttcataattatgtgatcacaaagaagctgaagaattggccttgtktgatttaattatcctaaagatttgatgaaaagcaaactggaacctgcttttttctcccaacaaacatactattggtagcaaatgtatagctaaatcattt

SEQ ID NO: 23254 - DNA, 201 bp, Homo sapiens
tactgtccgacctaaaaagacagccttccaaggagggtagaaagtgctcttggggttgggtgtggtggctcacgcctgtaatcccaacactttgggaggcsgaggcgggtggatcacctgagatcaggagtttgagacctgccttgccaacatggcaaaacctcgtctctactaaaaatacaaaaaattagctgggcatgg

SEQ ID NO: 23255 - DNA, 201 bp, Homo sapiens
agccctcttcactatactgtccgacctaaaaagacagccttccaaggagggtagaaagtgctcttggggttgggtgtggtggctcacgcctgtaatcccarcactttgggaggccgaggcgggtggatcacctgagatcaggagtttgagacctgccttgccaacatggcaaaacctcgtctctactaaaaatacaaaaaa

SEQ ID NO: 23256 - DNA, 201 bp, Homo sapiens
actgttaaaattatcaggtatttcaaacagtgagacaactgaatctgtttcattcccatagtaagtagcattttggcaagccctcttcactatactgtcckacctaaaaagacagccttccaaggagggtagaaagtgctcttggggttgggtgtggtggctcacgcctgtaatcccaacactttgggaggccgaggcggg

SEQ ID NO: 23257 - DNA, 201 bp, Homo sapiens
ggcctcaaacgatgagtagagaagtaattgcttgtcttctttttttctggaagagattgtatggaattgaatatatttattctttaaatggctgctaccaygccccagtgaaattttctggatctggagatttatttttcagtatgtaaccttatgaacttatggaacaccattatagtaactattttaatatccattctg

SEQ ID NO: 23258 - DNA, 201 bp, Homo sapiens
gttcatatcagcaattattgattttaattcaactggctgtgaaattgtgttctgttgaagctttccaaaatgcccagaggtttctcagcagttttctagawgagctataatccaggcttgaccttggatagaatacaaaataaaatcaagttaccatagttctgaaatgaaaaccttactgaagtatttgacattgaacag

SEQ ID NO: 23259 - DNA, 201 bp, Homo sapiens
gttaatcattcatttaatgaatattcactgagaccgattacgtatctggtgttctacaaggcactgcgcatattcagaggcatattcatctttgtcacagstcttaagaagcacacagtccacttctggggatagatgtgtaaacaagtaactatactgggtggctgacaaatgctaaaatagccatttgtatcaagtcct

SEQ ID NO: 23260 - DNA, 201 bp, Homo sapiens
cagcagaagcagaataggtggcagaggcaattgattggagggagggagagggggtaggtgaaggggatgaggaggaagacagaggaggctggagaaagggraattgttgtatagcaatgtctgtatgttcatcactatgctagggggaaagactgctaaaatattggggccccaaatagcgagcttggttttggatgtgct

SEQ ID NO: 23261 - DNA, 201 bp, Homo sapiens
aggagattattggtgtctttctagaaatgtagcccttactttccccattccttgcagtcttagaagggcctaagtttttttttttttttttttttttttttttacaaaattgaactattttaattaagggttttagtttacatttggccacctcaaagtagttgtaacattgggttggtcaatttaaatactgtggctcct

SEQ ID NO: 23262 - DNA, 201 bp, Homo sapiens
acctaagagaggagattattggtgtctttctagaaatgtagcccttactttccccattccttgcagtcttagaagggcctaagtttttttttttttttttktttttttttttacaaaattgaactattttaattaagggttttagtttacatttggccacctcaaagtagttgtaacattgggttggtcaatttaaatact

SEQ ID NO: 23263 - DNA, 201 bp, Homo sapiens
tttgacaaacctaagagaggagattattggtgtctttctagaaatgtagcccttactttccccattccttgcagtcttagaagggcctaagtttttttttktttttttttttttttttttacaaaattgaactattttaattaagggttttagtttacatttggccacctcaaagtagttgtaacattgggttggtcaatt

SEQ ID NO: 23264 - DNA, 201 bp, Homo sapiens
atcacaatttcaattttgtcagctatataaagaatgatgtgtctcccttacctagctctaaacattgttgcatgaaatgtgcttgcctgtggttgccctakgaacatctttctctcatcttcacgtgtttgatcatatagatctggaaaccaaaaccctccaggggactaaaggtgaaaacagtctcagctccacaggaac

SEQ ID NO: 23265 - DNA, 201 bp, Homo sapiens
ttgtgtttgacaaacctaagagaggagattattggtgtctttctagaaatgtagcccttactttccccattccttgcagtcttagaagggcctaagttttkttttttttttttttttttttttttacaaaattgaactattttaattaagggttttagtttacatttggccacctcaaagtagttgtaacattgggttggt

SEQ ID NO: 23266 - DNA, 201 bp, Homo sapiens
attcatatcagttacttgtgaagtttacacccatcttttaaagaaataatttgtcaaaccattcttcattcatccaacagtagtgttgctaacaaaaagartttttttttttttcaagccggagtctcactctgtcacccaggctggagtgcggtggcacgatcttggctcactgcaacctccacctcccgggcccaagca

SEQ ID NO: 23267 - DNA, 201 bp, Homo sapiens
atggtgtttgcttacttattttagagggtttatttaaaacttttttttgacatcattgagaggcattaaataactaaagagtttttacacgagatcttctsatctcatgtaaaaatgggaagtagataagagtagaaatacaaagaaggtgtttccttttctctcttccaagtttctttctcatccagtagtaattttttc

SEQ ID NO: 23268 - DNA, 201 bp, Homo sapiens
tggagtgcagtggcatgatgatctcggctcactgcaacctccacctcctgagttcaagtgattctcctgcctcagtctcccaagtagcttgggcttgcagrtgtatgccaccatgcctggctaattttttgtatttttagtagagatgaggtttcaccatgttggccaggctggtcttgaactcccgacctcaagtgatct

SEQ ID NO: 23269 - DNA, 201 bp, Homo sapiens
ggagtgcagtggtgtgatctcagctcactgcaaactccacctcccgggttcaagtcattctcctgcctcagcctcccaagtagctgggattacaggtgtgygccgccacacccagctaatttttgtatttttttttagtagagacgaggtttcaccatgttggccaggatggtcttcatctcttgacctcgtgatctgccc

SEQ ID NO: 23270 - DNA, 201 bp, Homo sapiens
cactcaaaaatagtacttttgtgagcagtaacagatactgaaataaaatattcaggccaagaacatcaccaagtgggggactgactcttcattgcggaagraagaacccataggagtagatttaagagggaaatttatttttataaatgtattagtctcatagatttcataattatgtgatcacaaagaagctgaagaatt

SEQ ID NO: 23271 - DNA, 201 bp, Homo sapiens
gaaattccaaagtttccctgatcttcctgccttctcaaactcttccaacctctgccagttacccagttccaaagtcatttccacattttcagctatctttrtagcaatgccccacttcttgatagccattttctgtattagtctgttctcacattgctataaaggactaccagtactgggtaatttctttaaaaagaggtt

SEQ ID NO: 23272 - DNA, 201 bp, Homo sapiens
tgggcatctccacccctatgaagttgagtgcctgcagcttttctaggttcatggtgcaagctgtcagtggatctaccattctggggtctgcaggatggtgrccttcttctcacagctccactaggcagtgccccagttgagactctgtgtggggcctccaatcccacatttcccatccatactgttctagtagaggttctc

SEQ ID NO: 23273 - DNA, 201 bp, Homo sapiens
cacatgtcaaaagataatgtatgtgtgtgtattattaccactcaaatgattcatttttccccatttgagaactggagagggctaactgtccactaactctscactcaactaactctccactcaaaaatagtacttttgtgagcagtaacagatactgaaataaaatattcaggccaagaacatcaccaagtgggggactga

SEQ ID NO: 23274 - DNA, 201 bp, Homo sapiens
aaagggcacccagaggaatgtgcagcacggtgggagaggatgtggcccctgcctcgccagctatactaatggcattaatcaccaaggaggcaggtgttgcmaccagattgctctcacatcctaagagatcttaaacaccactctgtgcacaatattgtaatagatgccaagtagaagcatcttccaatccatcccaaatca

SEQ ID NO: 23275 - DNA, 201 bp, Homo sapiens
gctgctgttccccatatcctgtgaatagaacatctgtgtgaataggaagcctgtgcaaacagcaggcactgcccacaggggtgtgtatgtgtatgtatcaygcatatgcatgtgtatcaatgcctgtgtgtatatgtgtgtacatgtctactatctgtgtgtgtgtgtgtgtgtgtgtgtgtgtgtgtctccccagccctg

SEQ ID NO: 23276 - DNA, 201 bp, Homo sapiens
atcctcatcacctttctctgacacagctgtgaatcacgcagaacatccacatatgacaagattttaaaatgaatataaaatattctatatagaaagttgtrtgatatacatatagatagatattttttaaagaatacttttaggtacagtccttgggaagaattttcttgagaaaagacatttgcaacccatatctgtgaa

SEQ ID NO: 23277 - DNA, 201 bp, Homo sapiens
ttgtttggtgttagtattagcacaaaatggcctcaaacgatgagtagagaagtaattgcttgtcttctttttttctggaagagattgtatggaattgaatwtatttattctttaaatggctgctaccatgccccagtgaaattttctggatctggagatttatttttcagtatgtaaccttatgaacttatggaacaccat

SEQ ID NO: 23278 - DNA, 201 bp, Homo sapiens
aaacctaggtttgttttatgcctgcatttaaattaagtggaaatctgagagttatgctacaaaaggaagaactgactgatgtttacatacatccctttgcmaagcaataacagcattagtaatagctgtcatgtattttgtgtctgaatgtggctagttgtttgaaaatcattacaataaatccttacaataatcatacag

SEQ ID NO: 23279 - DNA, 201 bp, Homo sapiens
ctctgtgaaaaatagaggattgtaatgaaaatgctgacaggcctggagccagctcatgaagtaataatgccacatctttcatacttttacacagcatgtcstaatcagccacagctttcttttcctttagaaagcagttaaatacgtgaaaattcccagagtactactttttctcctcctcttttagattgtatattctta

SEQ ID NO: 23280 - DNA, 201 bp, Homo sapiens
acatctagcaactgtacaggacggcatagtgtgcattatgtttagttctctcatttctagatttatctttcttacctttgcctttttgctccattcactcwtttgttcttgtgaattttatggttatttatatgctataaatctttttattatttaatgaaaggttaagcataagcaaattaatgaatatctaaatctttt

SEQ ID NO: 23281 - DNA, 201 bp, Homo sapiens
ggtgaccgcaggtgttgttggggctgagccccttccccttcacttgctatatgtgcttctgaggcacagatcacagatgaaaccatcgttcatccctgtgygtaagtgtagctctagaggtaatgatcttgattagaatattcaaacttgttattaccactcactattgccatataaatattgtatagtatgccttttcat

SEQ ID NO: 23282 - DNA, 201 bp, Homo sapiens
gggaggggtaggaggtgaccgcaggtgttgttggggctgagccccttccccttcacttgctatatgtgcttctgaggcacagatcacagatgaaaccatcrttcatccctgtgcgtaagtgtagctctagaggtaatgatcttgattagaatattcaaacttgttattaccactcactattgccatataaatattgtatag

SEQ ID NO: 23283 - DNA, 201 bp, Homo sapiens
cccccagtaatcaccatctattttctttctctatgaatttgactatttggggtgcctagtataatgaaatcatataatatttgtcctttttttgtctggtytattttacttaacctaaggtcttcaaggttcttctatgtcatagcaagtcataattacattcctttttagagctgaataatattttgttgtatgaatata

SEQ ID NO: 23284 - DNA, 201 bp, Homo sapiens
aagttagttacttccaggatacaatggaggtacaggcattgggtaaatacacgcattctaaacgggagaaattagcccaaacaaaggggttacagaccccrtgcaagtcagaaacccagcagggcggtcattaaatcttaaagctccaaaatgatctcctttgactccatgtgtcacatccgggccacactgatgcaaggg

SEQ ID NO: 23285 - DNA, 201 bp, Homo sapiens
tcctccaacactggggattataatttgacaggagatttgggcaaggacacaaatctgagccatatcatcctgcccctggcccctcccaaatctcatgcccwtctcatgttgcaaaatacaatcatcccttctcaacaatctcccaattcttaactcacttcggcattaactcaaaagtccacagtccaaaatctcatctga

SEQ ID NO: 23286 - DNA, 201 bp, Homo sapiens
aattgtgtgacatgtgtttttatatccctcctcaaaatgtagtgaaccaaacatcatttatgggtccatatagtgttactatttatattctaaatataagktacctgaattatattctcttcatgaatctcaggccacagaaaagtaacaatgaatatcttgtttatgtgtagaaacaggtgagatgattcatgattctta

SEQ ID NO: 23287 - DNA, 201 bp, Homo sapiens
gggacaggaaggaaattgttcatttccttaactccttcaggcaactaacaggccacctaatgccctagaaggtgtaatttgctaagggactcatatttttwaaaaaaaaggaaaaagaaaaaagaaaaaaaggtatagtctggatgctttaggtgctcttcctgatctccaaaacaaggcatcccaggtagagaaagtgag

SEQ ID NO: 23288 - DNA, 201 bp, Homo sapiens
gaaaaatctccaaatacataatgaattagaatccaaatagaggtcccttgacgtcatctagtgcaactccccattgatgcttcattctcccatttcttccygaacaatcacaaccatataccacagatatgttaaatatatatttacgcaaatatgcattcatatattcaatgcatatgtattcacacatgtatatacaca

SEQ ID NO: 23289 - DNA, 201 bp, Homo sapiens
tgagcatgcccaaaaggcagcatcccttttcttatacattgttactgaaggttaatacacacacaggcacacacacacacacacacacacaaacacacacatcatgaaaattttctcacacaaatgaatataaaaaacttatttacacaaataaatacagaaaatttagtcatgtaaaataaataagttagtactccaatg

SEQ ID NO: 23290 - DNA, 201 bp, Homo sapiens
ttgagcatgcccaaaaggcagcatcccttttcttatacattgttactgaaggttaatacacacacaggcacacacacacacacacacacacaaacacacacatcatgaaaattttctcacacaaatgaatataaaaaacttatttacacaaataaatacagaaaatttagtcatgtaaaataaataagttagtactccaat

SEQ ID NO: 23291 - DNA, 201 bp, Homo sapiens
tcaacacacacctgatcactatggacacatgctttggcgatgaaacactggtgatatgatggaccatgttgtgtatcttcttgagaggtggaactggtagragtaaaagaataggggaggggccaggcatggggactcacacctgtaatcacagcactttggggggccaaggtgggtggatcacctgaggtcaggagtttg

SEQ ID NO: 23292 - DNA, 201 bp, Homo sapiens
tgggattttgagcatgcccaaaaggcagcatcccttttcttatacattgttactgaaggttaatacacacacaggcacacacacacacacacacacacaaacacacacatcatgaaaattttctcacacaaatgaatataaaaaacttatttacacaaataaatacagaaaatttagtcatgtaaaataaataagttagta

SEQ ID NO: 23293 - DNA, 201 bp, Homo sapiens
aactggtgaagacaaagggtacagggtaaatagagctgactattggtcaaatgctgactcaggaggctggaaatagatgtaaaggaggccttgcaagaagktcagcagggagttaaaaactcctgcactataaaatgcaaaagacattgggaaggaaaactagactaagaaaagatcttgcatgttaatataactattatt

SEQ ID NO: 23294 - DNA, 201 bp, Homo sapiens
gatgtttctactttttggctattatgaataaagctgctatgaagattcacgtacatgtttttatgtggacatattttttatttctcttggttatacacacstaggagtgaaatttctgggttgtttggcgcatttatgtttactattgaagaaagtgccaactatgtttcaaagagactgcaccactttacatttccacca

SEQ ID NO: 23295 - DNA, 201 bp, Homo sapiens
tattcttttttgtattgtctttgtttggtgttagtattagcacaaaatggcctcaaacgatgagtagagaagtaattgcttgtcttctttttttctggaaragattgtatggaattgaatatatttattctttaaatggctgctaccatgccccagtgaaattttctggatctggagatttatttttcagtatgtaacctt

SEQ ID NO: 23296 - DNA, 201 bp, Homo sapiens
tcaactgacaaagtcctgtggtttttcttctttagattgttattgtgatgaattacattaattggtttttaaataaccaactctgcatttctgggataaastgtacttggtcatggtgtattattctttatatagatttctagtttgattcggcagtattttgttgaggctttttatctgtgttcatgagagatactggtc

SEQ ID NO: 23297 - DNA, 201 bp, Homo sapiens
gaaacatgattgatttttgtgtgttagccgtgtattatgtaaacttgatacactcactcaatacctctgagttttttggtagatgactgggattttctcartaaacaatcatgttgtttacaagtaagagtggttttgcctcttttcaatttgtaagccacttttttttttgtagtcttattgtactggctacgcatgcaa

SEQ ID NO: 23298 - DNA, 201 bp, Homo sapiens
tttttttattttgcttgtttgtttgtattatctcattttatttttttttttagagaaatggtaggttcacagcaaaattgagcagaaaatagagaagtttycatatgtctctgcctaccacatgtacagtctcccccactatcaatgtcctgtcccagagtggtacatttgttagaattaatgagctacattgacacatga

SEQ ID NO: 23299 - DNA, 201 bp, Homo sapiens
aacaatatctcttcccagctgtatctaatatgctttttattcgacctgaaaatttataaaaacatttatatctgcatgtatatgagttctgtttttttttwaaatctacatgatgacacctgttctttggttactctttcaaaattcttcttaaaaatgtccataagcatgttaaatttttttattttgcatcctgtgtct

SEQ ID NO: 23300 - DNA, 201 bp, Homo sapiens
aacaaaattgggagcaggctctcctatctttcagagtctgcatgcattctgcatttggacagtctctaaaaggctattacgatgtatgagtggcaggcgcrgtggctcatgcctgtaatcccggcactttgggaggccgaggcaggcagatcacctgaggtcaggagttaagaccagcctggtcaacatggtgaaacaccg

SEQ ID NO: 23301 - DNA, 201 bp, Homo sapiens
ttagccctccaaactgtgccagcctctgccagttacccagttctaaagtcacttccacattttcaagtatccttatagcagcaccccactcctgataccaktttactgtattagtccattcttatgctgctttaagaacatatgcaacactgggtaatttggaaaaaagagatttaattgactcacagctcttcaggggtg

SEQ ID NO: 23302 - DNA, 201 bp, Homo sapiens
gactttgttgcctgtatcactatcagcattttggtcaaagccattcaacaagactgtaggaagttccgaattttcccacatcttcctgtcttctgagcccyccaagtatctaggaagttccaacctttcccacattttcctgtcttcttcttagccctccaaactgtgccagcctctgccagttacccagttctaaagtca

SEQ ID NO: 23303 - DNA, 201 bp, Homo sapiens
caggatttcatggttacagtgagctatgatagtgccactgcactccaggctgggtaacagaatgagatgagatgctgtctcaaaaaagcaaaagcaaaaasaaaaaaaccagatggaccatcctgctttaaaattctttgccataagtccgtatttgaaaagctagtgatattcagggaaatacagtaacccattcttgct

SEQ ID NO: 23304 - DNA, 201 bp, Homo sapiens
aacagcttgcttctgtccaagctggtgtcttttcaattaagtattgttaaatccataccatttggaatgatgcttcagacagccctgacactctctctctygcttctgatttcatttcacctaatatgttgtgcatggagccagtaaccagtattattcagctgccacggcttctgctagtgctgctgctcacacacttgc

SEQ ID NO: 23305 - DNA, 201 bp, Homo sapiens
cagtttttgcccattcagtatgatattggctgtgggtttgtcataaataactcttattattttgagatatgttccattgatacctagtttattgagagttyttagcatgaaggggtgttgaattttattgaaggccttttctgcatctattgagataatcatgtggtttttgtctttggttctgtttatatgctggattac

SEQ ID NO: 23306 - DNA, 201 bp, Homo sapiens
ctcctgcctgattgccctggccagaacttccaacactatgttgaataggagtggtgagagagggcatccctgttttgtgccagttttcaaagggaatgctkccagtttttgcccattcagtatgatattggctgtgggtttgtcataaataactcttattattttgagatatgttccattgatacctagtttattgagagt

SEQ ID NO: 23307 - DNA, 201 bp, Homo sapiens
gtgggattttgagcatgcccaaaaggcagcatcccttttcttatacattgttactgaaggttaatacacacacaggcacacacacacacacacacacacamacacacacatcatgaaaattttctcacacaaatgaatataaaaaacttatttacacaaataaatacagaaaatttagtcatgtaaaataaataagttagt

SEQ ID NO: 23308 - DNA, 201 bp, Homo sapiens
tcagtaagacatgtattttgagaggatgaggtgggatgccttttctactgatagcacatcactccagaatgatcacttgctcatgctcaccttctcttcttaccaccacaacccctgatgatggggatattacatggagtcatgttactgcccagtgtaagagaaacaatgtaagaactgtgtgcctggtggtcagcataa

SEQ ID NO: 23309 - DNA, 201 bp, Homo sapiens
ttcagtaagacatgtattttgagaggatgaggtgggatgccttttctactgatagcacatcactccagaatgatcacttgctcatgctcaccttctcttcttaccaccacaacccctgatgatggggatattacatggagtcatgttactgcccagtgtaagagaaacaatgtaagaactgtgtgcctggtggtcagcata

SEQ ID NO: 23310 - DNA, 201 bp, Homo sapiens
ttccagcttcatccatgtccctacataggacatgaactcatcctttttatggctgcatactattccatggtgtatatgcgccacattttcttaatccagtygatcattcatggacattaggtttggttccaagtctttgctattgtgaatagtgccgcaataaacatatgtgtgcatgtgtctttatagcagtatgattta

SEQ ID NO: 23311 - DNA, 201 bp, Homo sapiens
attcagtaagacatgtattttgagaggatgaggtgggatgccttttctactgatagcacatcactccagaatgatcacttgctcatgctcaccttctcttcttaccaccacaacccctgatgatggggatattacatggagtcatgttactgcccagtgtaagagaaacaatgtaagaactgtgtgcctggtggtcagcat

SEQ ID NO: 23312 - DNA, 201 bp, Homo sapiens
caattcccacctatgagtgagaacatgcgatgtttgttttttttttccctgcaatagtttgctgagaatgatggtttccagcttcatccatgtccctacawaggacatgaactcatcctttttatggctgcatactattccatggtgtatatgcgccacattttcttaatccagttgatcattcatggacattaggtttgg

SEQ ID NO: 23313 - DNA, 201 bp, Homo sapiens
ccaaggtgggcagatcacgagggcaggagatcgagaccatcctggctaacaaggtgaaaccccatctctactaaaaatacaaaaaattatccgggcgtggyggcgggcgcctgtagtcccagctactcaggaggccgaggcaggagaatggcgtgaacctgagaggaggagtttgcagtgagccgagatcgcacctctgca

SEQ ID NO: 23314 - DNA, 201 bp, Homo sapiens
ccatataaattttactatctgcttgtccatatctacaaaaagtcttgctgggatttttttgtgttaattctacagattgatttggagggggtaggaattgrcatctttagcatgttaagtcactcaatctataaggtatgagaattttatgtctctgtttacttaggtcttattttatctctttgattagcctttattagc

SEQ ID NO: 23315 - DNA, 201 bp, Homo sapiens
catccactggattccatggtggtggattagttcatctactagttcttgaggctgaagagattgttgacatctcgcctatactcttcaaaatactttttatrttttcatggcttttttgctgattctaaatgctaacttagaaatattgataagttaaaagactgtaatgaaaacaatgaactcactaataatccccaatgc

SEQ ID NO: 23316 - DNA, 201 bp, Homo sapiens
tatttgaattggaaatattttctccatcatagcttttttattcaaaattgcttaatgttatctttcacagagcaaaagcttttcatttggatgaagaccasgctatcattttttttcttttacggctcatgcttttaatgtcatgtctaagaacttcttgcctaagaccaggacacaaagattttctcctgtgttttcttg

SEQ ID NO: 23317 - DNA, 201 bp, Homo sapiens
tattttcattattactcagcaaatattttttgagggcctacaattgaccaagcactgttctcactgcttggaatacattaattaacccaatatacaaatcrcccacccttacgcagcatacgttctaacgaaccatgtggaacatggagatcatttataaaatgtttcctgctaccattacctcttggttgtagtttttgt

SEQ ID NO: 23318 - DNA, 201 bp, Homo sapiens
catttctctaataattaacatcggtgtacttgggaaatagtctctaaaaaataatagccctttacagcaattcttgttgatgcatcagggcagaggtttasgtttagcctcttgctgtcatttatggtatgtctgtttctttgtgtgcacagttaaaaacacatgtacatatacatacctacacacatgcatgcacacatt

SEQ ID NO: 23319 - DNA, 201 bp, Homo sapiens
aatagaagatttgaaaatagagttgtctcagaaattccaggatagtggtcagagttgttatgtgctaggcaatgaactggatctttttatataagctatcrcctcaaatccttagaacaagtatataaaataggttggattatataactcacaagagaactgaactcgtactgagagtgatatattcaagccatcacatcc

SEQ ID NO: 23320 - DNA, 201 bp, Homo sapiens
accataaaattcgtggtcaaatatgtttttctatcgaatatggcatttgatagacccactttgtagaatatggggacttttcaatttagattcacatagayatattgaaaagaacgcattgcatattttttttcaaatgactcaaaatttttttaattgacgctgtattatgcaatacatttgaaactataatctttggtg

SEQ ID NO: 23321 - DNA, 201 bp, Homo sapiens
atggcaataccatgctgtttgggttactgtagctttatagtatattttaaaattaggtggtgtgatgcttccagctatgtactttttttttttttttttttgagatggagtctcactctgtcaccaggctggagtgcagtggcacaatctcagcttactgcaaactctgcctctttggttcaagtgattctcctgcctcag

SEQ ID NO: 23322 - DNA, 201 bp, Homo sapiens
aaagctaatcgcaaatcagtacctttgaaagggaccgtggagaaattatcagctgaatctccttattttgttttattttattttatatgaaacataaaatrtgaccagcatcagggcaggatgtgacttacccgaagtctctcaactagcaagtggcaaagccagaaacactcaaacctgggtcttctggctccaagtcca

SEQ ID NO: 23323 - DNA, 201 bp, Homo sapiens
ctctcttgaaagttagttttgcagtgaacttaactctacgttgacagttatcttgtctcaacacttcaaagagaattatccattgacttctaactaccatygttgccattgagaagccagctgtcattctaatttgtttttcctgtatcttttctgcctgacttcttttatttattgttggtgttcagtagttagctatga

SEQ ID NO: 23324 - DNA, 201 bp, Homo sapiens
cactttatttgatcccattttttctcagatcatagatcttcaaatattactttccttttatctggagtatatcctttagactttctgttagtgagggttcmttagaagtgagtgcttttggttttctgtattttgtttgtctgaaatatttgtatttggtgctctctcttgaaagttagttttgcagtgaacttaactcta

SEQ ID NO: 23325 - DNA, 201 bp, Homo sapiens
agagaacatgttttcctgctctggagtgtaaatttctatatgagtatatcaaatgttttgaatgtgtttattaaatgtcctagttctttaataattttttwaaaatacttgagagaatgatatttaaaatcttcttctttgttaggttaatttgccaatttcaccttgtagtccgtttgggttattttggactgtcttatt

SEQ ID NO: 23326 - DNA, 201 bp, Homo sapiens
gggcgcccctcccccagccttgctgccgcattgcagtttgatctcagactgccatgctagcaatcagcaagactctgtgggcataggaccctccgagccakgtgcgggatataatctcctggtgcgccgttttttaagcctgtcggaaaagcgcagtatttgggtgggagtgacccgattttccaggtgccgtctgtcacc

SEQ ID NO: 23327 - DNA, 201 bp, Homo sapiens
tcattatcattcagttctaggtatttttaaatttccatatgattccttcaggtcataaattacttacaaatctgttcattaacttctaaatacatggggcrtttacatttttctttattaatcgctaacaattgcattatgatttttccaaaatggtctttttattccatttctttggaatttgttgagattttgtttgat

SEQ ID NO: 23328 - DNA, 201 bp, Homo sapiens
agccctagagaatagtatttagacaccaagatttcaacatcaagtaagttcattgctactgatgtgtcactgctctcagtacccagaagttaaaaaaaaaatgcatatatctgtgcatgtatagccatatacacacacactaatataatcatttctatattaatctatacattgagtcatgagtcctcccttgtatgtcca

SEQ ID NO: 23329 - DNA, 201 bp, Homo sapiens
ccccagtgtgtgatgttccccttcctgtgtccaagtgttctcactgttcaattcccacctatgagtgagaacatgcgatgtttgttttttttttccctgcratagtttgctgagaatgatggtttccagcttcatccatgtccctacataggacatgaactcatcctttttatggctgcatactattccatggtgtatatg

SEQ ID NO: 23330 - DNA, 201 bp, Homo sapiens
cacaccccatgacaggccccagtgtgtgatgttccccttcctgtgtccaagtgttctcactgttcaattcccacctatgagtgagaacatgcgatgtttgktttttttttccctgcaatagtttgctgagaatgatggtttccagcttcatccatgtccctacataggacatgaactcatcctttttatggctgcatacta

SEQ ID NO: 23331 - DNA, 201 bp, Homo sapiens
accatgaagtgattattatgcattgcatgcctgtatcaaaacctcttctgcaccccataaatacatacacctactagatacccagaaaaattaaaaatttwaaaaaagcattgtcctgaataaatatatatttattcaatgtttattaaaaataatttaaatatgttaatattaataaagtactcactagggatgcatact

SEQ ID NO: 23332 - DNA, 201 bp, Homo sapiens
ggatagatacccatttaccatgaagtgattattatgcattgcatgcctgtatcaaaacctcttctgcaccccataaatacatacacctactagatacccasaaaaattaaaaatttaaaaaaagcattgtcctgaataaatatatatttattcaatgtttattaaaaataatttaaatatgttaatattaataaagtactc

SEQ ID NO: 23333 - DNA, 201 bp, Homo sapiens
ctactgatggatgatgcctggcagcatgccaccttgttgtttcttgtattattacaacagaaagcattttcaaaagccacatttatcaagtcatcataatwgtttggcttgtatatctatctattcaaaaaaaaaattaatctctcccttagtactaatctgtttgagccatgtgatgtatcccatgtagaaaaggcagtg

SEQ ID NO: 23334 - DNA, 201 bp, Homo sapiens
atttttgtgtctttcacagtgccttgcttagtactagtatagactggatacccaatgaatgtgttaagtgactgcaaattggaaaacattatacaaaaagygtgttaaccaggaagcactgcccaggactcactttccgcattggagtgcttattgtacattgtctcattagattttttgagcagtatgttcagagcagtt

SEQ ID NO: 23335 - DNA, 201 bp, Homo sapiens
aattactttgatgttccatgggaatacattattttgatatttttactaatgactggcataggaaatagtttcaaggaaagaatctaaggtttgtttttttyttaaaaaaaatgaaaaccatgctttgtgagaaatagcacttcagttatatgcacacatagagctgctattagagtgtgatgtcagcaaccttgataatcg

SEQ ID NO: 23336 - DNA, 201 bp, Homo sapiens
ggagttcgagaccagtctggccaacatggtgaaatcccctgtctctactaaaaatacaaaaattagctgggtgtggtggcgcgagcctgtaatcccagctrcttgggaggctgaggcatgagaattgcttgaaaccaggaggcagaggttgcagtgagccaagatcatgccactgtactccagcctgggtgacagagcaag

SEQ ID NO: 23337 - DNA, 201 bp, Homo sapiens
ggaggccgacgcaggtggatcacaaggtcaggagtttgagaccagcctggccaatatggtaaaaccccatctctactaaaaatatcaaaaaaaaaaaaaaagttagccaggcattgtggcgggcacctgtagccccaactactcgggaggctgaggcaggagaatcacttgaacccaggaagcagaggttgcagtgagctg

SEQ ID NO: 23338 - DNA, 201 bp, Homo sapiens
ctgaacattccagattcttttttgtttcatatgaattttagaactgttttttccatttctataataatcagttactgggagtttgataggcaacgcattgtatctatagatcacattgggtaacatggacattttaacaacattactcttccactccatgaacatggaaggttttaccatttatttgtgtcatctttaatt

SEQ ID NO: 23339 - DNA, 201 bp, Homo sapiens
atttccctacagcaaatcatttagttcctttaacttttatgcttttataatacaatgaataacttaatacctaagtatttttctcttttcaaattattttyttggtataaatactcaggagtgagattgttagatcaaggaatttcagaatttttgtggctattggcacacattaccaaattctttccagaaggataacaa

SEQ ID NO: 23340 - DNA, 201 bp, Homo sapiens
tactattttaatttctgtagcttataaaatgttttgaaatcaggaactgtgatgccttcagctttgttctctctcaatattgttctgaacattccagattsttttttgtttcatatgaattttagaactgttttttccatttctataataatcagttactgggagtttgataggcaacgcattgtatctatagatcacatt

SEQ ID NO: 23341 - DNA, 201 bp, Homo sapiens
cgcccggctaattttttgtatttttagtacggacggggtttccccgtgttagccaggatagtctcgatctcctgacctcgtgatccgcccacctcggcctsccaaagtgctgggattacaggcgtgagccaccgtgcccgaccgaggaaacagtctttacttctctccttgattttgtagaaggccagagctagaaatatt

SEQ ID NO: 23342 - DNA, 201 bp, Homo sapiens
ctcctgagtagctgggactgcaggcgcccgccaccacgcccggctaattttttgtatttttagtacggacggggtttccccgtgttagccaggatagtctygatctcctgacctcgtgatccgcccacctcggcctcccaaagtgctgggattacaggcgtgagccaccgtgcccgaccgaggaaacagtctttacttctc

SEQ ID NO: 23343 - DNA, 201 bp, Homo sapiens
cgaggccctcctgtaaggcagatacctccgccaagatgccaaagacattttctgtctgtaaagtcccattagaggaaacagtcttttttttttttttttttgagacagagtctcgcactgtcgcccaggctggagtgcagtggcgccatctcggctcgctgcaagctccgcctcccgagttcacgccattctcctgcctca

SEQ ID NO: 23344 - DNA, 201 bp, Homo sapiens
tcttctgaacagagtggaatctcgaggccctcctgtaaggcagatacctccgccaagatgccaaagacattttctgtctgtaaagtcccattagaggaaayagtcttttttttttttttttttgagacagagtctcgcactgtcgcccaggctggagtgcagtggcgccatctcggctcgctgcaagctccgcctcccgag

SEQ ID NO: 23345 - DNA, 201 bp, Homo sapiens
gacttggccaggcacggtggctcacgcctgttatcccagcactttgggaggccgaggcgggcagatcacgaggtcaggagatcgaccatcctggctaacaytctgaaaccccgtctctactaaaaatacaaaaaattagccgggcatggtggcaggcgtctgtagtcccagctactcgggaggctgaggcagaagaatggt

SEQ ID NO: 23346 - DNA, 201 bp, Homo sapiens
ttttaaaataatctgaaggccaaatccatccatttatcctacattatgggcaattaagaaaatggtaagacttggccaggcacggtggctcacgcctgttwtcccagcactttgggaggccgaggcgggcagatcacgaggtcaggagatcgaccatcctggctaacattctgaaaccccgtctctactaaaaatacaaaa

SEQ ID NO: 23347 - DNA, 201 bp, Homo sapiens
actacatccctaagcaagcaattaggtacccttgtatctgacacataaaaatgagaaatagaaatctataggcagtgctctttttttgtgaaagacactgyattgcttcagctgtttttcttttaaagtagggaatggtatcactgtttattctaattagaaaatacgtaaatgctctacaggtcaaaatcccagggtatg

SEQ ID NO: 23348 - DNA, 201 bp, Homo sapiens
caaaggggttacagaccccatgcaagtcagaaacccagcagggcggtcattaaatcttaaagctccaaaatgatctcctttgactccatgtgtcacatccrggccacactgatgcaaggggtgggctccaaaggccttgggcatctccacccctatgaagttgagtgcctgcagcttttctaggttcatggtgcaagctgt

SEQ ID NO: 23349 - DNA, 201 bp, Homo sapiens
tcctatgtagatttctttggaagaaaaataatcattcagcaacgaaaataaagtttgaaaacacctgctttatgatatctcataaggtcttctaaattttrcgtggctatttctaggtaagaaattctccaataaatgtctattctgtacaattctaattgccaagaagatgtttcttagagcaaaatgatgtgtactttc

SEQ ID NO: 23350 - DNA, 201 bp, Homo sapiens
tgggcatggtggtggacacctataataccagctactcaggaggttgaggcaggaaaattgcttgaacccaggagacagaggttgcagtgagctgagatcaygccacttcgctccaccctgggtgacagagtgagactccatctcaaaacaaagtgctcttggataaacattgttttgtaataatattgcttccatttatga

SEQ ID NO: 23351 - DNA, 201 bp, Homo sapiens
agatggtgaaaccccatctctactaaaactacaaaaattggctgggcgtggtggcaggcatctgtgatcccagctactcgggaggctgaggcaggaaaatygcttgaatccaggaggcggaggttacaaagattgcaccattgtactccagcttgggtgacaagaacaaaactccatctcaaaaaaaaaaaaaaaaaagga

SEQ ID NO: 23352 - DNA, 201 bp, Homo sapiens
attataagaggtaacaatacaaggagtctggagagaaatcccatgtccaaaataatgggaatttattaagtaagtttataaaattatatatatatatatatatatttccttcgtttagcagatgattgatacatgaggcagattgaccatcctatatagtatcttccctctcctagcttataatgtcatttggaagataaa

SEQ ID NO: 23353 - DNA, 201 bp, Homo sapiens
tattataagaggtaacaatacaaggagtctggagagaaatcccatgtccaaaataatgggaatttattaagtaagtttataaaattatatatatatatatatatatttccttcgtttagcagatgattgatacatgaggcagattgaccatcctatatagtatcttccctctcctagcttataatgtcatttggaagataa

SEQ ID NO: 23354 - DNA, 201 bp, Homo sapiens
atgttttggaatatccttctcttgccacctttaaaactagactgaattctcatcttgcttcctagagcagcgtttcttctaaaaattttaaacttgttccrttggctctacatacatttttgtcaatgccagtttagtgtggtagaatagataatctgctgcttactgggtgtgtgaccttaagaatattgctttgcctca

SEQ ID NO: 23355 - DNA, 201 bp, Homo sapiens
ccgtctgtcacccctttccttggccaggaaagggaactccctgaccccttgcacttcctgagtgaggcaatgcctcgccctgcttcggctcgtgcacagcrcgctgcacccactgacctgcacccactgtctggcactccctagtgagatgaacccagtacctcagatggaaatgcagaaatcacccgtcttctgcgtagc

SEQ ID NO: 23356 - DNA, 201 bp, Homo sapiens
ccttgcagtttgatctctgactgctttgctagcaatcagtgagactccgtgggcgtgggaccctctgagccatgtgcgggatataatctcctggtgtgccrtttcctaagcccatcggaaaagtgcagtgtttgggtgggagtgacccgattttccaggtgccgtctgtcacccctttccttggccaggaaagggaactcc

SEQ ID NO: 23357 - DNA, 201 bp, Homo sapiens
tacctaagcaagcctgggcaatggcgggtgcccatccccaagcctcgctgccgccttgcagtttgatctctgactgctttgctagcaatcagtgagactcygtgggcgtgggaccctctgagccatgtgcgggatataatctcctggtgtgccgtttcctaagcccatcggaaaagtgcagtgtttgggtgggagtgaccc

SEQ ID NO: 23358 - DNA, 201 bp, Homo sapiens
tccacccagttcgagcttccaggctgctttgtttacctaagcaagcctgggcaatggcgggtgcccatccccaagcctcgctgccgccttgcagtttgatytctgactgctttgctagcaatcagtgagactccgtgggcgtgggaccctctgagccatgtgcgggatataatctcctggtgtgccgtttcctaagcccat

SEQ ID NO: 23359 - DNA, 201 bp, Homo sapiens
cttgaggaggcagtctgcccgttctcagatctccagctgcgtgctgggagaaccactgctctcttcaaagctgtcagacagggacatttaagtctgcagasgttactgctgtctttttgtttgtctgtgccctgccatcagaggtggagcctacagaggcaggcaggcctccttgagctgtggtgggctccacccagttcg

SEQ ID NO: 23360 - DNA, 201 bp, Homo sapiens
tttcatttttctaaactgtctgttctcatctttataaggaaatagcaacattgcctacccactcctatccctgtaggatcccaaagataaatgagatactstctggatagctttgaacttttggcagaaagacatcattccaggccaaggcattattatgttactactctgtaagatgaaccatggaaaagctttgacact

SEQ ID NO: 23361 - DNA, 201 bp, Homo sapiens
aatttaaagtcaaaagacatgagttggggccaggcacggtgtctcatgcctgtaatctgggcattttggtaggctgaggagggcggatcactcgaggtccrgagtttgagacctgcctggccaacacggcgaaaccctgtctgtactaaaaatacaaaaattagccaggcgtgatggcaggtgcttgtattcgcagctatt

SEQ ID NO: 23362 - DNA, 201 bp, Homo sapiens
gatcactcgaggtccggagtttgagacctgcctggccaacacggcgaaaccctgtctgtactaaaaatacaaaaattagccaggcgtgatggcaggtgctygtattcgcagctatttgggaggctgaggcaggacaatggcttaaacctgggaggcagaggttgcagtgagccgagattgcaccactgtactccagcctgg

SEQ ID NO: 23363 - DNA, 201 bp, Homo sapiens
ctgaggcttctgcattctccacgtagttctcgcgccttggctttcagctccatcagctcctttaagcacttctctgtattggttattctagttatacattygtctaaatttttttcaaagttttcaacttctttgcctttggtttgaatttcctcctgtagctcggagtggtttgatcgtctgaagccttcttctctcaac

SEQ ID NO: 23364 - DNA, 201 bp, Homo sapiens
tgccttgctagattggggaagttctcctggataatatcctgcagagtgttttccaacttggttccattctccccatcactttcaggtacaccaatcagacrcagatttggtcttttcacatagtcccatatttcttggaggctttgttcgtttctttttattcttttttctctaaacttcctttctcgcttcatttcattc

SEQ ID NO: 23365 - DNA, 201 bp, Homo sapiens
tttcagttggtgatcctaactttgtgcataggcattcctaaattcatttggcaggtaaggaaactaagaccctaagagagcaagaggtttatgcaagtggwagaacaaaatctatatcccagatcttcaggctcctaattcagatttgtttccataatttttttcatggatataaggttaggtaaaaaatttttaaaaagg

SEQ ID NO: 23366 - DNA, 201 bp, Homo sapiens
ttccttcaggagctcttttagggcaggcctggtggtgacaaaatctctcagcatttgcttgtctataaagtattttatttctccttcactgatgaagcttrgtttggctggatatgaaattctgggttgaaaattcttttctttaagaatgttgaatattggtccccactgtcttctggcttgtagagtttctgccgagag

SEQ ID NO: 23367 - DNA, 201 bp, Homo sapiens
gtactggttgttcctttccatgtttagcacttccttcaggagctcttttagggcaggcctggtggtgacaaaatctctcagcatttgcttgtctataaagkattttatttctccttcactgatgaagcttagtttggctggatatgaaattctgggttgaaaattcttttctttaagaatgttgaatattggtccccactg

SEQ ID NO: 23368 - DNA, 201 bp, Homo sapiens
cggctggtactggttgttcctttccatgtttagcacttccttcaggagctcttttagggcaggcctggtggtgacaaaatctctcagcatttgcttgtctrtaaagtattttatttctccttcactgatgaagcttagtttggctggatatgaaattctgggttgaaaattcttttctttaagaatgttgaatattggtcc

SEQ ID NO: 23369 - DNA, 201 bp, Homo sapiens
attctgttgatttggggtggagagttctgtagatgtctattaggtccgcttggtgcagagctgagttcaattcctgggtatcctttttgactttctgtctkgttgatccgtctaatgttgacagtggggtgttaaagtctcccattattattgtgtgggagtctaagtctctttgtaggtcactcaggacttgctttatga

SEQ ID NO: 23370 - DNA, 201 bp, Homo sapiens
aagtatgtggtcaattttggaataggtgtggtgtggtgctgaaaaaaatgtacattctgttgatttggggtggagagttctgtagatgtctattaggtccrcttggtgcagagctgagttcaattcctgggtatcctttttgactttctgtcttgttgatccgtctaatgttgacagtggggtgttaaagtctcccattat

SEQ ID NO: 23371 - DNA, 201 bp, Homo sapiens
ttctcgttggtttcaaagaacatctttatttctgccttcatttcgttatgtacccagtagtcattcaggagcaggttgttcagtttccatgtagttgagtrgttttgagtgagattcttaatcctgagttctagtttgattgcactgtggtctgagagacagtttgttataatttctgttcttttacatttgctgtggaga

SEQ ID NO: 23372 - DNA, 201 bp, Homo sapiens
ttttttctttattagtcttcctagtggtctatcaattttgttgatcctttcaaaaaaccagctcctggattcattaattttttgaagggtttttttttccyccatttccttcagttctgctctgattttagttatttcttgccttctgctagcttttgaatgtgtttgctcttgcttttctagttcttttaattgtgatat

SEQ ID NO: 23373 - DNA, 201 bp, Homo sapiens
ctttttttctttattagtcttcctagtggtctatcaattttgttgatcctttcaaaaaaccagctcctggattcattaattttttgaagggtttttttttyccccatttccttcagttctgctctgattttagttatttcttgccttctgctagcttttgaatgtgtttgctcttgcttttctagttcttttaattgtgat

SEQ ID NO: 23374 - DNA, 201 bp, Homo sapiens
ctcattgaacttacctgcatgaacttgtggcctcctgtcttatccaatgggctataatctatgctatcctaacttcttttattttaaagtaaaacattccscagatgcagccaatgtgactttaagatgactcatatcttttgacacgttcatatcattctttaagaacttcattactttctggcacaagaagatattcta

SEQ ID NO: 23375 - DNA, 201 bp, Homo sapiens
tggcctcctgtcttatccaatgggctataatctatgctatcctaacttcttttattttaaagtaaaacattccccagatgcagccaatgtgactttaagawgactcatatcttttgacacgttcatatcattctttaagaacttcattactttctggcacaagaagatattctaggttcatcttgaactttccctgctcca

SEQ ID NO: 23376 - DNA, 201 bp, Homo sapiens
gagctttgtattctagcaagataactgggaatgatgaagaggacagactggtgggaagagaggctggaggtcaaaaacaccagatgggaagtcaattgcaragtgccaggcatgaatggtagtaccagaattaagtcagtgaaagtaagattggacggggtgagaatggaagagagagggatttcagaaatggaattgata

SEQ ID NO: 23377 - DNA, 201 bp, Homo sapiens
taaacagcctcctaccattgctgcccccacccccacacagatgctgtcctcgcctcactcaggttctacatccctcctcaggtcaccactgcacccctggyttagatgcccttttcactctgttcagcctcaacatcccatcctggactaccacggctccctgtctccctatgaacattgatgaacattgtcttctttagc

SEQ ID NO: 23378 - DNA, 201 bp, Homo sapiens
catgctagcaatcagcaagactctgtgggcataggaccctccgagccaggtgcgggatataatctcctggtgcgccgttttttaagcctgtcggaaaagcrcagtatttgggtgggagtgacccgattttccaggtgccgtctgtcacccctttctttgactaagaaagggaactccctgaccccttgcgcttcccgagtg

SEQ ID NO: 23379 - DNA, 201 bp, Homo sapiens
tgcccttttcactctgttcagcctcaacatcccatcctggactaccacggctccctgtctccctatgaacattgatgaacattgtcttctttagccttgcstaatgggtttcgactgaaccatttaagaaaagaaagcaaaagtatgaggaattgctgaggatttctgaacagaaaccctattgtttccaggcttagaagc

SEQ ID NO: 23380 - DNA, 201 bp, Homo sapiens
ttgggaactccataagccctctaatatatgtgcaaatatgcttttctctggtgaaagaatccagaactttattcagtttcttaatagatgcattacccagyaacattaactacttgctctacatcaaaaggttgacaacaaattcggtcttaccaataattaaagaaaagcaaataaaatgaaatactatttgccataaat

SEQ ID NO: 23381 - DNA, 201 bp, Homo sapiens
tccaaaacagatcttactgggctaaaatcaagattgaccaagatgtttccttctggaggctctacggggaaatgtattcgtcttttccagctcctcaaagycacctgcatcccttggctgtggcccttctcccatctgcaagaatggcagcatagcatcttcacatttctctctgactcgctatcttccccattataaggc

SEQ ID NO: 23382 - DNA, 201 bp, Homo sapiens
ctacttgcataatcgaggataatcccccatctcagtattctttcttaatcacatttgcaaagtcccttttgtcatgtgaggtagcatattcataggtttcrgggattagggtgtggatttctttaggggggcagttattctgcctatcagaagatcaaagaattaaataatatatactatcatgcattgttgcccaaaacg

SEQ ID NO: 23383 - DNA, 201 bp, Homo sapiens
ccaggcagttagtggttttactaggccatttgttctcagcatacagaaactcaaatgatctcataccctcgaccaggggttggtcctgaaggcaagtctakaccaccacccctttataaataagattttagtggggcacagccccacccatttgtttatgtattgtctatggctgatctcaagttacaatggcagagttga

SEQ ID NO: 23384 - DNA, 201 bp, Homo sapiens
cactgttcattcccaattcccacccccaccatcataattcaaaaataaattttaaggggaaaaaatctcattactgtaggaaaaggttggttttccttctytatattctagggtttctcagctttggtctttagagagatctaagagcaaactctaatgaaatgctaattgtacattttaaagcagaatacaggtgcccag

SEQ ID NO: 23385 - DNA, 201 bp, Homo sapiens
attcacacataatagcttgtgattgagattatttctatttttaagagaaggaattaaatcaaaatgtgactgggcaggagtaaaatggtgattaagcaaayaaggaatttttgttgcaaatttgaattagaatatatatatatgtattccacccgcccccctcaagatggagtcttgctctgtcgcccaggctggaatgca

SEQ ID NO: 23386 - DNA, 201 bp, Homo sapiens
tatactaatctcttaagtgaattaaagactgaataattcacacataatagcttgtgattgagattatttctatttttaagagaaggaattaaatcaaaatstgactgggcaggagtaaaatggtgattaagcaaacaaggaatttttgttgcaaatttgaattagaatatatatatatgtattccacccgcccccctcaag

SEQ ID NO: 23387 - DNA, 201 bp, Homo sapiens
ttcccaagcaagataaagtctgcaagactttctggaattagttactgctatacagtaatactgatactgagacatgaactttgggacatactgcatggagyttgggagctgaggactgtatatatggtggtgtgtatgcttggaatttggataacagacatcctgaaattaaactcactcactgtggtgttcctggaattt

SEQ ID NO: 23388 - DNA, 201 bp, Homo sapiens
ggcctttccccggttgccattaatatggatctagattacctaaagttttacattacttttcctaggtgctgaaaacgttttagaaatgagaaagtcaagasacatagaagctggaggctaaaataagatactttccatcgtcaggtaacatatacccatggtaaaccctggtagcctactttccttttcctataaacatcc

SEQ ID NO: 23389 - DNA, 201 bp, Homo sapiens
ggtactcagcctagtacccaatagctattttttcagctccgctctctcctcccactctccaccctcaagtaagccccagggtctgttgttcccccttcttygtgttcatgaattctcatcatttagttcccacttataagtgagcacatgcagtacttggttttctgttcctgtattagtttgcctccagctccatccatg

SEQ ID NO: 23390 - DNA, 201 bp, Homo sapiens
attaaataattagaagaggtaatggtagtaatctgagcaacctgacccactgacattggcaaaaaaatatctgaatattgaaagagaatggtaatggaaasaaggatatgagaaggaaggcatgcagcctgggaatgtctgggaaaaggcagtctaagccctacctacttcctcaagtgctaagggccctgtaatatttat

SEQ ID NO: 23391 - DNA, 201 bp, Homo sapiens
gcagacataagcacagagattggagaatcatcttggctgttaaattcagcactcagccatcttgctcagaaatcttccaaatccgaatggcctaggcaaasttttgaaggaaaggaagtagtttccaggtaaattgcttcagtctggatccgtggagtttagctgtacttaccaatgcagataagggcctctccaggtatg

SEQ ID NO: 23392 - DNA, 201 bp, Homo sapiens
ctttctgtttgttagttttcctctaacagtcaggctcctctgctgcaggtctgttggagtttgctggaggtccactccagaccctgtttacctgggtatcrgcagcggaggctacagaacagcaaagattgctgcctgttgcttcctctggaagcttcatcccagaggggcacccaccagatgccagctggagctctccta

SEQ ID NO: 23393 - DNA, 201 bp, Homo sapiens
gcctgttgcttcctctggaagcttcatcccagaggggcacccaccagatgccagctggagctctcctatatgaggtgtctgttgacccctgctggaaggtrtctctcagtcaggaggcacaggggttagggacccacttcacgaggcagcctgtcccttagtagagctctagcgctgtgctgggagatctgctgttctctt

SEQ ID NO: 23394 - DNA, 201 bp, Homo sapiens
acgaggcagcctgtcccttagtagagctctagcgctgtgctgggagatctgctgttctctttagagccagcaggcaggaacgtttaagtctgctgaagccrcacccacagcctccccttcacccaggtgctctgtcccagggagatgggagtttgatctgtaagcccctgactggggctgctgcctttccttcagagatgc

SEQ ID NO: 23395 - DNA, 201 bp, Homo sapiens
caggccacccccagaagctctgacccaagtttttgttttagaaagacagctgggatggccacatagagtggaaaggcctggagaagggaggccaaaagttwcaagattattacacctctcctggtgagaagccacgaaggcagtagcaccagcagcagcagtagtgatgacaaagaagcgtaaacatccagctgtaaggct

SEQ ID NO: 23396 - DNA, 201 bp, Homo sapiens
attgcaccattacactccaacctgagcaacagaatgagagcctgcctcaaaaaaaaaaaaaaaaaaagaggatataggtcaggtaagagctgggtcagcamacaagtagcagctctgtcctattccaggccttcaatccattggccaagtggaaaagctggaagatacctctccctaaatgtatcagttagctatcacctc

SEQ ID NO: 23397 - DNA, 201 bp, Homo sapiens
aacagacatggtcctaaagatgagtccttctacatagaatgtcggtaaggatttggcacaggggtgaggaagacaggaattaattggtcagtactttccaktggttttatgttgctgtcatgatattattttctttaaactgtatatttaactattgctgatgtaacggggtttctgcctaaagaaatagacacattaatt

SEQ ID NO: 23398 - DNA, 201 bp, Homo sapiens
cacagtttgatgccattgcatacatctaccttgttgtgcagctatcatcactgtctccagaattttttcatcaactgaaactctgcactcctcctccctcycttctcccagcctctggtagccactattccactttctgtttctatgaatttggctgctccaggtacctcatataagtggaatcatacaatatttgtcctt

SEQ ID NO: 23399 - DNA, 201 bp, Homo sapiens
agatttggtgggaacgttttcagaactagccggttctttttttctagctgttataaccatttgtcactgagacctaatataatttccctgatatactacayacttttagttcttatttggggcttgtaactggtctgagataacaaacatgctttgaaattactgttatgaggttaattggcatttaaattcccagcccat

SEQ ID NO: 23400 - DNA, 201 bp, Homo sapiens
catttggaattatatttctgtcagtgcaattactatatgaggttgtatctcccatcctcattagaattatacctaaagttcttattaaaataaattaattrcaataagaccaagatgaccttgtgcatcaaaagtaggatagttgaaagaaagggaatagcagaaaaatcacgtgcatgaacatatgccgtttataataca

SEQ ID NO: 23401 - DNA, 201 bp, Homo sapiens
taagaggttgaagctgcaacgagctgtgatcataccactttcactactccagcctgggtgacagagcaaaaccttgtctttttttttttttttttttttttgaaaaaggtatgctgtctgcagtatagtgatcaaattggcaagtgaaaggactacagaaagagaaacctaatctaggtgagcaattatggtgatgagaat

SEQ ID NO: 23402 - DNA, 201 bp, Homo sapiens
gaatttattcttgctaatttaagcagaaagtgatgtgttataggatattaaataacacataacatttgagttaccaaagaaaaagactccaacttgagctytctgaagattccagtgctgctttacagaaacacatcaccatgggagttgctgcctcttccacagccaggaagtcatctgctgctgaatggaaaagctgca

SEQ ID NO: 23403 - DNA, 201 bp, Homo sapiens
gtattattcagctgccacggcttctgctagtgctgctgctcacacacttgcagacggttttaatttagatacctgaagaggaaaaaaggaatttggccaaygccctgctcagatgccgtaagtggcctttccccggttgccattaatatggatctagattacctaaagttttacattacttttcctaggtgctgaaaacgt

SEQ ID NO: 23404 - DNA, 201 bp, Homo sapiens
tacccttacctgagtttatcatccacacctgtgccaatgtctacactcacagtgttaggtggttcaccagctcctgttgtgagcacaccctctgccacatrttgtggaacctacagcaataaataaaacctgtgttttgtggtccctgatgcttacagaggagtgaaggcaagcgatggatacccggctacctagaattgg

SEQ ID NO: 23405 - DNA, 201 bp, Homo sapiens
gggctgcctggtgaagtatgactacagacaccacacccagggcatagggagctgcatccttgcaccttagctgctagggtttgtataggtctgctggaaartctatcaagcagtccctctaaaaacaaaggctcaaatgtacattgccttaagactgtatttgtacccttacctgagtttatcatccacacctgtgccaat

SEQ ID NO: 23406 - DNA, 201 bp, Homo sapiens
taagaacagacatatagaccaatgaaaccgaatagagaactcagaaataagatcacatacctacaaccatctgatctttgacaaacctgacaaaaacaagyaatggagaaaggactccctacttaatagatggtgcttggataactggctagctgtatgcagaaaattgatactggactccttccacacaccttatacaaa

SEQ ID NO: 23407 - DNA, 201 bp, Homo sapiens
ttgttggaactagagatgaccattggcttcactttaaagtcaccaggtgcattatcccctaacaagagagtcagcctgtcctttgaagctttgaagccagrtattgacttctctctagttatcaagctcctagatagcatcttcttccaatagaagagtgtttcatctacactgaaaatctcttgtgtttaacatagccac

SEQ ID NO: 23408 - DNA, 201 bp, Homo sapiens
tttatgggcatattgtatgtataataacaggagtcaaatcctcccccatccctgaaaggacttatgtcttagtggattttaagagagagggaaataacatscaaatgggccaaatgtacaaagaacacactgtgggcagctttctaattacaagaagaaagcacgactaaacagttgagtcttatggtggtcccaaaggga

SEQ ID NO: 23409 - DNA, 201 bp, Homo sapiens
gtcagatatattcctagatattttatttttgtgtatttttgtgttgctattgtaaatggcattgcattcttgatttggccctcagcttgaaggttattgayatacagaaatgttactgattttgtacattgattctgtatcctgaaactttactgaagtcatttatcaattccaggagccttttggaagtctttagggttt

SEQ ID NO: 23410 - DNA, 201 bp, Homo sapiens
cctccagaactactgctccgcctagtggcagccttcaagccttcatctaccaattttatgggcatattgtatgtataataacaggagtcaaatcctccccyatccctgaaaggacttatgtcttagtggattttaagagagagggaaataacatccaaatgggccaaatgtacaaagaacacactgtgggcagctttctaa

SEQ ID NO: 23411 - DNA, 201 bp, Homo sapiens
ctgttacattacttctaacaggaactataatccaaaagctgtactgtgggtacaatgaggtctgaaggaaccgtgcaaaaatgattcttgtaatgcttctktttctgtgtctgactatcttggaggggcttcacttctcatattgggcctgataaattgaaacgcttgcctttatttcggtttccttattttttcttcaat

SEQ ID NO: 23412 - DNA, 201 bp, Homo sapiens; identical to SEQ ID NO: 3848

SEQ ID NO: 23413 - DNA, 201 bp, Homo sapiens
ttgctttgaaggtaaccaaatgagtatttattatgtatttatttagtgtgccagcactatgctgaatactgaagagagaactatgaatgagataataattkataatctcactgaagaaatgagacactgttgattgaaaaaggcttcgtagtggagttttaacaactagatcaggaaacagacagattcttgtgtagtata

SEQ ID NO: 23414 - DNA, 201 bp, Homo sapiens
cacaatagcaaagacatggaatcaacctaaatgcccatcaatgatagactggataaaggaaatgtggtaaagaaacaccatggaatattatgcagccacaraaaagaatgagattatgtcctttgcagggacatgaatggagctggaggccattatccttaacaaactgacacaagaacaaaaacaaaaaacaaacaaaca

SEQ ID NO: 23415 - DNA, 201 bp, Homo sapiens
ctgagtacttgatgaaagctagagggaacctcttgctagaaaaaagccaataaacacaaaacttttgcttatactgttaaggattaacaccccagcaccayccccagtggaaccctagggatccaaagacccccaagttaagagcctttgttctaaagtgacctccatgggatgcgtatcctcttgttttactgaaatagc

SEQ ID NO: 23416 - DNA, 201 bp, Homo sapiens
tctcaaaaagtaatctggggtccagcagcatcaacgtcagcctggttcctgtgagaaatgaatatcaagtttcatctttggcctgcagaatcaaaatcttcagtttaacaagatctccaggtgactcgtatgcacattaaaggctgagaagctctgttctatcagatggtccttcctttcccagcctgggtcactgagtta

SEQ ID NO: 23417 - DNA, 201 bp, Homo sapiens
gacataggaactggcaaagatttcatgatgaagacgccaaaaccaacagaagcaaaaattgacaaatgggatctaattaagctaacaaacttctacacagygaaagaaactatcatcagagtgaacagacaacctacagaattggagaaaatatttgcaaactatgcatctgacaaaggtctaacatccagcatctataag

SEQ ID NO: 23418 - DNA, 201 bp, Homo sapiens
caggcacttttctgtgtcctttaaatacattagcttatacagaactctcacaacaaccctaggtaggtactatcattctcattttataaatgaggaaactrtcactgagaagttaagtaaattacttgcccaaggctacagagctgctaagtggcaaagcggggatttgatcccatcattaatggctccggagtctgtcct

SEQ ID NO: 23419 - DNA, 201 bp, Homo sapiens
ctggacataggaactggcaaagatttcatgatgaagacgccaaaaccaacagaagcaaaaattgacaaatgggatctaattaagctaacaaacttctacayagcgaaagaaactatcatcagagtgaacagacaacctacagaattggagaaaatatttgcaaactatgcatctgacaaaggtctaacatccagcatctat

SEQ ID NO: 23420 - DNA, 201 bp, Homo sapiens
caaaagaaaagtattgagtgtcaacacagtggtcgcagaaatgaccatcatgaatcatgcaggtgaagagcactggaggatagtagacaaccagtggcaamcagacagtactagtgaggcttagagtcaggcactatctattccctgaaatgctaggggatctccagagatccccctagcagttagtttactcttcctgga

SEQ ID NO: 23421 - DNA, 201 bp, Homo sapiens
taaatgattatatttcccagaaagttttgtacagtgttccaaagtggtgctgaataggagatgaattaaggcatatttggaagtctttaacttgggcaacwcagagtatcagcagatggaaacttctcagaatggaagtgaagatcagatgggaaattcctccagggtcaatttcagaaccatagttgtgaataattctct

SEQ ID NO: 23422 - DNA, 201 bp, Homo sapiens
tgataccaaaacctggcagagagagacacaacaaaaaaagaaaacttcagatcaatatccttgatgaatattgatgcaaagatcctcaacaaaatactggmaaacccaatttagcatcacttcaaaaagctaatttagcatgagcaactaggctttatcccagagatgcaaggttgattcaatgtatgcaagtcaataaat

SEQ ID NO: 23423 - DNA, 201 bp, Homo sapiens
ccaacacaagacaaagatgccttctctcaccactcctattcaacatcatattggaagtgctggccagagcaatcaggcaagagaaaaagataaaaagcatscaaataggaagaaaggaagtcacactatctctgtttgcagacaacatgattctctgtctagaaaaccacatgggctcaacccaaaagctccttaaaccaa

SEQ ID NO: 23424 - DNA, 201 bp, Homo sapiens
aattaaactaaagagcttctgcacagcaaaagaaactatcaacagagtaaacagataaccctacagaatgggtgaaaatatttgcaaactatgcaactgamaaacgtctattatccagcatgtataaggaacttaaacaagtttataaaacaaaccaccccaagaaaccccattaaaaagtgagtaaagggcatgaacagg

SEQ ID NO: 23425 - DNA, 201 bp, Homo sapiens
ctatcaacagagtaaacagataaccctacagaatgggtgaaaatatttgcaaactatgcaactgacaaacgtctattatccagcatgtataaggaacttamacaagtttataaaacaaaccaccccaagaaaccccattaaaaagtgagtaaagggcatgaacaggcacatttcaaaagatgacatacatgcagccaacaa

SEQ ID NO: 23426 - DNA, 201 bp, Homo sapiens
cttggttatacacacctaggagtgaaatttctgggttgtttggcgcatttatgtttactattgaagaaagtgccaactatgtttcaaagagactgcaccaytttacatttccaccagcaatgtaggatagttcagtttctccatattctcaccaacagttgttttcatctatcattttaattacagccagcctcatgagcg

SEQ ID NO: 23427 - DNA, 201 bp, Homo sapiens
ttatttgaggaacatctaggtagttgttcaaagagttgggttagcaaggtttctaggaaaacagcgtgatggagaattatcagcctaaatccaggcatcaygaggggatgttgatattctactgacattctttgctatcatctctgagctgataggaaagtgaaatctgtagcctctaaatgattatatttcccagaaagt

SEQ ID NO: 23428 - DNA, 201 bp, Homo sapiens
agagtataacacccctagccaaagaacctggtaaattttccttctctacatctaataccaggaggcttacgtaatatggacaaatatatgttcagtattcytacgtctaaatccagttctagaaacaatacctggaagggcagtgctgacttccttgtagaagagccagattctccaaaattggcactgcacattggatta

SEQ ID NO: 23429 - DNA, 201 bp, Homo sapiens
tatctaaaagagcaccgctcatcattgtctatccttttaactctatttagataattttattctctgatatgttacataaatatttgttgattgcctttccrcaaggctaaagactttctttacggctgtatgcccagtaaccggcaccaaacgtactaaataatagtgaatgaattaacaaatgaatggagcaaggcaaca

SEQ ID NO: 23430 - DNA, 201 bp, Homo sapiens
aggcttgactaagcttttcaatgcacgttaatggcatgtggtaaggaaaaataagacatttccctttctgacctttgacatcacaatttttccatttttgytggctgttcaataagaaatacggctggagcttagttttctctatctttcaagttctgtttaagaaaagagtgaatgtatctgcacagatcatgcaggagg

SEQ ID NO: 23431 - DNA, 201 bp, Homo sapiens
ctttggcccttttaatttttaccttaatgggcattgagagtctaactccaatggctttaagatggagaaggttcagtggaatcttgatagaaacagagacktggcagccaggtgcaaagaacactaaagcactgggcctaggcaagcagagggaaagtcctggattctccatcatccaggacatcgttgtgggggagggta

SEQ ID NO: 23432 - DNA, 201 bp, Homo sapiens
tcttgaaatagcacttaggaaacacactttggcccttttaatttttaccttaatgggcattgagagtctaactccaatggctttaagatggagaaggttcrgtggaatcttgatagaaacagagacgtggcagccaggtgcaaagaacactaaagcactgggcctaggcaagcagagggaaagtcctggattctccatcat

SEQ ID NO: 23433 - DNA, 201 bp, Homo sapiens
aactagctctgtggcctagggcgaggtgtctgccctttatgtttccacatctgcaaagtgaactggttgtacctgatgatctgagatcccatgacttgctyacatgtcccatgattctttattttgtaggcagaagcattaaacagctactcctgctgctgtgtgctaatcattcctgtaatttctgttctgcttatttgc

SEQ ID NO: 23434 - DNA, 201 bp, Homo sapiens
aatagtaggtcttaaagtaacaactaattttaattaatctaatagttactcaaaatcaacagattaagatatgtcaagtatgattatcctgatatccctgsaaacaattttccacttggaccaaagtaagaacattttatctgatataaagtattccacattttaaaaataattgagttagaagattttggcatcttgaag

SEQ ID NO: 23435 - DNA, 201 bp, Homo sapiens
cactagtggtatctaaacaatgaaaacactattaatttggtaagtttcagggtgctattttgcctttctttaaatttttcttggagcttcttacttttttrttacctgagattaaaatattgcaaaataagcaacactgtgcagtgattctggatgaggatgaggtcagaccactgcatccagctgacacctcatagtgga

SEQ ID NO: 23436 - DNA, 201 bp, Homo sapiens
ctattattttggtactttaattatggtgctcccgagtggtttttgatttattcatttattacacaaatattcattgtctactataaagaacacattattgsatacattttctaaaagatccagtagattctctgactcttacaactgcttatgtgttcctattttctaggaagctcaaatccagatgtgacctccccccac

SEQ ID NO: 23437 - DNA, 201 bp, Homo sapiens
tatagactcatagaatgttagaattagagaagaattagtatatttgggttgtctgccctgtgccaggcatggtaccttatgaccttttgccccaaactcaytcaattctcaccactaccttgaaaattgggcattaccttaattatacagataaggaaattggaacatttaaagacatgaaatgccttatttaggctatac

SEQ ID NO: 23438 - DNA, 201 bp, Homo sapiens
aaatgtgactggtttttacttaacagcatgtctatgagatgttttcataatagtaggtagaggtctatattaccttttttaacagctgattactgttcctraatgcatttaactatcccccaactgaaaattatttgggatttttctttttattttactcttttaagcattccaatgtgtgttgtgactttccaagtggac

SEQ ID NO: 23439 - DNA, 201 bp, Homo sapiens
agggaaaagatggaaattaacatcttcctacttcctcctaaaaagctgtggaacgagacagggcaatgggaaggggtcatcaggactctgctcagcctttkcctgcagggagaacattgagcccctggattagaggtcctgacaatttctttgagtgttggagactttttatgaaatccaaggcccatggcccatctaggt

SEQ ID NO: 23440 - DNA, 201 bp, Homo sapiens
ttactaaaggttgtatttattatgtggcagagctacgatatgcaacaaaaagaacttccttatgggtagtcactttaaagaatcacggaatcatagtcctytagtctagattcctcattttaaccttctatcttctcagaatccaagcataatgctcttttcattaagtctatatctaaatgctattgtttgactaatagt

SEQ ID NO: 23441 - DNA, 201 bp, Homo sapiens
atctttacaggggccctggcaatgaagatggttgtcattaattgattagtgactatctgccaggcaaatgtaaactctttatgtgttttatctcactgaawagaagtggatacaatttttatccacaccttatagaacaggaaatacataaagttaagtaatttactaaaggttgtatttattatgtggcagagctacgat

SEQ ID NO: 23442 - DNA, 201 bp, Homo sapiens
ttagttctgattgtggtggcagcttgatggtccacagccgggaatgaggtcctcccgaaaaacacaggcagtaaaggatggccccggccaaaataaacccygaagaatactttctctcccgtcctccggcaccttcgtctctccttctcttctccactctggctctttcctttgcccctctctcctggctgcatctcactc

SEQ ID NO: 23443 - DNA, 201 bp, Homo sapiens
ggagctacccaagaccgtggggacccacctcttgcatcagagtgatccagatatgagacaggagtcaaaggaaatcactttggggctttaagatttgactsccctggtggattttggacttgagtagggcctgtagtccctttgttttggccaatttctcccatttggaatggctgtatttaccaaatgcctgtatcccca

SEQ ID NO: 23444 - DNA, 201 bp, Homo sapiens
ccacaggggtggggctgtcatggagaacctctgctagggcagtgcagaagggaaatgtgaggtcggagcctccacacagagtgcctactggaacaccacckaggaaagctgtgagacaagggccaccatcctccagacgcagaatggtagatccactgacagcttgcactgtgtgcctggataagctgcagtcactcaaca

SEQ ID NO: 23445 - DNA, 201 bp, Homo sapiens
ttgccacaggggtggggctgtcatggagaacctctgctagggcagtgcagaagggaaatgtgaggtcggagcctccacacagagtgcctactggaacaccwcctaggaaagctgtgagacaagggccaccatcctccagacgcagaatggtagatccactgacagcttgcactgtgtgcctggataagctgcagtcactca

SEQ ID NO: 23446 - DNA, 201 bp, Homo sapiens
ctaggctgtcagtatttctgctggtatgaaattctcagaaatcacgtcagtctttcttgcaattaacaggtatccaagccatcaaacaagggggtcctctrcagttcttttctgaataactgcatctctattcctggcttctgctaagatgtttgagggattcatgggtcacatgcctaatttctttagcaaatggttatc

SEQ ID NO: 23447 - DNA, 201 bp, Homo sapiens
cccaggcttctgcatctgtgcctcagacctaagagtcattcttctttcactttgtcccatctctgagacatttattctaggctgtcagtatttctgctggyatgaaattctcagaaatcacgtcagtctttcttgcaattaacaggtatccaagccatcaaacaagggggtcctctacagttcttttctgaataactgcat

SEQ ID NO: 23448 - DNA, 201 bp, Homo sapiens
cggtgataatgtaactgataatattcatacatcagtaaagccaaaaagtataaatttagaatgttcctgttatttagttttctcaaattagcatccttgartattttatagaggtgagccaaaacatgtgtctcacaaaactgataagaaacaaaggggaattttcatattgtctcagtgatgtgtatgtcagcttgaggt

SEQ ID NO: 23449 - DNA, 201 bp, Homo sapiens
agctcacttgggtgatgctgactgacaagcaatcacctatattattgtcttgtggattgatggctaatgccaagcatctactttccttgactcagtatgartaggaatgcctacttggccaacccgtaatttccctcaatattgccatgatcagttgttatattgagacccactcagctagagctaactcctattattaat

SEQ ID NO: 23450 - DNA, 201 bp, Homo sapiens
gaactctgcatctcagcttctaggagcaacaaggcccagcagggagacattgggttgcccactgcatctcattagttctgattgtggtggcagcttgatgktccacagccgggaatgaggtcctcccgaaaaacacaggcagtaaaggatggccccggccaaaataaaccccgaagaatactttctctcccgtcctccggc

SEQ ID NO: 23451 - DNA, 201 bp, Homo sapiens
atggagggctgcaggcaggagagctcagctggagacggaaaaggaatcttaattacacgtggccaggctaaattctcctctccactggaaaaacagtttgmaggggggtagagcaaagttcacttgctggcatacagagatctggaagctggaggcagtgtattactaatgatgtctaatgttatccactctggggtttta

SEQ ID NO: 23452 - DNA, 201 bp, Homo sapiens
tatgtgcatttggcctttctttctccaccagtgttccacaagctgcggggaaggcacccagactcgaagcgccatttgccgaaagatgctgaaaaccggcmtctcaacggttgtcaattccaccctgtgcccgcccctgcctttctcttcctccatcaggccctgtatgctggcaacctgtgcaagtaagtatgtcagggc

SEQ ID NO: 23453 - DNA, 201 bp, Homo sapiens
tctgttttctaaagaggctgtatcattttactttcccaccagtaatgagtgaaactgctaattttccatatcctcaccaacacttgttgtcttttttttttattattattatggccattctagtggatatgaagttgtatctcatggtggttttgacttatatttcccaaatggactatttcattttaacaatgcatttgg

SEQ ID NO: 23454 - DNA, 201 bp, Homo sapiens
tgtttctctaggccctaattcagtttggctcagctatgacctcgactgtgtgcatagcaccgtgtctaactgcctttgggctccctcagtctcacatgttkctaagttacctcaaactccaaaggtctaacaccaagcttaatacatacctgcctgccaccccttcccccattaacctggtctttcatcattgatcattat

SEQ ID NO: 23455 - DNA, 201 bp, Homo sapiens
aatcactataagaactacttaccttgaaaaaactgttcaatgaatgaagattaattgtatctttttttaaagttagtatagggacataaacagaaagaaayaggtacttttgttatccagtaattttacttaattgaatgaatcatagtcaccctcctagaaattcagagaataaaaacatctcctgtttgctcaggaatg

SEQ ID NO: 23456 - DNA, 201 bp, Homo sapiens
ataatggctctgttttcttggatttcaatgcccccgggagtttttaaacacctcttgcctgcttcctaagtggctctgctcctgtgggttggaaatctgcrttcagtcatccctccacaaggcaaaagagcagggaagtggccacaaaactaagtaagtcacagtccagatttaggaggaatttgctccccttccctgcta

SEQ ID NO: 23457 - DNA, 201 bp, Homo sapiens
gtttgcctgccaggcatttggaacacttagtatccttctttgcatgtgaacaagtgttgccctggttgtctctttcagatacaactgggtaaccccgctgygacccaggtagctgttttttaaccattttgttagataaattttctccatcactaaaaccaaagagtgggatttttttgttctagattacatgagcaacag

SEQ ID NO: 23458 - DNA, 201 bp, Homo sapiens
agcaaacagccaataaagaaacagccatctttaagatgataggaaatttcctggtattttcgttcatccttgccccaccccctccccccatgtggcatggwtttgatcttaacaacgtggcagccactacttgtgaaatctgcagaaggaacacagacctgcagacacctgggaaaagagattatgggtggagactgaccc

SEQ ID NO: 23459 - DNA, 201 bp, Homo sapiens
tggactgctgaggaagggacttgtgtgtgttataattgtcttcctgtgttcctggagtttgtggcctttgaagcatatgagacagagaagattcagaaaaygttcttttgtgcctgcagatttgagggggacctttgagattttgggactaagaaaaaggtcccattggtcccattaagtacagtaggccttcagaacagt

SEQ ID NO: 23460 - DNA, 201 bp, Homo sapiens
cttttaacgaggctgcagggacctgagttacgcagccagcccttacccaacaatcggaagcttggaattgtaaatgggctcctcgtggaacaaaaccagasctcattggtgctgttttggccccaggattcttttccacacactgggttcttctccttctatctccacaccaccccctcctcctgacctccctgtacctct

SEQ ID NO: 23461 - DNA, 201 bp, Homo sapiens
aagccctggagacacaatagaattatctggggaaaaattacttggaagaagattataccgatatctttcttaaaaacaaaacaaaaactggtacctgggasccacatcccagaatatctgatttgatgggtctgaagtgaggcccaggcatcggtactttttaaaagctccccaggagaccttgaggtgcatgcaaggttg

SEQ ID NO: 23462 - DNA, 201 bp, Homo sapiens
ccatccattcatcaatgtctactctaggtagggaattagtaaggtgaaaaagggtttgtatgtttgtcatgtctttgccatctttattttcaggtccactktttggattaggattaccagtctagtttttggagcaagcagttgctattgtttttctgtgtgctgtatttgactatatgcttttatatttcatgaagcaga

SEQ ID NO: 23463 - DNA, 201 bp, Homo sapiens
taggatttcttattaaaaaagtgcaatattaataattgtacattgtcatccagaaacaaaactattggggggactttattaactaacttcctgcagttgtkttcctgtaaactcagtagtgattattatatttttcctatttttaatagaacctggtgtttaactctggatccattcactgtacaggatgtgttgtaaaaa

SEQ ID NO: 23464 - DNA, 201 bp, Homo sapiens
cagttaaatctttaaaacaggattacaaaaaggtttgatttctggtatccatccattcatcaatgtctactctaggtagggaattagtaaggtgaaaaagrgtttgtatgtttgtcatgtctttgccatctttattttcaggtccactttttggattaggattaccagtctagtttttggagcaagcagttgctattgttt

SEQ ID NO: 23465 - DNA, 201 bp, Homo sapiens; identical to SEQ ID NO: 3853

SEQ ID NO: 23466 - DNA, 201 bp, Homo sapiens
gctactttactataatttccattgtattgaaaattcagacacactgtagagaaagtcatggaagagccagctaggttggacttaagccagttaaatctttmaaacaggattacaaaaaggtttgatttctggtatccatccattcatcaatgtctactctaggtagggaattagtaaggtgaaaaagggtttgtatgtttg

SEQ ID NO: 23467 - DNA, 201 bp, Homo sapiens; identical to SEQ ID NO: 3854

SEQ ID NO: 23468 - DNA, 201 bp, Homo sapiens
ttaagatgataggaaatttcctggtattttcgttcatccttgccccaccccctccccccatgtggcatggttttgatcttaacaacgtggcagccactacktgtgaaatctgcagaaggaacacagacctgcagacacctgggaaaagagattatgggtggagactgaccctctatgcaactgacgctctaaagtcccaag

SEQ ID NO: 23469 - DNA, 201 bp, Homo sapiens
aaatagcccacttctttttacacgctgggggatggatgatctttgtactcgggtagtgttaacccatgtttgtgtcagtggctcaccatgctcagagagcrccaatattcaacgcacatagttaaaacttaccaaaccaagtcagcacaatatttaagaccatctagtctgtgccgacactgaactagaacgtcctggtgc

SEQ ID NO: 23470 - DNA, 201 bp, Homo sapiens
ttaggatttcttattaaaaaagtgcaatattaataattgtacattgtcatccagaaacaaaactattggggggactttattaactaacttcctgcagttgtgttcctgtaaactcagtagtgattattatatttttcctatttttaatagaacctggtgtttaactctggatccattcactgtacaggatgtgttgtaaaa

SEQ ID NO: 23471 - DNA, 201 bp, Homo sapiens
tcagaggtacttacccatgagaaaggtggcaaagcttgaggcaaagagtaggaagtaaaaaccaaatgtagctgtgcagttttctccccaactgggcctcmctgagcaataaattcccaacactaaggcagacgccatgtaggcaaatagcccacttctttttacacgctgggggatggatgatctttgtactcgggtagt

SEQ ID NO: 23472 - DNA, 201 bp, Homo sapiens
atgccagaaactatgctaggtacttcacatgtgttctctctgttaatcaccatattatgagaagtatcaatgttccccccacccccttttttttttttttkgagatgggattttactcttgttgcccaggctggagtgcattggcccgatctcagctcactgcaaccttcacctcctgggttcaagcgattcttgtgtccc

SEQ ID NO: 23473 - DNA, 201 bp, Homo sapiens
caaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacagaaaaagagaaacag

SEQ ID NO: 23474 - DNA, 201 bp, Homo sapiens
tcaaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacagaaaaagagaaaca

SEQ ID NO: 23475 - DNA, 201 bp, Homo sapiens
ttcaaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacagaaaaagagaaac

SEQ ID NO: 23476 - DNA, 201 bp, Homo sapiens
gagtaggcataggggagaggtcagagcttaaaattaaaatttttgatttatcagcacaaacttgtttctttccaacaattgtggtttcagaaaaattacartaagttcatggaagaatcttagtaattcacagaatggaaagtattgtggagaatatagtccccaaatttggcaaatccttaggagtcagtaatccacgtg

SEQ ID NO: 23477 - DNA, 201 bp, Homo sapiens
tttgaggtttaggagataataattttatgaaccagctattatttctctcagagaaaaaaaatacactgcattttcaacagtgtaaatatttatgaatcattatcaaaacaccatatactcccagaacttattgtaaaatgtcactccactgttcagctcataccctgaccacttccttactgggaaacaaacaaataatta

SEQ ID NO: 23478 - DNA, 201 bp, Homo sapiens
atctttcctgacctacccagctgaaaaacagaaatttccctcatactatataacctcccctaagatagacattgctctcatgttaaagtcagatgggacaygtcttttctaagtcacttgatgaaggcttgatttgtacactgatataacaaaattgggagcaggctctcctatctttcagagtctgcatgcattctgcat

SEQ ID NO: 23479 - DNA, 201 bp, Homo sapiens
tgtgtgtgtgtgtgtgtgtgtgtatttagagactggattttcattgactcagtttcagaataaatcaggtaagaccaattctaaaatccccaagtaaactstaggaaaacttgctactttactataatttccattgtattgaaaattcagacacactgtagagaaagtcatggaagagccagctaggttggacttaagcca

SEQ ID NO: 23480 - DNA, 201 bp, Homo sapiens
gtaaattttaatctgaaggcttgtagaataagataaacctatcaaaaagcccttccaagggataggcaatatttgcctttttaaaattaaatcttacctgyttttactgagatttattattcattagataatggccattgttagccatagttttacattttaaattgccctttatgaaacttacatcaaaaagattcttat

SEQ ID NO: 23481 - DNA, 201 bp, Homo sapiens
aatccttcttccccttaatttttaaacatgtgtatttcaagggaaatttgattcatatgtttctgattcatttacacttaaatcatcaaaatgttatttttgtaaaagctatttgatgtccaagaagctttctgaacctgttttataagttttcttaagtcctttttcttaaaacaggaagttgcattttgccaagtacaa

SEQ ID NO: 23482 - DNA, 201 bp, Homo sapiens
attgttcttactgatcttacttagttcagctgatctaagctgggtttggctggagtgacttgactgttctccacatttctctcatcttcctcttgggatcrtcaggccagtcccggcatgactttctaatataatggcaaaggcacaacagcacaagcaaaagctcccaagatctcttgtggtctaggtttggaactggta

SEQ ID NO: 23483 - DNA, 201 bp, Homo sapiens
tacagttcataagaatgaatgtatacagagtatcttttccaaccacagggaaggaaactagaagtcaacagcagaagtaaactggaaaattcacaaatacrtggaaatcaaacaaaacacaaacagtaaatcagtcagaaaagaaataacaaggaaaattagaaaataccttaagacaagtgaaaacaaaaccacaacata

SEQ ID NO: 23484 - DNA, 201 bp, Homo sapiens
agttgcataggcacccacacatccacagagggtagccgcctgtcttagtccagtcaggctgatataacagacatataaaaactagtggcttataaacaaacaaaacaaatttgttttttacagttctggagtctggcaagtcccaggtcagtgcagccgcagatttgatatcggtgagggcttgctgtctgcttcatagat

SEQ ID NO: 23485 - DNA, 201 bp, Homo sapiens
tgcagtgacttcctcaacactgaagttttgaacccctcaaagtcatccatgagggctagaatcaacctctcccaaattcctgttcatgttggtattttgayctcctcccatgaatcatgaatgtccttaatggcatctagaatgatgaatcctttccagaacattttctatttacttttcccagatccattttagaaatta

SEQ ID NO: 23486 - DNA, 201 bp, Homo sapiens
acacatgtttcagggttccatgggggatatgatgctgaccattcttttgtttctcacagagttccaggaccgcacgctccgaggaggaccgggacggcctrtgggatgcctggggcccatggagtgaatgctcacgcacctgcgggggtggggcctcctactctctgaggcgctgcctgagcagcaagtaagtcctgcacc

SEQ ID NO: 23487 - DNA, 201 bp, Homo sapiens
tcctcgtcatcccaataccatcatttgtattccagttgggaaggagtttatttttttcttcctctgaacccaaatcagaggtacttacccatgagaaaggyggcaaagcttgaggcaaagagtaggaagtaaaaaccaaatgtagctgtgcagttttctccccaactgggcctcactgagcaataaattcccaacactaag

SEQ ID NO: 23488 - DNA, 201 bp, Homo sapiens
attgtgagctggtggtggagttgagcattttcagtggggtgcatgggtgtatgcagagaggtgtatataagcatgacagggtatgccccaagggcttccaygatctccatcctggccctgagagagccaggtgctattggcccagtgctggaggaaatcagcctccagttcccctgcagtcagtctggctggtgcccacag

SEQ ID NO: 23489 - DNA, 201 bp, Homo sapiens
cacctcagaagttaagacccactggcttggaattccagctgcctgccgagtgcatcaggctggagactgcctgagacagattagttcctgggggaggggtrgccaccatttctgtgcttaggtcaacccagctgttctagcctgccagttccagtgagtcctggcagcccaggtgaggagaagtccctcacaacacacctg

SEQ ID NO: 23490 - DNA, 201 bp, Homo sapiens
ccttcaaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacagaaaaagagaa

SEQ ID NO: 23491 - DNA, 201 bp, Homo sapiens
tccttcaaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacagaaaaagaga

SEQ ID NO: 23492 - DNA, 201 bp, Homo sapiens
tgacttccttcaaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacagaaaa

SEQ ID NO: 23493 - DNA, 201 bp, Homo sapiens
ggacttttgtacttgccgatccctctgttgaagaagctctttcctcaatatcatgggcatttttattattccacatttctcttccgcattgcccagaagayattctctatgagggctccacccctgcagcagacttttgcctggacatccaggcattttcatacatcctctgaaatctaagcagaggttcccaaacctcaa

SEQ ID NO: 23494 - DNA, 201 bp, Homo sapiens
atgacttccttcaaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacagaaa

SEQ ID NO: 23495 - DNA, 201 bp, Homo sapiens
tggagaggacataatgggcaagtttggaggcaggaatgtctgagcactagtttcaccagagttgagtatagcagtataaaagagaagaattgaaatatatytttgaggttatatcataaaaagattcgaatgttagtcttcaaagtttatattagttcagtgaataatgggagtcactaagagcaagagtatgatgttaca

SEQ ID NO: 23496 - DNA, 201 bp, Homo sapiens
gatgacttccttcaaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacagaa

SEQ ID NO: 23497 - DNA, 201 bp, Homo sapiens
agtggctcacgcctgtaattgcagcactttgggaggccgaggcgggtggatcacctgaggtcaagagttcaagacaagcctggccaatatggacaaacccsatttctactaaaaatgcaaaaattagctgggcgtggtagcgggtgcttataattgcagctgctagggaggctgaggcaggagaatcgcttgaaccccaga

SEQ ID NO: 23498 - DNA, 201 bp, Homo sapiens
tgatgacttccttcaaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacaga

SEQ ID NO: 23499 - DNA, 201 bp, Homo sapiens
tctgccagtctcaggtgaaatatatccaaggcaggagagggatttcttaacctcaggtaggaagactcttaagtgagaaagaaattctaattgcaggaacrttgatttcttcctaataaatgtgccaaatcccccacctactagagagggcctccaagaacctggctgctgcttcaccctgccacagacgcactctctcca

SEQ ID NO: 23500 - DNA, 201 bp, Homo sapiens
gtgatgacttccttcaaaaacatgaaataaatgaatttttttaaatgactgtagtttctacaggatacagttctcctgttttccacttttcctttgtaaaatacatgaattaccagcttcaggcttctactcctaattgagcactctctaggtctagaagctcagctattatagttattttaaagaagattattatcacag

SEQ ID NO: 23501 - DNA, 201 bp, Homo sapiens
tcttcaagaggccttgggattccttcacttctagtgattgagggatgattgtcacatgaagaacttggtgcatgtcaaactctcatcacttcccaataggstttattggcactattagtcctatcgataccaaaagatcatatggcttcattctttatattccaaaaagccagagtggtaagaagtttagctgaaagatgt

SEQ ID NO: 23502 - DNA, 201 bp, Homo sapiens
cttggccctgtttcttcaatattcttattttccccctgcatccgagatgtttaatccacttgttaaattaagtagcacagaaatagggctatttttaaaakaatctgaaggccaaatccatccatttatcctacattatgggcaattaagaaaatggtaagacttggccaggcacggtggctcacgcctgttatcccagca

SEQ ID NO: 23503 - DNA, 201 bp, Homo sapiens
accattttttataaatccccagcatccaatacagtgcctagcactcagtgggtactcaataaatgtttggtgaaagaatgaatgagtgaatgaagaaacamgtgaagtgagttggaagttgtaagcagagtgcagagtccattatgttaaatgaaaagttggccttacaaacaaaacataaacatcactttgtgttgggtt

SEQ ID NO: 23504 - DNA, 201 bp, Homo sapiens
cattaattattagagatgatctggccatcatctggataactggctgacttagtatcccctccctcccttaccatgccatgtgcatcttttctgaagctgcrgacccaaggaaagagaatgactttcccaggtagaagagtcctccttagtcataggtccattcttcattagaacctccaactcagctctacctgttaaagc

SEQ ID NO: 23505 - DNA, 201 bp, Homo sapiens
attacattgagtccactcagatcatccaggataatcacttaattttaaggtgacctgattagcaatcttaattccattagcaaccttaattcccccttgcmacataatattacacattcacagatttaaggacatatttggcaggggagagggatacattagtctacttaccacagtgtgctttgttcatcttttgcatag

SEQ ID NO: 23506 - DNA, 201 bp, Homo sapiens
catagcatcacttctgcctcattctattcattagaagtgagccactaagtctagcccatactcaagacttcacctttggaaggaaggcatggcaaagaatrtatggatgtatcttaaaaccaataacaccacaatgttttaaagcttataattaactcaatctaagggtttaaaaataagagaagtttatagaaatttaca

SEQ ID NO: 23507 - DNA, 201 bp, Homo sapiens
ctatcattagagagaacagacaacctacagaataggagaaaaattttgcaatctatccatctgacaaaggtctaaatccagtcaagaggaacttaaaaaartttacaagaaaataactccattaaaaagcaagcaaaggacatgaacagacagttctcaaaagaagacattcatgtggccaacagtcatatgaaaaaaagc

SEQ ID NO: 23508 - DNA, 201 bp, Homo sapiens
tccacacaccttatacaaaaattaactcaagatggattaaagacttaaatgtaaaaccccaaactataaaaaccctagaagaaaatcgaggcaataccattcagaacataggcataggcaaagatttcatgatgtagatgccaaaagcaattgcaacaaaagcaaaaattgacaaatgagttctaactaaactaaagagct

SEQ ID NO: 23509 - DNA, 201 bp, Homo sapiens
aatcaaactcagatttgacaaactcattcatttattcaacaaatattattcagtgccaactatgtgtgaggcactacaccagtacaagaataaataacatrtggtccctgttttaaacatctgtagtatagtaagaggtatagagaaagaagacagatgtgcattgcacataaccacattctaggaaaaaaatatcacaaa

SEQ ID NO: 23510 - DNA, 201 bp, Homo sapiens
aagcaacttcagcaaagtcccaggatacaaaattaatgtgcaaaaattgctggcattcctatacaccaacaacaggcaagcagagagccaaatcatgaatkaactcccattcacaattgctacaaaaagaataaaatacctaggaatacagcaaacaagggaagtgagggacctcttcaaggagatctacaaaccactgct

SEQ ID NO: 23511 - DNA, 201 bp, Homo sapiens
gctcctaacccagtggattagttttggcttttgagcttatgatataaatcacacagtatcaatttttgtgtttctggctttgttcattcaattttatgttkgtgagattcatttatgttgttgcttattgttgcagtttattctcattgctttatataatcttgtgtgaatatatcataattttttattcattcatgtgct

SEQ ID NO: 23512 - DNA, 201 bp, Homo sapiens
atccagcccctagatctagcaaacaccccagaagcccaccccactctactcctcttctagtttttacccaccgagggtaaccaatgttctggctcctaacmcagtggattagttttggcttttgagcttatgatataaatcacacagtatcaatttttgtgtttctggctttgttcattcaattttatgttggtgagattc

SEQ ID NO: 23513 - DNA, 201 bp, Homo sapiens
ccttctcttcgagaattaccacagggtgcacacatgcaacaagaatccctgcctgtttgtatatggaccgaggatttcagagtgttcctagtttacaggtkggctttgtgagaaaagtccatcggtcacagtctcacttttggaacctaacattcagagaacaactatttctaccatgtatgcagccctctgagaggtata

SEQ ID NO: 23514 - DNA, 201 bp, Homo sapiens
ataaagacaaaaatatagataggatttgatgcagagtaagttacaaaagtacaacagaagagctcagaggacatctatgcaatctattaatatcttaatawctattcatcctctcctttccaagcaagcaacaatcacagattaaatataaaatgataaaaccagtggcatagccaggttcaaaagcaagagaaaaagtcc

SEQ ID NO: 23515 - DNA, 201 bp, Homo sapiens
tcgcgatttccccaagctctctccttctcttcgagaattaccacagggtgcacacatgcaacaagaatccctgcctgtttgtatatggaccgaggatttcmgagtgttcctagtttacaggttggctttgtgagaaaagtccatcggtcacagtctcacttttggaacctaacattcagagaacaactatttctaccatgt

SEQ ID NO: 23516 - DNA, 201 bp, Homo sapiens
gataaattttctccatcactaaaaccaaagagtgggatttttttgttctagattacatgagcaacagtctcgcgatttccccaagctctctccttctcttygagaattaccacagggtgcacacatgcaacaagaatccctgcctgtttgtatatggaccgaggatttcagagtgttcctagtttacaggttggctttgtg

SEQ ID NO: 23517 - DNA, 201 bp, Homo sapiens
cacgcctgtaatcccagcactttgggaggcagaaacgggtggatcacctgaggtcaggaatcaagaccagcctggggaacatggtgaaaccctgtctctaytaaaaatacaaaaattacccgggcatggtggcgggtgcctgtaatcccaactactcaggaggctgagacaggcgaatcgcttgaacccagaaggtggaga

SEQ ID NO: 23518 - DNA, 201 bp, Homo sapiens
tgctaaaatagccatttgtatcaagtcctagcaatatgctcaaaacacacaggatggctgggtggtggctcacgcctgtaatcccagcactttgggaggcrgaaacgggtggatcacctgaggtcaggaatcaagaccagcctggggaacatggtgaaaccctgtctctactaaaaatacaaaaattacccgggcatggtg

SEQ ID NO: 23519 - DNA, 201 bp, Homo sapiens
ctctccaaccttccagatgctgttgatcctttccttaagcttaaggatttaaatgccaacttaaaacataaatagcctcaggattgaacctttttttttttcttttgagacagagtctcgctctgttgcccaggctgtagtgcagtggtgagatctcagctcactgcaagctccgcctcccgggtttacaccattctcctg

SEQ ID NO: 23520 - DNA, 201 bp, Homo sapiens
aagtccctcacaacacacctgctgtgccagatagtggccagaatgattgtttaagtgggaacctgatccatctggcctccctgcgggaatttcagcaactscaacctgggttatactaacagatgtctgatctctccctgggacagagcccccgggggaaggggcagtgagtctctgcccttgagttactcagccttccca

SEQ ID NO: 23521 - DNA, 201 bp, Homo sapiens
cctgccagttccagtgagtcctggcagcccaggtgaggagaagtccctcacaacacacctgctgtgccagatagtggccagaatgattgtttaagtgggamcctgatccatctggcctccctgcgggaatttcagcaactccaacctgggttatactaacagatgtctgatctctccctgggacagagcccccgggggaag

SEQ ID NO: 23522 - DNA, 201 bp, Homo sapiens
atcgatttggctgttgatgcttgtgtatgcttcacaaagttctcatgctctgtttatcagcaccatcaggtcatttatgttcttctctaaactggttattstagttagcattttgtctaacatttttcaaggttcttagcttccttgcattgggttagaacatgctcctttagctcagaggagtttgttatcacccacctt

SEQ ID NO: 23523 - DNA, 201 bp, Homo sapiens
gaccaacctgggcaacatggcaaaacctcatctctaagaaaaaatgcaaaaattggacaggcatggtagtgcgtgcctgtagtcctagctactcaggaggytgaggtgggaggattgcttgagctggagagatggaggctgcagtgagccgagattgtgttgactgcactccagcctgggtgacaaagtgagaccttgtct

SEQ ID NO: 23524 - DNA, 201 bp, Homo sapiens
tagtcccagctactcgggatgctgaggcaggagaatggcgtgaacctgggaggcggagcttgcagtgagccgagattgtgccactgcactccagcctgggygacagagcaagactctgtctctgaaaaaaacaaaaacaaaacaaaacaaaaaactcaaagatcattgttggcttataaatatcagggtgacctggcaaga

SEQ ID NO: 23525 - DNA, 201 bp, Homo sapiens
aaaggggaattttcatattgtctcagtgatgtgtatgtcagcttgaggtaggatcttttactgagtgagagactgagaagcaatttagggaatacattaaratcacaaaattctgtcattcagcaaataatcaaatattgatgccatgcgaaattcaaaaataaacaattttgccacctagtaagttaaaggtctaggtgt

SEQ ID NO: 23526 - DNA, 201 bp, Homo sapiens
gtttctggcttccttttccatttgttccatttgtacaacttcgtgcccacttcagtcattgcccagggcccttaaatttaaatatccctccccctgaacakataggcattatgaaatggaaaagaatccgagaatctgattgcgcgttttcattcctagcaaagccaccatgtacacacacgtacaggccagtcacatttt

SEQ ID NO: 23527 - DNA, 201 bp, Homo sapiens
ttgtaggcagaagcattaaacagctactcctgctgctgtgtgctaatcattcctgtaatttctgttctgcttatttgccattatttgaaaaacatgcaaaagggtctttctaaccacattcctgtgttgtaacaacacccaaatgctgaggcagtgccgaggagtcagtgcctgggacttgcttaaaactgctgggactcg

SEQ ID NO: 23528 - DNA, 201 bp, Homo sapiens
ttgataatttttatttgcaatctagatctttcactattaacagaaattcctgggttacagcctcatgtttcaaaaagctagctttcagctatcaaagttcwtggagacacctagcattcattaaactttcagttatagtcatgtataaaaattttaattttcattaaaatacataactctaagcagtaagaaatattaaat

SEQ ID NO: 23529 - DNA, 201 bp, Homo sapiens
cagtccctacaattttatggtgtcttgagaaacttgccttctagatacttctttttgagcaaatctcatctatgggtttggaagggagacgtttaagaacyaaatccagactttcaaatctgctgatggaatgaagaaatgttgctgaatagggtcagatcctagataaaagggggaatgctgattttgaatgatagtttt

SEQ ID NO: 23530 - DNA, 201 bp, Homo sapiens
cactgctcaaactcctgtttcactagctctgagtcagggcctgcgggtgtcagtgggaaggttgttttccacggctgtggttattatgcatcttattctcyttctttgttccaacttccaaggctgccctaggtcacaaaagaaatgaaccagaatcagaaggcaaacagcaaagactggagtcctagattcaagacctca

SEQ ID NO: 23531 - DNA, 201 bp, Homo sapiens
tgggcatcaaaatgaaatgtctggtcattacattgctcatttaaatgtctccacaaggggaccaggtgcaatggctcacgcctgtaatcccagcacttttrgaagccgaggtgggcagatcacttgaggtcaggagttcgagacagactgaccagcatggtgaaaccccatctctactaagaatacaaaaattagccggcc

SEQ ID NO: 23532 - DNA, 201 bp, Homo sapiens
tctcgaactcctgacttcaggtcatccgtccaccctggcctcccaaagtgttgggattacaggcatgagccactgtgcctggctttgtggttctttttttwaaaaaatgtttaatttctcagacttacaaagaagaaaggtgatttggactccagctgagtcactttttaaatgatggccttcctaagtggactagatcaa

SEQ ID NO: 23533 - DNA, 201 bp, Homo sapiens
acaattatactattctgggagatataaacactgaaaatcccattttctggaagatcgaacgcaagcctaacctgctcagatctgtatcctgtgtccaactrtcacttccttgttagattttaatttcccacatgtgaactgataggtgttatcaaggaaaacaactctgagcctgatcagctttattgtattgaactccta

SEQ ID NO: 23534 - DNA, 201 bp, Homo sapiens
actaaaatttattttggtatataggacgtgtatattttcaagtctttgttcgacagtaacattttactgtattatcaactttgatctttcaccaaaatgtmacccacaaggttatatatatttttaattatttcttctgaagccaaccaaaaatctgcaggattaacaaatagattttaaatcaattttgggttgtagagc

SEQ ID NO: 23535 - DNA, 201 bp, Homo sapiens
tccttgttaattttctgtcttgttgatctgtctaatattgacagtggggtgttaaaatctctcaatattattgtgtgggattctaagtctcttttaggtckctaagaactttatgaatcttggtgctcctgaattgggtgcatatatatttaggatagttagctcttcttgttgcattgatccctttaccattatgtaatg

SEQ ID NO: 23536 - DNA, 201 bp, Homo sapiens
tagagtttttatggttttaggtcttatgtttaagtcttattccatcttgagttaatttttgtataaggtgtaaggaagtggtccagtttcagttttctgcwtatggctagcctgttttcccaacaccatttattaaatagggaaccctttcactattgcttgtttttgtcaggtttgtcaaagatcaggtggttgtagatt

SEQ ID NO: 23537 - DNA, 201 bp, Homo sapiens
ttccagaaggaaggaagtcaatggtataaaaatacatccaacagaataaacaaaatacaaattaagcattggccttattttatacatacggtgcatattcraacttgactgacaggcagttacctgtaactctgtgaatggcagtttcagtgtaaaagtaggcactgaaatcaaaccagcaataggtttagttacaaatga

SEQ ID NO: 23538 - DNA, 201 bp, Homo sapiens
gccaaaatcaagttcaaaatcaaggtgtcagcaggactgtactccctctgaaacctataaggagagtccttccttgcttcctctactttctggtggctccyggcactcttcggcattccttggcttgtagatgcatcgctccagtctctggctctgtcgtcgcatggcattttgcctgtgtgtctccctcttttcttataa

SEQ ID NO: 23539 - DNA, 201 bp, Homo sapiens
acagaaaaaaaagagggtggattgttgctatatggaattgtttgggacatgtttagtatgagatatctaagtacagatgctcattaagtagttgcacatayaggtctgggacttaaaagagagctatgctaaacactatcaatttgaaagtcattagtatacaagtggtggctaagaatcatagatggtatcacccagaga

SEQ ID NO: 23540 - DNA, 201 bp, Homo sapiens
cagaaatgtcacacaagtttaaagaatacttctaaaaaataacttcagtttacaataacttcagtttgctcctaaccaaaacttcattttacatttctgamtaaagaaaaactttgctgcaaaagtcgaggtaaaagaaggttcttagggcataatagctcagggtgggaagggtctgccattagaaattatgaacattta

SEQ ID NO: 23541 - DNA, 201 bp, Homo sapiens
gctcctctccttcaggccacaaatccacccctgtcaccttctccctgccctgctcagaaggaattcagagtgtgggcaattatgctatattcttttctacwctgctcctcctcccatgacagattactggtggtctgtggacagactggcaacctgctcagcctcctgtggtaaccggggggttcagcagccccgcttgag

SEQ ID NO: 23542 - DNA, 201 bp, Homo sapiens
agtccagtcaggctgatataacagacatataaaaactagtggcttataaacaaacaaaacaaatttgttttttacagttctggagtctggcaagtcccagrtcagtgcagccgcagatttgatatcggtgagggcttgctgtctgcttcatagatggcagcttctcattgtgtcccacatggtggaagggccaaggcagct

SEQ ID NO: 23543 - DNA, 201 bp, Homo sapiens
tctggacatggtggtgcacacctgtaattgtagctacttgggagttggaggttgctgtgagctacgattgcaccactgcactccagcttgggtgaccgagygagaccctgtcaacaaagaaatgaaacattagaaaaaatcccttctctctatagttgcataggcacccacacatccacagagggtagccgcctgtcttag

SEQ ID NO: 23544 - DNA, 201 bp, Homo sapiens
tgagaaaagcacagtacttgaggtctgcaaaaattaatgagccttccaattatgtgtcttttttcctggaaatgactaaggcattggggaataatttccaktgatgtgagctggccaaaatgcataaagaaatatattgcattggcatgtacatttaaacttgcctggatggtttgatactacaggttatcagctgacatc

SEQ ID NO: 23545 - DNA, 201 bp, Homo sapiens
cacttgaggccaggagttcaagaacagcctggccaacatggtgaaaccttgtctctacttaaaaatatgtatgtgtatatatacatgtgagtgtgtatgtrtatatatatatatatatatatatatatatatatatatatatatacacacacatacatatacatacatacaagtatatacatacatacacacacacagaaa

SEQ ID NO: 23546 - DNA, 201 bp, Homo sapiens
tgtgtgtaatgaaagtgtggagcaagtcccctttggtatctaaagggaatcagacattttggatgatttcattttagatgatttatagtctcctccatatrtagtttgaatgcatctgctcaggatcctccatggaagtgtagttgtcttcattatcttttaagttgtcaagcacctaagaagctatttgttttcttgata

SEQ ID NO: 23547 - DNA, 201 bp, Homo sapiens
aaggcaagcttggggctggagggtctgcattcaaggtagctcgctcacatggctggcaagttgatgctgattattggtggggaggctgcagtttcacacaygaactttccttaagactctctgggtattctcatgacatcgtggctggcttcgccaccaccgtgagtgggcaaagagagagcatcaaattggaagcattat

SEQ ID NO: 23548 - DNA, 201 bp, Homo sapiens
tactcaagaggctgaggcaggaggatcccttgagcccaggaggtcaaggctgcaatgatcgtgtcactgcactccagcctgggcaacaaagtaagacacgstctcaaaaaaaaaaaaaaaaaaaagtaaaagagaagagaaataagcatgtgttctaccagggccagacacaaaatttgtttatagtgaagaaagtcttaa

SEQ ID NO: 23549 - DNA, 201 bp, Homo sapiens
catacaaagagggttcaccagcattggccatggatgttagattttgttttacacccacaacattttagtatttcccttgagtggaaagaaaaccttttttkaagcataatacctgtaaggaaagtacacacaaatcctatgtgtacacttggtgacttttcataaaatggacccagatccagcccctagatctagcaaaca

SEQ ID NO: 23550 - DNA, 201 bp, Homo sapiens
gtgaggatgtaaagcctctactttgatgagcttaaccttgggacagaattagctgtgtaggcagctattttataagacatacaaagagggttcaccagcaytggccatggatgttagattttgttttacacccacaacattttagtatttcccttgagtggaaagaaaaccttttttgaagcataatacctgtaaggaaag

SEQ ID NO: 23551 - DNA, 201 bp, Homo sapiens
caatattttttacccagaatcagcaaagtccttaatatacagacagcttctgctgacctccgtccttgagaatgcagtgcacttttatcagggcaggcagrtatgtctgttttgtgagtttttctgagcagtgctcaagtggcctcatggctgccaaaaggcctctgcttcaaggtcccaggggctaaatttctgccagaa

SEQ ID NO: 23552 - DNA, 201 bp, Homo sapiens
accagatgatccaaatttcctaagcaaagccagcagcaaatatcatctgggaaggcgcatgcctcagtatccacacactacgctctttaagaaagtacatsaaaaagctaatggacttttacaagagcccagttactgcttaatgtctgtgagctctcaggagcagggaatcacaacccctaccacatacagttggcggca

SEQ ID NO: 23553 - DNA, 201 bp, Homo sapiens
tcttttcttataaaaaacacagtcgcattgaatcaagggctcaccctactctagtttgacctcatcttaagcgattacatctacagtgactctatttccaygtaaggtcacattctgaggtactaagggttaggactccaacatacctttttttggagacacaggtcaacacataacaagtggtaaaccaaaatagacata

SEQ ID NO: 23554 - DNA, 201 bp, Homo sapiens
aataaaaagatgctagttaactccaagccacctgaacatataaagactctccaataaaggtaaatagacgggcagacattaaaaccagtattattttgttkcatagctccactttttattttctataggatttcaaagaaatgcataagaagtaattataaatctgttagtgaatatacagcatatagatataattctcaa

SEQ ID NO: 23555 - DNA, 201 bp, Homo sapiens
tgaattgaatgatcattatttctagtctaagacaaatgtgctttaaaaaattatttatggtctctcagttatagttctcagttacaagtcaagcctggaaytttatgaacagatggaaaaaatagatacagtaatggaatatctaaataaccagatacctttttctttaagagtctaaccattctgctgaccaaccaaggg

SEQ ID NO: 23556 - DNA, 201 bp, Homo sapiens
tgttttctcagcaaagattcttaataaccggtggaaaaaagcactaaaatgatttcccaaaactgttttctaaaccatgatattttggaaactttgaaaakgcatcttttgtcatgattgagaacgtaagaataaatgcaccacactgttcacatgtagttgaaaaggaatgaatagtggaacaagtactagcaaagaatc

SEQ ID NO: 23557 - DNA, 201 bp, Homo sapiens
tgtcttttagtatgtgaatgtattataattagtgtataatgaacaataaggacaaccagagcttgctttcattgccatcttggtttgacaggatctggccsgcttctttccagcatcctattttattagtggggtcttataaaacaaattcctatctcattggaatttagagtgaggagaagaaaccaccaattccctgct

SEQ ID NO: 23558 - DNA, 201 bp, Homo sapiens
ttttccctatttatccaaaagcctcttcagatgccaaaatgtgcagcttaggtttagttaactgcactttatcctaaggtttttactccattaatgtctcraggattgcccagaatcaggggaaggatcaacttttcaaagtttaaaaaatatatataagaatgaagattgggttaaaaaatgatgaggcaatatggaatt

SEQ ID NO: 23559 - DNA, 201 bp, Homo sapiens
tttgtagaaccgctacatataacttgttggggagttcgtattccccagggtaatatgaggagtagaaaacatctccccagtttccctttttttttttttttcctgaaaagcagctcacaggcttttaaaaatttattgccaaccactctataagtagtatgtcaatacaagaaagttaaagttcccataatgtttgcatag

SEQ ID NO: 23560 - DNA, 201 bp, Homo sapiens
tgtaaatatagcttttccatgtgttttgctgggttttttacttttttttttttttttttttgagagactgggtctttctttgtagcccaggctagagtgcrgtggcacaatcagagctcactgtaaccttgaactcctgggtgcaagagatcctcccaccttagccttcctggtcactgggactacaggtgtgtgctacca

SEQ ID NO: 23561 - DNA, 201 bp, Homo sapiens
ttgtcatgagaaaaagtctgtttgttacttggaaaatgcctgtaaatatagcttttccatgtgttttgctgggttttttacttttttttttttttttttttgagagactgggtctttctttgtagcccaggctagagtgcggtggcacaatcagagctcactgtaaccttgaactcctgggtgcaagagatcctcccacct

SEQ ID NO: 23562 - DNA, 201 bp, Homo sapiens
tgatttgcaaatattttctctcattctgtgagttgctttttcactcacttgatggtgtcttatgatgtgtcaaagatttaaattttgatggaatccacttkattttttcatttgttgcctatattttagtgtcatatctaagaaatcattgccaaacccaatgtcattaaagttttcccctgcgattttttttaagagttt

SEQ ID NO: 23563 - DNA, 201 bp, Homo sapiens
attaattgagcatcttttcatgtgtttattggccattcatgtatctcttttggagaaatgtctgctcaagtcctttgcttatttgggcatttgcctgaacygggttgtttgttagttatcaaattttaagagttctttttatattctggatattaatctcatcagatctatgatttgcaaatattttctctcattctgtga

SEQ ID NO: 23564 - DNA, 201 bp, Homo sapiens
acacctctttcatcatgtcacccccctcttcagtggcttcccactgccttatggaccaattacaaacctcttgtctgaaaattaaaggtctccaaactaascctcaagctcctgacacttagaacttgagccctctgttctgtcaaactgttctgtcccatgcctgccttgggactcctacactgaaattattatcttttt

SEQ ID NO: 23565 - DNA, 201 bp, Homo sapiens
gcattctactctaaggtagttttctcttctctctggtttatttatttatgaatttccactttgctcaaaggattaaaatatattactatcaaattgtcccmgacaggaccagcaaaagccctttcaagctggcccctatgcccttttgacatataccccatcattctttgagcacttctcaattttctggtacaacatact

SEQ ID NO: 23566 - DNA, 201 bp, Homo sapiens
gatgatggccagccaggtgtttccactgtaaaattaataaatatgtagcacttaataagtaacaaagaagtattttatgggggacaatatgagctaagtaratatcctgttcatcattaacctttgacccactagatttaatattgattgatgattactgcctgagtcaattattattatgatgattgccaaatggtaact

SEQ ID NO: 23567 - DNA, 201 bp, Homo sapiens
ctggcttttattggaaaatggaacgagcattttactccaggctacaattagggttggagggtataggtgcccggatcccaggagatccccagtggactgayttctctccccaaggccatttctacactcatttcagaacaggagtgcagtgacaccaccatggacctcgtggcatgtagatgcctagatgccgccaggagc

SEQ ID NO: 23568 - DNA, 201 bp, Homo sapiens
gcaccttaaagatggtaagcatggtttccacttctggatctgtcacaatgcttagcaatgaaagcttaaatgagaaactaagttgaacatgtcacaaatgyccttctcctcagtctccaaaacctatggctactttctctgactgactttaggaagctgcctcactctacttacttgtttcccatcctcacaataatcatc

SEQ ID NO: 23569 - DNA, 201 bp, Homo sapiens
gttccaagaactccacatccatggcaggcctgcccttcgaagcatctctaccctattctcatctgcacgaggaatagcaggctgggaggccctgggaacargaccaagacccaaggctcagatgggccaagagaggtttcctggctactcactatggcctctgattccaaggaggagggaggaatttggatgtgatttttg

SEQ ID NO: 23570 - DNA, 201 bp, Homo sapiens
atttaagcaaagagaattgtgtcagattaaatgctatagcagtttacttagaatagctgtgtagtaagtattgcagaatgtaaatggaagtaaatccaatrgaatctcaaggacggtacagttgatgtgagctgggatggtgagggaaaccttgctggaagaggaagggcttgaatcagtccttgatcttgaggtaggaac

SEQ ID NO: 23571 - DNA, 201 bp, Homo sapiens
ttttcccctcaggattattagaatttcaaagcttggaggagaggccacaaggagctgagactcagagctctgcagggagtgggaggtgccagttgctgctrggatctctgagagggcacaataaggcagcctctgaagtgtgggaaaagcaaattgcaaactaggaccaactactgacaatggaaccagctgcactgccag

SEQ ID NO: 23572 - DNA, 201 bp, Homo sapiens
aatgtcaaattatttccttaatcccaaggcacttgatcctaaatcttaaatgccttgtggtctacttgggatgataactagggggaaaaaaacatttaagyaaagagaattgtgtcagattaaatgctatagcagtttacttagaatagctgtgtagtaagtattgcagaatgtaaatggaagtaaatccaatagaatctc

SEQ ID NO: 23573 - DNA, 201 bp, Homo sapiens
atgaatttgcttccagcttttcttgtgtagggtgttcttcaggttgctacttcaaggtcaaggtctgattcaagcccttcctcttccagcagtgttgcccycaccatctcaactcattcaactcaaccctccttgcaatttgattggatttactgccatttacattctacaatacttactatgtggctgttctaagtagag

SEQ ID NO: 23574 - DNA, 201 bp, Homo sapiens
ccttgcctcttcctatcttctgatggtctgccagcaatctttagcatctgtcagcctgtgaatgtgtccctctaatcctcctttgcatggctatcttcccytctgtgaatctatgaatttgcttccagcttttcttgtgtagggtgttcttcaggttgctacttcaaggtcaaggtctgattcaagcccttcctcttccag

SEQ ID NO: 23575 - DNA, 201 bp, Homo sapiens
aaggaatgaaagtcaagaaataggaattcagctgacctccgtgtggctggcttggggtagaaacactctccatgtttttttgcaacttctgtgtaatccartgttcttattcagaatctaattgctgagttgcccccactgtttctgttttcctagctggaaaaatagataatctgctctgaggatcagagggcaactaga

SEQ ID NO: 23576 - DNA, 201 bp, Homo sapiens
gtggagtgaagtgaaaccacatgtgggctggattgaccctcccttgatctagaaaagaaaaagtgctgttttccagctcacccttgcatacctaactcctycagcagggtagctctgcatgacaaggttggcaagaggtagactactttttaccacacatggtcttactgcagttgtgtgtttgtatgtgtgtagaaagtg

SEQ ID NO: 23577 - DNA, 201 bp, Homo sapiens
aagagaaggggaagcaggcacatcttacatggccagagaaggaggaagagggcaaagggagaggtgatacacacttttaagcaaccagatctcttgagagytcactatcacaagaacagcaaggggaaaatccactcccatggtccagtcacctcccaccaggtccctcctccaatattggggattacaattcaacaggag

SEQ ID NO: 23578 - DNA, 201 bp, Homo sapiens
cttttctaccacataggctgcaaattttctaaacttttattatctgcttcccttttaaatataagttccagtttcaggttatgtctttgctcatgcatgtsattatatgctgttagaagcatccaggtcacatctggaacactttgctgcttagaaatttcttccaccagttaccctaaattatcactttcaagttcaagg

SEQ ID NO: 23579 - DNA, 201 bp, Homo sapiens
atggcttgcaccttctggagcagatgcctgagacatatctggagcccttttagccatggctggagctggagcagctgggacacaaggagcattgtcccaargttgtgcagggcagtggagccctgggcctggcccataaaaccattcttccctcctaggcctccaggcctgtgataggagggactgccacagctctgaaat

SEQ ID NO: 23580 - DNA, 201 bp, Homo sapiens
gggagaaatctgtccccatgatgtaatcaccttccccagccccctcctccaacactggggattataatttgacaggagatttgggcaaggacacaaatctragccatatcatcctgcccctggcccctcccaaatctcatgcccttctcatgttgcaaaatacaatcatcccttctcaacaatctcccaattcttaactca

SEQ ID NO: 23581 - DNA, 201 bp, Homo sapiens
ctccttcaggcaactaacaggccacctaatgccctagaaggtgtaatttgctaagggactcatattttttaaaaaaaaggaaaaagaaaaaagaaaaaaargtatagtctggatgctttaggtgctcttcctgatctccaaaacaaggcatcccaggtagagaaagtgaggaccagtgcggcacttagggaagccaggttc

SEQ ID NO: 23582 - DNA, 201 bp, Homo sapiens
ctttctaattacaagaagaaagcacgactaaacagttgagtcttatggtggtcccaaagggattatagggtggaaaaaaaaaagtgctggaccaaaaacawgagattctacttcaaatcctgactctgcccccaaataactatgtacccttgagctagacagttccattttataaatataagtgacttttataagtataca

SEQ ID NO: 23583 - DNA, 201 bp, Homo sapiens
gatacaactgggtaaccccgctgtgacccaggtagctgttttttaaccattttgttagataaattttctccatcactaaaaccaaagagtgggatttttttgttctagattacatgagcaacagtctcgcgatttccccaagctctctccttctcttcgagaattaccacagggtgcacacatgcaacaagaatccctgcc

SEQ ID NO: 23584 - DNA, 201 bp, Homo sapiens
ttttggaaactctcaaaagtgtacatttatttggtggggaattggaactacaaagtggtagtacaattatatttgttaatcaggtggaagctaaaaaaatkactgacaggtttcccatctcttatttttataccgtagttttagtcttggttgagatgtatgcataaacatcactatcacctgacatgtatcacccacgca

SEQ ID NO: 23585 - DNA, 201 bp, Homo sapiens
gatttaggatacatcatttaaatgccagattgagcccatctggttgctttcatggaaaaatatataggaatagctttctaggtctttttggaaactctcaraagtgtacatttatttggtggggaattggaactacaaagtggtagtacaattatatttgttaatcaggtggaagctaaaaaaattactgacaggtttccc

SEQ ID NO: 23586 - DNA, 201 bp, Homo sapiens
ggcccaggcatcggtactttttaaaagctccccaggagaccttgaggtgcatgcaaggttgagaccactgagtaagaaggtgaaagctgggctgcagctawgttctgactgtacccaaggacactggtatcaccatcataaccttgactgccggcaaaaaaccccatagccattctgagtacaacttactaaacaaagacc

SEQ ID NO: 23587 - DNA, 201 bp, Homo sapiens
gtataagaacagacatatagaccaatgaaaccgaatagagaactcagaaataagatcacatacctacaaccatctgatctttgacaaacctgacaaaaacragcaatggagaaaggactccctacttaatagatggtgcttggataactggctagctgtatgcagaaaattgatactggactccttccacacaccttatac

SEQ ID NO: 23588 - DNA, 201 bp, Homo sapiens
agctgagaatggaattgaacctggattattcaagagactcagccacatgaagatctaagagaagaatggtgcaggtagagagaacagcaaatgcgaaggcsctgtgggagaaacaagcttgacatgtttgaggaacaaaacaacaaaaaaaaagtctggctggagtacacagggaaagggggggtgtcgtaaaagataaga

SEQ ID NO: 23589 - DNA, 201 bp, Homo sapiens
actgatataaacaagacatttattgatgtaaagccaccaaaactagactatttatcaatgttgctttcatgagaaaatgatgccaaaattctaatatgaastagaggctgctttggagccagatctccctcacaagatgcgccccactgtccagtttgactctgtggctttcgggggttagggagcataaacggtaggcca

SEQ ID NO: 23590 - DNA, 201 bp, Homo sapiens
tatgccaactgttaaaaatggatcaaattaacttttattaaacctctgtccctatggacaacactggaacttgaagcctcacaatttatctatagctttcrtgtgttctccaaggtaccatgctgcctcagacacctctcatggctcaggacatgcaagagagagaccaagaagacagggaaatgtatttatgttgcattt

SEQ ID NO: 23591 - DNA, 201 bp, Homo sapiens
aatcacacgtgtgattgatatactaattagatattcccccagagtcccaatccaggctttccaagaaacctcagggcagttttgtgctgtgccttccatcmcctttcagtcttccaggtaagcctaaaattgcttgattccactgtgtaagagtatctctagttactctcagtgaccaggaagctgatagatttttgtcct

SEQ ID NO: 23592 - DNA, 201 bp, Homo sapiens
ttgttcttagagctggtaaaatattttttcttaaaaatctaatcacacgtgtgattgatatactaattagatattcccccagagtcccaatccaggctttycaagaaacctcagggcagttttgtgctgtgccttccatcccctttcagtcttccaggtaagcctaaaattgcttgattccactgtgtaagagtatctcta

SEQ ID NO: 23593 - DNA, 201 bp, Homo sapiens
ttcgtgggccgggcccaggatccccatgctgtgtgcaccctagggacttggtgccctgcatcccagctgctccagccatggctgaaaggggtcaaggtagrgctcgggccgtagcttcagagggtgcaagccccataccttagcagcttccatgtggtgttgagcctgtgagtgcacagaagtcaagaattaaggtttggg

SEQ ID NO: 23594 - DNA, 201 bp, Homo sapiens
tcatgccttatgacctctaccatccccttcctcggtacgtaaatcaatcatcctgatgttagaattagcaaattagtcttctgctgcttatctatatatakagagatatacatatacatagagagagagattatatgtttttaagatggtagatggtatattttgcaatccatcctgagttctgcttttgaataatactag

SEQ ID NO: 23595 - DNA, 201 bp, Homo sapiens
atttctcagagcagagcccaacacataggaaatgaagcatgctaaaagaggagtctaatagagctaaagtgaatgtcttcaaccccaccactgagttattrggcaaaaagctcatttccttaaaaaaatagaaagaaatactaagacatgcagagaggtgctttgcttatagatctggaagaagctttgtatctttgttct

SEQ ID NO: 23596 - DNA, 201 bp, Homo sapiens
tctttttttaccagatatgatttttcccaatgggggaatcttggcaatttttaagaattggggaatttcaggaggacaagaccaagaggagacttggcaakgtcaaagctaaatattccccaccaggagtagagatactgcctggaaaaaaagaaatatcatagggttttaagatcagacagatgttggctttctcacttg

SEQ ID NO: 23597 - DNA, 201 bp, Homo sapiens
ttcaatttttacatggggagttactgtccttgaggcctagacacgcacagacacaggccgtgggctgcatgctggaacagctgaaagtggtgtcttctctrtaacttactgctattgactctggtcactgagtggatagacacagacaccttttcggctgcctaaaggagctactatgtgattcacagaggtagaaagggc

SEQ ID NO: 23598 - DNA, 201 bp, Homo sapiens
cccagacctgtagatgctcattaccttctcatgaggcttcaatttttacatggggagttactgtccttgaggcctagacacgcacagacacaggccgtggkctgcatgctggaacagctgaaagtggtgtcttctctgtaacttactgctattgactctggtcactgagtggatagacacagacaccttttcggctgccta

SEQ ID NO: 23599 - DNA, 201 bp, Homo sapiens
atagtaactttatgaatagggcaagcatggagttcggtggaagcttgaggctgagagaaggcttcctggaggaggcaatgcctatgctgaatggtaaggcmtaagtaggagttatccaaatgaagaaggaagatgttgcaggcagaaggaaaaccatgagcacaaaatgaaggacaaaaagtggaagccagtgttagagag

SEQ ID NO: 23600 - DNA, 201 bp, Homo sapiens
ctctgggaaatgtctttatatagaccgttggttaacgttaactttctgcacaaatattaaagcagagagtgtttttgcatcccaattcagagaaaaaaaamacacacacacacacataacaagcatctttgtgtctgcttgtatttggttgtcacggataacgagaagacaaaaccctgtcctaaaggagttaccagttaa

SEQ ID NO: 23601 - DNA, 201 bp, Homo sapiens
gtacggtgttgctgtgtttaaaatgttagcaaatcattttggctttggcagttttatatttctcacttgctttgttttttgactataaataattgctgtgyatagagaacaagaagtgatgcccctaacttaaaatagtcaattgtttattagctttatctttaccaagccacttcagagaaagaaaagcagtttgcagtt

SEQ ID NO: 23602 - DNA, 201 bp, Homo sapiens
cccaaagtgctaggattacaggcgtgagcctccacgcccagccgactgagtcatttactgggatagttggagtagttgtaaaatgatgtatgtataggtayggtgttgctgtgtttaaaatgttagcaaatcattttggctttggcagttttatatttctcacttgctttgttttttgactataaataattgctgtgcata

SEQ ID NO: 23603 - DNA, 201 bp, Homo sapiens
actgaaaaagagcccgagtagtcaagacaatcctaagcataaaggacagagctggaggcatcacactacctgactgcaaactatactacagtaacaaaaayaggagggtaccggtataagaacagacatatagaccaatgaaaccgaatagagaactcagaaataagatcacatacctacaaccatctgatctttgacaaa

SEQ ID NO: 23604 - DNA, 201 bp, Homo sapiens
gccaaactgaatgcttccttattgaaagacagagagctaactatgccaccagagacagcttcatttactgaggttttttttgtttttttttttttgagacrgagtctcactctgttgcccaggctggagttcagtggcgtgatctcggctcactgcaacctctgcctcccaggctgaggcgattctcctacttcagcctcc

SEQ ID NO: 23605 - DNA, 201 bp, Homo sapiens
tctccttttttgtgtgtaatgaaagtgtggagcaagtcccctttggtatctaaagggaatcagacattttggatgatttcattttagatgatttatagtcwcctccatatatagtttgaatgcatctgctcaggatcctccatggaagtgtagttgtcttcattatcttttaagttgtcaagcacctaagaagctatttgt

SEQ ID NO: 23606 - DNA, 201 bp, Homo sapiens
gatatattcctagatattttatttttgtgtatttttgtgttgctattgtaaatggcattgcattcttgatttggccctcagcttgaaggttattgatatayagaaatgttactgattttgtacattgattctgtatcctgaaactttactgaagtcatttatcaattccaggagccttttggaagtctttagggttttcta

SEQ ID NO: 23607 - DNA, 201 bp, Homo sapiens
tttctcctccctggtcccatgcacagcaaaccctttgttccctttctatacacccaatttatgttttttcattgaaatctctacatttctcatttccccaygtcttcacgacatctagaatttataagccctggcatgaagagtgaatggtaatgatcatggcgatgttaacaactgtaacaaaatcataatcacctacat

SEQ ID NO: 23608 - DNA, 201 bp, Homo sapiens
gaggaggttgccacaggtgcgtctgacaggatttagttcaaaacagcaataaagtattacaagcttactatgagtgccaaactgaatgcttccttattgaragacagagagctaactatgccaccagagacagcttcatttactgaggttttttttgtttttttttttttgagacggagtctcactctgttgcccaggctg

SEQ ID NO: 23609 - DNA, 201 bp, Homo sapiens
cagaaatcctgattaactttaataaatgcatctctctcgaagccttggtttcctcctctgtaaaatgggtgtaataatagtatctaaatcagagatcatgygtaggttaaatgagatataacataaacagggtggttaacctagtgcctgcaatatagtaacttctacatacagtaagttacttttaactcctgactatcg

SEQ ID NO: 23610 - DNA, 201 bp, Homo sapiens
taaattaatgatataaaaggaaacaaaaaaaaacagaaatcctgattaactttaataaatgcatctctctcgaagccttggtttcctcctctgtaaaatgrgtgtaataatagtatctaaatcagagatcatgcgtaggttaaatgagatataacataaacagggtggttaacctagtgcctgcaatatagtaacttctac

SEQ ID NO: 23611 - DNA, 201 bp, Homo sapiens
gatattctagaaatatatgtttgatttactatccacatttcttgcctttaaaaacaagggagtgaacccaagtatgtctattttgctaaggctgaagtacmttgggaagtctcatacttcaaactgatgaaacagaaaactgtcactttttatattgaaaattaaaacattaatatgagactgaattccagaaccataatt

SEQ ID NO: 23612 - DNA, 201 bp, Homo sapiens; identical to SEQ ID NO: 3855

SEQ ID NO: 23613 - DNA, 201 bp, Homo sapiens
tacctttattttggtaggaaatttgcctttgctaatagttgcctactatgttcagtagtttccccctccccttataaaatacccaagtggctactttccargtattagtgaaatccctagatctgccaagagaagaaacctagctaatgcagttacatagtattgtcaattctgaagtacatattctccagcttgaatagc

SEQ ID NO: 23614 - DNA, 201 bp, Homo sapiens
tttgtatatggcaagagataggggtctattttcattactctgcatagagatatccagttttccaagcaccattcattgaagaaactgtcttttccccagtktatgttcttggcacctttgttgaaaatgagttcactgtagctctgtagttttgtttctgggttctctattctattccattggtctatatgtctgttttca

SEQ ID NO: 23615 - DNA, 201 bp, Homo sapiens
actctgtgccccaaggaaatagggtagaggtctgactcatttactactctgtctccttacataaagcctggcacacaaaaagtgttcaataaatactaatyaaatggataaataaatgaatagcatttgttacagtatcttatggttgtctctaaaaacccgtaaaatcaagaatattttgaaaatctctatgtcccaatc

SEQ ID NO: 23616 - DNA, 201 bp, Homo sapiens
aactcaatcagaaaatgtattttgaggtgattgctttatcagatttctacattttgcaagccaaataatcatataacctctaagatgatattataagttcyatctatcatgaccaggacatttgttttgctttctaagacctaagcagaccatatagctgctctggtttcatgtttgggggtatcctcctaacctttgtat

SEQ ID NO: 23617 - DNA, 201 bp, Homo sapiens
attagtactgctgttattcatttattttcattatccaaattacccctatttatatttgttgtaaagcacaaagccggtttctgttttaaatatattttttraaagagtagcataaatgtatggacagaacatgtgctgctgttaaaaataattttgaggttattttgaaagcaaatagagaaaagtatgttttatttttgt

SEQ ID NO: 23618 - DNA, 201 bp, Homo sapiens
agatgttagaatgattgtaacatgaggaacgattgagctttcacctgatttcttatcatctgtcagaaggtagaaaaaaataggatggttcactcaaaaaacagaaaaggttaaaggctgttcatttcattcttgtgtgaagaactgtgggattttgagcatgcccaaaaggcagcatcccttttcttatacattgttact

SEQ ID NO: 23619 - DNA, 201 bp, Homo sapiens
tgtaagaatgattcttactagatgttagaatgattgtaacatgaggaacgattgagctttcacctgatttcttatcatctgtcagaaggtagaaaaaaatrggatggttcactcaaaaaacagaaaaggttaaaggctgttcatttcattcttgtgtgaagaactgtgggattttgagcatgcccaaaaggcagcatccct

SEQ ID NO: 23620 - DNA, 201 bp, Homo sapiens
gaaccggccgggtgtggtggctcatgcctgtgaggaggccaaggtgggcagatcacgagggcaggagatcgagaccatcctggctaacaaggtgaaacccyatctctactaaaaatacaaaaaattatccgggcgtggcggcgggcgcctgtagtcccagctactcaggaggccgaggcaggagaatggcgtgaacctgag

SEQ ID NO: 23621 - DNA, 201 bp, Homo sapiens
tctttatggttcattttcattataaaaagaacagaaccggccgggtgtggtggctcatgcctgtgaggaggccaaggtgggcagatcacgagggcaggagwtcgagaccatcctggctaacaaggtgaaaccccatctctactaaaaatacaaaaaattatccgggcgtggcggcgggcgcctgtagtcccagctactcag

SEQ ID NO: 23622 - DNA, 201 bp, Homo sapiens
ctaacttagaaatattgataagttaaaagactgtaatgaaaacaatgaactcactaataatccccaatgcccgcagataacctctgttaatgcttttgctrtatttctttccagtcttgtctatagctcataacataattgagatcatactttatacagtagatacttggcattgaataatttggcattcttggttctcat

SEQ ID NO: 23623 - DNA, 201 bp, Homo sapiens
tttacatgaaagtgattaatgtactgatttaaaaacaaaaaaaaatttccctctattttaaaggtccctctttaaagcttctagctcagcaagtgctgttygagatgagacttctaaacattagaattaaacctcctaactcacttgcctgccctctcactgacctcgcttcctcccacttgtggccagaaaactcaagat

SEQ ID NO: 23624 - DNA, 201 bp, Homo sapiens
gcagtctggttcttgacattatgctcacatgtctcctacttagtaaatacaacttagggatttaggccaattcatcagttctatcagatccaagtgtgttkaaaaatagtgtcccagggataaaagtcctagcaataaatgagaatcatggataatcaaaaacaaatgagggatttaataagccaatataaatcctaatat

SEQ ID NO: 23625 - DNA, 201 bp, Homo sapiens
gaaatgaagggaaaagcagcccacaatatttgcaggagaatgaggtgacagaatagaaatagaaatgtggcctggaaagcaggtgcaagaccataaaaggstcttgtatgctgtacaaagaatttggattttattgtaagtgcaactacaaagatttttaagaaggaatggcacaatcagacttttaagattactgtctgg

SEQ ID NO: 23626 - DNA, 201 bp, Homo sapiens
aagctataaccgtttttgccccctggactagggacaccctgctgttcttcccccactgagtctgggtgctagggagataaagttaaaaaaaaaaaaaaaawtttttttggctttctcaaaaaaaagagcaattattagagcacttctgctctaattatgctctttctcacctagagaaagctgtcattctaaggaaaaaag

SEQ ID NO: 23627 - DNA, 201 bp, Homo sapiens
agactccagaaaatagatctgctcttccatcagacagtgcagaatcaaacccccaggaagctgttttctcactcagatttaatggtctaatagtaaaatcragagtgaacaatgacattcaaccaacacttttgtgtccaaatttagaaattcccaaaagggaaaaccaacgttcttggtataaagtcacatgtttttaat

SEQ ID NO: 23628 - DNA, 201 bp, Homo sapiens
tgccttttctatgtccagtgttattttaaaacatttattacagcacatgagtaaatgttgggacagttggctatgtaaaaaagaaagacacaaagaaagayaagtgagaaaagggaaaagaaaaaataggcaaatgtcaggaagctgcttttttttattgaagaagtaattagacaaagctgagaaaattaagacttagca

SEQ ID NO: 23629 - DNA, 201 bp, Homo sapiens
ctaatatgtatttagcaataaccgtgttcaacccacctgctagggataatgtatttggcagattgattagggtaagaatgatataaaaggcctaatttttwaaaattctctatgcacatttatttttcaccccgagaatctaagtcttgatcaccaccctaccagaaatccacaggacaataaaaaggcaggtaggaaaga

SEQ ID NO: 23630 - DNA, 201 bp, Homo sapiens
ggaaataaaggacggaaagggaatacaggcttggaataagatgatagtgaaatcacaaattgagatattgttctcccttgctctgtggcaacagaactcakaagataatgatagtgaaagcttatgcaaggaccattcactggtaaaatggtaggatacatgatactgccattgccacttctcccgcagtgcagtccctca

SEQ ID NO: 23631 - DNA, 201 bp, Homo sapiens
cttaaccaaaaccagtatcttttattttctgcagtatataattttcttagaacaaattgtctatttctgaatctacattttaaaatccacataattttatytattataccaaagaggttggaaataaaggacggaaagggaatacaggcttggaataagatgatagtgaaatcacaaattgagatattgttctcccttgct

SEQ ID NO: 23632 - DNA, 201 bp, Homo sapiens
aagtaccagttttatttaaaagcaaataaattgtttttaagtaagtaatcgtttttataacataaatttgtgttttcagtttgattcttaaaccatcaacrtttgaattacctagttcgctgggcatgggcccagaagtttgccttttagcaagcatctagttggtaacttcgcacactaaatggacaagaagcccaatat

SEQ ID NO: 23633 - DNA, 201 bp, Homo sapiens
cttgtctcacataccccctttaaaaaaaaaaagaaattgcaatttccattaagtaccagttttatttaaaagcaaataaattgtttttaagtaagtaatcrtttttataacataaatttgtgttttcagtttgattcttaaaccatcaacatttgaattacctagttcgctgggcatgggcccagaagtttgccttttagc

SEQ ID NO: 23634 - DNA, 201 bp, Homo sapiens
tgggagctgaggcaggagaactgcttgagctcaggagtttgagactagcctgggcaacttagtgagaccccatttctatgaaaaagaaaaaaaaaaaaaaactctgagctaggggcctatgggctgaactgcactattttccaatatggaggtctggagttctagaaaaactagaaaactctataagaagtatagaggtaa

SEQ ID NO: 23635 - DNA, 201 bp, Homo sapiens
tatacctgttgtttccagagaagcatctctgatctactgccctactcaagggttgtgggcagcattaatcataaccctgagctaggtaggttgggcacagyggcttatgcctggaatgctggcacttttgggagctgaggcaggagaactgcttgagctcaggagtttgagactagcctgggcaacttagtgagaccccat

SEQ ID NO: 23636 - DNA, 201 bp, Homo sapiens
tattttcaacttaagatgggtttatcaggatataaccccattgtaagttgaggagcatctgtaaccaattcctttatccgctggaggctgaggtttggccratgtgtaatcccagattggtttcaccctgacacccagcctgtttctagacagtctccccatttcagtcaacccatgcttataaaagggaaaaccattgtc

SEQ ID NO: 23637 - DNA, 201 bp, Homo sapiens
tgactactcatgtcatttgtatgagatagtcttttcattttgttaaaggagattgcatattttggaacatatgcttaagagtttgcagttgccttcctttyactttttgggttaaagcctagtctaaatatattaccaagacttctaatatttcaggtcatatatcttaggggggtgtattgttccaagatctgatctcct

SEQ ID NO: 23638 - DNA, 201 bp, Homo sapiens
tgcccaattgtagcccagcacatttaaggtaggtgtggggaagctgggatgtttggtaagtgaggtgtgttaaatgcattttcaacttacaatattttcarcttaagatgggtttatcaggatataaccccattgtaagttgaggagcatctgtaaccaattcctttatccgctggaggctgaggtttggccgatgtgtaa

SEQ ID NO: 23639 - DNA, 201 bp, Homo sapiens
tagcccttctaaagtttgtatatctcctcaattttaattcattcattcaataaatatttattgaatacctactatgtattaagcaaattggtaggtataaytaaggatagaaatcccaaagggccagagtctcaagaatttaccaaattattaatttgcctctgagtttctactgattatagttgcaagatattttaagaa

SEQ ID NO: 23640 - DNA, 201 bp, Homo sapiens
tcttcccccactgagtctgggtgctagggagataaagttaaaaaaaaaaaaaaaattttttttggctttctcaaaaaaaagagcaattattagagcacttmtgctctaattatgctctttctcacctagagaaagctgtcattctaaggaaaaaagggaaagatgtaagaaataataattcatgccacacatacatacata

SEQ ID NO: 23641 - DNA, 201 bp, Homo sapiens
accattctttttttcacttttagcacagtacttaataaattatatgaaatattcagcactttattataaaacatgctttgtgttagatgattttgcccaaytgtagcccagcacatttaaggtaggtgtggggaagctgggatgtttggtaagtgaggtgtgttaaatgcattttcaacttacaatattttcaacttaaga

SEQ ID NO: 23642 - DNA, 201 bp, Homo sapiens
cagcaatatgcattcagtagaaaatttatttcaagtacccatacaaccattctttttttcacttttagcacagtacttaataaattatatgaaatattcarcactttattataaaacatgctttgtgttagatgattttgcccaattgtagcccagcacatttaaggtaggtgtggggaagctgggatgtttggtaagtga

SEQ ID NO: 23643 - DNA, 201 bp, Homo sapiens
gaacaaaactccatctcaaaaaaaaaaaaaaaaaaggaaaaaaaaagaaagcctttgtgatactgggcagcctgtaaatcttgggtaggattgaaatacarttagtcctctacttacaataaccaacaacaaattttttactttattttggtgaaacagcaatatgcattcagtagaaaatttatttcaagtacccataca

SEQ ID NO: 23644 - DNA, 201 bp, Homo sapiens
tccaggaggcggaggttacaaagattgcaccattgtactccagcttgggtgacaagaacaaaactccatctcaaaaaaaaaaaaaaaaaaggaaaaaaaaagaaagcctttgtgatactgggcagcctgtaaatcttgggtaggattgaaatacaattagtcctctacttacaataaccaacaacaaattttttactttat

SEQ ID NO: 23645 - DNA, 201 bp, Homo sapiens
ttttccttatctgtaaaacaaagataattatcccaaccacagagcagggttggtaaggatgatcgcatatgtaaaacacttagctagttcctacctcatakagcaggcactgatataaataaggatttgctaacactcttacttttctatgcaggaaaccatatgatatagaccttcataataattttatactcaccgagt

SEQ ID NO: 23646 - DNA, 201 bp, Homo sapiens
ctacaaaaattggctgggcgtggtggcaggcatctgtgatcccagctactcgggaggctgaggcaggaaaatcgcttgaatccaggaggcggaggttacaragattgcaccattgtactccagcttgggtgacaagaacaaaactccatctcaaaaaaaaaaaaaaaaaaggaaaaaaaaagaaagcctttgtgatactgg

SEQ ID NO: 23647 - DNA, 201 bp, Homo sapiens
aaactacaaaaattggctgggcgtggtggcaggcatctgtgatcccagctactcgggaggctgaggcaggaaaatcgcttgaatccaggaggcggaggttrcaaagattgcaccattgtactccagcttgggtgacaagaacaaaactccatctcaaaaaaaaaaaaaaaaaaggaaaaaaaaagaaagcctttgtgatac

SEQ ID NO: 23648 - DNA, 201 bp, Homo sapiens
cttcattagaacctccaactcagctctacctgttaaagcagctaagatattttggtacatattctggttttgttcacttgaaagatctatgcagaaagccrgattagacagagaggaaggtgatcgatgaatatctaagctaccaaagtagcagaaacacacagcagaagagaaaataatagcaaactcagagctaagagc

SEQ ID NO: 23649 - DNA, 201 bp, Homo sapiens
taccacagaacaaaggttggtggaaccaattctacttttgcagaattaagaaaatatttcagacttagacctagactgagctgggaaggatcttagagctmatctcctctctaattccctcttggttatttcccttcctctttttatttttattttttattgtggtaagacaatttagcatgagatccaccatctcaacca

SEQ ID NO: 23650 - DNA, 201 bp, Homo sapiens
gttctaaaataatgttttggaatatccttctcttgccacctttaaaactagactgaattctcatcttgcttcctagagcagcgtttcttctaaaaattttraacttgttccgttggctctacatacatttttgtcaatgccagtttagtgtggtagaatagataatctgctgcttactgggtgtgtgaccttaagaatatt

SEQ ID NO: 23651 - DNA, 201 bp, Homo sapiens
tatagctgagagatcattgccaaatcaatattaggaagctttgcccctgtattttccagttggagttttatagtttcaagtcttatatttaagtctatagyccattttgagttaatttttgtctatggtgaaattttgatagcaattttattctttcacatgtggatatccagttttcccagcacctttccccattgtgta

SEQ ID NO: 23652 - DNA, 201 bp, Homo sapiens
agtacaattatatttgttaatcaggtggaagctaaaaaaattactgacaggtttcccatctcttatttttataccgtagttttagtcttggttgagatgtrtgcataaacatcactatcacctgacatgtatcacccacgcaagtacatagtgtgacccttctgacagcttaatttcttgaggaaaaatgatacaatgatg

SEQ ID NO: 23653 - DNA, 201 bp, Homo sapiens
attgcagaatataagggcctgaagcaactgggtggtataattgatccactgtgaaatctatatgcacacagcatgcagattcatcgtagcatgctctgggktgtgtgtgtgtcattccacatgcgtaaaatcaattagagcatttcattgttcagccctgcctgggtctcattattagccaacattgagtcacagccttga

SEQ ID NO: 23654 - DNA, 201 bp, Homo sapiens
aggtgatattatagtactgaatgcctttccctgatgattaatgatgttgagcatttttaaatatgcctgttggccatttgtatgtcttctcttgagaaaartctattcagatcctttgtttatttttcagtcagattgttttcttgctattgagttgtttgagtttcttgtatattttgggtattagccccttatcagaag

SEQ ID NO: 23655 - DNA, 201 bp, Homo sapiens
agattgagcccatctggttgctttcatggaaaaatatataggaatagctttctaggtctttttggaaactctcaaaagtgtacatttatttggtggggaaytggaactacaaagtggtagtacaattatatttgttaatcaggtggaagctaaaaaaattactgacaggtttcccatctcttatttttataccgtagtttt

SEQ ID NO: 23656 - DNA, 201 bp, Homo sapiens
caaggcatggcaggattttatttttgagatgtggacattctcttaaaacagtgtaattgaaacaagttctcttttaatttttattaattaatttttaattratgagtaaaaactagattcatcatatacaacatgttttcaaatatgtatactttggggaacagctgaactgagctaattaacatatgtgttacttcacat

SEQ ID NO: 23657 - DNA, 201 bp, Homo sapiens
tcaaagcagactttccaacgcctcctgggccaagaatgactagcttatactcatgcatgatgcaaacttgtcgaaacctagtacctctcacgctgtcaccrggttcccgcagccagtgtcactccctccgggttgctactctcggcaccacagcagtcctgccgctgccgccgccgctccagctggtttacacacctgact

SEQ ID NO: 23658 - DNA, 201 bp, Homo sapiens
aggcaattttttaatattcttattgttcaaaacattttaggagacattttttctaaacaaaattcaatgtgctgcattgcttttttaaagtacagtacttytgaaaactagaaaaaaggtaatgaaagtaactcaggaacttttaaaagaaagtgttccctttataatatattcataagaaaaccggagaagctgaaaaat

SEQ ID NO: 23659 - DNA, 201 bp, Homo sapiens
caaaaccttccagcttacaaatcaatcaacagtagcagagtggagtttcccaaaataaatcttttttttttctaagttttttgctttccttacaatctagkgtttccaaagtcctaaggtaacaatttaagagcaggcaataatttggctgatgctttgaaatgatgattattgcttcctaagtatacaagatgccttctt

SEQ ID NO: 23660 - DNA, 201 bp, Homo sapiens
actgaacaaatgtctattgaatgcctgcattgtgccaagcattgtgtgggagatacagtaatgaacaagacccactttgttccctgcagcagccaaagccvgagtttgggaatggtcctggaggggtcactctattttctaaatcttggatgccttaagtgctgctcttcttaagacacttattatcttaagcctcctgag

SEQ ID NO: 23661 - DNA, 201 bp, Homo sapiens
caacaaagaaggaacaattctaatcagaaaaataccttgagtcaaatttaagttccaaagacaaagcacctctattagttacaaaacaggaactggctttwactataaagagccacgagaagtctgcagggagcaagacctacctggccataagaaaaatgtaggtgaaagcattcaggcagcaaggatggctcaacattg

SEQ ID NO: 23662 - DNA, 201 bp, Homo sapiens
tactggcctatgctgcctgagtcattttctacaaattggatcatgttaccccctactttgaaacccctattgatacctcatggttttaagattatgtccaraggcacttcaccatgtgcccctaatctaatgtctcagaataattttccacctactcttcttcatggacccaaatggtgcaccgtctaaggactgctctga

SEQ ID NO: 23663 - DNA, 201 bp, Homo sapiens
tatggcttattctggaaaatgttccatgtgttgataggaaaagtatgtattctgtagcagttggatgaaatattctgtaaatgtctgttacaccatttggyctagaatatagtttaaccctgatgcttttttgttaaatttctgtctggatgatctgtccattgctaaaagtggggtgccctactatttttgtattgccat

SEQ ID NO: 23664 - DNA, 201 bp, Homo sapiens
agtcattttctacaaattggatcatgttaccccctactttgaaacccctattgatacctcatggttttaagattatgtccaaaggcacttcaccatgtgcycctaatctaatgtctcagaataattttccacctactcttcttcatggacccaaatggtgcaccgtctaaggactgctctgagtcatcagaacatgccatg

SEQ ID NO: 23665 - DNA, 201 bp, Homo sapiens
tcattgcccagggcccttaaatttaaatatccctccccctgaacatataggcattatgaaatggaaaagaatccgagaatctgattgcgcgttttcattcstagcaaagccaccatgtacacacacgtacaggccagtcacattttagaacacatgtttcagggttccatgggggatatgatgctgaccattcttttgttt

SEQ ID NO: 23666 - DNA, 201 bp, Homo sapiens
catcgtacccactccctgctataaacccaaaggtaacttgacaggtgctctattaccagcctgttaattgttgtgtgtagtcaggtgtgttttaaactccytggaatatttttaagtatcccaagtattcttagtaagaattctttataacttaaactctactaaaggaatttgattatcttaaagaatctttcaagtgat

SEQ ID NO: 23667 - DNA, 201 bp, Homo sapiens
cttgcctgagttcacactgatgggaagccagcactgaaaatcacatctctttacttctggtccagaacgcttttaatattttgtgttgcttctaagagtakatatctttttcttcagtgtttctttagaaaacactgggaatcaaataaatgtaaagttattctaagatagattatgtaattcttaaattagtttgcttaa

SEQ ID NO: 23668 - DNA, 201 bp, Homo sapiens
taccccaaatttctgtctgtatctccccacctctgtgttccttgagagaagaaactgaattgtatttgtcttcatatctccataagaagaacctaataagyactaacaactgctggataaataaagaatttttgccacacaacaattgtttaaatagagcagatgctgacatctctattatacccacaaggaaacttagct

SEQ ID NO: 23669 - DNA, 201 bp, Homo sapiens
ccctgattttcccttctatatgccaccggtcagacttcatccaaactatctctcaacattggtttttctcctccatccttgctgccactgcgttagcgcasgcctttactttttctcatctgaactagtaccatggaccctgagctagtttaccagcctctgatttcattgcctatgttaccttcagagtgcgtttcctaa

SEQ ID NO: 23670 - DNA, 201 bp, Homo sapiens
tcaccctgattttcccttctatatgccaccggtcagacttcatccaaactatctctcaacattggtttttctcctccatccttgctgccactgcgttagcrcaggcctttactttttctcatctgaactagtaccatggaccctgagctagtttaccagcctctgatttcattgcctatgttaccttcagagtgcgtttcc

SEQ ID NO: 23671 - DNA, 201 bp, Homo sapiens
ggattcaagcaatattgcttacattggaacagctcacagcattgtcaaatgtgttacatctatccagttgccttctgcacatcactgcttgaataacccayaggcacaacaagcccgacatgcgtaagtttaacttgagccccagaaacctgctttatcatctttatttttttaatcttataaatgaagacactgtctgcc

SEQ ID NO: 23672 - DNA, 201 bp, Homo sapiens
agttaaatgatttctgttaagcaagaaaatccagtaaagaagtgaaagatgtctttattctttgaagcccttggagtaccattaaatagaccaagtatacyatagtaatttccctagtggccttgtgagagttaatacacatactgaaattatataactggattcaagcaatattgcttacattggaacagctcacagcat

SEQ ID NO: 23673 - DNA, 201 bp, Homo sapiens
cacatgaacgtgagcaagaagctacaagccatccgaggtagctcacaatagaaatgatgctgtaggtagttaaatgatttctgttaagcaagaaaatccartaaagaagtgaaagatgtctttattctttgaagcccttggagtaccattaaatagaccaagtatactatagtaatttccctagtggccttgtgagagtta

SEQ ID NO: 23674 - DNA, 201 bp, Homo sapiens
aagtgatttaattttcagcgagcttcacctcaaatagccaaatagaacaaagatcccttgactggtaagaagtggtataaatttaccaggagtcctcgtgwggggggggggggggcggggaaaaagaaaacttagattaaaagttttcgatgggaagtgaagaaaagtaaacaaggctttgcctacgagtctcctctctct

SEQ ID NO: 23675 - DNA, 201 bp, Homo sapiens
cactcacagcagatttcattgtcaaggtgagccctatttagatacctccttttcaagccacatcccaaatgatgttacttataatttcctgagcagagagygatttttggttctgacatatgtttggaaagcccgtttgttacccaggaaatgtttaatctgagggtgttgagctagctgcatcctggaccttatgaggac

SEQ ID NO: 23676 - DNA, 201 bp, Homo sapiens
tgctcatcatttccactcctgtagaaatgccgagtgcaaacccactgcacctgcacaccatagtgatctcagggtggccaagagctggtggctgactagtsctgtgtgagcatgggtttataaatgcacttgagtaccagtttagtttctttgccatcagcgttacaagtgatttaagtaacagatatttcagagaaaggg

SEQ ID NO: 23677 - DNA, 201 bp, Homo sapiens
gcaatataatttagctataatcgtagtttaaattttttgatatccatgtaggggtatttcccatatttttggaagtagcggtcattagcaaagtaactaartaaaatacagtgctggtagtcaaaattaagcacactctacagtctcttttctcctttcttctttttggtgcttggtttgagactttgcacacagtgggta

SEQ ID NO: 23678 - DNA, 201 bp, Homo sapiens
tctgatctttgacaaagatgacaaacacaaccaatgaggaaaggactccctattcaataaatggtgctgggataactggctagccatatgcagaagactgraactggaccccttccttatatcatagacaaaaattaactcaagtagattaaagacttaaatgtaaaactaaatactattaaaaaaaaactgtggaagaca

SEQ ID NO: 23679 - DNA, 201 bp, Homo sapiens
aaaatgagggggaagttatgacattccagggagcttgttgccactattcctgattacaagacatattaaatggagtcctttgagttataataaaaagatgstagttaactccaagccacctgaacatataaagactctccaataaaggtaaatagacgggcagacattaaaaccagtattattttgtttcatagctccact

SEQ ID NO: 23680 - DNA, 201 bp, Homo sapiens; identical to SEQ ID NO: 3861

SEQ ID NO: 23681 - DNA, 201 bp, Homo sapiens
ctgcccttccagaattttcactgtgagaggagataagtaaatatgaaagtgtactatagtcactatactatactgccctcactgtaaatggggacctcttkctaaaatacagatttggtttcatttatcatctgcttgaatcatttcaattgcattttttttttgccttcaggttaaaaaaatcccaaattcctttacatg

SEQ ID NO: 23682 - DNA, 201 bp, Homo sapiens
gattgtaagcttcctgaggcctcaccacaagcagttgctggtgccatgcttcttatactgcctgtaagaccatgagccaaataagccctttttctttatttaaaaaaaaaaaagaaaaattataaagtacagaaagaaaaaactattaaccaagaattatctggcaaaactgtccttcaaaaatgagggggaagttatgac

SEQ ID NO: 23683 - DNA, 201 bp, Homo sapiens
actagaaggcagagagtgctggtgtttatcaacattttctaattatgctccttacattatttcttcagtttatcccatgagctgagattttgtctagctgyaattctgtcattaatattatgaaaacaataggtttaatgaatataccttttcaaaccacattctccccctttctctccctctctccctcctagattctga

SEQ ID NO: 23684 - DNA, 201 bp, Homo sapiens
tggcatcccagagggagttgcctcacacaggctgagaatagggagttgtcagagaaggagaccaggaagtgacacttgagctttgaaggagttaaccaggrgaataagaggtgaccatattggatcatgtcagccagaggagtgaaacattgagagaatggcaaatatgccaacatcaagtgtgggctggatggtaacaaa

SEQ ID NO: 23685 - DNA, 201 bp, Homo sapiens
agatcgtttttgactacatgcaaagcattgctctaggagcaaatgaaaataagaaaatgtatgtaagactttgtactctcaaatgttttaaaattggaggraggaagagaataaagacaaaaatatagataggatttgatgcagagtaagttacaaaagtacaacagaagagctcagaggacatctatgcaatctattaat

SEQ ID NO: 23686 - DNA, 201 bp, Homo sapiens
atcttagccaaaaggccgagaagcgatagtgaatgattatgaaagaaataaagcagagtaatgggatagagagtgacacagggatggagggttgctctacmtgaggtggtcaggaaattctctctgagttgacatttaaatgtccttagtatgtttggaaggtgaggcatgaaggagcccagcttatttgggggcctgtgg

SEQ ID NO: 23687 - DNA, 201 bp, Homo sapiens
agtttcatatagtgaatgattatgctacacttgatcttagccaaaaggccgagaagcgatagtgaatgattatgaaagaaataaagcagagtaatgggatrgagagtgacacagggatggagggttgctctacatgaggtggtcaggaaattctctctgagttgacatttaaatgtccttagtatgtttggaaggtgaggc

SEQ ID NO: 23688 - DNA, 201 bp, Homo sapiens
gtctgcatgagtcaattatctccacctggttcttcccttgacacgcagggattatgggaagtacaacttaagatgagatttgggtggggacacagccaaaycatatcagactctgacctcatattacttaaaatccatagcactccatgagccaaaatctttatagcttgtagaatcaagttgatgctgaatttttttaat

SEQ ID NO: 23689 - DNA, 201 bp, Homo sapiens
tgtcaggagaaagaagaatgagaactgagtgaagggagaagccccttataaaatcatcagatcttgtgagaacttactatcatgagaatagcatggggaarattgtctgcatgagtcaattatctccacctggttcttcccttgacacgcagggattatgggaagtacaacttaagatgagatttgggtggggacacagcc

SEQ ID NO: 23690 - DNA, 201 bp, Homo sapiens
tttttgtatttgaaatataattcagcaaaatgaatgtgggagtgaaagataccctgtttctcttttgctcttcactcccagaagctggtacagtgtgaaascaaccttaaatattttggaccaaaccagaataagatgaggcaatctagtctgcccccttggctcatctttaattagaggtaccttgagaaggacagctgt

SEQ ID NO: 23691 - DNA, 201 bp, Homo sapiens
tatagctaaatcatttttccttgtgtgttctttttttgtatttgaaatataattcagcaaaatgaatgtgggagtgaaagataccctgtttctcttttgcycttcactcccagaagctggtacagtgtgaaaccaaccttaaatattttggaccaaaccagaataagatgaggcaatctagtctgcccccttggctcatct

SEQ ID NO: 23692 - DNA, 201 bp, Homo sapiens
gctgaagaattggccttgtttgatttaattatcctaaagatttgatgaaaagcaaactggaacctgcttttttctcccaacaaacatactattggtagcawatgtatagctaaatcatttttccttgtgtgttctttttttgtatttgaaatataattcagcaaaatgaatgtgggagtgaaagataccctgtttctcttt

SEQ ID NO: 23693 - DNA, 201 bp, Homo sapiens
actaaagagcttctgctcatcaaaagaaactatcattagagagaacagacaacctacagaataggagaaaaattttgcaatctatccatctgacaaaggtstaaatccagtcaagaggaacttaaaaaaatttacaagaaaataactccattaaaaagcaagcaaaggacatgaacagacagttctcaaaagaagacattc

SEQ ID NO: 23694 - DNA, 201 bp, Homo sapiens
aggggatatggtagcattttctgtaaaattcagtttcactgaaaggcttcacttcagttggttccttgagcatttctgatttcctccactgtgattgttcctgggtttccacaaagccatctatcgtctgtcctttctcccctcccacacaaatgcctgtgaaaccaatttagatagcaagtagtattttttagtagttgg

SEQ ID NO: 23695 - DNA, 201 bp, Homo sapiens
ggagctgaaagtactagaactgaattgaaaattttactggcgggattcaacagcagatttcgcaggcagcagaaagaattttcaaacttgaagatagataggccaataaaaatagaagaaaataaacaaacagagtctaaaagagttgtgagacaccctcaagtgaaccaacatatacattttgagagtctcagaagaaga

SEQ ID NO: 23696 - DNA, 201 bp, Homo sapiens
ctgtggttgcaattccctatggaagtagacatattcgccttgtcttaaaaggtcctgatcacttatgtaagtaactccattgttttcctttgggaattggkaattgtagtcattattatttattttgtcttcccagaaaagattaaaacacaagaatacaaatctttctactctatcataatatgatattttgagtacctc

SEQ ID NO: 23697 - DNA, 201 bp, Homo sapiens
gggagctgaaagtactagaactgaattgaaaattttactggcgggattcaacagcagatttcgcaggcagcagaaagaattttcaaacttgaagatagataggccaataaaaatagaagaaaataaacaaacagagtctaaaagagttgtgagacaccctcaagtgaaccaacatatacattttgagagtctcagaagaag

SEQ ID NO: 23698 - DNA, 201 bp, Homo sapiens
tgggagctgaaagtactagaactgaattgaaaattttactggcgggattcaacagcagatttcgcaggcagcagaaagaattttcaaacttgaagatagataggccaataaaaatagaagaaaataaacaaacagagtctaaaagagttgtgagacaccctcaagtgaaccaacatatacattttgagagtctcagaagaa

SEQ ID NO: 23699 - DNA, 201 bp, Homo sapiens
ttgggagctgaaagtactagaactgaattgaaaattttactggcgggattcaacagcagatttcgcaggcagcagaaagaattttcaaacttgaagatagataggccaataaaaatagaagaaaataaacaaacagagtctaaaagagttgtgagacaccctcaagtgaaccaacatatacattttgagagtctcagaaga

SEQ ID NO: 23700 - DNA, 201 bp, Homo sapiens
gagcggatcatgaggtcaggagttcgagaccagtctggccaatatagtgaaaccccatctcaactaaaaatacaaaaattagtcgggcgtgatggtgggcrcctataatcccagctacttgggaggctgaggcagaagaattgcttgaacccaggaaacagaggttgcagttgagccaagatcacaccactgcactccagc

SEQ ID NO: 23701 - DNA, 201 bp, Homo sapiens
aaagtcccaaggacagccttgagtgagactctgggaaattaagacactcaaaagcagctatgtatatggagaaggcccatacacaccacataaaagaaagatctgagaagaccttacgctttcacctcagactgattactatgctcagagtatacccagctaatcagtgatggattgcccaatcacagagccagtctacag

SEQ ID NO: 23702 - DNA, 201 bp, Homo sapiens
tttgggaggctgaggtgagcggatcatgaggtcaggagttcgagaccagtctggccaatatagtgaaaccccatctcaactaaaaatacaaaaattagtcrggcgtgatggtgggcgcctataatcccagctacttgggaggctgaggcagaagaattgcttgaacccaggaaacagaggttgcagttgagccaagatcac

SEQ ID NO: 23703 - DNA, 201 bp, Homo sapiens
taaagtcccaaggacagccttgagtgagactctgggaaattaagacactcaaaagcagctatgtatatggagaaggcccatacacaccacataaaagaaagatctgagaagaccttacgctttcacctcagactgattactatgctcagagtatacccagctaatcagtgatggattgcccaatcacagagccagtctaca

SEQ ID NO: 23704 - DNA, 201 bp, Homo sapiens
ctcttgagcccgggaagctaaggctgcagtgagctgtgatcacactgtgatagcgagaccctatctcaaaataataataagggctgagtgcagtggctcaygcctgtaatcccagcactttgggaggctgaggtgagcggatcatgaggtcaggagttcgagaccagtctggccaatatagtgaaaccccatctcaactaa

SEQ ID NO: 23705 - DNA, 201 bp, Homo sapiens
tttggaaaaaagagatttaattgactcacagctcttcaggggtggggattgtaagtaggaaacttacaatcatggcagaaggggaagcaaacacatctttyttcacagatgtcaggagaaagaagaatgagaactgagtgaagggagaagccccttataaaatcatcagatcttgtgagaacttactatcatgagaatagc

SEQ ID NO: 23706 - DNA, 201 bp, Homo sapiens
ctaaagtcccaaggacagccttgagtgagactctgggaaattaagacactcaaaagcagctatgtatatggagaaggcccatacacaccacataaaagaaagatctgagaagaccttacgctttcacctcagactgattactatgctcagagtatacccagctaatcagtgatggattgcccaatcacagagccagtctac

SEQ ID NO: 23707 - DNA, 201 bp, Homo sapiens
acctaatacaaatgctatatgcatttcttacaccaaattatataattaattttcttaataacaaagaccaagtcatattcattcttctttgtattcttcayagtaatttcattgccaaacacatcacagaagctctgtggacgtttattgaataaaaaagtaaattaggaggcattaaagcattgtgatcatgagtgtgtg

SEQ ID NO: 23708 - DNA, 201 bp, Homo sapiens
tctaaagtcccaaggacagccttgagtgagactctgggaaattaagacactcaaaagcagctatgtatatggagaaggcccatacacaccacataaaagaaagatctgagaagaccttacgctttcacctcagactgattactatgctcagagtatacccagctaatcagtgatggattgcccaatcacagagccagtcta

SEQ ID NO: 23709 - DNA, 201 bp, Homo sapiens
aatgctggggaaaccagcctcccaaatattttggccaagagcccaaccatgaagctaaacacctgaagcctaggagctgaaagaaaccatagcagtcatgyttaccaccctccttatctagggacacaatcctttagccaaaaccactggggcagatgtctttcagattccaaatttttttgtactttagaaagatgttag

SEQ ID NO: 23710 - DNA, 201 bp, Homo sapiens
atttggccctcagggagtcagctgctatttagaaccaagggtttatatcagatcataaatggttggagtaatccacagcagcctgctccatctcaaattamaccaagcccagaaaataattttattttgaactgtaagggtttgatggaaaaatctccaaatacataatgaattagaatccaaatagaggtcccttgacgt

SEQ ID NO: 23711 - DNA, 201 bp, Homo sapiens
gttgttgaattgatccctttaccattatgtaatagccttctttgtctcttttgatctttgttgatttaaagtttgttttatcagagactaggattgcaacmcctgcctttgttttccatttgccgcgtagatcttcctccatccctttgttttgagcctatgtgtgtctctgcacatgagatgggtctcctgaatacagca

SEQ ID NO: 23712 - DNA, 201 bp, Homo sapiens
taaggtagaatcatgttacactggagtgaaaacagtaattcactctgattagatacagtttatgggtttatattatgtctttctttccctccctttgttcyttcctatttttcctctcaataggaccctagtcattaaagcactgttgctaactattaaacaaacaaacactgcctaaagtattattgcactaccactaac

SEQ ID NO: 23713 - DNA, 201 bp, Homo sapiens
tccctagggccttgttagtgcctctggcacactgggatgagctaacatggcaccagggatgtgtctgttcccagccagctcacctactgatggatgatgcytggcagcatgccaccttgttgtttcttgtattattacaacagaaagcattttcaaaagccacatttatcaagtcatcataattgtttggcttgtatatct

SEQ ID NO: 23714 - DNA, 201 bp, Homo sapiens
ataatactagcctgctcagactgtaagcttatcattcaaaaaccactttaaggtagaatcatgttacactggagtgaaaacagtaattcactctgattagrtacagtttatgggtttatattatgtctttctttccctccctttgttctttcctatttttcctctcaataggaccctagtcattaaagcactgttgctaac

SEQ ID NO: 23715 - DNA, 201 bp, Homo sapiens
tatgcaaggaccattcactggtaaaatggtaggatacatgatactgccattgccacttctcccgcagtgcagtccctcacacagcctaaaaccatcagcaytaccatatactcttgttcgaagctgcaagggaccagaaagcaccgcactgtcacattacttctactttcctgttgactcctgcagattcgtaactcgggc

SEQ ID NO: 23716 - DNA, 201 bp, Homo sapiens; identical to SEQ ID NO: 3843

SEQ ID NO: 23717 - DNA, 201 bp, Homo sapiens
cctggtcttagctcagaaaagtaagttcctgcacaggtaggatggttctcctactgcagtgaaagggccagggctgagactggacttcttggaatctgctktgggacagaagtagatgagcctgtcagggaggctcagactgccaggcttgacgtatggacaagtctccctctaagctgggatcttagctgaggaaggctg

SEQ ID NO: 23718 - DNA, 201 bp, Homo sapiens
aaagtccagctcaaatctgtactgtgatggttaaatatttgctatatttatatatctttgtagaaaacaaagtcactttctggtgaaccaatgaggaaaawaaagtactgtagccaatatctttaaaaataagatgacctgtggcattaattgtgcactcttttatgtcagacactgagctactttactttcattatttcc

SEQ ID NO: 23719 - DNA, 201 bp, Homo sapiens
aagtgttggttgtgcaatatgcagtcaggcattgtcatgaagaaaaattgggccctttctgttaaccaatgccggctgcaggtgttgcagttttcagtgcwtctcattgatttgctaagcatacttctttgagataatggtttcaccaggattcagaaagctgtagtggatcagattggcagcaaaacaccagacagtgag

SEQ ID NO: 23720 - DNA, 201 bp, Homo sapiens
tgcataggcacccacacatccacagagggtagccgcctgtcttagtccagtcaggctgatataacagacatataaaaactagtggcttataaacaaacaaaacaaatttgttttttacagttctggagtctggcaagtcccaggtcagtgcagccgcagatttgatatcggtgagggcttgctgtctgcttcatagatggc

SEQ ID NO: 23721 - DNA, 201 bp, Homo sapiens
ttgcataggcacccacacatccacagagggtagccgcctgtcttagtccagtcaggctgatataacagacatataaaaactagtggcttataaacaaacaaaacaaatttgttttttacagttctggagtctggcaagtcccaggtcagtgcagccgcagatttgatatcggtgagggcttgctgtctgcttcatagatgg

SEQ ID NO: 23722 - DNA, 201 bp, Homo sapiens
ttggtttctatttgcatggagtatcttttcccatcccttcactttcagtttgtgtgcccttataggtgaagtgagcttcttgtttacagcgtatagttggrccttattatttattccattcagccactctttatcttttaattgaagaatttagcccatttacatttaatgttattatcgataagtaaggacttcttattg

SEQ ID NO: 23723 - DNA, 201 bp, Homo sapiens
ctctacttaaaaatatgtatgtgtatatatacatgtgagtgtgtatgtatatatatatatatatatatatatatatatatatatatatatatacacacacatacatatacatacatacaagtatatacatacatacacacacacagaaattatctggacatggtggtgcacacctgtaattgtagctacttgggagttgga

SEQ ID NO: 23724 - DNA, 201 bp, Homo sapiens
tctctacttaaaaatatgtatgtgtatatatacatgtgagtgtgtatgtatatatatatatatatatatatatatatatatatatatatatatacacacacatacatatacatacatacaagtatatacatacatacacacacacagaaattatctggacatggtggtgcacacctgtaattgtagctacttgggagttgg

SEQ ID NO: 23725 - DNA, 201 bp, Homo sapiens
aaccttgtctctacttaaaaatatgtatgtgtatatatacatgtgagtgtgtatgtatatatatatatatatatatatatatatatatatatatatatatacacacacatacatatacatacatacaagtatatacatacatacacacacacagaaattatctggacatggtggtgcacacctgtaattgtagctacttgg

SEQ ID NO: 23726 - DNA, 201 bp, Homo sapiens
aaaccttgtctctacttaaaaatatgtatgtgtatatatacatgtgagtgtgtatgtatatatatatatatatatatatatatatatatatatatatatatacacacacatacatatacatacatacaagtatatacatacatacacacacacagaaattatctggacatggtggtgcacacctgtaattgtagctacttg

SEQ ID NO: 23727 - DNA, 201 bp, Homo sapiens
gaaaccttgtctctacttaaaaatatgtatgtgtatatatacatgtgagtgtgtatgtatatatatatatatatatatatatatatatatatatatatatwtacacacacatacatatacatacatacaagtatatacatacatacacacacacagaaattatctggacatggtggtgcacacctgtaattgtagctactt

SEQ ID NO: 23728 - DNA, 201 bp, Homo sapiens
ctttgctaatagttgcctactatgttcagtagtttccccctccccttataaaatacccaagtggctactttccaagtattagtgaaatccctagatctgcsaagagaagaaacctagctaatgcagttacatagtattgtcaattctgaagtacatattctccagcttgaatagctctctctttcatcagaagtgagacag

SEQ ID NO: 23729 - DNA, 201 bp, Homo sapiens
gcttaaaatccagttaaagtgacaggccaatccaggcacacttgaggctgggcaaagggcaggaagactaattccagccattaaggtggagggagaccctmtgtctcctgcctgcccctggtcagaagtcagttgttcaggtactgggcagggtcaagccaggagggcttcagcttgatctgtcaactcatggaggctttc

SEQ ID NO: 23730 - DNA, 201 bp, Homo sapiens
tctgcactccaacctgggcgacagagtgagactccatctcaaaaaaattaaatttaattaaaaaaaagaacagaaccccggtaaattaggtgcccatggarttaactactttaggatttttcttgtagagagagatgtatctcaatagttatattctacaactgagcagtgtgagcccaattttggcttgttttttttttt

SEQ ID NO: 23731 - DNA, 201 bp, Homo sapiens
tgaggccaggagttcaagaacagcctggccaacatggtgaaaccttgtctctacttaaaaatatgtatgtgtatatatacatgtgagtgtgtatgtatatrtatatatatatatatatatatatatatatatatatatatacacacacatacatatacatacatacaagtatatacatacatacacacacacagaaattat

SEQ ID NO: 23732 - DNA, 201 bp, Homo sapiens
acttgaggccaggagttcaagaacagcctggccaacatggtgaaaccttgtctctacttaaaaatatgtatgtgtatatatacatgtgagtgtgtatgtakatatatatatatatatatatatatatatatatatatatatatacacacacatacatatacatacatacaagtatatacatacatacacacacacagaaat

SEQ ID NO: 23733 - DNA, 201 bp, Homo sapiens
cacaatgaagtaataatcataggaacagtgtcttatttgaactcactgctgagggagagttgcttttttaaaaaaatatactttaaatactgggatacacrtgcagaacgtgcaggtttgttacattggtatacacgtgccatggtggtttgctgcacccatcaacccatcatctacattagttatttctcctaatgctat

SEQ ID NO: 23734 - DNA, 201 bp, Homo sapiens
tcaagtggtttgttggagactgggaaggagagaaggtgaagagaaatgctacagtcttctacaagcggtccatcatggcatttatcttttaattgctctaraaagtgcctttttccatttgtctgataaatgactggcataagaaccacatgttccatgaagcaactgcaatctccatatttgcaatctatcaatctcacc

SEQ ID NO: 23735 - DNA, 201 bp, Homo sapiens
tcacttgaggccaggagttcaagaacagcctggccaacatggtgaaaccttgtctctacttaaaaatatgtatgtgtatatatacatgtgagtgtgtatgkatatatatatatatatatatatatatatatatatatatatatatacacacacatacatatacatacatacaagtatatacatacatacacacacacagaa

SEQ ID NO: 23736 - DNA, 201 bp, Homo sapiens
catttttgtcatctaaataactcacatggccaaagccaagagggggaagtataaccgctttctcatgggagggcactgtcaagtggcatgggctagtcagyggatacatgaaggagtgaagaattggatcatataacactacatcccatactgagcttccaggggtccatttttaggttatctttttagaaccctcccttc

SEQ ID NO: 23737 - DNA, 201 bp, Homo sapiens
ggttgtttagttattctgggtttttgatattccatataaattttagcatgagattctctatttgcaaaatatatcattgggatttgatggggattgcattsaatctgtagatcactatgagtagtattgacatcctaacagtattaagtctcctaatccgtaaacatgagatgtcctcccatgaatttatatcttctttaa

SEQ ID NO: 23738 - DNA, 201 bp, Homo sapiens
aggggctgctaccactcctttttctgcctaaatactctctcagaaaatcctaaggcagttgggaaaatgaggactatgagaaaatatgaaagattccctgrcaaatgtgcttaggagtagtaaggttcatatttaccgactaaaatctcatcagcctcaccagggctgaccaaacaggattcatggagccagcaccttgat

SEQ ID NO: 23739 - DNA, 201 bp, Homo sapiens
ctaccacatctgcagtgacttcctcaacactgaagttttgaacccctcaaagtcatccatgagggctagaatcaacctctcccaaattcctgttcatgttrgtattttgacctcctcccatgaatcatgaatgtccttaatggcatctagaatgatgaatcctttccagaacattttctatttacttttcccagatccatt

SEQ ID NO: 23740 - DNA, 201 bp, Homo sapiens
aaggcagatggctgacaattttgttcatttactttggttataattaatttattttgatctttccctttactgttgaaagtggactttcctaaaagtgtttycaattcaagatgaacagtcatgcttattagaagcacattccctgaggtcactgtcctgatgtgaagggaaatacagtcacctctacagcagagggacatt

SEQ ID NO: 23741 - DNA, 201 bp, Homo sapiens
attgttttataagtttgggagctccagtattatgtgcatagttaggattatgatattttcctgttggactagtccttttatcattatatatgtctctctttgtcttttttaactgctgttgctttaaagtctgttttgtctggtataagaatagctactcctgcttgtttggggtgttcatttgcatggaatacctttttc

SEQ ID NO: 23742 - DNA, 201 bp, Homo sapiens
ctctgttacagttctggaggtcagaagtccaaaacagatcttactgggctaaaatcaagattgaccaagatgtttccttctggaggctctacggggaaatrtattcgtcttttccagctcctcaaagccacctgcatcccttggctgtggcccttctcccatctgcaagaatggcagcatagcatcttcacatttctctct

SEQ ID NO: 23743 - DNA, 201 bp, Homo sapiens
gattgttttataagtttgggagctccagtattatgtgcatagttaggattatgatattttcctgttggactagtccttttatcattatatatgtctctctttgtcttttttaactgctgttgctttaaagtctgttttgtctggtataagaatagctactcctgcttgtttggggtgttcatttgcatggaataccttttt

SEQ ID NO: 23744 - DNA, 201 bp, Homo sapiens
ataataccttataaaatgtaaatgctatgtaaataattgttatactataatgtttagggaataatggtgagagaaaacatctgtacatattcattacagaygcaactatccattttttttcttcaaatattttcaggctatggttgaatccgtggacgcaggacccatggatataaagggccaatagtacacagttaaaag

SEQ ID NO: 23745 - DNA, 201 bp, Homo sapiens
tttctttccttcctttcctaactagcttttaaaaacttgtttttgcttttttgttttaattttggatgtggttgcattacttgcctttgcatctgcacacygatgacataagttcactcaatgattatttactaatcacctgtgtgcagaacactgtcctaagagatgcagtaaagaaccaatatagcttctgcctcatgg

SEQ ID NO: 23746 - DNA, 201 bp, Homo sapiens
aaatcaaacaatggctaaatcactcagtacagaaagaagtaaacaaagaccaaggaaatattagtcccacttatttaaaagcagttcagaaattacattcrttaataccaagaatgtttaaccccacaaatgtagatgtgaggaagtattcaatgatttgacccaaattattaaaactcttcagtatttagtttattacag

SEQ ID NO: 23747 - DNA, 201 bp, Homo sapiens
gaagagtctttagggctttctaggtatatgattatatcattggtgaacagcaacagttttacttcctctttaccgatttggatgcgctttctttcttttcyttctcttgtctgattgctccggctagggcttccagtactatgttgaagagaagcggtaaaagtgggcattcttgtcttgttctggttctcagggagaact

SEQ ID NO: 23748 - DNA, 201 bp, Homo sapiens
agcagttctttggactgaaatgcacatccataaatataaaaagacaccagagcataagtgacacttaaaatagttggacatggaaagcaaggcagtaaatstcactgcctagccactgttctaagccatagcgagcacccaggcatgggcttatttaaagacgctagataggaaatgaggaccttgagaaaacgcactcac

SEQ ID NO: 23749 - DNA, 201 bp, Homo sapiens
gtcacacctctgataacacaatatacagatgtcactcacctctgtgttttcaaaaggcaaattccatctccaacctaggatttcccaggctgcccctaaasatatggtttatatgtgtataaacagaaattaaatgtgaggttttatgtgagtgaggaaaaagcagacagtcaggaatggttctcctgccgaacataaata

SEQ ID NO: 23750 - DNA, 201 bp, Homo sapiens
attaggatttcttattaaaaaagtgcaatattaataattgtacattgtcatccagaaacaaaactattggggggactttattaactaacttcctgcagttstgttcctgtaaactcagtagtgattattatatttttcctatttttaatagaacctggtgtttaactctggatccattcactgtacaggatgtgttgtaaa

SEQ ID NO: 23751 - DNA, 201 bp, Homo sapiens
atgaaaatcaaatgtttttggccatagagttcacgttccatctcgtaagccatttgtgtcccaggtaagttgaagctaccgctcaatgctagccaatcaayatacctagctggagactcctttctggagcttctactaacccctccttatttccagtgacataatgtatatgcttcataatcaaacaggcatgagctccct

SEQ ID NO: 23752 - DNA, 201 bp, Homo sapiens
cctcctcctttcacattctgattggccaggcatagcttttgtgggttgtccagctgagacacccccagagcagcaggcttttaattctttgtgtaattctrtgaaccaatgtgattgaatgaatgtttttaggcagtcagcaactcaaaacatcttataattggccatctatacattattacatttatgtcctccactccc

SEQ ID NO: 23753 - DNA, 201 bp, Homo sapiens
ttatttctagtctaagacaaatgtgctttaaaaaattatttatggtctctcagttatagttctcagttacaagtcaagcctggaactttatgaacagatgsaaaaaatagatacagtaatggaatatctaaataaccagatacctttttctttaagagtctaaccattctgctgaccaaccaagggtataaaatttgaagt

SEQ ID NO: 23754 - DNA, 201 bp, Homo sapiens
taaagccagattcaagaccttcctttttctagcatataagcatttgaatttgccttcctaaccccagtgccttttttttttttttttttttttttttttgkatagtatacaactcacaggagggagctgctgctgcttgaaatacctcacagagatacttgcttacagagggcaaagcggcctgtgaaaattaagatccag

SEQ ID NO: 23755 - DNA, 201 bp, Homo sapiens
tttcccttccattatagcattccaaatggtgtttgcttacttattttagagggtttatttaaaacttttttttgacatcattgagaggcattaaataactraagagtttttacacgagatcttctgatctcatgtaaaaatgggaagtagataagagtagaaatacaaagaaggtgtttccttttctctcttccaagtttc

SEQ ID NO: 23756 - DNA, 201 bp, Homo sapiens
cagctaatttttgtatttttttttagtagagacgaggtttcaccatgttggccaggatggtcttcatctcttgacctcgtgatctgcccacctcagccccsccaagtgctgggattacaggtgtgagccaccgtgcctggccaaaaattttatttaactcacaaattattgaggaagccaatgtgatgttaaaactagttc

SEQ ID NO: 23757 - DNA, 201 bp, Homo sapiens
attcatatttccacaggtggtacaggagccatggctggggaggccacaggaaatttacaatcatgatggaagagaaggggaagcaggcacatcttacatgkccagagaaggaggaagagggcaaagggagaggtgatacacacttttaagcaaccagatctcttgagagctcactatcacaagaacagcaaggggaaaatc

SEQ ID NO: 23758 - DNA, 201 bp, Homo sapiens
tctactaaatgtaaccacatgctccacactttcttgcaaggaaagttggaaaaatctctattccaagaaactatgtacctcaagttcagaggttcttttccaataagaggaggacagatatgaagggactagcagattctgccacacacagcaaccaacctaaagttgtcagaagcaaaggtattgagcacaaatgaaagt

SEQ ID NO: 23759 - DNA, 201 bp, Homo sapiens
tctcctaatgctatccctccccgctccccccaccccacaataggccccggtgtgtgatgttccccttcctgtgtccaagtgttctcattgttcaattcccrcctatgagtgaaaacatgtggtgtttggttttttgtccttgcaatagtttgctgagaatgatggtttccagcttcatccatgtccctacaaaggacatga

SEQ ID NO: 23760 - DNA, 201 bp, Homo sapiens
cccattaactcgtcatttaacattaggtatatctcctaatgctatccctccccgctccccccaccccacaataggccccggtgtgtgatgttccccttccygtgtccaagtgttctcattgttcaattcccacctatgagtgaaaacatgtggtgtttggttttttgtccttgcaatagtttgctgagaatgatggtttcc

SEQ ID NO: 23761 - DNA, 201 bp, Homo sapiens
gggtatttaacctggggtccacaagctttgggaactccataagccctctaatatatgtgcaaatatgcttttctctggtgaaagaatccagaactttattsagtttcttaatagatgcattacccagcaacattaactacttgctctacatcaaaaggttgacaacaaattcggtcttaccaataattaaagaaaagcaaa

SEQ ID NO: 23762 - DNA, 201 bp, Homo sapiens
gttttctcctaggagactgcctttccctggcactggatgcaaccaattatcattttagagagacagtttaaccactgcctgaccatcacctaatggttgcstgacattgctgaaggggtgccctcttctgccttgctcgtgtctgcctaactacctactccaacaaatccatctaaccctatgctctctactggggtcctt

SEQ ID NO: 23763 - DNA, 201 bp, Homo sapiens
tgagcactttccttttgtccttttcctgtggttctactgatactaccatttcatgttctcttgctctgagaagatatgcaggcttccaaaaatacaagcawgttttctacataagagtgtcaactccagtagcaatctagcagcttccatttgtctagttcatacatatattttaacgttgtatagctttgcactttttat

SEQ ID NO: 23764 - DNA, 201 bp, Homo sapiens
ttttacaaccacagcagaaacattaattctgaaagtagaaaggaattaagcctttgacagttcagaaatagtaaagcagcagttcagattttctctcaagwgtcaggctagtataatggcaggcggtgtacacttgttaagatggggactgttggcattaaaggtatctcagtttgaatccccaccctggcactggtgggt

SEQ ID NO: 23765 - DNA, 201 bp, Homo sapiens
tacaacaggccagagagggctcactgagaaagcagttcttgagcaaagacatgaatgtgtgctcttgagccttcacatgtctggagagagaagagaggagaagagcatcccaggcacaggaagaatgagtgcggagttccgcctgcatgaaacgtgcatgcctagtgtgttccaggaacaacaaaaaggccagtgtggcca

SEQ ID NO: 23766 - DNA, 201 bp, Homo sapiens
tttttacctcttgggtgaaaggtcaggtccatcatgtggccagaaagcctcaaagtataagcctgtggttcagcaacaactaaaaaggcatagcatgaatycagctaataaacaccttgatgtttcaaagcagctttagatgtaaaatatacaacatttagccttacatatcttaatctgtgagatggtgagacagttaag

SEQ ID NO: 23767 - DNA, 201 bp, Homo sapiens
atacaacaggccagagagggctcactgagaaagcagttcttgagcaaagacatgaatgtgtgctcttgagccttcacatgtctggagagagaagagaggagaagagcatcccaggcacaggaagaatgagtgcggagttccgcctgcatgaaacgtgcatgcctagtgtgttccaggaacaacaaaaaggccagtgtggcc

SEQ ID NO: 23768 - DNA, 201 bp, Homo sapiens
aataggggaggaaagtgcagcaaaacaaggaaatgggcatttaaaggagattgagagaaccagaatctggttgaggaagtatttacgttggggagcctaakatattaaaacgagctttggccactctattgtgccgcctagggccctctctctgggacttcatccagaggctcacttgataaccttatagtgagaacctga

SEQ ID NO: 23769 - DNA, 201 bp, Homo sapiens
gccgcattgcagtttgatctcagactgccatgctagcaatcagcaagactctgtgggcataggaccctccgagccaggtgcgggatataatctcctggtgygccgttttttaagcctgtcggaaaagcgcagtatttgggtgggagtgacccgattttccaggtgccgtctgtcacccctttctttgactaagaaagggaa

SEQ ID NO: 23770 - DNA, 201 bp, Homo sapiens
agcctgggcaatagagcaagactctgtctcaaaaaaaaaaaaaaataggggaggaaagtgcagcaaaacaaggaaatgggcatttaaaggagattgagagraccagaatctggttgaggaagtatttacgttggggagcctaagatattaaaacgagctttggccactctattgtgccgcctagggccctctctctgggac

SEQ ID NO: 23771 - DNA, 201 bp, Homo sapiens
ttggaaatcttaagggtttgaactttttagccaagacagttataacccatgcaatttgatttcattttaaaattattctacttatatatttttatgcatarctgtaataggaagaccagtgtgtgaaaggcacagttatcctaattcagacaggtcaagtcagccctagagagaccttgaaagtcttttacacatttccat

SEQ ID NO: 23772 - DNA, 201 bp, Homo sapiens
agcacttctctgtattggttattctagttatacattcgtgtaaatttttttcaaagttttcaacttctttgcctttggtttgaatttcctcctgtagctcrgagtagtttgatcgtctgaagacttcttctctcaacttgtcaaagtcattctccgtccagctttgttccattcctggtgaggagctgtgttcctttggat

SEQ ID NO: 23773 - DNA, 201 bp, Homo sapiens
attactttgatgttccatgggaatacattattttgatatttttactaatgactggcataggaaatagtttcaaggaaagaatctaaggtttgttttttttwtaaaaaaaatgaaaaccatgctttgtgagaaatagcacttcagttatatgcacacatagagctgctattagagtgtgatgtcagcaaccttgataatcgt

SEQ ID NO: 23774 - DNA, 201 bp, Homo sapiens
tctgcagaggttactgctgtctttttgtttgtctgtgccctgtccccagaggtggagcctacagaggcaggcaggcctccttgagctgtggtgggctccamccagttcgagcttcctggctgctttgtttacctaagcaagcctgggcaatggcgggcgcccctcccccagccttgctgccgcattgcagtttgatctcag

SEQ ID NO: 23775 - DNA, 201 bp, Homo sapiens
aagaatacggatgtacctgcttaaagggagaccagatattctagaaatatatgtttgatttactatccacatttcttgcctttaaaaacaagggagtgaayccaagtatgtctattttgctaaggctgaagtacattgggaagtctcatacttcaaactgatgaaacagaaaactgtcactttttatattgaaaattaaaa

SEQ ID NO: 23776 - DNA, 201 bp, Homo sapiens
ttctcatctctcttactttctccccatcattccctaccctgctccctattctctctcattctctttcttttacccttctttctatttgtatatctgaactktgaaaacatctttacccatgctacctttttttctttcttagcttgatttaaattccagttgaattcagtccccttcacggggtatgttttaggcccctca

SEQ ID NO: 23777 - DNA, 201 bp, Homo sapiens
aacttagattaaaagttttcgatgggaagtgaagaaaagtaaacaaggctttgcctacgagtctcctctctcttgcaatctctttccagtgcacagtgacrtgtggccagggcctcagataccgtgtggtcctctgcatcgaccatcgaggaatgcacacaggaggctgtagcccaaaaacaaagccccacataaaagagg

SEQ ID NO: 23778 - DNA, 201 bp, Homo sapiens
taactactttaggatttttcttgtagagagagatgtatctcaatagttatattctacaactgagcagtgtgagcccaattttggcttgtttttttttttttaacactggggactctgttctaaagtagcatcttagatcacttctgcacagactcaatgatcttgaagtaacgcatggaatttgaggtgatggcctcattt

SEQ ID NO: 23779 - DNA, 201 bp, Homo sapiens
taaaattattctacttatatatttttatgcataactgtaataggaagaccagtgtgtgaaaggcacagttatcctaattcagacaggtcaagtcagccctwgagagaccttgaaagtcttttacacatttccatgaaaatttgtacgtgtatttctaggagaaatgacaatttcacttcccacaacttcataaagcttttt

SEQ ID NO: 23780 - DNA, 201 bp, Homo sapiens
ttcagaattaaccagggaaatcgaacttcactgcatccctgtggggaaaacaaggctcagatgctgccataaccacttccttaaagaggggagattaggcmctgcctagctcttgaaatcctcccagccctgagttctttccaggagaccctgtgtcccctatacactggtttctgcagctgacgggctaagcagagaggc

SEQ ID NO: 23781 - DNA, 201 bp, Homo sapiens
gcttcagctgtttttcttttaaagtagggaatggtatcactgtttattctaattagaaaatacgtaaatgctctacaggtcaaaatcccagggtatgagayattctgtagggtttctctcttccttctttccacccctctcagactttctgagaaacatttccatattcccatctaaactccaaaaactgatgtagagttt

SEQ ID NO: 23782 - DNA, 201 bp, Homo sapiens
aaaaaggaaaagatgctttaacagtgctttctctggaaaagcctttgtgtgcttaatgatgtcttcatgtgcttatactatctccttgattccttgaattytacatggaattaaagctcaaccataaccccccatacacatttctatggccctccagctctgtcatgacagtgcagtcaattgctatggaaaatttttgtc

SEQ ID NO: 23783 - DNA, 201 bp, Homo sapiens
ctctttttttctttattagtcttcctagtggtctatcaattttgttgatcctttcaaaaaaccagctcctggattcattaattttttgaagggtttttttttcccccatttccttcagttctgctctgattttagttatttcttgccttctgctagcttttgaatgtgtttgctcttgcttttctagttcttttaattgtg

SEQ ID NO: 23784 - DNA, 201 bp, Homo sapiens
tatttgattcttctctctttttttctttattagtcttcctagtggtctatcaattttgttgatcctttcaaaaaaccagctcctggattcattaattttttgaagggtttttttttcccccatttccttcagttctgctctgattttagttatttcttgccttctgctagcttttgaatgtgtttgctcttgcttttctag

SEQ ID NO: 23785 - DNA, 201 bp, Homo sapiens
agctattgattattgccacaatttcagatcctgttattggtctactcagagattcaacttcttcctggtttagtcttggagagtgtatgtgtcgaggaatktatccatttcttctagattttctagtttatttgtgtagaggtgcttgtagtatcctctgatggtagtttgtatttctgtgggatcggtggtgatatcccc

SEQ ID NO: 23786 - DNA, 201 bp, Homo sapiens
ttccctctttttctattgattggaatagtttcagaaggaatggtaccagttcctccttgtacctctggtaaaatttggctgtgaatccatctggtcctggrctctttttggttggtaagctattgattattgccacaatttcagatcctgttattggtctactcagagattcaacttcttcctggtttagtcttggagagt

SEQ ID NO: 23787 - DNA, 201 bp, Homo sapiens
gcctcatcaaatgagttagggaggattccctctttttctattgattggaatagtttcagaaggaatggtaccagttcctccttgtacctctggtaaaattyggctgtgaatccatctggtcctggactctttttggttggtaagctattgattattgccacaatttcagatcctgttattggtctactcagagattcaact

SEQ ID NO: 23788 - DNA, 201 bp, Homo sapiens
gctgctggattcggtttgccagtattttattgaggatttttgcatcaatgttcatcaaggatattggtctaaaattctctttttttgttgtgtctctgccyggctttggtatcaggatgatgcaggcctcatcaaatgagttagggaggattccctctttttctattgattggaatagtttcagaaggaatggtaccagtt

SEQ ID NO: 23789 - DNA, 201 bp, Homo sapiens
ttgatttgcatatattgaaccagccttgcatcccaaggatgaagcccacttgatcatggtggataactttttgatgtgctgctggattcggtttgccagtwttttattgaggatttttgcatcaatgttcatcaaggatattggtctaaaattctctttttttgttgtgtctctgcccggctttggtatcaggatgatgca

SEQ ID NO: 23790 - DNA, 201 bp, Homo sapiens
tatctttgtggtgttctctgtatttcctgaatctgaatgttgccctgccttgctagattggggaagttctcctggataatatcctgcagagtgttttccarcttggttccattctccccatcactttcaggtacaccaatcagacgtagatgtggtcttttcacatagtcccatatttcttggaggctttgttcatttctt

SEQ ID NO: 23791 - DNA, 201 bp, Homo sapiens
aaaggccttttctgcatctattgagataatcatgtggtttttgtctttggttctgtttatatgctggattacatttattgatttgcatatattgaaccagmcttgcatcccaaggatgaagcccacttgatcatggtggataactttttgatgtgctgctggattcggtttgccagtattttattgaggatttttgcatca

SEQ ID NO: 23792 - DNA, 201 bp, Homo sapiens
ggtgaatctgacaattatgtgtcttggagttgctcttctcgaggagtatctttgtggtgttctctgtatttcctgaatctgaatgttgccctgccttgctrgattggggaagttctcctggataatatcctgcagagtgttttccaacttggttccattctccccatcactttcaggtacaccaatcagacgtagatgtgg

SEQ ID NO: 23793 - DNA, 201 bp, Homo sapiens
taggagtggtgagagagggcatccctgtcttgtgccagttttcaaagggaatgctcccagtttttgcccattcagtatgatattggctgtgggtttgtcayagatagctcttattattttgagatacgtcccatcaatacctaatttattgagagtttttagcatgaagggttgttgaattttgtcaaaggccttttctgc

SEQ ID NO: 23794 - DNA, 201 bp, Homo sapiens
agaatgttgaatattggtcccccctctcttctggcttgtagagtttctgcggagagatccgctgttagtctgatgggcttccctttgtgggtaacccgacstttctctctggctgcgtttaacattttttccttcatttcaactttggtgaatctgacaattatgtgtcttggagttgctcttctcgaggagtatctttgt

SEQ ID NO: 23795 - DNA, 201 bp, Homo sapiens
agcttagtttgcctggatattaaattctgggttgaaaattcttttctttaagaatgttgaatattggtcccccctctcttctggcttgtagagtttctgckgagagatccgctgttagtctgatgggcttccctttgtgggtaacccgacctttctctctggctgcgtttaacattttttccttcatttcaactttggtga

SEQ ID NO: 23796 - DNA, 201 bp, Homo sapiens
tcctgcctaattgccctggccagaacttccagcactatgttgaataggagtggtgagagagggcatccctgtcttgtgccagttttcaaagggaatgctcycagtttttgcccattcagtatgatattggctgtgggtttgtcatagatagctcttattattttgagatacgtcccatcaatacctaatttattgagagtt

SEQ ID NO: 23797 - DNA, 201 bp, Homo sapiens
agcaggttgttcagtttccatgtagttgagcagttttgagtgagtttcttaatcctgagttctagtttgattgcactgtggtctgagggacagtttgttayaatttctgttcttttacatttgctgaggagagctttacttccaagtatgtggtcaattttggaataggtgtggtgtggtgctgaaaaaaatgtatactct

SEQ ID NO: 23798 - DNA, 201 bp, Homo sapiens
cagaaatgaccatcatgaatcatgcaggtgaagagcactggaggatagtagacaaccagtggcaaacagacagtactagtgaggcttagagtcaggcactrtctattccctgaaatgctaggggatctccagagatccccctagcagttagtttactcttcctggaagagtggtcctagcacatggcagagttccagaaaa

SEQ ID NO: 23799 - DNA, 201 bp, Homo sapiens
tttctagtttatttgcgtagaggtgtttgtagtactctctgatggtactttgtatttctgtgggatcagtggtgatatcccctttatcattttttattgcstctatttgattcttctctcttttcttctttattagtcttgctagcggtctatcaattttgttgatcctttcaaaaaaccagctcctggattcattaattt

SEQ ID NO: 23800 - DNA, 201 bp, Homo sapiens
atccatctgatcctggactctttttggttggtaagctattgattattgtcacaatttcagttcctgttattggtctattcagagattcaacttcttcctgstttagtcttgggagggtgtatgtgtcgaggaatttatccatttcttctagattttctagtttatttgcgtagaggtgtttgtagtactctctgatggtac

SEQ ID NO: 23801 - DNA, 201 bp, Homo sapiens
tgccagtattttattgaggatttttgcatcaatgttcatcaaggatattggtctaaaattctctcttttggttgtgtctctgcccggctttggtatcaggrtgatgctggcctcataaaatgagttagggaggatttcctctttttctattgattggaatagtttcagaaggaatggtaccagttccttcttgtacctctg

SEQ ID NO: 23802 - DNA, 201 bp, Homo sapiens
cacttgattttttattataaaagtaataaaagggctataaaacaattcaaatatctaaatctataaaaagtacaagcctccctcttccccccaatgctccyagaggctatcattcttaataatttggtatacatccttttagaatgtttatatattttactgtattacataaaaagcatatatgcacacataggatttggg

SEQ ID NO: 23803 - DNA, 201 bp, Homo sapiens
tgttgaattttgtcaaaggccttttctgcatctattgagataatcatgtggtttttgtctttggttctgtttatatgctggattacatttattgatttgcrtatattgaaccagacttgcatcccaaggatgaagcccacttgatcatggtggataagctttttgatgtgctgctggattcggtttgccagtattttattg

SEQ ID NO: 23804 - DNA, 201 bp, Homo sapiens
tagtctcttcatttcataaatgaggagactgtaccatatcatctgtgacatccctcctacctccttccctcatttacggaaggccacggaaggttaaaacycatatgctgatgggagaaccttgaccacagtaacttcagaagttgtggcacaagttgtttctaaatgctccacaaacaggctcagtgatcacaagagttt

SEQ ID NO: 23805 - DNA, 201 bp, Homo sapiens
tgaataccctttatttccttctcctgccgaattgccctggccagaacttccaacactatgttgaataggagtggtgagagagggcatccctgtcttgtgcsagttttcaaagggaatgcttccagtttttgcccattcagtatgatattggctgtgggtttgtcatagttagttcttattattttgagatacatcccatta

SEQ ID NO: 23806 - DNA, 201 bp, Homo sapiens
ggcagaggttgcagtgagccaagatcatgccactgtactccagcctgggtgacagagcaagaccctgtctcaaaaaaagaagaaagaaagaaggaaaatcrctttgtttaaaaatgaactgtcaattactttgatgttccatgggaatacattattttgatatttttactaatgactggcataggaaatagtttcaaggaa

SEQ ID NO: 23807 - DNA, 201 bp, Homo sapiens
ctctgggttttctctctccccacctctttctctgtcccttcgggttcgctctccttccagggcccgggcggccatccacgaagcacagcccgcacatcgcrgccgccaggaaggtctacatccagactcgcaggcagaggaagctgcacttcgtggtggggggcttcgcctacctgctccccaagacggcggtggtgctgc

SEQ ID NO: 23808 - DNA, 201 bp, Homo sapiens
tgtccagtgttcattactaatcacgtgttattagtacccatactccttgctctggctgctatgcgaggccatctcggagtctacagactccccttttataragcagcaggtgacatgctcttcagagtcattttctcttctgatttcctttcattctggttccttgtttctttccttaacaaggtccaggccaatggacca

SEQ ID NO: 23809 - DNA, 201 bp, Homo sapiens
ttttaaaagggttcgtaatggcatataaaataggaatgtcacttcagtctatagcatcttaggtttgatgcaatgctgtatcagtctttccaatatctaaygaatagaagcaaagctaggcttaagattcagatgcagaaatacgattatggaaccctctcattccctatcatctgatgtggattattcccgcctttattt

SEQ ID NO: 23810 - DNA, 201 bp, Homo sapiens
gctgagacaatggggttttctagatatacaatcatgtcatcttcaaacagggataatttgacttcctcttttcctaattgaataccctttatttccttctmctgcctaattgccctggccagaacttccagcactatgttgaataggagtggtgagagagggcatccctgtcttgtgccagttttcaaagggaatgctccc

SEQ ID NO: 23811 - DNA, 201 bp, Homo sapiens
taagaatgcttgtgatttttgtacattgattttgtatcttgagactttgctgaagttgcttatcagcttaaggagattttgggctgagacaatggggtttyctagatatacaatcatgtcatcttcaaacagggataatttgacttcctcttttcctaattgaataccctttatttccttctcctgcctaattgccctggc

SEQ ID NO: 23812 - DNA, 201 bp, Homo sapiens
aatggttgcactagtttacagtcccaccaacagtgtaaaagtgtttctatttctccacatcttctccagcacctgttgtttcctgactttttaatgattgycattctaactggtgtgagatggtatctcattgtggttttgatttgcatttctctgagggccagtgatgatgagcattttttcatgtgtcttttggctgca

SEQ ID NO: 23813 - DNA, 201 bp, Homo sapiens
gttcaattcccatctatgagtgagaacatgcagtgtttggttttttgtccttgcgatagtttactgagaatgatgatttccaatttcatccatgtccctayaaaggacatgaactcatcattttttatggctgcatagtattccatggtgtatatgtgccacattttcttaatccagtctatcattgttggacatttgggt

SEQ ID NO: 23814 - DNA, 201 bp, Homo sapiens
acagaagtattattaatatcacgcagtatttgtctttctgggcctagcttatttcatttaacataatgttctccaggttcatccacattgtcacaatgacrggattttcttcttttttcaaagctgaatagtattccattgtgcatacatattacattttgtttatctgtctgttgatgaacacctaggttgatttcacat

SEQ ID NO: 23815 - DNA, 201 bp, Homo sapiens
cctgggtgacagagcgagattcctcaaaaaaaaaaaaagaatatgtaaatatatatatatatatttatatatataaatatgtatgtaaatatatatttaaatatatatattaaataaaaaagataagtatgaacaaagaatcacacagggcttctgaatatgctggtaaatattttaaaacctgcctttctcttgtcttct

SEQ ID NO: 23816 - DNA, 201 bp, Homo sapiens
gttgcagttgagccaagatcacaccactgcactccagcctgggtgacagagcgagattcctcaaaaaaaaaaaaagaatatgtaaatatatatatatatatttatatatataaatatgtatgtaaatatatatttaaatatatatattaaataaaaaagataagtatgaacaaagaatcacacagggcttctgaatatgct

SEQ ID NO: 23817 - DNA, 201 bp, Homo sapiens
cttaaggagattttgggctgagacaatggggttttctagatatacaatcatgtcatctgcaaacagggacaatttgacttcctcttttcctaattgaatamcctttatttccttctcctgccgaattgccctggccagaacttccaacactatgttgaataggagtggtgagagagggcatccctgtcttgtgccagtttt

SEQ ID NO: 23818 - DNA, 201 bp, Homo sapiens
ggttgcagttgagccaagatcacaccactgcactccagcctgggtgacagagcgagattcctcaaaaaaaaaaaaagaatatgtaaatatatatatatatatttatatatataaatatgtatgtaaatatatatttaaatatatatattaaataaaaaagataagtatgaacaaagaatcacacagggcttctgaatatgc

SEQ ID NO: 23819 - DNA, 201 bp, Homo sapiens
cccaccccacaacagtccccagagtgtaatgttccccttcctgtgtacatgtgttctcattgttcaattcccacctatgagtgagaacatgcggtgtttgkttttttgtctttacaatagtttactgagaatgatgatttccaatttcatgcatgtccctacaaaggacatgaactcatcattttttatggctgcatagta

SEQ ID NO: 23820 - DNA, 201 bp, Homo sapiens
tctttcctttgcccctctctcctggctgcatctcactctgggttttctctctccccacctctttctctgtcccttcgggttcgctctccttccagggcccrggcggccatccacgaagcacagcccgcacatcgcggccgccaggaaggtctacatccagactcgcaggcagaggaagctgcacttcgtggtggggggctt

SEQ ID NO: 23821 - DNA, 201 bp, Homo sapiens
ccaatgttttgggaggctgagatgggaggattgcttgaggtcaagcatttaagaccagcctgggcaacacagcaagaccttatcactacaaaaatttttttaaaatataactaggcatggtggtgcaggcctgtagtccaagctgcttgggaggctgaggtgtagtcctagctgcttgggaggctgaggtgggaggatcac

SEQ ID NO: 23822 - DNA, 201 bp, Homo sapiens
cctctccagggaaggaattgggagcatatgattcttttttctcattcaacagataatgtgctaggggccttggagagttgaaacactatttaaaaaaaaaatagtttttcaatccctgtcctttaagagatttggggtagagagaggaaaataatgtttacagaatacttactgtgttccaggctatacatccctatatct

SEQ ID NO: 23823 - DNA, 201 bp, Homo sapiens
tgtaatcccaatgttttgggaggctgagatgggaggattgcttgaggtcaagcatttaagaccagcctgggcaacacagcaagaccttatcactacaaaamtttttttaaaatataactaggcatggtggtgcaggcctgtagtccaagctgcttgggaggctgaggtgtagtcctagctgcttgggaggctgaggtggga

SEQ ID NO: 23824 - DNA, 201 bp, Homo sapiens
aatcatgggctggctcctgccagtcagggatggtcacaagagtggaagctaagaattgaatggcaaagcccagttgggtgaaagactaagaccaggctctyggcaggcttggtgctgatcaggctgggagccctcctcatgaagcaacggtcacactaccctccattgggtctgcaagcacgcaggagttgctacaaccac

SEQ ID NO: 23825 - DNA, 201 bp, Homo sapiens
tctagaaagtcccattgttttaactgctttgagtttcttttgcaaacttaaaaagtcatgtctttatgcaaggcgtttaaagctctgtaggcccagtctcsgccgggtgtggtggctcactccagtaatcccagcattttgggaggccgaggtgggtggatcacaaggtcaggagttcaagacctgcctggccaagatggt

SEQ ID NO: 23826 - DNA, 201 bp, Homo sapiens
ctactctccaacctgaatcatgggctggctcctgccagtcagggatggtcacaagagtggaagctaagaattgaatggcaaagcccagttgggtgaaagastaagaccaggctctcggcaggcttggtgctgatcaggctgggagccctcctcatgaagcaacggtcacactaccctccattgggtctgcaagcacgcagg

SEQ ID NO: 23827 - DNA, 201 bp, Homo sapiens
gtggttttaatttgcattcccttaattactagtagtgttgaacatgtattcatgtgtttatttgccatcctgatttcttctttggtaaaatgtctgctcarttttttggacctttatttaaacattgagttgtttacttatatcaaattttcagtgttttaatatattttgaatgtaagtcttttaatgagatatgtaatt

SEQ ID NO: 23828 - DNA, 201 bp, Homo sapiens
ataatcagtgacgttgagtttttttcatgtgattgttggacgcatgtatatcttcttttgaaaagcgtatgttcacatctttgcccactttttaatgcaaytgtgtttttttgtaaatttaagttccttatagatgctggatgttagacatttgtcagatgtatactttgcaaaaattttctcccattctgtaggttgtgt

SEQ ID NO: 23829 - DNA, 201 bp, Homo sapiens
cagaattaatagaagcttcaaattgcatattgcctttggcttacaaatagtaaactgactcccagtgaaatgtgcgttgtgaacttctttattttagaatyactatgagaaactctcataactgttcatcacagcctggtcacaagcagggtggcagcaattgtttattttcaagttcagtaactcttttgggtcactcag

SEQ ID NO: 23830 - DNA, 201 bp, Homo sapiens
gctaaccaatgtccttattctctttattctatgtgtcaacacatactttgtcatggattggcctgctgtctgccagtcactttccttgaaacacaaagatraacaagacagtcttactccccaggaagctcacaggcaccaaagtttttaaaaaataatagaccgaggcagagcagaggatatgagtttctgtagtagcac

SEQ ID NO: 23831 - DNA, 201 bp, Homo sapiens
actcatttttccttgttctttcaggagaaaaatagctaagagtgcatttcttcaatttacttctgaggctgtctcctaaatgccgtggattttttttttttaaatgggaaaaaaactaagctcagggtccaaagtccaagctggcatggacaggcatcatgatgctcttgctctccctagtggtgctgcaatgaaaaatca

SEQ ID NO: 23832 - DNA, 201 bp, Homo sapiens
catgacaattttccatcttgacaaggaaactgaggcacagagaggttatgtaacatgcctaagatcactcagtcggtaggggaagagtacagattcgaacygaggcagagttcattcatgtctcaactctccggttttcttttaccagtacaagaaattaaaggtcatttgaaaaagccaaaagtcccaggtacatgattt

SEQ ID NO: 23833 - DNA, 201 bp, Homo sapiens
catgccactgcactccagcctaggtgacagagcaagactccatctcaataagaaagaaaaggaaggaaggaaggaaagaaggaaggaaggaacgaaggaasgaaggaaggaaggaaggggaaggaaaagaggaaaagggtttgcaggaactcatttttccttgttctttcaggagaaaaatagctaagagtgcatttcttc

SEQ ID NO: 23834 - DNA, 201 bp, Homo sapiens
ccctatggatggagccatgacaattttccatcttgacaaggaaactgaggcacagagaggttatgtaacatgcctaagatcactcagtcggtaggggaagrgtacagattcgaaccgaggcagagttcattcatgtctcaactctccggttttcttttaccagtacaagaaattaaaggtcatttgaaaaagccaaaagtc

SEQ ID NO: 23835 - DNA, 201 bp, Homo sapiens
aaatacaacaggccagagagggctcactgagaaagcagttcttgagcaaagacatgaatgtgtgctcttgagccttcacatgtctggagagagaagagaggagaagagcatcccaggcacaggaagaatgagtgcggagttccgcctgcatgaaacgtgcatgcctagtgtgttccaggaacaacaaaaaggccagtgtgg

SEQ ID NO: 23836 - DNA, 201 bp, Homo sapiens
atgttgtttacaagtaagagtggttttgcctcttttcaatttgtaagccacttttttttttgtagtcttattgtactggctacgcatgcaatacaatagtraataggaatgatgacaatggaggtccttatcttattcctaatcttaagaggaaagcattcagtttctcaccattgagtatgatgttagctgtaggttttt

SEQ ID NO: 23837 - DNA, 201 bp, Homo sapiens
ttctttctgtctttcttccttccttccttccttccttcctttctttcttttctttttttctttttctttctttctttcctttctttctttcttttcttttytttttctttctttcttctttttttcttttattgaaacagggtctcactctgtcactgaggcttcagtgcagtggcactatcacagctcagctcattgcag

SEQ ID NO: 23838 - DNA, 201 bp, Homo sapiens
tttattttctttctttctttctttctttcttactttctttttctttctttctttctttctttctttctgtctttcttccttccttccttccttccttcctttctttcttttctttttttctttttctttctttctttcctttctttctttcttttcttttctttttctttctttcttctttttttcttttattgaaacagg

SEQ ID NO: 23839 - DNA, 201 bp, Homo sapiens
atttattttctttctttctttctttctttcttactttctttttctttctttctttctttctttctttctgtctttcttccttccttccttccttccttcctttctttcttttctttttttctttttctttctttctttcctttctttctttcttttcttttctttttctttctttcttctttttttcttttattgaaacag

SEQ ID NO: 23840 - DNA, 201 bp, Homo sapiens
tatttattttctttctttctttctttctttcttactttctttttctttctttctttctttctttctttctgtctttcttccttccttccttccttccttcctttctttcttttctttttttctttttctttctttctttcctttctttctttcttttcttttctttttctttctttcttctttttttcttttattgaaaca

SEQ ID NO: 23841 - DNA, 201 bp, Homo sapiens
gtatttattttctttctttctttctttctttcttactttctttttctttctttctttctttctttctttctgtctttcttccttccttccttccttccttcctttctttcttttctttttttctttttctttctttctttcctttctttctttcttttcttttctttttctttctttcttctttttttcttttattgaaac

SEQ ID NO: 23842 - DNA, 201 bp, Homo sapiens
aagtgatccaatcatagatatactgcacctgtatttattttctttctttctttctttctttcttactttctttttctttctttctttctttctttctttcygtctttcttccttccttccttccttccttcctttctttcttttctttttttctttttctttctttctttcctttctttctttcttttcttttctttttct

SEQ ID NO: 23843 - DNA, 201 bp, Homo sapiens
actgtaccagtagctgtggaaatgatgagaagtgatccaatcatagatatactgcacctgtatttattttctttctttctttctttctttcttactttctytttctttctttctttctttctttctttctgtctttcttccttccttccttccttccttcctttctttcttttctttttttctttttctttctttctttcc

SEQ ID NO: 23844 - DNA, 201 bp, Homo sapiens
ggactgtaccagtagctgtggaaatgatgagaagtgatccaatcatagatatactgcacctgtatttattttctttctttctttctttctttcttactttytttttctttctttctttctttctttctttctgtctttcttccttccttccttccttccttcctttctttcttttctttttttctttttctttctttcttt

SEQ ID NO: 23845 - DNA, 201 bp, Homo sapiens
ggcttggactgtaccagtagctgtggaaatgatgagaagtgatccaatcatagatatactgcacctgtatttattttctttctttctttctttctttcttwctttctttttctttctttctttctttctttctttctgtctttcttccttccttccttccttccttcctttctttcttttctttttttctttttctttctt

SEQ ID NO: 23846 - DNA, 201 bp, Homo sapiens
ccttcacatgtgacaaatattcacctgatcccaatatcccaaaagttttaacccatttcagagtcaactgtaactctaaaatattatcaactcagaaagtkccaaattctatcagctgaatcagctatgggtgagacttggatatagtgcatcctgggacatcatttgtctccatctgtgcacatttgaaaccaaaaataa

SEQ ID NO: 23847 - DNA, 201 bp, Homo sapiens
aaacacaatgtacacaggacttcgacttctggaaagatggcatagttacacttttccctattcttactgctaagtaccactaaaggccctgtacattatawataaaacacacataaggagaataaaaagtaaagggaagaaagccaactgaccaaagaccttggaaatcaaactgtaaatttgttgggttttctttttgcc

SEQ ID NO: 23848 - DNA, 201 bp, Homo sapiens
tgagttctttgtgtatgtaaaagatagtactgttgtttctgcctctcagggttgttatccaaaaaatccagataatgcacatagcacaccatataaacacwttttcacttaacagatacttattgagaatctactaggcgccaggcctaggtgatagaaataaagaagacaagagagatgtgatctctgatgttatcaaaa

SEQ ID NO: 23849 - DNA, 201 bp, Homo sapiens
tgaagtcttgcaagaataacaaatgaaaggaaaatgtctcagagaactggtgaagacaaagggtacagggtaaatagagctgactattggtcaaatgctgmctcaggaggctggaaatagatgtaaaggaggccttgcaagaaggtcagcagggagttaaaaactcctgcactataaaatgcaaaagacattgggaaggaa

SEQ ID NO: 23850 - DNA, 201 bp, Homo sapiens
ccatccatgttcctgcaaaagacatgatcttgttcctttttatggctgcatagtattccatgatgtatatataccatgttttctttagccagtctgtcatkgattggcatttaggttggctccatgtctttgctattgtgaagagtgctgcagtgaacatttgtgtgtgtgtgcctttatgatagaatgattttatattcc

SEQ ID NO: 23851 - DNA, 201 bp, Homo sapiens
tctccttgttccacctgttgcaagaaagactacgacccataaataattggaattctgtggtcatggcttgaagcaggagtgttccccagtacttctctctsagtctgctttatttcatcctcttgctctaatgcactgccaacattcccctttatccattgaggttagacaatacattctgcacatggtgacttaagaaca

SEQ ID NO: 23852 - DNA, 201 bp, Homo sapiens
gtgcaaatcagtagcatgttggaacatgaattgtgaattataatcattgaagactcttttggatcctgtcatctccttgttccacctgttgcaagaaagaytacgacccataaataattggaattctgtggtcatggcttgaagcaggagtgttccccagtacttctctctgagtctgctttatttcatcctcttgctcta

SEQ ID NO: 23853 - DNA, 201 bp, Homo sapiens
gcttctcaaaaagtaatctggggtccagcagcatcaacgtcagcctggttcctgtgagaaatgaatatcaagtttcatctttggcctgcagaatcaaaatcttcagtttaacaagatctccaggtgactcgtatgcacattaaaggctgagaagctctgttctatcagatggtccttcctttcccagcctgggtcactgag

SEQ ID NO: 23854 - DNA, 201 bp, Homo sapiens
caatggcttggactgtaccagtagctgtggaaatgatgagaagtgatccaatcatagatatactgcacctgtatttattttctttctttctttctttcttwcttactttctttttctttctttctttctttctttctttctgtctttcttccttccttccttccttccttcctttctttcttttctttttttctttttctt

SEQ ID NO: 23855 - DNA, 201 bp, Homo sapiens
ctgtcagctcgccacatgctctcttcaaacttctggcactcagattccccacattgaactcactttctttctgaacttatatccaagtttttttttttttycccttatgttatcaagcctcagaggaacaaagcaaaaacaggaaagtggagaaaaaccatggtagaatgtgccagaaggataaagagaagtaggagaagt

SEQ ID NO: 23856 - DNA, 201 bp, Homo sapiens
gtctgcaaataaatacctcaatgaaaagtgccctattcaagaccgacagtaggtaaattatataatacacaacctgatgattatacatactgacaaaatgsaattgattcgtttaccttagcactgatgatgtctcatgacaaaatgattgatatcaataaagcccaccatatgcatgcacctcaccacaatctatagcag

SEQ ID NO: 23857 - DNA, 201 bp, Homo sapiens
aatggacaagaagcccaatatgtgtctctgaatgggaagtgttatttaattcttcaactcgtcttttttcttaaccaaaaccagtatcttttattttctgyagtatataattttcttagaacaaattgtctatttctgaatctacattttaaaatccacataattttatctattataccaaagaggttggaaataaaggac

SEQ ID NO: 23858 - DNA, 201 bp, Homo sapiens
gtagagtcaataatgctttgaatgttgcctaaattaaaactgtcatgctttctcaaaggatttggtccctccaaggcaattaggttatcagttttctgatwtttttttttttttttttttttggccaacttggttttttgcttcctctccaattagttagtatccaggcatttctaaaggacatggtgaacctcatgtgac

SEQ ID NO: 23859 - DNA, 201 bp, Homo sapiens
agtagagtcaataatgctttgaatgttgcctaaattaaaactgtcatgctttctcaaaggatttggtccctccaaggcaattaggttatcagttttctgatttttttttttttttttttttttggccaacttggttttttgcttcctctccaattagttagtatccaggcatttctaaaggacatggtgaacctcatgtga

SEQ ID NO: 23860 - DNA, 201 bp, Homo sapiens
acctatgtaacaaagctgcacatcatgcacatgtacccctgaacttaaaagttaaaaattaaatattatgactgaggagaaatacagctttaaatagtctkatcaaagtagatcttattgagaaggtattaattttctcaaacgaagacttcaaagagtcagacaactgccgtcgaagtgcctgagaaagagtgttacagc

SEQ ID NO: 23861 - DNA, 201 bp, Homo sapiens
ttttagaattcaattaccttgtaaatttaccatcagctggaacctagctctcatattgttggagtcagaaacctgatatttttcagcaatagcaccaagawcacatccttttcttaggggtgtactcacaataactcagcccatgagatgaatatttcaaactagaatgccagttgattaatttacagcaaataacagaac

SEQ ID NO: 23862 - DNA, 201 bp, Homo sapiens
ccacttagtattgtgagtctacttttatctctctgaaccttggttttcttattagttaaactaaaatgatactagtacaattaggcactttgattctgcccttcggactagcagaagtgcaaagaacagaaataatgtctgtaacgtgcctgacacacagtggatactcatttgccagtatccaaaatcattgtcatttag

SEQ ID NO: 23863 - DNA, 201 bp, Homo sapiens
aaggggaacaacagacactggtgcctacttaagggtgaagggtgagaggagggacaggatcagaaaaaaactattgggtactaggcttagtacctgggcartgaagtaatctgtacaatatagcccacgacacgcatatacctatgtaacaaagctgcacatcatgcacatgtacccctgaacttaaaagttaaaaattaa

SEQ ID NO: 23864 - DNA, 201 bp, Homo sapiens
gggatgccttttctactgatagcacatcactccagaatgatcacttgctcatgctcaccttctcttcttaccaccacaacccctgatgatggggatattasatggagtcatgttactgcccagtgtaagagaaacaatgtaagaactgtgtgcctggtggtcagcataatgaaggcactggagaatgagttttacccccaa

SEQ ID NO: 23865 - DNA, 201 bp, Homo sapiens
cttttcttttcaaaaggaatgcaagtgaacttaaagaataatatgaaactagatgcttgaagaaaatacttatttcttcctgtgggtgggaggtcactcccaggtgatactcctactaacatggaatcctagggaaatggctaagtctaaggaatttcagccttttaatccctaagcctgttccctgttttccttctcttc

SEQ ID NO: 23866 - DNA, 201 bp, Homo sapiens
agtttcagctggatttaaactagactatagcaggaaagaaaaagaattcatttctatgcatgtgagtggggggttagtggaatcttaatctttctgaatgggaaaatgtatgcagtcctttcttttcatctcagcgcctttgagtgaatttgcttttgtctaaaatgaaaggagaaacagctcatttttccattgtcataa

SEQ ID NO: 23867 - DNA, 201 bp, Homo sapiens
gctttaaaggcattatcttgtttaattttccctcaagatcgtaggaactagtaggtactactgtagttaccacatcttagatagaaagctgagggacagakgttggacccacatagaaacactggaaatggtctgaacacaggcagcatgccccagagcttgtgcttttaacctgcccctctgtccacgccctccagcccc

SEQ ID NO: 23868 - DNA, 201 bp, Homo sapiens
tagtttcagctggatttaaactagactatagcaggaaagaaaaagaattcatttctatgcatgtgagtggggggttagtggaatcttaatctttctgaatgggaaaatgtatgcagtcctttcttttcatctcagcgcctttgagtgaatttgcttttgtctaaaatgaaaggagaaacagctcatttttccattgtcata

SEQ ID NO: 23869 - DNA, 201 bp, Homo sapiens
tgttcactgttgaacatagagaaatactgattttggtatgttgattttgtaccctacaaatttactgaatttaaatttctttaccagttctaatagttttsttgtggagtctttaggtttttccaaatataagatcatatcatctgcaaacaaggataatttgacttctttctttccaatttggatgccatttatatcctt

SEQ ID NO: 23870 - DNA, 201 bp, Homo sapiens
atattctgaaactgacacccaatttgctaacagcctaaaactttcctaaataggtaagtgcaaggaagaacaaagaatttgcttacaaaaggtttaaggargcaataacatttccaaataaggaaggggcataggctgcaagctggaacgtgcctgtgagcatgtccaacaattacatagggtagggcttaacaaagagtt

SEQ ID NO: 23871 - DNA, 201 bp, Homo sapiens
gttcatctgtacgttggcttcctattgctgctgtaaaaaattaccacaaacttggtggcttaaaacaacacaaacttactctcttatagttctggagatcrgaagtcccaactcaatctcacctagctaaattcaggggaaccgcaggcctgcgtgccctctggagatcaaggggagggtctctttgtcttttctggcttc

SEQ ID NO: 23872 - DNA, 201 bp, Homo sapiens
cagtgatgatgtttaaacgtaagacagagacgtttctatgcagcaatggaactttaaaggaagctggagccaatgacctttcactttgaagccaaagaatyacaagcataaaattttcagtcttgctaagaattggggctggagaaattagcagaaagtcctctttaagccccacaattcagtatgtggtgcccaaagcct

SEQ ID NO: 23873 - DNA, 201 bp, Homo sapiens
aagacacaactagaaaaccatggggcataactggagaataacaaacagattattacagatatggctaagcttagtgtagatgaaaggaggtagtggaaacmggttggaaagttagttacatgtcagagcagtaggaaaagattgagtgcatacacttaatattacagtctgatgaaaaacattaaggccaaaaaattttca

SEQ ID NO: 23874 - DNA, 201 bp, Homo sapiens
gcaacagtcatcaccctctctgaaagagcagaggagcaaaaccttggcaactcacataatgagcccttgtccaaaggaaggcaaaaaaaaaaaaaaaaaaattcctccttttgtatagctaatacaaacacaagctgccaagaagggtcaaccatcatgggtcgttgattacccatattaaccctgatggctgcctttaca

SEQ ID NO: 23875 - DNA, 201 bp, Homo sapiens
tcggccatcttggctcaagtgtcggcagcacactctccttagtgagcaagctcccatgcctccttcagaggaactcctcacaaatctccattggaggcacrtgtcagccccacagaaagcaaacagcaccagccttttctcatgccttgtgatttaccaagaggaggaagatgtgggcagtcattccaacctgagtgtaca

SEQ ID NO: 23876 - DNA, 201 bp, Homo sapiens
ggaattgcaggaggtataattcaaatgagatttgggtggggacacagccaaaccatattacacacacacacacacacacacacacacacacacacacacamgcaaaaacctagaggagtagaaattgtcctcaggaaggtagggaaagagagaaaagctctaaagagcctggagtttcctcagaattagatagcctcaggt

SEQ ID NO: 23877 - DNA, 201 bp, Homo sapiens
gagttaatccctttgggggtgtattgattgtagaaaatctgcatctccaaggacaatttaaagatctacagtgactaagtaaatacctttataataatacyaaataagtatgttaacccattgaatgttcctggatgctataatgctgatttttaaaatattagttggtgcaaaagtaattgcagtttttgctattacctt

SEQ ID NO: 23878 - DNA, 201 bp, Homo sapiens
caagcaacccagaaacagtggcaaaatcgcttatgaactaaactgaagcgccatcacaggacagggtggaggagccctgagtacccctgggacagctctgrgcactggaggcaggtgggatgcagcccctcacagcccccatggcttcctgcctggggcttctcatcctgtcctcttgtttgcttgccgactgcaggttca

SEQ ID NO: 23879 - DNA, 201 bp, Homo sapiens
tattccagccctttcattttgcagataatttaatttaaaataaatgtctgtaaagagattcgagttatatttatcacgagcatctagtacataggatccakatactggaatcttgtgctgtttccttgtgtctgttctccttctattgagttcattctcctgtattatactgtgtggcccctttaggacctttaaataaca

SEQ ID NO: 23880 - DNA, 201 bp, Homo sapiens
caaaagatctctcagcaaggcaatctttactttctgcagaaagggtgctcagtcgcagatggaacaatggcgagagcacacctgaacaaaggaaaagcagrcatatttatccctatgcatttgggttgtccttactgctgtgtcctgcatccattggctggagctggacctcatattctgaaactgacacccaatttgcta

SEQ ID NO: 23881 - DNA, 201 bp, Homo sapiens
ttagttgcttctgtgtctgttgcttttctgcctcctattctttttttattatagtaaaatgtaacatagattttaccatttgaacccttttaagtatatasttcagggacattaaatacattcacgttgttgtgccatctccaggactttttcatcttcccaaactgacactctatgcctattaaccaataactccctgtt

SEQ ID NO: 23882 - DNA, 201 bp, Homo sapiens
attcagatttagatccatctgtctccaaagctatatgctatgctatgctatgctatgctatgctatgctatgctatgctagctatgctatgctatgctatgctatactgtgctatactgtactatgcagtattgttgggtccatatatgtcttgctcagtagaagaacagtgagtgcaaacacatggagttttgtccacat

SEQ ID NO: 23883 - DNA, 201 bp, Homo sapiens
gattcagatttagatccatctgtctccaaagctatatgctatgctatgctatgctatgctatgctatgctatgctatgctagctatgctatgctatgctatgctatactgtgctatactgtactatgcagtattgttgggtccatatatgtcttgctcagtagaagaacagtgagtgcaaacacatggagttttgtccaca

SEQ ID NO: 23884 - DNA, 201 bp, Homo sapiens
agattcagatttagatccatctgtctccaaagctatatgctatgctatgctatgctatgctatgctatgctatgctatgctagctatgctatgctatgctatgctatactgtgctatactgtactatgcagtattgttgggtccatatatgtcttgctcagtagaagaacagtgagtgcaaacacatggagttttgtccac

SEQ ID NO: 23885 - DNA, 201 bp, Homo sapiens
tagattcagatttagatccatctgtctccaaagctatatgctatgctatgctatgctatgctatgctatgctatgctatgctagctatgctatgctatgctatgctatactgtgctatactgtactatgcagtattgttgggtccatatatgtcttgctcagtagaagaacagtgagtgcaaacacatggagttttgtcca

SEQ ID NO: 23886 - DNA, 201 bp, Homo sapiens
ttagattcagatttagatccatctgtctccaaagctatatgctatgctatgctatgctatgctatgctatgctatgctatgctagctatgctatgctatgctatgctatactgtgctatactgtactatgcagtattgttgggtccatatatgtcttgctcagtagaagaacagtgagtgcaaacacatggagttttgtcc

SEQ ID NO: 23887 - DNA, 201 bp, Homo sapiens
aaatagcagaacttagattcagatttagatccatctgtctccaaagctatatgctatgctatgctatgctatgctatgctatgctatgctatgctagctatgctatgctatgctatgctatactgtgctatactgtactatgcagtattgttgggtccatatatgtcttgctcagtagaagaacagtgagtgcaaacacat

SEQ ID NO: 23888 - DNA, 201 bp, Homo sapiens
ttggcctctcttgagcctcacagcaacctagtgaggaaaccaagtcacaaggctggtaaatgtgaaaggggccctgtgtgcttcaaactcattttcttttycactatgcagtatggctttcccaagacttctttactatctgctcttaactgttaaactgtgaagacatctggtaacagtcctaaaatcagcagtttacag

SEQ ID NO: 23889 - DNA, 201 bp, Homo sapiens
taaatagcagaacttagattcagatttagatccatctgtctccaaagctatatgctatgctatgctatgctatgctatgctatgctatgctatgctagctatgctatgctatgctatgctatactgtgctatactgtactatgcagtattgttgggtccatatatgtcttgctcagtagaagaacagtgagtgcaaacaca

SEQ ID NO: 23890 - DNA, 201 bp, Homo sapiens
aataaatagcagaacttagattcagatttagatccatctgtctccaaagctatatgctatgctatgctatgctatgctatgctatgctatgctatgctagctatgctatgctatgctatgctatactgtgctatactgtactatgcagtattgttgggtccatatatgtcttgctcagtagaagaacagtgagtgcaaaca

SEQ ID NO: 23891 - DNA, 201 bp, Homo sapiens
aagaggggagattaggcactgcctagctcttgaaatcctcccagccctgagttctttccaggagaccctgtgtcccctatacactggtttctgcagctgaygggctaagcagagaggctcaacctgaagaaagagacaggtggctccagagcaagacttgtaacgaattctccccagggagagaaataccgaaagtttagc

SEQ ID NO: 23892 - DNA, 201 bp, Homo sapiens
aaccagagtgttctgggcaggcagcttagtaaacctcatctgaaggtttgattccaaaatttgcacacactgatccaaacaaatgtgattgtagtttttcytgtcacatttataacatgccagaacttcctcagaaggtaacaaggcaggaagagaacaaggtaaaaatgtagcaaatgaataggttgcattgattccttg

SEQ ID NO: 23893 - DNA, 201 bp, Homo sapiens
taataaatagcagaacttagattcagatttagatccatctgtctccaaagctatatgctatgctatgctatgctatgctatgctatgctatgctatgctagctatgctatgctatgctatgctatactgtgctatactgtactatgcagtattgttgggtccatatatgtcttgctcagtagaagaacagtgagtgcaaac

SEQ ID NO: 23894 - DNA, 201 bp, Homo sapiens
tgagagacaaagagaatgaataaataaatgcatgtatgtatttgtgcatttgtatgttttaatacatgttgatgcccatttactattatgtatgtataaaytggaaagcagtcttctaacacaccatggagtaggctattactctaacttaggagattcacatctcctaagttgattctatcctactaacaatattacagt

SEQ ID NO: 23895 - DNA, 201 bp, Homo sapiens
gcagctaataaatagcagaacttagattcagatttagatccatctgtctccaaagctatatgctatgctatgctatgctatgctatgctatgctatgctaygctagctatgctatgctatgctatgctatactgtgctatactgtactatgcagtattgttgggtccatatatgtcttgctcagtagaagaacagtgagtg

SEQ ID NO: 23896 - DNA, 201 bp, Homo sapiens
aggctattactctaacttaggagattcacatctcctaagttgattctatcctactaacaatattacagttagggtttgcaatttttatcagttaagtgtcrttaactctatacaagttactcatgttttttaaaaacttagtttacttgggctgtattttgcttggggattatattagcatgagacatggtctggtgtttt

SEQ ID NO: 23897 - DNA, 201 bp, Homo sapiens
tggctgggtttgttgttgtaatcattaatagtaatggtaggtgttccatgattaaactctgagagctttctattcctttgttgaatccttataacaacaactcttggaggtatgattggtaccattttacaggtgaagaaaccaaggcctagaaagatgaggtgacttggaaaaagttatgcagctaataaatagcagaac

SEQ ID NO: 23898 - DNA, 201 bp, Homo sapiens
catattctactgtttctgtggtctcatgagtagagtgacccagaagtgacctcttcgtagcataaggaccggagccttttcttgagtgagagcattccttsaatcaccatgaataacctactggttaactgtattgagataatcacaggaaaatgtgtctaaatcaagttttacagtcttgtcattgttactaactttctt

SEQ ID NO: 23899 - DNA, 201 bp, Homo sapiens
tatggctgggtttgttgttgtaatcattaatagtaatggtaggtgttccatgattaaactctgagagctttctattcctttgttgaatccttataacaacaactcttggaggtatgattggtaccattttacaggtgaagaaaccaaggcctagaaagatgaggtgacttggaaaaagttatgcagctaataaatagcaga

SEQ ID NO: 23900 - DNA, 201 bp, Homo sapiens
caagtcatcaacgctaagaaacgcaaaagaggtatatattctgtattcctttctctgtcttttaaatatacgtagccacacactgaacaacaattaacccsttttgctcttgttaattagaatgaatcattttggatgtttcatatattttttatccatttagttctcaaatatttttcctttttcaaaacttgtcctcag

SEQ ID NO: 23901 - DNA, 201 bp, Homo sapiens
accaaagaggcaaggctgtggtgaaacagttgaaatctcctgggacagagtgggatcaaacagtgaggccaagaacatagaagcacacagatccaaggggraggcgaatataacagaaaaagatgctgagaagctgaaaccagggtgcaacactgaaactgctccaagggcagaatgtcagaaaatcagagtgaacaattc

SEQ ID NO: 23902 - DNA, 201 bp, Homo sapiens
caaattcccagggaagagagtctggcctagtctaagtgtctctattactgaattaattagccatggccaggggatggagtgactaacacagtcatggccastgaggatttcctagggatgctataagtgaccatgggcatagtgccaggtctgtaattatttttgtatatttatttctaaattagggatttggtctatatg

SEQ ID NO: 23903 - DNA, 201 bp, Homo sapiens
agaggcaaggctgtggtgaaacagttgaaatctcctgggacagagtgggatcaaacagtgaggccaagaacatagaagcacacagatccaaggggaaggcraatataacagaaaaagatgctgagaagctgaaaccagggtgcaacactgaaactgctccaagggcagaatgtcagaaaatcagagtgaacaattcacaga

SEQ ID NO: 23904 - DNA, 201 bp, Homo sapiens
attttcaaattcccagggaagagagtctggcctagtctaagtgtctctattactgaattaattagccatggccaggggatggagtgactaacacagtcatrgccagtgaggatttcctagggatgctataagtgaccatgggcatagtgccaggtctgtaattatttttgtatatttatttctaaattagggatttggtct

SEQ ID NO: 23905 - DNA, 201 bp, Homo sapiens
cacttgtgtttcttttctttctgatttctcaaaaccttaaactaactctctcagttttctctatctccttttgaaaactctgggaatacatttcctaataragtttccttctgtatactcagctccagaataggacaataagtgcccttcctggtgaaatacatatactctattttaggattcttttggttacaagcaata

SEQ ID NO: 23906 - DNA, 201 bp, Homo sapiens
aggcgggcagatcagaaggtcaggaaatcgagatcatcctggctaacatggtgaaacctcgtctctactaaaaatacaaaaaaaaaaaaaaaaaaaaaaaattcggatctgcagcatttggtctgtactccaatacagcaaacatctgatagagctgaaatgacactgctgccttgagatgctgcatactctttggggcct

SEQ ID NO: 23907 - DNA, 201 bp, Homo sapiens
gaatatacccagtgttttgttttcccaagtttttgactatacttcatactgtcctctctgccccacaggttctcatggtgggggaggatttctgtctcctycctactcctgagggtgactgtcaacttctgaggcagaaatctcagtattagggttgattgacagaaagatttattaatttgttgatgcacccatccatgc

SEQ ID NO: 23908 - DNA, 201 bp, Homo sapiens
gtaaaatttgaagtcagataatgtgattcctcagttttgttctttttgctcaggatagctttggctattctgggtcttttgtggttccatgtacatcttargattgttttttctatttctgtgaagaatgtctttggtattttgacagagattgcaatgaatctgtagattgttttgaatagtatagacattttaacaata

SEQ ID NO: 23909 - DNA, 201 bp, Homo sapiens
gtagtcccaatgggcattcccagaagtccagagacacaccctcctgcatgtcagggatctaccacgtttgttttctgcttcatacatttaacactatgttmtgtatgctttcccatgtgactaagacatttaggatctagtaaaatgtaaaatcctctcttgtgcctaccatggtataagcaaagcttctgtcttacgcca

SEQ ID NO: 23910 - DNA, 201 bp, Homo sapiens
agaagttgcagcgagccgagatcatgccactgcactccagcctgggtgacagagccagaaaaaagaaaaaacaaaaaggttttggcctgaagagtatagarttgacattgggttggggaatgctgcagggagaacagatttcatggggatagcaggaggatcagggattcaggtttggacatgatgagtttccagtgtctt

SEQ ID NO: 23911 - DNA, 201 bp, Homo sapiens
cagatactggaatcttgtgctgtttccttgtgtctgttctccttctattgagttcattctcctgtattatactgtgtggcccctttaggacctttaaatarcagccatcatgctggctttggtagagagggattgaaatgttgaaatgtcacatgcggaagaaaccaaggatcgaatgaagctgctgcaaaacaatcttga

SEQ ID NO: 23912 - DNA, 201 bp, Homo sapiens
gttcattctcctgtattatactgtgtggcccctttaggacctttaaataacagccatcatgctggctttggtagagagggattgaaatgttgaaatgtcasatgcggaagaaaccaaggatcgaatgaagctgctgcaaaacaatcttgagttaaaactcaaagatcggcgtggcgcgctggctcacacctgtaatcccag

SEQ ID NO: 23913 - DNA, 201 bp, Homo sapiens
tcacatgcggaagaaaccaaggatcgaatgaagctgctgcaaaacaatcttgagttaaaactcaaagatcggcgtggcgcgctggctcacacctgtaatcscagcactttgggagtccaaggcaggtggatcaggaggtcaggagatcgagaccatcctcgctaacacggtgaaaccctatctctactaaaaatacaaaaa

SEQ ID NO: 23914 - DNA, 201 bp, Homo sapiens
ccaaaataggagccattacaatcagtacattttggccaatgagaaataagtttgtttattcctgtagcataaaaattcatgcttcaggatttgactaactsttggaaagcattttctgcatcctgctggttgtggaggcattttccctgcaaaaagttatcgagatgcttgaagaagtggtaagcagttggcaagagttca

SEQ ID NO: 23915 - DNA, 201 bp, Homo sapiens
caactttctaagatttaaaggccccagaaattcctggatgctctagttaaatacctgggattaagagtggagagggtagatcttgctacaaaattcatctsaaagagaagaaacaaaatcctttgggccgattcctggtttttcttcttcttctggatttttttttcttcctttactctgccaaattaagataagaattag

SEQ ID NO: 23916 - DNA, 201 bp, Homo sapiens
tttagatcccactgtttagcatagaaccagggcttggaactgagtcagtgttcaacaaatgtttgctgaatgaaagtgtgaaagagttagtaattttattsaaggcctcccagttaaaatttttgacctacagttagggattatttttcccaaattattgaaggtattcgggaacaaccaatgtatctgtatcctaaaaag

SEQ ID NO: 23917 - DNA, 201 bp, Homo sapiens
tgatttttctctaatattaggttggtgcaaaagttattgtggttttggaccataaattttaaatcactgtaactaggctcaaacacatctttattaaccaraataggagccattacaatcagtacattttggccaatgagaaataagtttgtttattcctgtagcataaaaattcatgcttcaggatttgactaactcttg

SEQ ID NO: 23918 - DNA, 201 bp, Homo sapiens
ttttattcaaggcctcccagttaaaatttttgacctacagttagggattatttttcccaaattattgaaggtattcgggaacaaccaatgtatctgtatcstaaaaagttaagaactttctgtcattcagcaaagtgtgaattcaggcccaagttttctgaagagactgccaaactgttgtgacttaaccctttattcact

SEQ ID NO: 23919 - DNA, 201 bp, Homo sapiens
attgatttctagttttatttcattgtggtcaaaaaagatacttgatataatttgaataattttgaattttttaagatttgttgtgtgtcctaatatatggyttattctggaaaatgttccatgtgttgataggaaaagtatgtattctgtagcagttggatgaaatattctgtaaatgtctgttacaccatttggtctaga

SEQ ID NO: 23920 - DNA, 201 bp, Homo sapiens
aaccctttattcactctcagcgagcttttaaaaatagaggctatttcaaaagggcaatcctggcctagccagcatggtggcccacacctgtagtctcagcwctttgggaggccaaggcaggaggatcgcttgagcccaggagttcaagaccaacctgggcaacatggcaaaacctcatctctaagaaaaaatgcaaaaatt

SEQ ID NO: 23921 - DNA, 201 bp, Homo sapiens
ctttgggaggccaaggcaggaggatcgcttgagcccaggagttcaagaccaacctgggcaacatggcaaaacctcatctctaagaaaaaatgcaaaaattrgacaggcatggtagtgcgtgcctgtagtcctagctactcaggaggctgaggtgggaggattgcttgagctggagagatggaggctgcagtgagccgagat

SEQ ID NO: 23922 - DNA, 201 bp, Homo sapiens
acattgtacttccgttttcatgtttctcaagaatttttaaaaattccttctttatgtattgactcagtaagcattcaggagcatatttaatttccatgtayttgtatagtttccaaagttcgtctatatttgtatagttttgaaagttattgatttctagttttatttcattgtggtcaaaaaagatacttgatataattt

SEQ ID NO: 23923 - DNA, 201 bp, Homo sapiens
cctttttgttttctttgctgtgcagaagtttttagcttaatgtaatctatgtgtctgtttttgcttttgttttctgtgcttttgagatcttatccaaaaamtctttgcccagatccttgttgtggagcatttccctaatcttttcttctagtaattttacaatttcaagtcttacatttaagtctttaatcaatattgggt

SEQ ID NO: 23924 - DNA, 201 bp, Homo sapiens
gtgtcatataagcctgaccacagatcacaacccattttaccggtaagaaaactgagtaccaaaacctaaaaggtgttatgaatttcctaacttttcatgtrtgcgtattcagtgcttagagcaaacaaatcttattgaaatatgcagtacagattattttccatgttgtttgaactatgtttttggccttggttagcagga

SEQ ID NO: 23925 - DNA, 201 bp, Homo sapiens
ttttctataatgagtgtactacttcacattcccaccaacagtgtgcaagtgtttctcttactttgcatcctcaccagcatttgctatttttgtccttttartaatagccactctgaggcgaaatgatacattattgtggttttgattcgcatttccctgatgatttgtaatgttgagcatttttttacatgcctgtcagct

SEQ ID NO: 23926 - DNA, 201 bp, Homo sapiens
gctcccacatatgagtgagaacatgcaatatttgtctttctgtgcctggtttatttcacttaatgacctccagttccatccatattgctgcaaatgacagsatttcattttttatgactgaataatattccattgtgtatatataccatgtgtcataaccatttattaattgatgaacacttaggttgattatatatcttg

SEQ ID NO: 23927 - DNA, 201 bp, Homo sapiens
ccagaaatttcaatacaggcagaatttattaatgtgcttatcatgggaaaatctttaaaagtacaggacacttgggccattgtattttttgtgtagagacrtaattgttttccttattgtgtattttttacttttcttataaaacgaacccatgacctcatatcatgaaacgtgtatggcagctggtataagcaatataga

SEQ ID NO: 23928 - DNA, 201 bp, Homo sapiens
ctagaaaaaaaactattttaaaattcatatggaattttaaaaagagccccatagtcaaggcaatcctagacaaaaagaacaaaactgaatgcatcacattrcctgacttcaaactatagtacaggactacagtgaccaaaacagcatggtactggttcaagaacagacacatagaccaatggaacagaatagagagcccag

SEQ ID NO: 23929 - DNA, 201 bp, Homo sapiens
agacgcagaatggtagatccactgacagcttgcactgtgtgcctggataagctgcagtcactcaacaccagccagtaaaagcagccgggaaggaggctgtrccctgcagagccaccaggacggagctacccaagaccgtggggacccacctcttgcatcagagtgatccagatatgagacaggagtcaaaggaaatcactt

SEQ ID NO: 23930 - DNA, 201 bp, Homo sapiens
tcgcatcacctgggatcttgtttgaaatgcaaattattaagcctcaccccaggtctactgaattagaagctctggagggtggggccccaacaatcctgtaktttaaaaaggccttcaggtgattttgatgtacgtttaagtttgaaaaccactgctttaaagtttttgactaggctgggcaaggtggctcatgccgttaat

SEQ ID NO: 23931 - DNA, 201 bp, Homo sapiens
gaaaaagaacaaaagcaaggagttttaaactatacctagtatacatgaaaatatggtgccctaagccatttaatcctagttatgaaaaaaaaaaaaaaaaagcctgttggccttttcaaaaaggagggaaaattagccaagaacggcctttacctgctatggcaccatcctccaaaactgaccccactttctgttctttgc

SEQ ID NO: 23932 - DNA, 201 bp, Homo sapiens
aagttgaaaactttgaaaaaagatttagaagaatgtataactagaataaccaatacagagaagtgcttaaaggagctgatggagctgaaaaccaaggctcmagaactacgtgaagaatgcagaagcctcaggagccgatgcgatcaactggaagaaagggtatcagcgatggaagatgaaatgaatgaaatgaagcgagaa

SEQ ID NO: 23933 - DNA, 201 bp, Homo sapiens
gttattttccaaaagacttgagagtttgggggaaaagtaaaagaaatctgtaaaccttttgcaccaggaaaaagaacaaaagcaaggagttttaaactatrcctagtatacatgaaaatatggtgccctaagccatttaatcctagttatgaaaaaaaaaaaaaaaaagcctgttggccttttcaaaaaggagggaaaatt

SEQ ID NO: 23934 - DNA, 201 bp, Homo sapiens
tagagcaaggaaggtgggattgatgattcattatatcacacatttcatatcttttatgtctggacctgaatgaagacattggaacagtttaaagctttcartatacctgtaactagtgttctcttagtaaacacatagtagggcacacccaaagtttgaatatattagaaagagttccatattattttcaaggtcatagag

SEQ ID NO: 23935 - DNA, 201 bp, Homo sapiens
ggggtacctcagttggaaatgccgaaatcacctggcttctatgttgatctcgctgggagctgcagaccagagctgttcctattctgccatcttgccagccsctgcctcacttgtaaatagaaacataaggaacttgttttgcaacagacccaaggaatagtggcaaggaatttatgtgctgaaatagctctcctatactag

SEQ ID NO: 23936 - DNA, 201 bp, Homo sapiens
ctgccctttatgtttccacatctgcaaagtgaactggttgtacctgatgatctgagatcccatgacttgctcacatgtcccatgattctttattttgtagkcagaagcattaaacagctactcctgctgctgtgtgctaatcattcctgtaatttctgttctgcttatttgccattatttgaaaaacatgcaaaagggtct

SEQ ID NO: 23937 - DNA, 201 bp, Homo sapiens
attgaaaattttactggcgggattcaacagcagatttcgcaggcagcagaaagaattttcaaacttgaagatagataggccaataaaaatagaagaaaatraacaaacagagtctaaaagagttgtgagacaccctcaagtgaaccaacatatacattttgagagtctcagaagaagaaaggagttgaaagattatttgca

SEQ ID NO: 23938 - DNA, 201 bp, Homo sapiens
ttttaccggtaagaaaactgagtaccaaaacctaaaaggtgttatgaatttcctaacttttcatgtatgcgtattcagtgcttagagcaaacaaatcttaytgaaatatgcagtacagattattttccatgttgtttgaactatgtttttggccttggttagcaggagcctccccagtgtgctgagcgatttccacagctt

SEQ ID NO: 23939 - DNA, 201 bp, Homo sapiens
caaaaacttaggagccccttgtccctaaaacagggataatatactgattccaggaactcctgtagtcaatgtgaatgcactttgtaaattgttaagtctayatgtgagaggaagcattctggtgcctaatgtgaagatgatcatccgatcctgttacatagcatgcacaaagagattcagaaatcctccagttaccaggat

SEQ ID NO: 23940 - DNA, 201 bp, Homo sapiens
gaataggactatgaacctctttcccgttataaacagagggatttaaatagctgctctcttgggtctcttttagacccaagagttctatgaatctcttgcayatataataatgaatgatagcattctctaccatgactatcaactattaactccctttacctgaaattctgacgttgaaaattgactctgttgtattttggg

SEQ ID NO: 23941 - DNA, 201 bp, Homo sapiens
acctggctttgtctcctaccctttaacagaaacctcatttccccttttttcctaaaatgcccataaaccttcagtgcctcatagtagtattatgaggatcraataagtacgtgtaagtactttgaaaactgtaaaaccttagtcatctcgtgctcaaaagccttcactgtctccagctgtctggagtctactcaaggacca

SEQ ID NO: 23942 - DNA, 201 bp, Homo sapiens
gctgaaaatgcttacacgttgaaagcacaattaagctttataaactctcaaagtatttgcttctactctgcaagcattgagagccagagatggctcacaaraatcacaaaaaatcatgtcatgtttcatgtactgttaataataaacatttaataagtggttttgcagatggctccttaacatgatcatttaatttataaa

SEQ ID NO: 23943 - DNA, 201 bp, Homo sapiens
ctcaaagtatttgcttctactctgcaagcattgagagccagagatggctcacaaaaatcacaaaaaatcatgtcatgtttcatgtactgttaataataaayatttaataagtggttttgcagatggctccttaacatgatcatttaatttataaattagaagatggtagtccttcccatatatacaatatctggattatat

SEQ ID NO: 23944 - DNA, 201 bp, Homo sapiens
ggaatatcacacgctggggactgtggtggggaggggggaggggggagggatagcattgggagatatacctaatgctagatgacgagttagtgggtgcagcrcaccagcatggcacatgtatacatatgtaactaacctgcacaatgtgcacatgtaccctaaaacttaaagtataattaaaaaataaataaataaaaaaaa

SEQ ID NO: 23945 - DNA, 201 bp, Homo sapiens
ccttcagtgcgtacacacaatcttgctatgccagcatcctcatctccctggaaactgctcatgtgtcactgctgtctagagcttccctaattttcccagakagatttaattgcactctttgttgtattccctttttgtaaaactgatcacattgtatagtaagtttttctccctcactggactgcaaatatctgaggctta

SEQ ID NO: 23946 - DNA, 201 bp, Homo sapiens
tcaagagttgctttgtaacaaaacaattcttaggactgaagctgtaggactgcctctacttggatttcatttattaattgcactgcacaacgttttttcaygtattagcacttatatttaaaaaaataactctatgagttacacagagcaaatgcttatgttccattttacaaattagaaaattgatttgtaaatgtgctt

SEQ ID NO: 23947 - DNA, 201 bp, Homo sapiens
gtaggactgcctctacttggatttcatttattaattgcactgcacaacgttttttcatgtattagcacttatatttaaaaaaataactctatgagttacayagagcaaatgcttatgttccattttacaaattagaaaattgatttgtaaatgtgcttaaatgaaatagactaatttagaatcatagacatttttgtagct

SEQ ID NO: 23948 - DNA, 201 bp, Homo sapiens
ttccacatctcctgagatcccattcaatgttattgctactatattaccctgctgaatgaaccaaaataaacaagacagctcagcaaattaggtttcatttrtttcttttgcatgggagttcaacgtggcatattttttcctaaactaatcctgccagcaggcctcatggtaccttagcaactgaaagagaatcctatctca

SEQ ID NO: 23949 - DNA, 201 bp, Homo sapiens
agtgattaacttgttggttgccatctctaccttacatggtttcctagccccagagcacctcctagatagctaagagactaggttggtttgctttacattcrtaatgggaaagtatgaccagaacctcaaaatcaacctactcccaaaactgcaaaatttgccagagtgttccaaatatccaggctactgcctgtagttaca

SEQ ID NO: 23950 - DNA, 201 bp, Homo sapiens
gaatagtgtttatcaattatgtactagactttgaaattatcccctggattggctattcctgaagtgtgtgtttgtgtttgtgtgtgtgtgtgtgtgtgtgtatttagagactggattttcattgactcagtttcagaataaatcaggtaagaccaattctaaaatccccaagtaaactgtaggaaaacttgctactttact

SEQ ID NO: 23951 - DNA, 201 bp, Homo sapiens
ttgttggttgccatctctaccttacatggtttcctagccccagagcacctcctagatagctaagagactaggttggtttgctttacattcataatgggaargtatgaccagaacctcaaaatcaacctactcccaaaactgcaaaatttgccagagtgttccaaatatccaggctactgcctgtagttacagctacaggtt

SEQ ID NO: 23952 - DNA, 201 bp, Homo sapiens
tgaatagtgtttatcaattatgtactagactttgaaattatcccctggattggctattcctgaagtgtgtgtttgtgtttgtgtgtgtgtgtgtgtgtgtgtatttagagactggattttcattgactcagtttcagaataaatcaggtaagaccaattctaaaatccccaagtaaactgtaggaaaacttgctactttac

SEQ ID NO: 23953 - DNA, 201 bp, Homo sapiens
gaagaaagtccctgaaattgaaattacttggcaattttaagtgactggatatttctcatggtcttgctttctcccccactttatgcttactctatgccctmtgtacctttttgagagacaaatgacaaatatgtaaacatttaaaataaaacgtatttccaggcatttcatcattgattaaatatttgttgaaatcttaca

SEQ ID NO: 23954 - DNA, 201 bp, Homo sapiens
ctgttttataagttttcttaagtcctttttcttaaaacaggaagttgcattttgccaagtacaaataaactcaaacactaaaaaggttcaagttcagtttycaactctgaactccaggtttaaatgcattctcaatttagcaaaatatattttcccacccctacaaaaatatgggtggaaggaaagacagtagtgataaaa

SEQ ID NO: 23955 - DNA, 201 bp, Homo sapiens
ggcctggtggtgacaaaatctctcagcatttgcttgtctgtaaaggattttatttctccttcacttatgaagcttagtttggctggatatgaaattcttgsttgaaaattcttttaagaatgttgaatattggcccccactctcttctggcttgtagggtttctgcagagagatctgctgttagactgatgggcttccctt

SEQ ID NO: 23956 - DNA, 201 bp, Homo sapiens
ttgcccattagttgatgcagtttcttcatagtgtcaatggtgttcacaatttggtatgtttttgcattggctggtaccggttttttctttccatgtttagygcttccttcaggagctcttttagggcaggcctggtggtgacaaaatctctcagcatttgcttgtctgtaaaggattttatttctccttcacttatgaagc

SEQ ID NO: 23957 - DNA, 201 bp, Homo sapiens
aatatgagcaggttacctcctattctgctatcttggtgacatcatccccacagaagacagttttgaaactgaaagggaatttgaaattttgtagtttaatrtttccatttacatttaagatatctgaagcctaagtgggttcaatcaatttttaaaaaagttctgccgtgtgggtctgaattaggttcaatggggacatga

SEQ ID NO: 23958 - DNA, 201 bp, Homo sapiens
agtagtacagcttttgtgatgaagtcttgcaagaataacaaatgaaaggaaaatgtctcagagaactggtgaagacaaagggtacagggtaaatagagctsactattggtcaaatgctgactcaggaggctggaaatagatgtaaaggaggccttgcaagaaggtcagcagggagttaaaaactcctgcactataaaatgc

SEQ ID NO: 23959 - DNA, 201 bp, Homo sapiens
tgctttctgtgttttctgtattcatcagaaggtcccagcactgctcctcacagagttttgccattgtgttatagcagagatagtgctggtgatagctagcrtttattcaaacttcctgctgtgctaagccgttgttcttacagctttgcatgcatccatttacttactcctctcagccactgtagaagtagaaaactgagg

SEQ ID NO: 23960 - DNA, 201 bp, Homo sapiens
tttaaataacttgcctaagggtacttagctatactatgcagagatgagctcgggacacctaacctgtagacagccctttctcctgcccctgcccctgcccmctgcaggcatcactagctcatcgtgtgtttttgctcttcagcccttatgaatgtaactcggaatccgtatctgcacagtactccaggaaaactctgtcag

SEQ ID NO: 23961 - DNA, 201 bp, Homo sapiens
cgtgtgtttttgctcttcagcccttatgaatgtaactcggaatccgtatctgcacagtactccaggaaaactctgtcagtcattagatttggcttcaggayctcaaacctgtttgctgttcgtgggccctttctgaagctctcatgaaatctccaaacctgccaaatctgcccagcctgcggtccttgtgtctgttgttgc

SEQ ID NO: 23962 - DNA, 201 bp, Homo sapiens
ttagccaaacagagaatctaagtccttgaagtacaactcatttttgatggcaaagactaggggaaattattttgaagtatattcgtgacttacaatgttaraggaatggaaggaagacccattggatccatccattcagggtcaacaaacgttcattaagcctgggttaaatggcacttactaactgttacagaaaaacaa

SEQ ID NO: 23963 - DNA, 201 bp, Homo sapiens
aagaggaaaagggtttggctgatagcaagtcactctctgccatggcttctaaaatggaaggcggcatggcagtttaaacaaagtttctattagcagaggcmtgggattcagccctgagtaaacagtgcttacaatgctctctactcttggcttcattcaaaaaacaaactttccatctcctctggcttctctctcaatcac

SEQ ID NO: 23964 - DNA, 201 bp, Homo sapiens
atcaaaatggtgcctggttggctgaacacttctgttttaaaggcatcacaaggccatgctccttccttaatggccttcacatccttggatgctgacgtacragttttagccatatgtcaggctctcctgttgtgtaagagctgccctcgtttactgtgaggctctatttcccctgttacattacttctaacaggaactata

SEQ ID NO: 23965 - DNA, 201 bp, Homo sapiens
cttctgttttaaaggcatcacaaggccatgctccttccttaatggccttcacatccttggatgctgacgtacgagttttagccatatgtcaggctctcctkttgtgtaagagctgccctcgtttactgtgaggctctatttcccctgttacattacttctaacaggaactataatccaaaagctgtactgtgggtacaatg

SEQ ID NO: 23966 - DNA, 201 bp, Homo sapiens
aagtgactggatatttctcatggtcttgctttctcccccactttatgcttactctatgccctatgtacctttttgagagacaaatgacaaatatgtaaacrtttaaaataaaacgtatttccaggcatttcatcattgattaaatatttgttgaaatcttacattttcttcaaaatgacattcttaataattatttcaata

SEQ ID NO: 23967 - DNA, 201 bp, Homo sapiens
cttagttctacagatggtttgtaaattcatttcagctcaatttgccagtgctgcagaaagtatctatggctgattggagtcacagtttggacggacctctrgttagattagatggaagtggaaactaaaacttctaactggctcaccaggaagttgggaattcacaaaaagagcagagagagaatttcgtttgagggggtg

SEQ ID NO: 23968 - DNA, 201 bp, Homo sapiens
gagttttagccatatgtcaggctctcctgttgtgtaagagctgccctcgtttactgtgaggctctatttcccctgttacattacttctaacaggaactatratccaaaagctgtactgtgggtacaatgaggtctgaaggaaccgtgcaaaaatgattcttgtaatgcttctgtttctgtgtctgactatcttggaggggc

SEQ ID NO: 23969 - DNA, 201 bp, Homo sapiens
tctatttcgttaatctttaaaaaaaaaaacagctcctggattcattgatttttttgaagggttttttatgtctctatctccttcagctctgccctgatctyagttatttcttatcttctgctagcttttgaattcctgttcctgttttgaaatccgttcctgtttgctcttgcttccctaggtcttgtaattgtgatatta

SEQ ID NO: 23970 - DNA, 201 bp, Homo sapiens
atcccccttatcattgtttattgcgtctatttgattcttctctctttttttctttattagtctggctagtgctctatttcgttaatctttaaaaaaaaaaacagctcctggattcattgatttttttgaagggttttttatgtctctatctccttcagctctgccctgatcttagttatttcttatcttctgctagctttt

SEQ ID NO: 23971 - DNA, 201 bp, Homo sapiens
tgttcgtggtggataagctttttgatgtgctactggattcagtttgccagtattttgttgaagatgttcacatcaatgttcatcagggatattggcctgawattttcttttttgttgttgtttatctgccaggctttggtatcaggatgatgcaggcctcataaaatgagttagggaggagtccttcattttctgttgttt

SEQ ID NO: 23972 - DNA, 201 bp, Homo sapiens
atcctgagactttgctaaagttgcttatcagcttaaggagatttgggtctgagacagtggggttttctaaatatacaattatgtcatctgcaaacagagasaatttgacttccccttttcctatttgtataccctttatttctttctcttgcctgattgcccgggccagaacttccaatattatgttgaataggagtggtg

SEQ ID NO: 23973 - DNA, 201 bp, Homo sapiens
attagatcccatttgtcaattttggcttttgttgccattggttttggtgttttagtcgtgaagtctttgcccatgtttatgtcctgaatggtattgcctargttttcttctagagtttttatggttttaggtcttatgtttaagtcttattccatcttgagttaatttttgtataaggtgtaaggaagtggtccagtttca

SEQ ID NO: 23974 - DNA, 201 bp, Homo sapiens
gtgagaacattcagtgtctggttttctgttcttgtgttagtttgctgagaatgatggtttccagctttatccatgtgcctgcacaggacatgaactcatcmttttttatggctacatagtattacatgttatatatgtgtcacattttcttaatccagtctatcattgatgggcatttgggttggttccaagtctctgctc

SEQ ID NO: 23975 - DNA, 201 bp, Homo sapiens
ggttcttgatactatcagataccaatattgattctacacataaaagcattaataggatggcactcatataataggttaaatgaaacaacaaaattaatagrataggactaccactgaatatttaagggaagaggaaaaacagaggtatgtctctctaaaggaaaatgccttctttaaaaagaatgaaaataaagaaaaatt

SEQ ID NO: 23976 - DNA, 201 bp, Homo sapiens
aactaccagtctttttattgtctccttagtttggtgttttttaggagctgagtatcattttcttttcctagtttattccttctctgagggttttgccttasagtcctggcattacgagcagatattcatcttcttccacaacttgccgttcatagactttatcccctgttccctgcttataaagactgttagaatggaaag

SEQ ID NO: 23977 - DNA, 201 bp, Homo sapiens
aaggttttcttaggtcatatcttcatgttaaacctcaaatttgaaccccttgaacttaattagggattttaaagtgacttccaatgtgtttagagtacttrtaaactgttttttttgcactatccttaaagtacatatgagttggtatttaggaggcagtgaccataattagcaacataataggccacactgcttgtggta

SEQ ID NO: 23978 - DNA, 201 bp, Homo sapiens
aatgagatatttgtactgtgcctgatacaggacagggtaaggcaaatgacagggtcttagtggtattcatccctgctgcccttcatgcaaccgtcctcttmcacacacacacacacacacacacacacacacacacacacacacagtaagtttgtatctgtttgctgattctctcctcttttttaagctggagtactagct

SEQ ID NO: 23979 - DNA, 201 bp, Homo sapiens
ggagagtgagtgattaggacagtgtggaggggcagtatggggtttaagtacatttctaagagaggaaaattaagtcagaagcatggatttttttttttttyggttactacagtacatgtagtcatctgaatatgatttccaaggttcttgatactatcagataccaatattgattctacacataaaagcattaataggatg

SEQ ID NO: 23980 - DNA, 201 bp, Homo sapiens
gttagaattaatgagctacattgacacatgatcagctaaagcccatagtttacgtcaaggtttactcttgtgttgtacattctatgggttttcacaaatatgtaaggaacatatatccacctctgtagtatcatacaggatagtttcactaccttaaaaatcttctgtgctccacctgttcatcctcacctccccataacc

SEQ ID NO: 23981 - DNA, 201 bp, Homo sapiens
tagagtcaataatgctttgaatgttgcctaaattaaaactgtcatgctttctcaaaggatttggtccctccaaggcaattaggttatcagttttctgattwttttttttttttttttttttggccaacttggttttttgcttcctctccaattagttagtatccaggcatttctaaaggacatggtgaacctcatgtgaca

SEQ ID NO: 23982 - DNA, 201 bp, Homo sapiens
tggagagtgagtgattaggacagtgtggaggggcagtatggggtttaagtacatttctaagagaggaaaattaagtcagaagcatggatttttttttttttcggttactacagtacatgtagtcatctgaatatgatttccaaggttcttgatactatcagataccaatattgattctacacataaaagcattaataggat

SEQ ID NO: 23983 - DNA, 201 bp, Homo sapiens
tccatatgtctctgcctaccacatgtacagtctcccccactatcaatgtcctgtcccagagtggtacatttgttagaattaatgagctacattgacacatsatcagctaaagcccatagtttacgtcaaggtttactcttgtgttgtacattctatgggttttcacaaatatgtaaggaacatatatccacctctgtagta

SEQ ID NO: 23984 - DNA, 201 bp, Homo sapiens
aaacctcaaatttgaaccccttgaacttaattagggattttaaagtgacttccaatgtgtttagagtacttataaactgttttttttgcactatccttaargtacatatgagttggtatttaggaggcagtgaccataattagcaacataataggccacactgcttgtggtagctggtgatgctcttaatttctttattaa

SEQ ID NO: 23985 - DNA, 201 bp, Homo sapiens
aagttactcatgttttttaaaaacttagtttacttgggctgtattttgcttggggattatattagcatgagacatggtctggtgttttggttctccccttyattatggcttactcagaatataattttaaactcttccaggaaaaatactgggtcctatgaatttctgcttttcccgaagcacctagtagagtgccgtgta

SEQ ID NO: 23986 - DNA, 201 bp, Homo sapiens
tagaggatatattttccagaacatttatccatttattatagagcagccttttatggtaatcttttctggttttactgtcagtaaattgaggattcctaatattttgagggtaaaacaactggtaacattttctaacatcatccagtagctggtaaatttccacgtatgtttttatcataacgtggttatccgcagttgttg

SEQ ID NO: 23987 - DNA, 201 bp, Homo sapiens
tgaaggaaacttctacccccaacctttacccgtagccaacctgagataagcaagttttccttattatttctttatgcggatctgagtggttttttttttttattttgcttgtttgtttgtattatctcattttatttttttttttagagaaatggtaggttcacagcaaaattgagcagaaaatagagaagtttccatatg

SEQ ID NO: 23988 - DNA, 201 bp, Homo sapiens
cctcaaatttgaaccccttgaacttaattagggattttaaagtgacttccaatgtgtttagagtacttataaactgttttttttgcactatccttaaagtwcatatgagttggtatttaggaggcagtgaccataattagcaacataataggccacactgcttgtggtagctggtgatgctcttaatttctttattaaatt

SEQ ID NO: 23989 - DNA, 201 bp, Homo sapiens
acatgctgtaataaaacttaagtgaatgtgatctctctttcattctctcaaaatatcttattgtactgtgctcacctgttctcaaactgtgggtgactgtstgtaactaaaaccccagaaagcaaaaccacagacaagggggactactgtatataagtctgaatttcaagcgaggaggtctgagttgcaaatagaaattga

SEQ ID NO: 23990 - DNA, 201 bp, Homo sapiens
tttgggtatgttctagagatagaatggcttttcctaagttacggtgcctcatcctcaatttgacatgattcactcttgtgatctccagcattgttgtgtgraacaggaggcaaaggccgcggcattatagccagagagaacagaatgatcatggcaagtttataatttctttgagcctcagtttctacactcaaacagtga

SEQ ID NO: 23991 - DNA, 201 bp, Homo sapiens
ttgtctatttttctcataaggcctttgtatatcacaaagtcaggaaacacttggtgctttatgtcaaggatcaaatggaacatatggaagaaacaatgackctgctacaggtcttccttggtcagaatttgaaagaaactgttgaaacaacattcagaccagagaaatacccctgaagtctagagagatgctctagtaaat

SEQ ID NO: 23992 - DNA, 201 bp, Homo sapiens
ctgaagtctagagagatgctctagtaaataataacaactgcaagagttggtcagtgagccaactctttccagccaacgcttggctctttccagccaagagscactctaagatgggaagtaggctactaaactttcccatactctagtccttattattctagcagttgaaaataaggcatgatgctacttgccagggccatt

SEQ ID NO: 23993 - DNA, 201 bp, Homo sapiens
taaagagataggcagcctgcccttgggggaagtcagaggctaggagaaaagacaaatacacaaacacaaaactaaataaagtatgacgcacgctatcagtrtggaggtaagaacaaagtgctaagtcatggaaggaccatgtctgattctttcaccgctgcatactcagggtctggcattcagtgtctgacaccatgcctc

SEQ ID NO: 23994 - DNA, 201 bp, Homo sapiens
aaatatattaatacatgtaagcatatttaaaccataattcatttgttttattctttattttaaatatgccaatttaaagtttattattcttaccactaggrtatgatgagagcagaaatcccacattatatatatttagtacattctacattcagtattccttaaagaaaactacctatcatggttaaaactgattacttg

SEQ ID NO: 23995 - DNA, 201 bp, Homo sapiens
acttgcctggagaatgaagggcgagaccccattcgccacaaaaggaaaaaaaaaaaaagaccaaaaaaacccacaaaaggatcaggaagtataatggtttyatggaccaatttataattataaaccaaaacctttgtagatggtaaatctctatacaaattatttttattagcatacttgtggaacaagaggctacaatga

SEQ ID NO: 23996 - DNA, 201 bp, Homo sapiens
aaaaaaagaccaaaaaaacccacaaaaggatcaggaagtataatggtttcatggaccaatttataattataaaccaaaacctttgtagatggtaaatctcyatacaaattatttttattagcatacttgtggaacaagaggctacaatgactacttgagtttccactcttgcagctggatgatcccagatgcattaggggt

SEQ ID NO: 23997 - DNA, 201 bp, Homo sapiens
aagagagatgtgatctctgatgttatcaaaattacataatgaagtagcaggggctggggggagatacacaaatatagaagataaattctgttagttctagkgcttatgaaaaaagtaaagttgtccccatctaaagtatacatctcttcacctccataccacacacagggatgcatgctttatatggagtggttagaaaag

SEQ ID NO: 23998 - DNA, 201 bp, Homo sapiens
gagggaagagtgaaagtcagaagaccagttagtctgtatagtagtccagccagagattatggtagcattagatcatagcaacagagatgctggtgagatgyaggggtagatttggagtcagagctgggtagctctaactctgagtagggaggtgaggtcatgtataccagtgctaattcagtatcattccaactgcttcct

SEQ ID NO: 23999 - DNA, 201 bp, Homo sapiens
taaggagaataaaaagtaaagggaagaaagccaactgaccaaagaccttggaaatcaaactgtaaatttgttgggttttctttttgcctcataaatcacaracttggagttcaagaagctggctactggtaaacaccaatgagtaccaaaaaaaaaaaaaaaaaaaaaaacaaacaccagctagaaaccttctctctctaa

SEQ ID NO: 24000 - DNA, 201 bp, Homo sapiens
ttgcctcataaatcacaaacttggagttcaagaagctggctactggtaaacaccaatgagtaccaaaaaaaaaaaaaaaaaaaaaaacaaacaccagctaraaaccttctctctctaacaaaaggactaggaaaggggaagcatagcaagacagaaaacctttagaaaattctactctatgctagccaaatgccaccgaaa

SEQ ID NO: 24001 - DNA, 201 bp, Homo sapiens
aggactaggaaaggggaagcatagcaagacagaaaacctttagaaaattctactctatgctagccaaatgccaccgaaaacagtgtgtccaccactacctrcaccagcaaaggctgagcagggagcctagattccccaccagccagcctcaaatgaggtgccccccaaccctcatggaggggagtatcagagattttcagt

SEQ ID NO: 24002 - DNA, 201 bp, Homo sapiens
ataattggcactaatatgccagaaactatgctaggtacttcacatgtgttctctctgttaatcaccatattatgagaagtatcaatgttccccccaccccytttttttttttttttgagatgggattttactcttgttgcccaggctggagtgcattggcccgatctcagctcactgcaaccttcacctcctgggttcaag

SEQ ID NO: 24003 - DNA, 201 bp, Homo sapiens
attcctgtcataatcttactaatattttatacatgtagagaagattattctaaaatgtatatgaaaaagcaaaggaactagaatagcaaagaggcaggagwaatcagccaacctaatttcagaattagttatatagctacaataaataatattgtgtgatattggtagagggacagacacatagatcagtggaacagaata

SEQ ID NO: 24004 - DNA, 201 bp, Homo sapiens
acgatcatttgtctaaatcctggcatgcttcctggcatgcaggtacttaagaaaccccagttttccctcaccatcaactctccaggcttagtgcagttagkcgccttaacaggaatgcgcaaaagcgcactggaatgtgtgcatagatgctgagaaagcaaaagggagacaggtacccaaaagtcctccttggcctgtata

SEQ ID NO: 24005 - DNA, 201 bp, Homo sapiens
ttgctatcaaaagcataatcctgtttttgcttttgttgcctatgtttttgggatcttatctaaaaaattgctgcccagactaatgtcatgaagtgtttcckctatgttttttcctagtagttttatcattttgggtcttacatttaaatctttgatccatttttaatttttatgtagtaagaactaggggtctagcttcag

SEQ ID NO: 24006 - DNA, 201 bp, Homo sapiens
aatgtgtgcatagatgctgagaaagcaaaagggagacaggtacccaaaagtcctccttggcctgtatagcttttacaccctgttacagaattgacttttckcttcagtagcaagggacaggcttcatgcagtggcctctgaaagaccatgcactgtgtcactggcagttcatcatatctcccaacagtgcagctgtgataa

SEQ ID NO: 24007 - DNA, 201 bp, Homo sapiens
gaagccaaggattagataagatttatagagacctgatgtgggtagggcagctaaaaatggaatctgcagatttgtttccaaagcttcagacatggccaggmtgtttctgtgtatagattgctccacttcgcatgggcagaccacaggaaaaatggttctctcatcactgggggagttgcccctctttttaatatagaagtg

SEQ ID NO: 24008 - DNA, 201 bp, Homo sapiens
tgtttccaaagcttcagacatggccaggatgtttctgtgtatagattgctccacttcgcatgggcagaccacaggaaaaatggttctctcatcactggggragttgcccctctttttaatatagaagtgtgtgacatccatttgatacagccacatacacagctccagataacttaagctaaatgctgtctgtctggaagt

SEQ ID NO: 24009 - DNA, 201 bp, Homo sapiens
tcggggggcagttctctccctccctttagtaaatctgaaagaagaataaagaaaaatcatcagtgttaagtgtgcttgctcaactcaaaaataagacaagkggctgcgtatctttgtacacatatatgtatataagagagggtacaaaaagcatacatttaagatatgaaagcagaaattgataacccactagtggtatct

SEQ ID NO: 24010 - DNA, 201 bp, Homo sapiens
ttcaaagagaattatccattgacttctaactaccattgttgccattgagaagccagctgtcattctaatttgtttttcctgtatcttttctgcctgacttsttttatttattgttggtgttcagtagttagctatgatctttgtagaaatgaatcattattttattttattctcattagacttctgaatctgaggatttgt

SEQ ID NO: 24011 - DNA, 201 bp, Homo sapiens
aactttctcttcaactctggctgtatctgcatctgtctccctatttgcatctctaatggtgtttgggatttcttctttgttaagaaagaagaaattcaaamttcatcatttaatgaaatttgtcagaatttattttattaatcttttcaagtagcagcctttggctttgttgagcctatggtttttatattttccacttca

SEQ ID NO: 24012 - DNA, 201 bp, Homo sapiens
agttccttgtcattgatattaacagctaaagaccatcatctcacatgacattgctgctgaaatttccagcagtggggtcagggataatcttttgatcactrtgttcaatagcatccataaccttccttttgagacattgaattaaaatattacatttatctgacgaaaatcattgaaaaacattggctggcctgtatagaa

SEQ ID NO: 24013 - DNA, 201 bp, Homo sapiens
atttccttcacagaagaagcaggacctaagccaggtagaaaacttgatgtcaggagtttcgaggaggctctctgttgtgaagagcggctgtatatatatawaaaaaaaaaaaaaaaaaaaaagacagttgccagttgcctagaatgagagttttctctgaaattgtgtgtctaaaagaggctgtttgatagacatagatac

SEQ ID NO: 24014 - DNA, 201 bp, Homo sapiens
atccacacaccgtacttcataaacaccacaattccttcccccccagttttcttatttattgcctcttctcggcctcaagtttggtaagtgagaaccatccrctgctgcagtctataatttcctaatgtaatttcccactcttcagaataattgtggctcacagtatttattttctcccttcctgccaactgagatacaacc

SEQ ID NO: 24015 - DNA, 201 bp, Homo sapiens
aataaagacaaaaatatagataggatttgatgcagagtaagttacaaaagtacaacagaagagctcagaggacatctatgcaatctattaatatcttaatatctattcatcctctcctttccaagcaagcaacaatcacagattaaatataaaatgataaaaccagtggcatagccaggttcaaaagcaagagaaaaagtc

SEQ ID NO: 24016 - DNA, 201 bp, Homo sapiens
ttaagttttcttcttaaatatcctccttcaccatttggcttttcagacaggaaaacaaatgttttcagacaagaaaacaaattttcttggagccagctagyctctgctgaaaaccagaagccagggcctatttgcaagacttgtaatatgcaactttgcaaataagcactcaaaatttaccatctcacctatcagtgagtc

SEQ ID NO: 24017 - DNA, 201 bp, Homo sapiens
gttgcagagtttgttttacaggcttcacgaactctgtaaaacacctgacaggacttgatccacacaccgtacttcataaacaccacaattccttccccccmagttttcttatttattgcctcttctcggcctcaagtttggtaagtgagaaccatccgctgctgcagtctataatttcctaatgtaatttcccactcttca

SEQ ID NO: 24018 - DNA, 201 bp, Homo sapiens
agctatatgggtgatctggactaattctcatttagtaaacagcaaaactgagatccaaaaagtttaaggctcaagcatttttacaacatatgctttttttwttaagaaaagagatattcaaacaagtctattatagcaattataattcttcaaggctagaagtatatgaactgctgagaatttttaatgtgcaaattaaat

SEQ ID NO: 24019 - DNA, 201 bp, Homo sapiens
attaatggtgctgtaaacagaaattaagagcctctgatccaactcactgtagtcattcaacacataggatgaataaaaaaatgcatgacattctaaataargtgacagttgagctgagctttaaaagatgaaagggattttttcaggctgcaatgagaaagagaaagagagagggagagttagttttctgaaaaatggaag

SEQ ID NO: 24020 - DNA, 201 bp, Homo sapiens
gttgagaagaactgctgttgctagaacaaaaggatgttctttaggcaacacatctgcaaaaaatcctaatttctctgatttgacccacagcttttttttttaatgctaaaattagataacaaagggaaacaatgtttctgaaaagagaaatgatgagtgactttgattgtttctctgagggcagagcccctatccaccctg

SEQ ID NO: 24021 - DNA, 201 bp, Homo sapiens
tttgatggatgtgcagctgcttgcttcacaccataacaagaatgtaaaaccttgaaggtacagtgtacaccccttgtacttccagagtcaagaaagcttgmgactagatgaacaagggaattctaatccccaaaatggctgaagtaagacttctgttctcattttaataattatgtttagtaagtgagattccagttctca

SEQ ID NO: 24022 - DNA, 201 bp, Homo sapiens
gagactaaatcccaattctgtcattttctagataggtgatataggcagttgctttggttttgtcacctgttcagttgcagagtttgttttacaggcttcaygaactctgtaaaacacctgacaggacttgatccacacaccgtacttcataaacaccacaattccttcccccccagttttcttatttattgcctcttctcg

SEQ ID NO: 24023 - DNA, 201 bp, Homo sapiens
tgcttttatagtgttttaattttttataatgaacacatattcctgtatttgtagtataattttaaagaaaatacaaaacaaaagaagatgaggttgggagraaacattttatacataattgagtttttatttgtttttgaaacaaagaaaaaaaataccacctcccagagttctgctgaggattatgtgagaaaatgtcta

SEQ ID NO: 24024 - DNA, 201 bp, Homo sapiens
aaacctgtgagttcttccaaattatcttgttaaaagtttaaaaaagcaaattgtggagtaataacctatagtatgatctcagtttttaataatccccagamtgaaatgtgtctggttgtgtggcaccatcccaaggcattgaaggacacacatccaactgatcacctaatacagagcagggagggactgaataagttaggg

SEQ ID NO: 24025 - DNA, 201 bp, Homo sapiens
aaatgcctgagaattaaagttttcattttctagatttaaacatacatacataccttcaagcaaagacaaaaatacctttggtttggattagagaactgaaytctggcagagtcacatagtaatcagttttgttatattccagtgactaaaatgtaaatccacataagttagaggctatatttatttaaaattttctgtccc

SEQ ID NO: 24026 - DNA, 201 bp, Homo sapiens
tttatagtgttttaattttttataatgaacacatattcctgtatttgtagtataattttaaagaaaatacaaaacaaaagaagatgaggttgggagaaaayattttatacataattgagtttttatttgtttttgaaacaaagaaaaaaaataccacctcccagagttctgctgaggattatgtgagaaaatgtctaaaat

SEQ ID NO: 24027 - DNA, 201 bp, Homo sapiens
cagtgttatgtagcagaaagaacatgggccctcttgaatcctgagctgccacttaccagttatgtgctttcaaacgcgtttattaacctctctcagtctcrgttttcttgcatataaaaatatcgttctaatatatgtacaaacagaaaatgttaatacaatgttaatggtaattttaaaattggaaacaaatggaggatg

SEQ ID NO: 24028 - DNA, 201 bp, Homo sapiens
ttctacagctggagagtcgacgacagtcttccatggtaaattttaatctgaaggcttgtagaataagataaacctatcaaaaagcccttccaagggatagrcaatatttgcctttttaaaattaaatcttacctgcttttactgagatttattattcattagataatggccattgttagccatagttttacattttaaatt

SEQ ID NO: 24029 - DNA, 201 bp, Homo sapiens
gcaggagaatcgcgtgaaaccaggaggtggaggtcgcagtgagctgagatcgtgtcattgcactccagactgggcaacaagagcaaaactccatctcaaaraaaaaaaaaaaaaatttatgggtgggaggagtgtggagagtaatttaaaggatctatttttcactttttcaatcccatggataatgaggacttaaagcag

SEQ ID NO: 24030 - DNA, 201 bp, Homo sapiens
ggccagcatgagttcgtgaacttctcacaacaaccttgagagctgtgcagagttattgcctctgttctaacacaagactaggcttccctgtgttagaatargggcaataactctgcactgcattgcagccacccacccatctaaggaggaagtccatgctctttccattctgccatgctgccttaagccaaagcaattcat

SEQ ID NO: 24031 - DNA, 201 bp, Homo sapiens
gaagaactgctgttgctagaacaaaaggatgttctttaggcaacacatctgcaaaaaatcctaatttctctgatttgacccacagcttttttttttaatgstaaaattagataacaaagggaaacaatgtttctgaaaagagaaatgatgagtgactttgattgtttctctgagggcagagcccctatccaccctgtgata

SEQ ID NO: 24032 - DNA, 201 bp, Homo sapiens
tcctatctttcagagtctgcatgcattctgcatttggacagtctctaaaaggctattacgatgtatgagtggcaggcgcagtggctcatgcctgtaatccyggcactttgggaggccgaggcaggcagatcacctgaggtcaggagttaagaccagcctggtcaacatggtgaaacaccgtctctactaaaaatataaaaa

SEQ ID NO: 24033 - DNA, 201 bp, Homo sapiens
tgtattttgaggtgattgctttatcagatttctacattttgcaagccaaataatcatataacctctaagatgatattataagttccatctatcatgaccasgacatttgttttgctttctaagacctaagcagaccatatagctgctctggtttcatgtttgggggtatcctcctaacctttgtatgtcctttctctcttt

SEQ ID NO: 24034 - DNA, 201 bp, Homo sapiens
aattaatctctaaatgcaattgtacagcatgccatgtggacaactggaggttgactttggttcaaaacacatcatttctttttcgctagttaaacactgarcattcagagtaatggttgaaaatatttgcagcaattactctgggaaaaaaaatcctcatattttatgactaactgttttatcatttgtggcataaagaaa

SEQ ID NO: 24035 - DNA, 201 bp, Homo sapiens
gtcagtggaaagaatacaggcttgggggctctgttacttactaactttgtggtttggggcaagctcttcaacttctcgtagcctcagtttcctcaatcttraagtggaaataatagtaatgctcagttatagtattcctttatagaaatcagtgcaacaatggaaatacatgggaaataacaaattttagttctttcttcc

SEQ ID NO: 24036 - DNA, 201 bp, Homo sapiens
tttgtggtttggggcaagctcttcaacttctcgtagcctcagtttcctcaatcttgaagtggaaataatagtaatgctcagttatagtattcctttatagraatcagtgcaacaatggaaatacatgggaaataacaaattttagttctttcttccacattgccttggtaaaagctaagtgagtgacactcttacaagaaa

SEQ ID NO: 24037 - DNA, 201 bp, Homo sapiens
gtctccacatgtacccctaaacataagaacccctgattaaagactctggcatggctcctggtataaaatgggtgcttaaaaataattgctgggacaccatycaccatctgattattgcccagttctggactcagccatgttgcaagctataaccgtttttgccccctggactagggacaccctgctgttcttcccccactg

SEQ ID NO: 24038 - DNA, 201 bp, Homo sapiens
taatttccctcaatattgccatgatcagttgttatattgagacccactcagctagagctaactcctattattaatgacagagtgatgactaaatgcatgtwtgaagaaaagaaaaatcattcaacagctcaactttcaactgatgaagagaattaagaatgagaccatcatttccacagggttgaaaattattagattgag

SEQ ID NO: 24039 - DNA, 201 bp, Homo sapiens
tagatcattactgaatgtgctcaggatgctctttgagaagtcagacggcattcttttttcttttttttttttttttttttgagacaaggtcttgctctgtygtccaggctggaatgcagtggtgtaatcatggctgactacagcctcaacctcctgggctcataaagcttatgtaactgatgcacttactggggaaattct

SEQ ID NO: 24040 - DNA, 201 bp, Homo sapiens
ccaagtgtccatcaacagatgaatggataaagaaaatatggtatatatgtacagtggaatacttttccaccattaaaaaaaaaaaagaaaaagaatgaggrcaggcgtggtggctcatgcctgtaatcccagccctttgagaggctgaggtgggtggatcgcttgagcccagccaggagtttgaaactagcctgggcaaca

SEQ ID NO: 24041 - DNA, 201 bp, Homo sapiens
agtagctgggattacaggtgcatgccaccacacccggttaatttttgtatttttagtagagacgggatttcaccatgttggccaggctagtctcaaactcytggcctcaagtgatcgacccacctcagcctcccaaagtgctgggactacaggcatgagccactgcacccagcactctctattatttcttataactgcaag

SEQ ID NO: 24042 - DNA, 201 bp, Homo sapiens
tagaatgtgaacctgcaaagatgggggcaaggagttccaagtggacacaggagagtgataaattcatggaagtagaaaatcctctaggctgtagagagaaytgggtgagctttggtctgggtggagcccagagtgcagaaatgcaggtgggaagtgacattaaagagccatgcttccaaaagacaaagccaccagcattga

SEQ ID NO: 24043 - DNA, 201 bp, Homo sapiens
ccttgcaaactcagaggtcaacagggaccaggaaggcacagtgaagcaaggagtagtagacaagagggggtggtaatatgctctgtataaaaatatttacyttcaattaaaagacagaaaacacctacatatagcagaatgaggcccagctactatttttcccttcatgtagaccactcatttgtcatgtgtgccctaggg

SEQ ID NO: 24044 - DNA, 201 bp, Homo sapiens
ccttgagatgttgacacaccgccatggtgcaggcagccttccaaatgtaataagggatccagttaacaagaataccctgtctgggactttttaaaaaagartattttagcatcaccctacctggcagctccatggacatcaaaggcactggaccttgtaatcatatcaagttaccacccagtatgactaagctcttttact

SEQ ID NO: 24045 - DNA, 201 bp, Homo sapiens
atctaggtcctacttaggcataaaaatccaaaccacaaagcaaattaactcaccaacttcacaactgcatcttttgcttcatagaaaagggtccttttaartaagaaattcccgtggtgtttatctgtgtggacaataacagagtgcctcattctgaagactgttactagagctaaatgaaaaatggactgaaatgtattt

SEQ ID NO: 24046 - DNA, 201 bp, Homo sapiens
aattattcctgtggctcaaagtttaaagcttctgtattcttttacccaccaactagcaaggaacaggaggccagtgggttcccagtcgtattggtgatgayttatcaacatggccacaggggcctggtatctttaggattagagcacagaaacatgaccctcaattttcgttttcatctgaaacttgcaaagaatcttcac

SEQ ID NO: 24047 - DNA, 201 bp, Homo sapiens
ctgagtttttctatatcttgttgatcagaattaatagaagcttcaaattgcatattgcctttggcttacaaatagtaaactgactcccagtgaaatgtgcrttgtgaacttctttattttagaatcactatgagaaactctcataactgttcatcacagcctggtcacaagcagggtggcagcaattgtttattttcaagt

SEQ ID NO: 24048 - DNA, 201 bp, Homo sapiens
gacaagctcccatccctgactcctataggtggccctttcagaccacagtgtgcgctctgggtatgagaaataagccagggaggctggagaggaggttttgygtagggttgctgagaaattaacatcaaactgtggaagccatgaatataaaacaaaggaagtagatgtactacctggggaacgggaacaaatctttcgagg

SEQ ID NO: 24049 - DNA, 201 bp, Homo sapiens
gtttctcacagagttccaggaccgcacgctccgaggaggaccgggacggcctatgggatgcctggggcccatggagtgaatgctcacgcacctgcgggggwggggcctcctactctctgaggcgctgcctgagcagcaagtaagtcctgcacccgttgggggtctttgtgagaaccagaggtagccggtttgaggcatgct

SEQ ID NO: 24050 - DNA, 201 bp, Homo sapiens
agggaatacattaaaatcacaaaattctgtcattcagcaaataatcaaatattgatgccatgcgaaattcaaaaataaacaattttgccacctagtaagtkaaaggtctaggtgttagggctctattatgatactacaaaagatatcagttgtcttctacttataaagtattagaaaagtagaatgtaaatgctgaaatta

SEQ ID NO: 24051 - DNA, 201 bp, Homo sapiens
ttctgtcattcagcaaataatcaaatattgatgccatgcgaaattcaaaaataaacaattttgccacctagtaagttaaaggtctaggtgttagggctctrttatgatactacaaaagatatcagttgtcttctacttataaagtattagaaaagtagaatgtaaatgctgaaattataaacatatagaagatatgtccct

SEQ ID NO: 24052 - DNA, 201 bp, Homo sapiens
atagaagatatgtccctattttactttcaagtattaaaaatatatattcagtaatctcatacaaggctgaccaagaagcttaaaaaatggggcggaggttsactacccattctttaggaatttgaagaagaaaaaaagcctccaaatagaaggcatttccaaatccaacaagaatataaagaaatattagtttcttaaaaa

SEQ ID NO: 24053 - DNA, 201 bp, Homo sapiens
tacttttaaattctagtcattctttagcaaatcaaaaacttgtcatcatcattaaactctggaacaatctggatagaaaatgtaatatatatttttaattktgaaagaactatttatatatgccctatcatatattttgacatcattcttcaataggatttgtattattaggctaaactgtattaattctgatccttgtaa

SEQ ID NO: 24054 - DNA, 201 bp, Homo sapiens
cctggtatattaggtgacctagtgtaataggaatgacattttttaaagagactaaatcccaattctgtcattttctagataggtgatataggcagttgctytggttttgtcacctgttcagttgcagagtttgttttacaggcttcacgaactctgtaaaacacctgacaggacttgatccacacaccgtacttcataaac

SEQ ID NO: 24055 - DNA, 201 bp, Homo sapiens
tggtccagataaagaccctttcctacttagggagagaaccacatgttgtgggaaccagaatttgtagcagtgagtttcattgcctactttgtggattattmcttctattttatttttcataaaactactgattttgaatattggcaccactgttctctacttgtatgacattggactagattttagtttctctgggatttt

SEQ ID NO: 24056 - DNA, 201 bp, Homo sapiens
cgagtcaatgctgaagccaagctataggcaagcattgaaaataaattttcaagggggttgttttcatattattaggaaaagccttggaatctttttgaaartttttgtttcctgagaaactgccctttgggaatatctttgttttttgagtgcctttagcttggtgctgagaaataaacttaggaaatatgattgagatgt

SEQ ID NO: 24057 - DNA, 201 bp, Homo sapiens
tttttgttctaaaaattaaattgaaacaaggaattaaagaaaaaaggtgctgaagggttaaactgaaaagaattggtccactttgaaacacaatttatatwtctctatattgcatatgttttatgttcaagattgcgtccacccaactgtacacacatgttgcacacatctgtgcagagacagaaacaattgccacaatct

SEQ ID NO: 24058 - DNA, 201 bp, Homo sapiens
gaatttgtagcagtgagtttcattgcctactttgtggattattacttctattttatttttcataaaactactgattttgaatattggcaccactgttctckacttgtatgacattggactagattttagtttctctgggattttgtttgcttatctgtgaaatcaagtgggcagtgcctggaacagaacaagtgttccata

SEQ ID NO: 24059 - DNA, 201 bp, Homo sapiens
ctcctggctagctccacgagcttaggcagacagctttcatctctttctgccacaatccccgttattgaaaatgacagataaagactgattacatacctcaragagaacctggcaaagttatagactcatagaatgttagaattagagaagaattagtatatttgggttgtctgccctgtgccaggcatggtaccttatgac

SEQ ID NO: 24060 - DNA, 201 bp, Homo sapiens
ttaaatacactcatcatcatcctcctcctcctcctcctcctcctctttggtgttggttataagtgacttattgcacacctcataagggatcatatcccacrggtgagttacaacactgtgattgagaatcactgttacctataccacaatttagtctgaaacactttgatcatgacagtctactgctaggatttttctcag

SEQ ID NO: 24061 - DNA, 201 bp, Homo sapiens
aatgttgtgactctccagacccctgttttgcaatgaacatctgggtgacatggaaggattggagaacttttgtctctagccaaaataattcataaatttcyagctcaaggcttgtatcaggagaggttgttagagtcctagagtttcataatatacattttcctcaaggggaagatggaaaagttggacttgatgttgcta

SEQ ID NO: 24062 - DNA, 201 bp, Homo sapiens
gaatgttagaattagagaagaattagtatatttgggttgtctgccctgtgccaggcatggtaccttatgaccttttgccccaaactcattcaattctcacmactaccttgaaaattgggcattaccttaattatacagataaggaaattggaacatttaaagacatgaaatgccttatttaggctatacagctaaggagtg

SEQ ID NO: 24063 - DNA, 201 bp, Homo sapiens
gcatcttctgcaatttattaaatacactcatcatcatcctcctcctcctcctcctcctcctctttggtgttggttataagtgacttattgcacacctcatragggatcatatcccacgggtgagttacaacactgtgattgagaatcactgttacctataccacaatttagtctgaaacactttgatcatgacagtctact

SEQ ID NO: 24064 - DNA, 201 bp, Homo sapiens
tttggctcacatgtgctgggcacctgctctgtctgcctggccctgagcttctgcaggcatgtgcctggccatttccttcatctagtaagaggggatccccrttgcacagtagagtcagctgggaagtttagaaaaaaatattccaacagagaccaattaattcgagatctcaggatgggacaaggcatcagtacttttaaa

SEQ ID NO: 24065 - DNA, 201 bp, Homo sapiens
cctttgagcgtctctgcctgtcaagaggatataaatttattaagtcaatactcctcagaatttactttctcaagtcctagtttctgaatttcataaaaagratgctggcctctagtgaaccagatagaagcttgaagcagggatttgagaataatttagaaagaaattactactgcagttcatcccttggcaaggccctac

SEQ ID NO: 24066 - DNA, 201 bp, Homo sapiens
aacaggactaggtggcagggccttgacttggaaggcctcttgaattgttttcatctctcatttctattctaattgtagctttatcatccgtcccacatacytccacccttcaccccacccgcacatttcctatagcctggatttttcttgtacagcctggatcgggcacttcctggatccaattatgtgataatgcaaaca

SEQ ID NO: 24067 - DNA, 201 bp, Homo sapiens
aaccacatgctccacactttcttgcaaggaaagttggaaaaatctctattccaagaaactatgtacctcaagttcagaggttcttttccaataagaggagracagatatgaagggactagcagattctgccacacacagcaaccaacctaaagttgtcagaagcaaaggtattgagcacaaatgaaagtaatctctgaatg

SEQ ID NO: 24068 - DNA, 201 bp, Homo sapiens
aaccacatgttccatgaagcaactgcaatctccatatttgcaatctatcaatctcaccctttctcacttgtcttttttttctatttagcatgtttcattgyagattaaacagattttattccctgttgcctggtaattatatataattaaaaagcacagaggaatgggcataaaagcacaatgaagtaataatcataggaa

SEQ ID NO: 24069 - DNA, 201 bp, Homo sapiens
caagaaagctgtgatgtgccttatggagaaaatgtgtgtgttagataagcttccttcaggcctgaattacagtgctgttggatgtgagtttcatgttaatsaatcaacaatctctacaaggagtgtttaaaaagaaacatacattaaataaggttatctacagatcagttaattaaaatgttgtgaccagagacttgaagg

SEQ ID NO: 24070 - DNA, 201 bp, Homo sapiens
cagtggctcaccatgctcagagagcgccaatattcaacgcacatagttaaaacttaccaaaccaagtcagcacaatatttaagaccatctagtctgtgccracactgaactagaacgtcctggtgctgtgtttaaggcatgatgggtagaaggaagagagactggagggcacatgaaaataaagcttaacagagaaagtag

SEQ ID NO: 24071 - DNA, 201 bp, Homo sapiens
accctattttgaggataacagaattctagaccaaggtggaaatacatggcaaagatactgttaatcactcctcccacagccaagacatccctagtcagtcrtgacattctttttcactcagctcaggcactgccttggaattcattttaatgttcttaccaagcctggtggtagttgatatatacaggatgaaagccattc

SEQ ID NO: 24072 - DNA, 201 bp, Homo sapiens
ccactactgctcccaccctaggtgaacactgatctgatttatgtcggggtaaactagactgcactttatagaatggtatagaaaaggactaatgcctttgrgatattttatttctttcactcagaataattactttgacattcatccatattgtaacatggatcaacagggcatttctattgctaattagtatttcattgt

SEQ ID NO: 24073 - DNA, 201 bp, Homo sapiens
taattactagtagtgttgaacatgtattcatgtgtttatttgccatcctgatttcttctttggtaaaatgtctgctcaattttttggacctttatttaaamattgagttgtttacttatatcaaattttcagtgttttaatatattttgaatgtaagtcttttaatgagatatgtaatttcccaatactttgtcccagtca

SEQ ID NO: 24074 - DNA, 201 bp, Homo sapiens
ttcttctttggtaaaatgtctgctcaattttttggacctttatttaaacattgagttgtttacttatatcaaattttcagtgttttaatatattttgaatrtaagtcttttaatgagatatgtaatttcccaatactttgtcccagtcagcagctatattttcattctcttaacagtgtcttacaaagagtagaagatttt

SEQ ID NO: 24075 - DNA, 201 bp, Homo sapiens
taaagttactgaaatctcttaggtctttaaatgtcaacaactgaacctacttaccttcagttatgtcactgtgccaaggtaatatatttaagcctaaaaarttagagtcgaaaattccaaagtgatgaaaatatgcttgggttatatggtccatatgatgcccatatgcactaaaatttattttggtatataggacgtgta

SEQ ID NO: 24076 - DNA, 201 bp, Homo sapiens
gaggctcaacttacccttttcttaattttttaaaataatttcaacttttattttagattcaggaggtacacgtgcaggtgtgttacatgggtatatttccyaatgctgagatttgaggtatgattgatcccatcacccagatactgaatatagtacccaatagtttttcagctcttgccctgttcctttcctctctcatta

SEQ ID NO: 24077 - DNA, 201 bp, Homo sapiens
attcttgatttggccctcagcttgaaggttattgatatacagaaatgttactgattttgtacattgattctgtatcctgaaactttactgaagtcatttaycaattccaggagccttttggaagtctttagggttttctagatgtataatcatatagtcagtgaagagagatagtttgacttattttcttattgggatgcc

SEQ ID NO: 24078 - DNA, 201 bp, Homo sapiens
aatgttactgattttgtacattgattctgtatcctgaaactttactgaagtcatttatcaattccaggagccttttggaagtctttagggttttctagatrtataatcatatagtcagtgaagagagatagtttgacttattttcttattgggatgccttttatttctttctcttgcctgatggctctcactaagactttc

SEQ ID NO: 24079 - DNA, 201 bp, Homo sapiens
atgaatgtgttaagtgactgcaaattggaaaacattatacaaaaagcgtgttaaccaggaagcactgcccaggactcactttccgcattggagtgcttatygtacattgtctcattagattttttgagcagtatgttcagagcagtttctggcttcgttagaagctgggcatgacctttatggtctacagtgtcatcattc

SEQ ID NO: 24080 - DNA, 201 bp, Homo sapiens
acattgattctgtatcctgaaactttactgaagtcatttatcaattccaggagccttttggaagtctttagggttttctagatgtataatcatatagtcartgaagagagatagtttgacttattttcttattgggatgccttttatttctttctcttgcctgatggctctcactaagactttccatttattcttttaggg

SEQ ID NO: 24081 - DNA, 201 bp, Homo sapiens
cttgtttggaaaaaaaaattggcagtgatttttctagttatagtttagacataccaaacagtcataatagcaaaaagccaatttgaaacttaaaggacaarctccacaattcagcctataatattctcatgtgggtctaaattttaatttaccagctttgcagcctcctaactgttgctcaaaaatctgtaaaagtgcaga

SEQ ID NO: 24082 - DNA, 201 bp, Homo sapiens
tcttatgggagtcgtgacatattccctgtttctaaggatcacatctttcctactgtatctctgtgtccttcatcctgtcactggcttaggcctccatgagrtcaaagaccctaaaagatgcactatattagcctgttttcatgctgctgttttcttcccgagactgggaagaagaagaggtttaatggacttacagttcca

SEQ ID NO: 24083 - DNA, 201 bp, Homo sapiens
tttaagtctagttcacaagttacagcaccatttttcaatctggaccttcactctcctctgatcagtttaaaattgctttgagaatgcggctttaaggctgrcttttcttttggctccctagggccttgttagtgcctctggcacactgggatgagctaacatggcaccagggatgtgtctgttcccagccagctcacctac

SEQ ID NO: 24084 - DNA, 201 bp, Homo sapiens
gctttaaggctgacttttcttttggctccctagggccttgttagtgcctctggcacactgggatgagctaacatggcaccagggatgtgtctgttcccagscagctcacctactgatggatgatgcctggcagcatgccaccttgttgtttcttgtattattacaacagaaagcattttcaaaagccacatttatcaagtc

SEQ ID NO: 24085 - DNA, 201 bp, Homo sapiens
gggacttgctttgtctcagatgagacgatggactgtgggcttttgagttaatgctgaaatgagttaagactttgggggactgttgagaaggatgattgtawtttgcaatatgagaaggggatgaggtttgggaggggctagagtggaatgatgtgttttggctgtgtccccaccctaatcttaccttgaattgtaactccc

SEQ ID NO: 24086 - DNA, 201 bp, Homo sapiens
gagggggtggtgagctgaaaaactacctaacaggtactatgctcactacctggtgacaggatcatccctaacccatacctcagcatcatgcagtatacccrtgtaacaaacctgcacttgtacccgagtctaaaataaaagttgaaattatttaaaataataataacaatgtatctgcagaaaatgaaaagaagctgacag

SEQ ID NO: 24087 - DNA, 201 bp, Homo sapiens
ttttcaaatatttacagttctgcatgttagacatcattatccttatttcacagatgaggaaactggaggctcaggtcgattttatatcttgcccagagacwcccagctctgtctgagttcaaaactcctattctttccagcgaggccaggtatacagaggcgcagaccatttggtaatggtccccagatttggctgcctat

SEQ ID NO: 24088 - DNA, 201 bp, Homo sapiens
tttgttacatatgtatatatgtgccatgttggtgtgctgcacccattaactcgttatttacattaagtatatcccctaatgctatcccgcccccctccccmcaccccatgacaggccccagtgtgtgatgttccccttcctgtgtccaagtgttctcactgttcaattcccacctatgagtgagaacatgcgatgtttgtt

SEQ ID NO: 24089 - DNA, 201 bp, Homo sapiens
aaaatctttaggaatagtagagaattgtaaagcaaatagatttagaaaggggactgtgttgtagggaatggcaaacaaaagaataataactccctatgtaygtatactgtttgagtaaaagcaaggaagatttccattttagaagtgaaaaaactgaggaccagaaaatatgcttgatctcctgaaagctgtatgtttggt

SEQ ID NO: 24090 - DNA, 201 bp, Homo sapiens
gaaactgatgtcatataggagtttgtcactgatgaaacatatcttaaggtttccttatatacaagagatatatgaatttcaggtgtaaatttgaatgtggmattttactattttaaagctagaaagggccttagagttattcaatcaacattctaaaaagcaatatatctgaataaatcatttctgatctttgctatttac

SEQ ID NO: 24091 - DNA, 201 bp, Homo sapiens
tgtctgacaaatggcaaatagccaatatttacacattctgcaggtccggagaggacctagcatggagttcaagtattgatgttaagatcttgttttagaamttaagcagaaatgaaacagaaatctaattctagctttggttgttaggggaccatttttatttcagttcttcctcttaatactctgccctttgcttttcct

SEQ ID NO: 24092 - DNA, 201 bp, Homo sapiens
ctgcatagtattccatggtgtatatggaccacattttctttttccagtcaataattagtggccatttgggttgattacatgtctttgctattgtgaatagkgctagaagaaacatacctgtgcatattacatttttatattaaaatatattctaatacttatattttgttctttcatacttgacccagtttctgagttcat

SEQ ID NO: 24093 - DNA, 201 bp, Homo sapiens
ctgaatcactcatctttacactttttagagtttgtaaatggtgaaagatttgaaaattaagctatgatttcagtgaaaagtaccaagtgttgtattgtgcraaggaaaagtagactagagttatttttctttccttgagtgtcacttgaatataaaagaataaaaatttttgaatagtgtttatcaattatgtactagact

SEQ ID NO: 24094 - DNA, 201 bp, Homo sapiens
atgcctgtaaaatttgtgtaggtatttgcaggttaaaatatcggggaaaaggctcatttaaactattgaaacaagtatttttctgctttgttttgtttagsaagcagtatctctgtaataatcccttggcatttgaacagagcttttgtacattatttcagttggtgatcctaactttgtgcataggcattcctaaattca

SEQ ID NO: 24095 - DNA, 201 bp, Homo sapiens
tcaatgtctttgtgtaaatggtttacatagtctcactctctgaatcactcatctttacactttttagagtttgtaaatggtgaaagatttgaaaattaagstatgatttcagtgaaaagtaccaagtgttgtattgtgcaaaggaaaagtagactagagttatttttctttccttgagtgtcacttgaatataaaagaata

SEQ ID NO: 24096 - DNA, 201 bp, Homo sapiens
gaaaggaaaattgactttggagcctaatactattcaggatgaggctggtgctaagaagctatgctataagcctcaaaggacaatctaaaagcactgggttktagaggtcagaaaacacatttctctattttttaagtttcttaaaatatgtccatgctccaagatcaacaaactaagaagtatgagcacatttgaacaaag

SEQ ID NO: 24097 - DNA, 201 bp, Homo sapiens
tggaggctgccaacaagttcaaagccagggaagagagacagagcagccaaagaggcaccagggaaggggaggagaggggctgcctggtgaagtatgactayagacaccacacccagggcatagggagctgcatccttgcaccttagctgctagggtttgtataggtctgctggaaagtctatcaagcagtccctctaaaaa

SEQ ID NO: 24098 - DNA, 201 bp, Homo sapiens
actaccacagtcacattaatcaaagaggcaagagagcacaggttcttgattgtccttgtagctggtttgtctctgttgttaaaacagggttctgcatacaycctgaggttccttcctgccttaccaatattgaatgccaaaaaggagtcaactgacttgaccaggtctatatttcttttctgtcgctccaggattcttcta

SEQ ID NO: 24099 - DNA, 201 bp, Homo sapiens
ccatcatccaccgatggagggagacggatttctttccttgctcagcaacctgtggaggaggtaatggtgttcacttagtctaaaaactgttggcttctgtraggaaatacttgggtattataagagtagagttacttcagcatggaagaaattttgtgctgtcttggaccagatcctttcttctgaacagagtggaatctc

SEQ ID NO: 24100 - DNA, 201 bp, Homo sapiens
gacatcattccaggccaaggcattattatgttactactctgtaagatgaaccatggaaaagctttgacactggaacactgactccgtgtgtgtggtccccmagggctgggcagagaatgcagccagcacctgctgtttcccatgggtgagcccatcgtgtatctgtgctggacaaggctgtttgttccagaaagcttttat

SEQ ID NO: 24101 - DNA, 201 bp, Homo sapiens
atggacttacagttccacatggctggggaggcctcacaatcatggcagaaggcaaggagaagcaagtcacgtcttacatggatggtggcaggcaaagagaragcttatgcagggaaaactctcatttttaaaaccatcagatctcatgagactcattcattatcacaagaacagcatgggaaagacctgcccccatgattc

SEQ ID NO: 24102 - DNA, 201 bp, Homo sapiens
agacaggcagcttatgcatttttttctctgcttattcctctgctgagaattgcagaacccagctggcatgagatgcagttcagacatccctgctaagagcrgcaaggctcttgttgaccctaaatctcatgcaaaaaggtgaaggaattacttctttctccaacactgaggttaagactgggacactataatataatatca

SEQ ID NO: 24103 - DNA, 201 bp, Homo sapiens
agaggttacccaggtgaggagaggggacgagcgcttcaggtagaggagccggcagaggttataaagaatgaaaatagaaaacctttcaagaacctttttgstcagaggtaagggggagtggccttagacaaggttaaagagggaggtggagcaaattgctggtgctctgtaagatatttacactttgccctaagtgcaatg

SEQ ID NO: 24104 - DNA, 201 bp, Homo sapiens
tgcacaggaaatcaaaaggaacaggagtggggactgctttctttgatgaaagggtaattggggtgggggtagggggcatttaacagaggaactgctcaagytcagcctcaaaggatgaggcaaagtattccatgcactgatacaacagacacacttactgagttccttccatgttttcagcaccattgaaggcagcagaga

SEQ ID NO: 24105 - DNA, 201 bp, Homo sapiens
tttctttgatgaaagggtaattggggtgggggtagggggcatttaacagaggaactgctcaagctcagcctcaaaggatgaggcaaagtattccatgcacygatacaacagacacacttactgagttccttccatgttttcagcaccattgaaggcagcagagacaaaacagacaaaagtccctcctctcatagaactgat

SEQ ID NO: 24106 - DNA, 201 bp, Homo sapiens
tcaatgggacatgcaggacttgaaattcattcgccttttgtctaggacattgctggactggacactgacacacatgtgtctttgtcatgctccttatttcyatggtttcaatgtgtggccagccattccttttctatttttaatgcatagtaatagtcagtctgattacagtcaagtctttaggaatgggaccctttctat

SEQ ID NO: 24107 - DNA, 201 bp, Homo sapiens
tatattggccacaggtaattgaaaccatggataaagggggggactactgtacttagggaggtcaggaagacagtgagcaaatctgactgcaaaaacaagtsccgtccctggtccttaaggtctgatttggaagtccaggcaggcaggtgtacggtgtggagctgcctcagcagcgttgacaccctagctccgtcactgctg

SEQ ID NO: 24108 - DNA, 201 bp, Homo sapiens
acttttcttgaagacttggggtcattcttgactgtcccagccctcatgggggctacagacttgggatagagacagactaacagagaaacctgtacaggatygtgattgtgagttctatgaagaaacagaacaggatccagtggtcttcaaaacagaaaggaatgaggctctgtacagcagttcccccttaggcatggggaa

SEQ ID NO: 24109 - DNA, 201 bp, Homo sapiens
caacctgtgtaacctcatcttaatttaactacttctgcaaagaccctattcccaaataaggtcatattctgaagttccatgtggacatgagttggggtggrgggatactcttcaactcatcacaacatctttatctcactgaatcttcacaatacttggatcttcatttaatagatgagaaaagagacactcagagaaatt

SEQ ID NO: 24110 - DNA, 201 bp, Homo sapiens
caatctcaagtgttggacccttgacctccttgaagcttccgtgatgggaggattcacattccttccttatcaaccggggccctcccaagggagttggtcamctttgagcctctcaaagccgtgtggtgggtgagttaatttattaaaagagaaaaatgatatcattccagacctggagattccagtctggcttggagacca

SEQ ID NO: 24111 - DNA, 201 bp, Homo sapiens
atctctaaccctaaaaagacctgagaaaaacatccagtgtgccctctcattgttgagagaaggggcctgcaggtaccttaatgggcaactggatggtgagyatgtgctcaaaaagactaaaatacctgtatccatttgctcagggctccatacaaagtatcaaaacctaagtggcctaaacaatgaacatttgtcctctca

SEQ ID NO: 24112 - DNA, 201 bp, Homo sapiens
catactagctgaccatccttaatccagaaatccaaaatctaaaatgttccaataacatgtcctttgagcatcatgtcagtgctcaaaaagttgtggatttrggggcatttgtgattccagatttttggattaggaatgctcaacctgtgtaacctcatcttaatttaactacttctgcaaagaccctattcccaaataagg

SEQ ID NO: 24113 - DNA, 201 bp, Homo sapiens
cgagaaaactaaggccaaaggtggtgggagggaagatgagtaaagtggcttgctgagatcacacaagtggcatggtagggaacccatggactggtccccaraattctcccccaacaattaaacattctagctcagtgttaggaggtaaaaggagctagacacaaaaggcatgtgttataggctctacagagacagcatcct

SEQ ID NO: 24114 - DNA, 201 bp, Homo sapiens
agtacaggttggggatcccttatccagaaatgcttgggaccagaagtttttgtgttttgcattttgaatgtttttggattttggagtatttgcagaatacrtactagctgaccatccttaatccagaaatccaaaatctaaaatgttccaataacatgtcctttgagcatcatgtcagtgctcaaaaagttgtggatttgg

SEQ ID NO: 24115 - DNA, 201 bp, Homo sapiens
cccaagacttctttcggaagcgcttgcccacgatcacgtacaccagtgggttgaggcagctgttgctgtaggccatgaaggaggcgatctgtgtgattacrtcgatgatgcgctcgtcctggcagctggagaggatgccgaggcgatgcagcgtatccaggaaggtgctgatctggaagggcagccagcagatgatgaata

SEQ ID NO: 24116 - DNA, 201 bp, Homo sapiens
aacactatgctttttgctatacagtaatggtgggtagcttatatagcatgggtacattggacaaagggacaactcatgtcccaggtgggacaaagcaggayggggcgaggtttcatcacactgctcagactggtgcataatttaaaacgtattaattgcttttttctggaattttccatttaatattttcagacctatatt

SEQ ID NO: 24117 - DNA, 201 bp, Homo sapiens
ggcgatgcagcgtatccaggaaggtgctgatctggaagggcagccagcagatgatgaatagcagcagcacaaccaggactagcaccgtggccctcctctcygtctggatctccttgaacttctgcatctcgttgttccgcagcacctgcatgatctgcatcgtgcagaaggtgatgacactcaggggcagcaggaagccca

SEQ ID NO: 24118 - DNA, 201 bp, Homo sapiens
acgtagcaccctttgcttttctaagtactttatacctgttactgcctttaaccctcacaacgacttcatgttacagaagagggaactgaggcagggacagrtggttgtgcaatagttattggttgagctggaaccttggtctcccccttctgctgtccatatcacccacagcaccctgctcgaccgtctcgtcgaacagct

SEQ ID NO: 24119 - DNA, 201 bp, Homo sapiens
acagcatcctacaacatgtgcctggcttctttcacaacaggtaaatctagagacagaaagattagtggttgcccaaagccatgaggaagggagaatgggaygtgactgttaatgaatatgcgatttcttgggggatgatgaaagtgttctggaattagacagtagtgatggttgcatgaattggttattaagtaaaagctg

SEQ ID NO: 24120 - DNA, 201 bp, Homo sapiens
agccatgtgtacagcaaagaatgggggtatggaataagatgttttccttagaaaccagtagttcctttatgatgttttaaagagatggaattggattaccrtattataaagttgatgctgtgagcatttatctttcatataaatcatattggtccccatgatggggatgcaaaactccggatccagggaaactgaaattgc

SEQ ID NO: 24121 - DNA, 201 bp, Homo sapiens
ggaaagttacttccctctctgggccccagtttccataccatgaaccagtgatcatgcaaactcccagagtggttgtgagcgtgaagtattttgatggggtycctttgacctgggactattttgcctcagccagcaaaacaaaataaaaaactaaaaccagaataaaactctcatgaacaaacgattaaactttcagccatt

SEQ ID NO: 24122 - DNA, 201 bp, Homo sapiens
aacaaacgattaaactttcagccattgctgttgccaaatcatgacctctgttgctcatccctgctccccaccctcatccttggtgaaggatcagagctacrtaagggtcaggaattgggtaacaaggagataatgcagcacatggctgggatctacacaatggagacactccccctctgagtcatgaaggctgtgctcaag

SEQ ID NO: 24123 - DNA, 201 bp, Homo sapiens
cctgaactcaaaataaaagttagaaaaaaataaaagaggtgctgacccaccagatggaacagatgaaggagagggtacgttgagcgatgagccccaggttyctggcatggatggatggatgcatggatggaggaggggcatttatggagacagactaggcaagttttgtttaataaatgagtgaaggaatgaatacatgaa

SEQ ID NO: 24124 - DNA, 201 bp, Homo sapiens
tgcccagtcctgcagtttgtgaatctggcgttccacggagatggaggtccgcagtgtgcccatggagttctccatctgaatgggttctgacctgcagcccyctttctggcacactccctggtacacctcccaagacttctttcggaagcgcttgcccacgatcacgtacaccagtgggttgaggcagctgttgctgtaggc

SEQ ID NO: 24125 - DNA, 201 bp, Homo sapiens
tgttacagctgtagaaccttatcgcaagaggggtgggacactatggaagggtttcccttggaggatgcccccatcacactcactgccaacaccaccaccacatcatcatcatcatcatcatcatcatcatcaaagctagtacatgttcagtgccaactatgtaccaggcactgtgctagatgctttcatacattaatccta

SEQ ID NO: 24126 - DNA, 201 bp, Homo sapiens
atgaaggagagggtacgttgagcgatgagccccaggttcctggcatggatggatggatgcatggatggaggaggggcatttatggagacagactaggcaarttttgtttaataaatgagtgaaggaatgaatacatgaataatgaagggatcccaaagtggcatggataatgaattccccatcactgggagtatgaaacaa

SEQ ID NO: 24127 - DNA, 201 bp, Homo sapiens
ttgcacaagacgatggtagtgtcattatgaggagggcccacacacaccgtgctctgtcttggccagaactgaagagaggaaacagacactcattgctcgcyggctgagtggacggcaaagggtgactcagcatgaagggaggcatccagagagtctcagaaccccatctttgaccatctttcagggttgtctataagtagc

SEQ ID NO: 24128 - DNA, 201 bp, Homo sapiens
tacagtaatggtgggtagcttatatagcatgggtacattggacaaagggacaactcatgtcccaggtgggacaaagcaggacggggcgaggtttcatcacrctgctcagactggtgcataatttaaaacgtattaattgcttttttctggaattttccatttaatattttcagacctatattggccacaggtaattgaaac

SEQ ID NO: 24129 - DNA, 201 bp, Homo sapiens
ctgttaatattttttttttttacatcttctttcttaaatttctactggttgattatattttagaatgtacatcttcatacagattaataagtatacatacygggtatgcataatcaattctttttttcctataggaatatacaatcacaaaagcttggagaccactgatctacatgccagaagcctgttaacagattgagc

SEQ ID NO: 24130 - DNA, 201 bp, Homo sapiens
ctagtgagggggcactccaggcaggctggactccctgtagtatgcgtgggcttgggccatactggatgtgtattcaagggaaggtgagctctggagtttgyggcccctggggacatgcagtcccagtgcccactgtgacatcaagggccacttttcagttctctcatccatcagtcctggagtttttttctcctttacttt

SEQ ID NO: 24131 - DNA, 201 bp, Homo sapiens
cagcagttcccccttaggcatggggaaaacgttccaagacccccagtggatgcctgaaactgcagatagtaccaaaccttataacactatgctttttgctrtacagtaatggtgggtagcttatatagcatgggtacattggacaaagggacaactcatgtcccaggtgggacaaagcaggacggggcgaggtttcatcac

SEQ ID NO: 24132 - DNA, 201 bp, Homo sapiens
ttttctggaattttccatttaatattttcagacctatattggccacaggtaattgaaaccatggataaagggggggactactgtacttagggaggtcaggragacagtgagcaaatctgactgcaaaaacaagtcccgtccctggtccttaaggtctgatttggaagtccaggcaggcaggtgtacggtgtggagctgcct

SEQ ID NO: 24133 - DNA, 201 bp, Homo sapiens
tatggaaaagctctttcatcatttttcaatcagcctagatgcctaattaagccatgtgtacagcaaagaatgggggtatggaataagatgttttccttagraaccagtagttcctttatgatgttttaaagagatggaattggattaccgtattataaagttgatgctgtgagcatttatctttcatataaatcatattgg

SEQ ID NO: 24134 - DNA, 201 bp, Homo sapiens
tgatctccagaactgtaagataataacttgcatcgttttaagccactcactttgtgataattaattatagcagccttaggaaaccagcacgggggtgaggytgcaccctgcccaggaagccagagacgaccagctacgcagggactttagctcgaacctgattaggtcagtggacaccgcccccatccccaggacggggag

SEQ ID NO: 24135 - DNA, 201 bp, Homo sapiens
gaaactgaaattgcttctgtgagctgcagaactctgagtataggggaactgaaattgctgaagataaccataacttttcttgaagacttggggtcattctygactgtcccagccctcatgggggctacagacttgggatagagacagactaacagagaaacctgtacaggatcgtgattgtgagttctatgaagaaacaga

SEQ ID NO: 24136 - DNA, 201 bp, Homo sapiens
agtgcaagaacacaaagaagacaccacccggcccctgccctgcctgactcctgacaactgtggcccagagggtggagggtgccctggagggagcagggggsttgtgggacacagacttggagagggggctggtgggtaaggggttggaggtgactctagagctgggtcttgaaggataagaagcattttgacgggacaaga

SEQ ID NO: 24137 - DNA, 201 bp, Homo sapiens
acccggcccctgccctgcctgactcctgacaactgtggcccagagggtggagggtgccctggagggagcaggggggttgtgggacacagacttggagaggrggctggtgggtaaggggttggaggtgactctagagctgggtcttgaaggataagaagcattttgacgggacaagaaggaggacaagtggaccaggcaggg

SEQ ID NO: 24138 - DNA, 201 bp, Homo sapiens
actaaaaccagaataaaactctcatgaacaaacgattaaactttcagccattgctgttgccaaatcatgacctctgttgctcatccctgctccccaccctmatccttggtgaaggatcagagctacgtaagggtcaggaattgggtaacaaggagataatgcagcacatggctgggatctacacaatggagacactccccc

SEQ ID NO: 24139 - DNA, 201 bp, Homo sapiens
catctctgcatcctattctcacccctctgtggccagggaagactcaggagctaggccccttgcctggtctcctgagcccacctggacttcttctcattgcrccagcttgctggagccagagagggtcaggagttgaggggctgctcctgttgcctcgctggggaggctctcccagcattttttttttctttttttgcctgc

SEQ ID NO: 24140 - DNA, 201 bp, Homo sapiens
ctcgctggggaggctctcccagcattttttttttctttttttgcctgctaagagccctgctcaggtttccaggcatgtggtttcccctggattgcagactmccttgagtaatgcaggcatctgtgaacaaaattccctggaggagtgagctcccttgggcacttgtggacaacttcctccaagttcagggcacttagtgag

SEQ ID NO: 24141 - DNA, 201 bp, Homo sapiens
tgctgtgcttgatgaagtcccctgggtacttgggtgaagaggtggtcacagaggataaaggcctgcctctggaaatagaggacaggccaaccttccctggsgtgtcctaaatactagtgagggggcactccaggcaggctggactccctgtagtatgcgtgggcttgggccatactggatgtgtattcaagggaaggtgag

SEQ ID NO: 24142 - DNA, 201 bp, Homo sapiens
cttaggcatggggaaaacgttccaagacccccagtggatgcctgaaactgcagatagtaccaaaccttataacactatgctttttgctatacagtaatggkgggtagcttatatagcatgggtacattggacaaagggacaactcatgtcccaggtgggacaaagcaggacggggcgaggtttcatcacactgctcagact

SEQ ID NO: 24143 - DNA, 201 bp, Homo sapiens
gttacagctgtagaaccttatcgcaagaggggtgggacactatggaagggtttcccttggaggatgcccccatcacactcactgccaacaccaccaccacatcatcatcatcatcatcatcatcatcatcaaagctagtacatgttcagtgccaactatgtaccaggcactgtgctagatgctttcatacattaatcctat

SEQ ID NO: 24144 - DNA, 201 bp, Homo sapiens
accgccaccggctcccaatactgattctgctccacggagctatttctagacctcagtgtcttttccttatagtaaacatatcccagttacgtctgcgtaawgatgcctcacatgtacgtagcaccctttgcttttctaagtactttatacctgttactgcctttaaccctcacaacgacttcatgttacagaagagggaac

SEQ ID NO: 24145 - DNA, 201 bp, Homo sapiens
cacaaagaagggaacaacagacactgaggtctagtggagggtgggggttgggaggagggagaggagcaggaaaaataactaatgggtagtaggcttaatgyttgggtgatgaaataatctgtacaacaaacccccatgacccaagtttatctatgtaacaaacctgcacgtgtacccctgaactcaaaataaaagttagaa

SEQ ID NO: 24146 - DNA, 201 bp, Homo sapiens
cctcgagaatcccaggagtgcacatgctctcagaaggggcttgtaccaggaaaatcagctgcatttctctgtctcctaaagccgaagccaggccgtctcaygtctcttctcgaactcctctgctgctgtctcaggcccaggaaaacagagaccttacggcggcaaggttgcacatgcgcagacccagctgtcccccagagc

SEQ ID NO: 24147 - DNA, 201 bp, Homo sapiens; identical to SEQ ID NO: 3865

SEQ ID NO: 24148 - DNA, 201 bp, Homo sapiens
gccattattcttagcgaactaacccaagaacagaaaaccaaataccacatgttctcatttgtaagtgggagctaaatggtgagaacacatggacacaaagwagggaacaacagacactgaggtctagtggagggtgggggttgggaggagggagaggagcaggaaaaataactaatgggtagtaggcttaatgcttgggtg

SEQ ID NO: 24149 - DNA, 201 bp, Homo sapiens
gcccacttagcagataaagctccactgggccaggggttcctccccgcccttgtgtggccctgctttgggagatgaaagccttctcgcccaggcagagcagrggatcacgagaccttcctctttagggagcctcgagaatcccaggagtgcacatgctctcagaaggggcttgtaccaggaaaatcagctgcatttctctgt

SEQ ID NO: 24150 - DNA, 201 bp, Homo sapiens
ggtgtctaagtgtaaggggggaggtaagcagaaaatcccaaatatacatttagcaaagcacaaacacttggagatctacaggatgacagggtggacatgarcacgtcctgggcattcaggcagctccaggtgctgccatggcctggcagccagcccagaagtgaagggtcctgggtgctggctctggggtgggaaggtgcc

SEQ ID NO: 24151 - DNA, 201 bp, Homo sapiens
ctcctttccagagtcctctgaaggtaagacttcccctgggtagtccccttggtccaaccctcaaccccatttctgtagctacagaaaacccatttcctgcrtacccctggcttggagagtctgtcatctttcatgagctaactcactagagaccaaagtatagcaccagatgctgcttattaatttctcagcaagacagta

SEQ ID NO: 24152 - DNA, 201 bp, Homo sapiens
gtgcccatcaattatagactggataaagaaaatgcggtacatatacaaccatggaacactatgcagccataaaaaagaatgagatcatgtcctctgcgggracatggatggagctggaggccattattcttagcgaactaacccaagaacagaaaaccaaataccacatgttctcatttgtaagtgggagctaaatggtga

SEQ ID NO: 24153 - DNA, 201 bp, Homo sapiens
ttcacaatggcaaaggcatggagtcaatgtaagtgcccatcaattatagactggataaagaaaatgcggtacatatacaaccatggaacactatgcagccrtaaaaaagaatgagatcatgtcctctgcggggacatggatggagctggaggccattattcttagcgaactaacccaagaacagaaaaccaaataccacat

SEQ ID NO: 24154 - DNA, 201 bp, Homo sapiens
ttactgggtatatacccaaaggaatataaatcattctatcataaatacacatgcacatgagtgctcactgcagcactattcacaatggcaaaggcatggartcaatgtaagtgcccatcaattatagactggataaagaaaatgcggtacatatacaaccatggaacactatgcagccataaaaaagaatgagatcatgtc

SEQ ID NO: 24155 - DNA, 201 bp, Homo sapiens
gggtgggacactatggaagggtttcccttggaggatgcccccatcacactcactgccaacaccaccaccacatcatcatcatcatcatcatcatcatcathaaagctagtacatgttcagtgccaactatgtaccaggcactgtgctagatgctttcatacattaatcctattaacaattttatgaggtagataccattat

SEQ ID NO: 24156 - DNA, 201 bp, Homo sapiens
cagcatcaacatcacataaggcagtccttcgagaccactgatctacatgccagaaacctgttagagtcatgacttattatctctccacttgacagacgagmaaactaaggccaaaggtggtgggagggaagatgagtaaagtggcttgctgagatcacacaagtggcatggtagggaacccatggactggtccccaaaatt

SEQ ID NO: 24157 - DNA, 201 bp, Homo sapiens
gagggtagagaatgagcctggagcagagagagggagacatagagacaagacagggaccagatcatgaagggtcttgcaagccatgttacagctgtagaacyttatcgcaagaggggtgggacactatggaagggtttcccttggaggatgcccccatcacactcactgccaacaccaccaccacatcatcatcatcatcat

SEQ ID NO: 24158 - DNA, 201 bp, Homo sapiens
ggctcctgaacacagttctctatgtttatagcctccccatgaatgtatttgcattcttaaaagaccatgttggctgcagagtgaagaataagaattgggasatggtagtagttagtattggaggcacccatgacagacgatggttggacatagaaggaaacatagatttaggaaacacttagtgagtagaatctaaaagag

SEQ ID NO: 24159 - DNA, 201 bp, Homo sapiens
ctgactcctgacaactgtggcccagagggtggagggtgccctggagggagcaggggggttgtgggacacagacttggagagggggctggtgggtaaggggytggaggtgactctagagctgggtcttgaaggataagaagcattttgacgggacaagaaggaggacaagtggaccaggcagggggaacagcctgagcagag

SEQ ID NO: 24160 - DNA, 201 bp, Homo sapiens
tggaagggagccaatgagcacctactgtgtgccagacactggtgcttcacaccgccaccggctcccaatactgattctgctccacggagctatttctagamctcagtgtcttttccttatagtaaacatatcccagttacgtctgcgtaatgatgcctcacatgtacgtagcaccctttgcttttctaagtactttatacc

SEQ ID NO: 24161 - DNA, 201 bp, Homo sapiens
agccacaacctggacaagcgcagtgctcagtagtgggagaggaagggccaagatctggctggggatggggaggagtggctcccccacttaaaacatttgtsccctctgtctccccattccagctggccttgggtgcggcactcgtgaatgtacagatccccctgctcctgggccagctggtagaggtcgtggccaagtaca

SEQ ID NO: 24162 - DNA, 201 bp, Homo sapiens
aggcggacggagacaggctcccattttcagccccaaacctgacattccacagagacgttcctcccatttccgcagctgcatggacaccctcgcgtgccccrtttctgctcgtgctccctaatctgagcaccttcagaccctttctggtcccgggctcaggcctccttggcagcctcgccctcctccagcccaaggagctgt

SEQ ID NO: 24163 - DNA, 201 bp, Homo sapiens
tgccaggccctaatgtcttccagatctctggtggagaatgtgcccctgctcatcaacagatagctggctgggctggctccttcctgcctggtgcctccccmggctgcctttagcaagtgctgactgcactgagtccactgggaccttttccttttgggtttcgaggctcctcccactcacccccaccctagtgctggaaga

SEQ ID NO: 24164 - DNA, 201 bp, Homo sapiens
tctcttgaacccgggaggcagaggttgcagtgagccgagattgtgccgcttcactccagccggggtgacggagcgagactctgtctcaaaaaaaaaaaaaacacaatgtctagaatagtggaatcgatgttagcattttatagatgtggcagctgaaggaaagagaaggtaattgtcctattcaagatgacaagataagtt

SEQ ID NO: 24165 - DNA, 201 bp, Homo sapiens
atctcttgaacccgggaggcagaggttgcagtgagccgagattgtgccgcttcactccagccggggtgacggagcgagactctgtctcaaaaaaaaaaaaaacacaatgtctagaatagtggaatcgatgttagcattttatagatgtggcagctgaaggaaagagaaggtaattgtcctattcaagatgacaagataagt

SEQ ID NO: 24166 - DNA, 201 bp, Homo sapiens
aattgctcaaacctgggaggcagaggttgcagtgagccgagattgtgccattgcgctccagcatgacagagcaagactccgtctcaaataaataaataaataaataaataaaagtaaatgtaggccaggcacagtggctcacacctgtaatcccagcactttggggggccaaggcaggcagatcacttgaggtcaggagtt

SEQ ID NO: 24167 - DNA, 201 bp, Homo sapiens
ggaaacaaacaaggaccctgaaactacaactcgaatgtaaatgctttatgagaagggactgattcctttttttttcttttcttttcttttcttttcttttcttttttttttttttttgagacagagtctcgctctgtcacccaggctggagtgcagtggcatggtctcgactgactgcaacctctgcctcctggtttcaag

SEQ ID NO: 24168 - DNA, 201 bp, Homo sapiens; identical to SEQ ID NO: 3907

SEQ ID NO: 24169 - DNA, 201 bp, Homo sapiens
cctgttttctggactccttgtcctgtttcctggactccttgcagatcgccagggcaatgggcgtagcagacgaggccctgggcaatgtgcggactgtgcgwgccttcgccatggagcaacgggaagaggagtgagtcctgggagggcggagcacaaagcagagatgccccccacaccctgccaacccttcgtgccagccca

SEQ ID NO: 24170 - DNA, 201 bp, Homo sapiens
cagagctggaagcctgccgctgccgggcagaggagctgggccgcggcatcgccttgttccaagggctttccaacatcgccttcaactgtgagtgagccatytgggggctggaggggcgcttgtgggctggggaggagctgggagcagccaaggcaggcaaaggccctcccttcatctgctggctgcctgcattcgcctcgg

SEQ ID NO: 24171 - DNA, 201 bp, Homo sapiens; identical to SEQ ID NO: 3953

SEQ ID NO: 24172 - DNA, 201 bp, Homo sapiens
cgaccatcatggaaaacatccgctttgggaagctggaagcttccgatgaagaggtgtacacagccgcccgggaagcgaatgctcacgagttcatcaccagyttccccgagggctacaacacggtcgtcggtgggtgctcgggtctgccgggaaccaggtggtgaggcactgggacacaggattccacaggagcagtgagca

SEQ ID NO: 24173 - DNA, 201 bp, Homo sapiens; identical to SEQ ID NO: 3977

SEQ ID NO: 24174 - DNA, 201 bp, Homo sapiens
ggggcagagctgctcaccactactaggggtggcatgggcaatgggctggacatcatgctggacgtgcagcaggaggaatatctacctgtgtggagggacartggtagggagcacacaaatgaggctgggggagggcacggatggagtgcaaaaggctaggggaaggagaggaggagaggaggtgtcagggtgttcccccag

SEQ ID NO: 24175 - DNA, 201 bp, Homo sapiens
ctgaccttcgggtacctggtgctgctgtcccacgttggcgagcgcatggctgtggacatgcggagggccctcttcagctccctgctccggtactgccagcygcagggtgcagagttggggtgactgatggcctgaggggtctgggggtaggaccttatcctgaagtaatgtctccctcttctgccctccttattggttctt

SEQ ID NO: 24176 - DNA, 201 bp, Homo sapiens
gtttctatggactctgtctccataacccctcacccacaggagcccgtcctgtttgggacgaccatcatggaaaacatccgctttgggaagctggaagcttscgatgaagaggtgtacacagccgcccgggaagcgaatgctcacgagttcatcaccagcttccccgagggctacaacacggtcgtcggtgggtgctcgggt

SEQ ID NO: 24177 - DNA, 201 bp, Homo sapiens
agtctgcagcattagatctgctctccccttctaagccacgcacccttgatctctgttcatggtggcggcctccgcatcctcagggccgagcagggagtccrtgggtcagctgggctcccttcctcgtgggctgatatcaccgctgcatgtgtgcacaggcctcaccctgcagaccacaggccagggcactggaggacaccc

SEQ ID NO: 24178 - DNA, 201 bp, Homo sapiens
aggcactgggacacaggattccacaggagcagtgagcagcccagtgggactgagggcagcagggacagctggggagaaagacagttgtgtcagggaagacsagaaccacagccaaaggggacagagtcgttgtgtggggacaggggagtccaggccagtgtggttcagaaccagcagaccaggcaggctgcagagacagga

SEQ ID NO: 24179 - DNA, 201 bp, Homo sapiens
gccttgataaattacaggccctccataccaatagttctcaatggctgaggcgtagggcaagagtgtcagaatcaccgggggagttcttccccaagtacacstgactgtggggaaaagaaagagagatcagattgttcctgtgtctgtgtagaaagaagtagacataggagactccattttgttctgtactaagaaaaattc

SEQ ID NO: 24180 - DNA, 201 bp, Homo sapiens
cagcactttggggggccaaggcaggcagatcacttgaggtcaggagttcaagaccagcccggccaacatggtgaaaccccatacaaaacttagccgggtgygttggctcacgcctgtaatcccagcactttgaggggccggggcaggcagatcacttgaggtcaggagttcaagaccagcctagccaacatggtgaagccc

SEQ ID NO: 24181 - DNA, 201 bp, Homo sapiens
aggcatggtggtgggcgcctgtagtcccagctactcgagaggctgaggcaggagaatcgcttgaacctgggaggtggaggttgcagtcagccagcatagcrccactgctctccagccggggcaaaagagtgagaccctgtcttgaaaagaaaagaaaagaatcagaatacatgttaagaattagagaaaatgttattttgt

SEQ ID NO: 24182 - DNA, 201 bp, Homo sapiens
ccggcatgaaggaggaggaggaggtggcagtggcatggggaggaggggcaccgatccgggccccagatctccccaccgccccagccgccttcttctccccycccagcccattcggctcaccatcaggccacggcttctccagaaaggttggaaggatgggagctgttgttgcttccacaaaggtctgtgacactgagctgg

SEQ ID NO: 24183 - DNA, 201 bp, Homo sapiens
agctccacatgatttttttcatctgtcaggtgagaataatggcacctccctcccagggaggtgaggatcaagggaagtagcccattagctccaggaggtgrggctgtgtctgccctggtggctgctgtgagcaagtccagtgccgggcacaggagcagctctctttcctcacctctctgcaccgtggtcccttaaaccccc

SEQ ID NO: 24184 - DNA, 201 bp, Homo sapiens
gccaggccctaatgtcttccagatctctggtggagaatgtgcccctgctcatcaacagatagctggctgggctggctccttcctgcctggtgcctcccccrgctgcctttagcaagtgctgactgcactgagtccactgggaccttttccttttgggtttcgaggctcctcccactcacccccaccctagtgctggaagaa

SEQ ID NO: 24185 - DNA, 201 bp, Homo sapiens
gggtgactgatggcctgaggggtctgggggtaggaccttatcctgaagtaatgtctccctcttctgccctccttattggttcttgtcccatgccagacaaracatcaccttctttgacgccaataagacagggcagctggtgagccgcttgacaactgacgtgcaggagtttaagtcatccttcaagcttgtcatctccca

SEQ ID NO: 24186 - DNA, 201 bp, Homo sapiens
tttaagtcatccttcaagcttgtcatctcccaggtcagtggcccagtggcccccaccacgtccacacacacactttcccatgtggattcaccaggccagcmctgcccgccccagccctgatgttgggctgacaggcgcatgctgactcgagaaacccactgcctgtgagggcatgggtgagggaccatggaagttcatgga

SEQ ID NO: 24187 - DNA, 201 bp, Homo sapiens
agggctcagcaggggcagggtcagggaggataaccatgggctgctctgggggctggggcaggagcccacctggctgtccctgatcactgcagcatcccggyacccccccttcctcccggcagacaatttattttcattgtcaccttcacaaccttcctccttcgatgcgtggattacaatgttctctttgccaaccaacca

SEQ ID NO: 24188 - DNA, 201 bp, Homo sapiens
ccctgatgggagtgggcaccctgatgggctcaggcctccgaaaattgtctcgccagtgtcaggagcaggtaccggcattcctggccatcctcttcaccctscccacaccgtttctctttccactccccggaactcctccctgtccccatcctggactccttgtcctgttttctggactccttgtcctgtttcctggactcc

SEQ ID NO: 24189 - DNA, 201 bp, Homo sapiens; identical to SEQ ID NO: 3873

SEQ ID NO: 24190 - DNA, 201 bp, Homo sapiens
tgggcatggtggtagtcccagctactcgggaggctgaggcaagagaatcgcttgaacctggtaggcagaggttgcagtgacctgagattgcgccactgcaycccagcctggcaacagcaagactccgtctcaaaaaaaaaaaaagaagcccagtggctcccttaataaaatcaccccttagccctctgtggtgggcagtgg

SEQ ID NO: 24191 - DNA, 201 bp, Homo sapiens
ctgctcaccatcctcgagatcctagactacctctgtgaggtgggccagggcccccactgcagggggtgggaggtgggaatcagggcccctaggatgagggrgaaggtgtgcactggccacctcccatcctgcttgcctccaggtgttccgagacaaggtcctgggatatttctggaaccgacagcactcccaaaggcactc

SEQ ID NO: 24192 - DNA, 201 bp, Homo sapiens
gtgggagctgcctattgactgggtgtgggcgggcagaggagctggggagaccccagcccagagccatggccactccctggagatgctgttgtcacccctaytcctgcctccctgcggactttggatcccctcccacaggtggtccgggggctgagtgcaggtgcccgggtctttgagtacatggccctgaacccctgcatc

SEQ ID NO: 24193 - DNA, 201 bp, Homo sapiens
cccagaggccgtgtggcgttggctaacagccactcattcaagccaaggctgaggggctcgtgcagggagacggatcctgagttggagccttgggctctgtragggggacagagggaatcatgttcttccaaaattcagctaagtaaggaagtggcagtaactaatgcagcatgccagtggcggttcctttcagattgggca

SEQ ID NO: 24194 - DNA, 201 bp, Homo sapiens; identical to SEQ ID NO: 3894

SEQ ID NO: 24195 - DNA, 201 bp, Homo sapiens; identical to SEQ ID NO: 3876

SEQ ID NO: 24196 - DNA, 201 bp, Homo sapiens
ctgggacaatccctagaatccctggcctccctccctctcaacccaattccccaggaaagaccaccgtggcttccctgctggagcgcttctacgaccccacrgcaggcgtggtgatgctggatgggcgggacctgcgcacccttgacccctcctggctccggggccaggttgtcggcttcatcagccaggtgcggggccaca

SEQ ID NO: 24197 - DNA, 201 bp, Homo sapiens
gcctgagcctgcgccgggggatgtgggcagcggccgtggtcctgtcagtggccaccttcctctaccaggtggctgagagggtgcgctactacagggagttmcaccaccagactgccctggatgagcgagaaagccaccggctcatcttcccggctgtcaccctgtgcaacatcaacccactgcgccgctcgcgcctaacgc

SEQ ID NO: 24198 - DNA, 201 bp, Homo sapiens
cctgcgccgggggatgtgggcagcggccgtggtcctgtcagtggccaccttcctctaccaggtggctgagagggtgcgctactacagggagttccaccacmagactgccctggatgagcgagaaagccaccggctcatcttcccggctgtcaccctgtgcaacatcaacccactgcgccgctcgcgcctaacgcccaacga

SEQ ID NO: 24199 - DNA, 201 bp, Homo sapiens
ccccacagctgagcttcctgccaccgccctggggcgattgcagttcagcatctctgaaccccaactatgagccagagccctctgatcccctaggctccccmagccccagccccagccctccctatacccttatggggtgtcgcctggcctgcgaaacccgctacgtggctcggaagtgcggctgccgaatggtgtacatgc

SEQ ID NO: 24200 - DNA, 201 bp, Homo sapiens
ctatgtccttttgtgactgcgttttgtcactccacattgtgtcctcagcttcctccgtgttgcaccctgtccgaattcccttccgctgcaggctgtgacaytccatgcatggaaggaccatccttgacaggctgtgtgagctgcccttccccatgcctgccacttccagggatgacaagctgacccctgtccccacacacc

SEQ ID NO: 24201 - DNA, 201 bp, Homo sapiens; identical to SEQ ID NO: 3877

SEQ ID NO: 24202 - DNA, 201 bp, Homo sapiens
gtccatgctgtcgacacgcctcacgctgctgctgatggtggccacaccagccctgatgggagtgggcaccctgatgggctcaggcctccgaaaattgtctygccagtgtcaggagcaggtaccggcattcctggccatcctcttcaccctccccacaccgtttctctttccactccccggaactcctccctgtccccatcc

SEQ ID NO: 24203 - DNA, 201 bp, Homo sapiens
ctgccactgggcctcccaggggccaagacctgggccttggccgtgggagtgcagagctacagtcagctgacccttggaaaagtccttcctgtcatggtgcrgacgccgtagcctcccgccttccctcccactccctaggggctgcgaagctgcacccaggtggcaggctgcctggtgtccctgtccatgctgtcgacacgc

SEQ ID NO: 24204 - DNA, 201 bp, Homo sapiens
gtccgggggctgagtgcaggtgcccgggtctttgagtacatggccctgaacccctgcatcccactgtctgggggctgctgcgtccccaaagagcagctgcktggctccgttacatttcagaacgtctgcttcaggtcagcacgggtgagcaggcgtggggatgggtccctgggccggggatgaggcgagtggattcggggg

SEQ ID NO: 24205 - DNA, 201 bp, Homo sapiens; identical to SEQ ID NO: 3872

SEQ ID NO: 24206 - DNA, 201 bp, Homo sapiens
accggcattcctggccatcctcttcaccctccccacaccgtttctctttccactccccggaactcctccctgtccccatcctggactccttgtcctgtttyctggactccttgtcctgtttcctggactccttgcagatcgccagggcaatgggcgtagcagacgaggccctgggcaatgtgcggactgtgcgtgccttcg

SEQ ID NO: 24207 - DNA, 201 bp, Homo sapiens
cagccagagccccatgggtgtgctggtcagcaggagggcagtcggagcctcaagccatccatgcctctctctccttacaggtactctgatggctaccgcarctcctccctcctccgggccgtggcccacctgcggtcccagctctgggcccacctccctcgagcccccctagctcccagatggagcccctctgcctggtgc

SEQ ID NO: 24208 - DNA, 201 bp, Homo sapiens
tactacagggagttccaccaccagactgccctggatgagcgagaaagccaccggctcatcttcccggctgtcaccctgtgcaacatcaacccactgcgccrctcgcgcctaacgcccaacgacctgcactgggctgggtctgcgctgctgggcctggatcccgcagagcacgccgccttcctgcgcgccctgggccggccc

SEQ ID NO: 24209 - DNA, 201 bp, Homo sapiens
ccctcccgcaagtctcatgtctcttttcccttcttgtaggtcaggcttcagccatacaattcctgaaatttctctcccatcctttcttactggagataccygcacttgcttttcctctgcctagagctctcccctttacactccacccccacctgtgcctggcctgttccccctcacaggttcccccttacctagaaggcc

SEQ ID NO: 24210 - DNA, 201 bp, Homo sapiens
taggcctaagccctagagaccttgacacctggtggctgagtcagtatctcagtaatgggctttagaaggaaacctggtgattcagggcctcaagaatggcrttgggcaagccaccagaccagctgcctgggtctcctcctccttgttgaggtgacaacaaggaactcagttcagctcctccctgggtatccaaattatcct

SEQ ID NO: 24211 - DNA, 201 bp, Homo sapiens
tcccaggaagcgggaggcggacggagacaggctcccattttcagccccaaacctgacattccacagagacgttcctcccatttccgcagctgcatggacaycctcgcgtgccccgtttctgctcgtgctccctaatctgagcaccttcagaccctttctggtcccgggctcaggcctccttggcagcctcgccctcctcca

SEQ ID NO: 24212 - DNA, 201 bp, Homo sapiens
acccccatgcagttctctttgttcagttcctagaacagaaagagaagcaagctgggatttgtctaggggaaggatgccacagttcatagcattctcgctcrgccccctcaggcctgctgctcgcaccccaactggccgagttagggttacgtactgtgaccggtggactgccactgggcctcccaggggccaagacctggg

SEQ ID NO: 24213 - DNA, 201 bp, Homo sapiens
ctgctcaggaggctgaggcaggagaatctcttgaacccgggaggcagaggttgcagtgagccgagattgtgccgcttcactccagccggggtgacggagcragactctgtctcaaaaaaaaaaaaaacacaatgtctagaatagtggaatcgatgttagcattttatagatgtggcagctgaaggaaagagaaggtaattg

SEQ ID NO: 24214 - DNA, 201 bp, Homo sapiens
tcaccctgtgcaacatcaacccactgcgccgctcgcgcctaacgcccaacgacctgcactgggctgggtctgcgctgctgggcctggatcccgcagagcaygccgccttcctgcgcgccctgggccggccccctgcaccgcccggcttcatgcccagtcccacctttgacatggcgcaactctatgcccgtgctgggcact

SEQ ID NO: 24215 - DNA, 201 bp, Homo sapiens
ctgacctcgggtgatctgcctgcctcggcctcccaaagtgctgggattacaggcatgagccacctcacctggccatcctttctaatcctagagtgaattasttgggggccaaacagatagaagattcccaagggcaggtggatgtggagttgtgtcatttggaaagcccatctgactgatggagggcaagagctggatcga

SEQ ID NO: 24216 - DNA, 201 bp, Homo sapiens; identical to SEQ ID NO: 3897

SEQ ID NO: 24217 - DNA, 201 bp, Homo sapiens
caggtccctccccgacagaggagaccccgtttgaggtggggatccgagtgcagatccacagccaggaggagccgcccatcatcgatcagctgggcttgggkgtgtccccgggctaccagacctttgtttcttgccagcagcagcaggtacccttccgtgtgcctccacacctactacttcaagcccacaccacctcggacc

SEQ ID NO: 24218 - DNA, 201 bp, Homo sapiens; identical to SEQ ID NO: 3934

SEQ ID NO: 24219 - DNA, 201 bp, Homo sapiens; identical to SEQ ID NO: 3898

SEQ ID NO: 24220 - DNA, 201 bp, Homo sapiens; identical to SEQ ID NO: 3935

SEQ ID NO: 24221 - DNA, 201 bp, Homo sapiens; identical to SEQ ID NO: 3899

SEQ ID NO: 24222 - DNA, 201 bp, Homo sapiens
tcttccaggctgggacacatgaagagctcctgaagaaaggcgggctatacgccgagctcatccggaggcaggccctggatgccccgaggacagcggccccmccgcccaaaaagccagaaggccccaggagccaccagcacaagtcctgagaagggccccctgaggtgtggtcgctgccaagcatcagtgttagggctgggg

SEQ ID NO: 24223 - DNA, 201 bp, Homo sapiens
caccacctcttcaccctctgactcttctctagcagccactcagagcaaggccgggagcagtgagcccccggtggggtcccttcctccactgccacaaggggccttctttcctgggacaatccctagaatccctggcctccctccctctcaacccaattccccaggaaagaccaccgtggcttccctgctggagcgcttcta

SEQ ID NO: 24224 - DNA, 201 bp, Homo sapiens
gggaagcacagtgtccatatcgccatttcaggggtactggccccaacatcagcccttaggcctaagccctagagaccttgacacctggtggctgagtcagyatctcagtaatgggctttagaaggaaacctggtgattcagggcctcaagaatggcgttgggcaagccaccagaccagctgcctgggtctcctcctccttg

SEQ ID NO: 24225 - DNA, 201 bp, Homo sapiens
ccaggccctaatgtcttccagatctctggtggagaatgtgcccctgctcatcaacagatagctggctgggctggctccttcctgcctggtgcctcccccggctgcctttagcaagtgctgactgcactgagtccactgggaccttttccttttgggtttcgaggctcctcccactcacccccaccctagtgctggaagaag

SEQ ID NO: 24226 - DNA, 201 bp, Homo sapiens
agggcggagtggtgattgccgcagacatgctgggatcctacggctccttggctcgtttccgcaacatctctcgcattatgcgagtcaacaacagtaccatkctgggtgcctctggcgactacgctgatttccagtatttgaagcaagttctcggccagatggtgtaagtcatccagagaacaggagagtggttcccaagta

SEQ ID NO: 24227 - DNA, 201 bp, Homo sapiens
cagctatttttaggaattgatccctttatgcttcacaattttattattctgtcttccttttttagtggctttgaatgaaatacagatgcattatccagaamtgaagttgccctacttttaactttgaacttggctagttcaaagatagactcttcttttgtaaagtaaataaattcttcaaaatgcttgctgagtggtttt

SEQ ID NO: 24228 - DNA, 201 bp, Homo sapiens
acattaactcacctacaagaaatgctgacatgcaggaggagctaattgcctccctagaggagcaactgaagctgagtggggaacattctgagtcttccackccacgacccagatcatctcctgaagagacaattgagcctgaaagtcttcaccagctctttgagggtgaaagtgagaccgagtctttctatggctttgaag

SEQ ID NO: 24229 - DNA, 201 bp, Homo sapiens
gaacaccatggtcatcggaggctatgctgatggagagaggttcatatgaatacaaataacttatttcctttaccacccaacctagtacctgtgtagtatcycttctgtctcttctccccaagtgaatcccactttaactcagaccccatggtccccttcttcagctaagatgaacctaaggtgaaatgagttttgacccat

SEQ ID NO: 24230 - DNA, 201 bp, Homo sapiens
agggaagaatctgacaggaagaagcgcacaggggtgtgcacaaagaaaatgacatgaatctttatttttcactgccagcttcaaggaaagaaaattttttytacaatttgcatgagggatttttttaattgtatgtactcatggttgtaaaccaaaacgtactgtaccgtacagagaaaaggagcaaaaaaccaagtcttc

SEQ ID NO: 24231 - DNA, 201 bp, Homo sapiens
agctaagatgaacctaaggtgaaatgagttttgacccattgtgtcctgttagcttcctcggttatgtggacatgcttggtgtagcctatgaagccccttcrctggccactggttatggtgcatacttggctcaggtaagtagtaagtctagaggtgggggaaagggaagacaaaaggaaatggattagtggttgtctgctt

SEQ ID NO: 24232 - DNA, 201 bp, Homo sapiens
aaggattgatgaggagcttctgggagatggacacagctatagtcctagagctattcattcatggctgaccagggccatgtacagccggcgctcgaagatgwaccctttgtggaacaccatggtcatcggaggctatgctgatggagagaggttcatatgaatacaaataacttatttcctttaccacccaacctagtacct

SEQ ID NO: 24233 - DNA, 201 bp, Homo sapiens
agtgctgtactaccgagatgcccgttcttacaaccgggtgagggatgtgctgggaacctaattggcgggctctggctacttgcaatccctgggtctctatrctttgaagaacagattgccttacttgtgtgactcctattttcacattggggaagacctccacctgacctttcatttaaggacttaaggcgtgggcattat

SEQ ID NO: 24234 - DNA, 201 bp, Homo sapiens
ttgatgaggagcttctgggagatggacacagctatagtcctagagctattcattcatggctgaccagggccatgtacagccggcgctcgaagatgaacccyttgtggaacaccatggtcatcggaggctatgctgatggagagaggttcatatgaatacaaataacttatttcctttaccacccaacctagtacctgtgta

SEQ ID NO: 24235 - DNA, 201 bp, Homo sapiens
gactcctattttcacattggggaagacctccacctgacctttcatttaaggacttaaggcgtgggcattattgaatgctctgctttcttccagtttcaaaycgccactgtcaccgaaaaaggtgttgaaatagagggaccattgtctacagagaccaactgggatattgcccacatgatcaggtgagtaatagggaaaaaa

SEQ ID NO: 24236 - DNA, 201 bp, Homo sapiens
ttgagggtgaaagtgagaccgagtctttctatggctttgaagaagctgacctagatctgatggagatttgagtgttggggtcatgagggggtgtggagtgrgggtgggaacatgtgagggagggtaaaggggcttagggaaaagggggcataccaggtggggtatttggtttctattttttaattttataccaccactccc

SEQ ID NO: 24237 - DNA, 201 bp, Homo sapiens
aggttcatatgaatacaaataacttatttcctttaccacccaacctagtacctgtgtagtatctcttctgtctcttctccccaagtgaatcccactttaastcagaccccatggtccccttcttcagctaagatgaacctaaggtgaaatgagttttgacccattgtgtcctgttagcttcctcggttatgtggacatgct

SEQ ID NO: 24238 - DNA, 201 bp, Homo sapiens
tgcgagtcaacaacagtaccatgctgggtgcctctggcgactacgctgatttccagtatttgaagcaagttctcggccagatggtgtaagtcatccagagracaggagagtggttcccaagtagagaggggagtcccctgttttttattcccttcgatgggatggggggacttgttgcagcgggggactgggagagttgtt

SEQ ID NO: 24239 - DNA, 201 bp, Homo sapiens
cctcatcaacatggctgctggaagtcgtctacaggaaaaagaaagaaatgacactgaaggatcacttccgcttccgttggcgcaagcgctttcattttttytgctaccgtgactaagatggaagcgtttttggggtcgcggtccggactttgggcggggggtccggccccaggacagttttaccgcattccgtccactccc

SEQ ID NO: 24240 - DNA, 201 bp, Homo sapiens
ctgtctcggtcgccacctaggattactgcatgttcagctacgacctcatcaacatggctgctggaagtcgtctacaggaaaaagaaagaaatgacactgamggatcacttccgcttccgttggcgcaagcgctttcattttttctgctaccgtgactaagatggaagcgtttttggggtcgcggtccggactttgggcggg

SEQ ID NO: 24241 - DNA, 201 bp, Homo sapiens
aaatggagggatggttttattttttccttcagttctcactgaatttctgtactttgaatttgctgcctatattttctttctcaagaagtttggagaggatwtgtgtcagaatcgcctacagtgttcattttaaaaattcaagctgggcatgatggctcatgccagtaatcccagcacttgggaggctgaggcaggaggttg

SEQ ID NO: 24242 - DNA, 201 bp, Homo sapiens
ccgatggcaacattaactcacctacaagaaatgctgacatgcaggaggagctaattgcctccctagaggagcaactgaagctgagtggggaacattctgaktcttccactccacgacccagatcatctcctgaagagacaattgagcctgaaagtcttcaccagctctttgagggtgaaagtgagaccgagtctttctatg

SEQ ID NO: 24243 - DNA, 201 bp, Homo sapiens
tcattttttctgctaccgtgactaagatggaagcgtttttggggtcgcggtccggactttgggcggggggtccggccccaggacagttttaccgcattccrtccactcccgattccttcatggatccggcgtctgcactttacagaggtccaatcacgcggacccagtaagttctcggcgctttcgtttgcgtagcgggag

SEQ ID NO: 24244 - DNA, 201 bp, Homo sapiens
atacttagggaagaatctgacaggaagaagcgcacaggggtgtgcacaaagaaaatgacatgaatctttatttttcactgccagcttcaaggaaagaaaaytttttctacaatttgcatgagggatttttttaattgtatgtactcatggttgtaaaccaaaacgtactgtaccgtacagagaaaaggagcaaaaaaccaa

SEQ ID NO: 24245 - DNA, 201 bp, Homo sapiens
ttctcttaatacttagggaagaatctgacaggaagaagcgcacaggggtgtgcacaaagaaaatgacatgaatctttatttttcactgccagcttcaaggraagaaaattttttctacaatttgcatgagggatttttttaattgtatgtactcatggttgtaaaccaaaacgtactgtaccgtacagagaaaaggagcaa

SEQ ID NO: 24246 - DNA, 201 bp, Homo sapiens
acccaacctagtacctgtgtagtatctcttctgtctcttctccccaagtgaatcccactttaactcagaccccatggtccccttcttcagctaagatgaayctaaggtgaaatgagttttgacccattgtgtcctgttagcttcctcggttatgtggacatgcttggtgtagcctatgaagccccttcgctggccactggt

SEQ ID NO: 24247 - DNA, 201 bp, Homo sapiens
catccagagaacaggagagtggttcccaagtagagaggggagtcccctgttttttattcccttcgatgggatggggggacttgttgcagcgggggactggragagttgttggaggtgggcgatctgtgtttgcaataaagtttttggcattaggtgtaaaatgggggaaggtgtggtaacttcttttggggatgggtggag

SEQ ID NO: 24248 - DNA, 201 bp, Homo sapiens
ggctcactgcaacctccatctcctgggttcaagcgagtctcctgcctcagccttccaagtagttgggactacaggcacgagcctggctaattttttttttktttttttgagatggagtcttgttttgttgtccaggttggcgtgatctcggcttactgcaacctccgcctcctgggttcaagcgattctcctacctcagcc

SEQ ID NO: 24249 - DNA, 201 bp, Homo sapiens
ctacaacctgccctcagctttcagcagccagacagcccacctgcctctggttctgccaccctgcaactccggagaaggccctgctatctcggctggctgarctgagaactgttctgggaaggagctgccccacttttccttcaaatcttgccccctgggtggccgtctgattccaggcagctctgagtggggactgaagct

SEQ ID NO: 24250 - DNA, 201 bp, Homo sapiens
atgggtgggggttctgtgggggtcctctggtaacgtctgttctctccaccataggagactcttcctggtttccaggagacgctggctgaggagctcagaaygtctctaaggaggatgatctcagaccctgtgtattttatggagaggtgcgtggctggggccctcccttgccccataggccatggcctttcctgtagtggg

SEQ ID NO: 24251 - DNA, 201 bp, Homo sapiens
ctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctgcctcagcttcctgagtagctgggactactg

SEQ ID NO: 24252 - DNA, 201 bp, Homo sapiens
tctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctgcctcagcttcctgagtagctgggactact

SEQ ID NO: 24253 - DNA, 201 bp, Homo sapiens
ctccgccagcaacccccggtgtccactgggtctgccacccattacccatacagcgtgcctctggtgaggaccctcccctggctgcccactttcctacgtcygtgcctgtgtctcagccttggtggctgattgagatcccagttcccttctgtgcctgagcctatgggtgggggttctgtgggggtcctctggtaacgtctg

SEQ ID NO: 24254 - DNA, 201 bp, Homo sapiens
ttctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctgcctcagcttcctgagtagctgggactac

SEQ ID NO: 24255 - DNA, 201 bp, Homo sapiens
ttctttcttttctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctgcctcagcttcctgagtagc

SEQ ID NO: 24256 - DNA, 201 bp, Homo sapiens
ctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctgcctca

SEQ ID NO: 24257 - DNA, 201 bp, Homo sapiens
ttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctgcct

SEQ ID NO: 24258 - DNA, 201 bp, Homo sapiens
tttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctgcc

SEQ ID NO: 24259 - DNA, 201 bp, Homo sapiens
ttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctgc

SEQ ID NO: 24260 - DNA, 201 bp, Homo sapiens
cagagtcagagacctcagagagccccttatcttgaccccttgttatcttgaggagaccaaggcccagagagggtcctggagtcttctaggaaccaggctgygtgactcccctgccttctttgccctccttccgtgtgacttgtcatttcatgggctgccaaggactcactgatgtgcctgggaagacttgctggaagcagg

SEQ ID NO: 24261 - DNA, 201 bp, Homo sapiens
cttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcctg

SEQ ID NO: 24262 - DNA, 201 bp, Homo sapiens
tgccaaggactcactgatgtgcctgggaagacttgctggaagcagggggtgccctgagtgggtaggcctcagatgggggttcactggttttgggtccttcsagtatggggctgagactgaaaagttgcagaagcagctggcttcggagaaggaaatccagatgcagctccaggaagaggtgagtctcgctgccggcttctg

SEQ ID NO: 24263 - DNA, 201 bp, Homo sapiens
aaaagttgcagaagcagctggcttcggagaaggaaatccagatgcagctccaggaagaggtgagtctcgctgccggcttctgcccccaccctggagagccrctggcccagagtggggaccccaggcccttggcagctacctgactctggagaggactagcaggaactgagtcttgtccgtttccaccccctccatgcctgg

SEQ ID NO: 24264 - DNA, 201 bp, Homo sapiens
caccccctccatgcctggcacagcccagcaggtgacagttccatcaaggtctgagtggtgtggagtgcagggacctgccctgggtcccccacatgacactyggagtccagaacctgggcctctggcctcagcctgagagcagataggcaggagtgctggactgggtgtgcctgggtcccagcagagcgtgtgggtgggttc

SEQ ID NO: 24265 - DNA, 201 bp, Homo sapiens
agggacctgccctgggtcccccacatgacactcggagtccagaacctgggcctctggcctcagcctgagagcagataggcaggagtgctggactgggtgtrcctgggtcccagcagagcgtgtgggtgggttcccagctgcaggacctgcgggagaagtacatggattgtgggggcatgctgattgagatgcaggaggagg

SEQ ID NO: 24266 - DNA, 201 bp, Homo sapiens
gcctctggcctcagcctgagagcagataggcaggagtgctggactgggtgtgcctgggtcccagcagagcgtgtgggtgggttcccagctgcaggacctgygggagaagtacatggattgtgggggcatgctgattgagatgcaggaggaggtgaagaccctccgccagcaacccccggtgtccactgggtctgccaccca

SEQ ID NO: 24267 - DNA, 201 bp, Homo sapiens
tgggttcccagctgcaggacctgcgggagaagtacatggattgtgggggcatgctgattgagatgcaggaggaggtgaagaccctccgccagcaacccccrgtgtccactgggtctgccacccattacccatacagcgtgcctctggtgaggaccctcccctggctgcccactttcctacgtctgtgcctgtgtctcagcc

SEQ ID NO: 24268 - DNA, 201 bp, Homo sapiens
gagtcccgcttgccactagttgcttctcggcagcccccacccctacgcgtggtccggcccggcggctggcgcaggttataaaggtcccgccgcagcagcgsacggcagactcgagatgcgcccgaggaggttgggccggtgctgcgcggggagccggctcggacccggggacccagcagcactcacctgtgcaccttcgcc

SEQ ID NO: 24269 - DNA, 201 bp, Homo sapiens
agctcccctcccgcgcggctctgagtcccgcttgccactagttgcttctcggcagcccccacccctacgcgtggtccggcccggcggctggcgcaggttayaaaggtcccgccgcagcagcggacggcagactcgagatgcgcccgaggaggttgggccggtgctgcgcggggagccggctcggacccggggacccagcag

SEQ ID NO: 24270 - DNA, 201 bp, Homo sapiens; identical to SEQ ID NO: 4019

SEQ ID NO: 24271 - DNA, 201 bp, Homo sapiens
cctaatgcactggccaccccagaccgtatgcacaacgttgggttggcagcttctacaccagggaaggcacccgaaaccccggcgcggcagctggggagggkctgcccccagccagggacccgcgagtgctggggcagccgcggctttgggcagaaccattctccggagatggagagggcagaaaaaatctttcgctcccat

SEQ ID NO: 24272 - DNA, 201 bp, Homo sapiens
acctgggactaaggcccagcgtggtccctttcctgactgtgtgtccttgggcaagtcatttgacctgtctgagcctgtctagaatggatttgttcctatgkcaagtagctgtggggtgggctatgaaggttaaatcatgcaggagggaggcagaagtgggtgttaaccctgttggtgtattccgtgcagggtcagggacat

SEQ ID NO: 24273 - DNA, 201 bp, Homo sapiens
aattgcttgaacctgggagacagagtttgcagtgagcctagatcacgccactgcaccccagcctgggcgacagagcaagactccatctcaaaaaaaaaaaaggtgggtctcctccaagcctgtcttctcttatttggggcaggcaagagggagccatgagctgccagagaccaggcacccagggctgggacagttcagagt

SEQ ID NO: 24274 - DNA, 201 bp, Homo sapiens
gcccttcttgccctgcttttcttactgtgctctgttccgtcaccactagctcccctcccgcgcggctctgagtcccgcttgccactagttgcttctcggcmgcccccacccctacgcgtggtccggcccggcggctggcgcaggttataaaggtcccgccgcagcagcggacggcagactcgagatgcgcccgaggaggtt

SEQ ID NO: 24275 - DNA, 201 bp, Homo sapiens
ctcccatcccaactcggagccatccggaacttgcactcgcccttcttgccctgcttttcttactgtgctctgttccgtcaccactagctcccctcccgcgyggctctgagtcccgcttgccactagttgcttctcggcagcccccacccctacgcgtggtccggcccggcggctggcgcaggttataaaggtcccgccgca

SEQ ID NO: 24276 - DNA, 201 bp, Homo sapiens
tgcaacctccatctcctgggttcaagcgagtctcctgcctcagccttccaagtagttgggactacaggcacgagcctggctaattttttttttttttttttgagatggagtcttgttttgttgtccaggttggcgtgatctcggcttactgcaacctccgcctcctgggttcaagcgattctcctacctcagcctcctgag

SEQ ID NO: 24277 - DNA, 201 bp, Homo sapiens
tcttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccctgcctcctgggttcaagtgattctcct

SEQ ID NO: 24278 - DNA, 201 bp, Homo sapiens
ctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccctgcc

SEQ ID NO: 24279 - DNA, 201 bp, Homo sapiens
ttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccctg

SEQ ID NO: 24280 - DNA, 201 bp, Homo sapiens
ttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaacccc

SEQ ID NO: 24281 - DNA, 201 bp, Homo sapiens
cttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaaccc

SEQ ID NO: 24282 - DNA, 201 bp, Homo sapiens
tttcttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgcaa

SEQ ID NO: 24283 - DNA, 201 bp, Homo sapiens
ctttcttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttggctcactgca

SEQ ID NO: 24284 - DNA, 201 bp, Homo sapiens
tttctttcttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttggctcact

SEQ ID NO: 24285 - DNA, 201 bp, Homo sapiens
tcaactctgggtactctgtgtgttaaatgtgtgatacacatgttaataaacttgtttgcttttctcttgtaatctgtcttttattacagagccccagccgwggacctaagatgggtagagaaaacactttccctcctctacagccctcaggtggcgggtagctcaaggtaatggtgtcaacaggcacaagaacaatgatgg

SEQ ID NO: 24286 - DNA, 201 bp, Homo sapiens
ctttctttcttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttggctcac

SEQ ID NO: 24287 - DNA, 201 bp, Homo sapiens
ctttctttctttcttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttggc

SEQ ID NO: 24288 - DNA, 201 bp, Homo sapiens; identical to SEQ ID NO: 4010

SEQ ID NO: 24289 - DNA, 201 bp, Homo sapiens; identical to SEQ ID NO: 4011

SEQ ID NO: 24290 - DNA, 201 bp, Homo sapiens; identical to SEQ ID NO: 4012

SEQ ID NO: 24291 - DNA, 201 bp, Homo sapiens; identical to SEQ ID NO: 4013

SEQ ID NO: 24292 - DNA, 201 bp, Homo sapiens; identical to SEQ ID NO: 4016

SEQ ID NO: 24293 - DNA, 201 bp, Homo sapiens
cggcagatctgcaccccctcagcgcccctctcctgggtctaccgcagtgccaggagaggggcggggggctgcgggagggcgctgtcccgcgcgctctgagyctgcgctggccgaccgggcttgcgtgcgatggaggggtgggtgggcgggcggagggggaagttttgcccactttttggttgcgggtatgggggcaaagtc

SEQ ID NO: 24294 - DNA, 201 bp, Homo sapiens
tggattgtgggggcatgctgattgagatgcaggaggaggtgaagaccctccgccagcaacccccggtgtccactgggtctgccacccattacccatacagygtgcctctggtgaggaccctcccctggctgcccactttcctacgtctgtgcctgtgtctcagccttggtggctgattgagatcccagttcccttctgtgc

SEQ ID NO: 24295 - DNA, 201 bp, Homo sapiens
ggagacgctggctgaggagctcagaacgtctctaaggaggatgatctcagaccctgtgtattttatggagaggtgcgtggctggggccctcccttgccccrtaggccatggcctttcctgtagtggggagggggtttgccctcacactctgaccttccacgcttccctatacccgcctcgttcactgcatcagcccctcca

SEQ ID NO: 24296 - DNA, 201 bp, Homo sapiens; identical to SEQ ID NO: 4023

SEQ ID NO: 24297 - DNA, 201 bp, Homo sapiens; identical to SEQ ID NO: 4025

SEQ ID NO: 24298 - DNA, 201 bp, Homo sapiens; identical to SEQ ID NO: 4026

SEQ ID NO: 24299 - DNA, 201 bp, Homo sapiens
tgctcttgtcccctggtttgtgcccgtgagtcaggttctggggcctgcacgctcgcccacccacctccacgcgcctcttgctgcggcagatctgcaccccytcagcgcccctctcctgggtctaccgcagtgccaggagaggggcggggggctgcgggagggcgctgtcccgcgcgctctgagcctgcgctggccgaccgg

SEQ ID NO: 24300 - DNA, 201 bp, Homo sapiens; identical to SEQ ID NO: 4007

SEQ ID NO: 24301 - DNA, 201 bp, Homo sapiens; identical to SEQ ID NO: 4009

SEQ ID NO: 24302 - DNA, 201 bp, Homo sapiens
caggaccagcctagacaacatggtgaaaccccacctctactaaaaagtacaaaaattagcctggcatggtggtgcccgcctataatcccagctacttgagrggctgaggcaggagaatcgcttgaacctgggaggtggaggttgcagtgagctgagatggcactactgcaatccagcctgggtggcagagcaagactctgt

SEQ ID NO: 24303 - DNA, 201 bp, Homo sapiens
tctttctttctttcttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttgg

SEQ ID NO: 24304 - DNA, 201 bp, Homo sapiens
ttctttctttctttcttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtcttg

SEQ ID NO: 24305 - DNA, 201 bp, Homo sapiens
ctttctttctttctttcttttctttctttctttctttctttctttcttttctttctttcttcttttctttcttttctttcttttctttcttttctttctttctttcttttctttctttccttctctctctctctctctctctctctctctctctttctttctttctttttttttttgagatggagtacagtgttgcagtct

SEQ ID NO: 24306 - DNA, 201 bp, Homo sapiens
acctcattttctttctttctttctttctttctttctttctttctttctttctttctttctttctttctttctttcttttctttctttctttctttctttctttcttttctttctttcttcttttctttcttttctttcttttctttcttttctttctttctttcttttctttctttccttctctctctctctctctctctc

SEQ ID NO: 24307 - DNA, 201 bp, Homo sapiens
agacctcattttctttctttctttctttctttctttctttctttctttctttctttctttctttctttctttctttcttttctttctttctttctttcttyctttcttttctttctttcttcttttctttcttttctttcttttctttcttttctttctttctttcttttctttctttccttctctctctctctctctctc

SEQ ID NO: 24308 - DNA, 201 bp, Homo sapiens
aacctggcaagacctcattttctttctttctttctttctttctttctttctttctttctttctttctttctttctttctttctttcttttctttctttctttctttctttctttcttttctttctttcttcttttctttcttttctttcttttctttcttttctttctttctttcttttctttctttccttctctctctct

SEQ ID NO: 24309 - DNA, 201 bp, Homo sapiens
gaacctggcaagacctcattttctttctttctttctttctttctttctttctttctttctttctttctttctttctttctttctttcttttctttctttctttctttctttctttcttttctttctttcttcttttctttcttttctttcttttctttcttttctttctttctttcttttctttctttccttctctctctc

SEQ ID NO: 24310 - DNA, 201 bp, Homo sapiens
ggaacctggcaagacctcattttctttctttctttctttctttctttctttctttctttctttctttctttctttctttctttctttcttttctttctttctttctttctttctttcttttctttctttcttcttttctttcttttctttcttttctttcttttctttctttctttcttttctttctttccttctctctct

SEQ ID NO: 24311 - DNA, 201 bp, Homo sapiens
gacccaggtgtccggagagcccagtttctgagcctggaggactgtgacccccttacctcaggctcctccaggggtaaaaaaaaaaaaaaaaaaaaaaaaaagccgggcgcggtggctgacgcctgtaatcccagccagcactttggcaggccgaggcgggcggatcactaggtcaggagttcgagaccagcctggccaaca

SEQ ID NO: 24312 - DNA, 201 bp, Homo sapiens
ggacccaggtgtccggagagcccagtttctgagcctggaggactgtgacccccttacctcaggctcctccaggggtaaaaaaaaaaaaaaaaaaaaaaaaaagccgggcgcggtggctgacgcctgtaatcccagccagcactttggcaggccgaggcgggcggatcactaggtcaggagttcgagaccagcctggccaac

SEQ ID NO: 24313 - DNA, 201 bp, Homo sapiens; identical to SEQ ID NO: 4024

SEQ ID NO: 24314 - DNA, 201 bp, Homo sapiens
gaagacttgctggaagcagggggtgccctgagtgggtaggcctcagatgggggttcactggttttgggtccttcgagtatggggctgagactgaaaagttkcagaagcagctggcttcggagaaggaaatccagatgcagctccaggaagaggtgagtctcgctgccggcttctgcccccaccctggagagccactggccc

SEQ ID NO: 24315 - DNA, 201 bp, Homo sapiens
tcccaccagggggatgggctgggtatttgaagccttggagctggtacctagctcccctctcccctggctgggacagaaccaggaggaaccatcagggtctrtgtggagacgggtgggggtgggcctggggggttggactttccagcccctcaaaagatgtcgctatctcccgcccaggtatgattttcgctacagtgagga

SEQ ID NO: 24316 - DNA, 201 bp, Homo sapiens
tgcttgccggcagggttgctggaactaattgagaacactgcccttagccctggtgggctgggaactgggaagccccactccctgcaccctgactcccattsctccctcccctaggatttcgcaggaggcattgctgcaccagcaccactgcccacagctggaagccttgcaggagaagctgaggctgctggaggaggagaa

SEQ ID NO: 24317 - DNA, 201 bp, Homo sapiens
gtgtcctaacctacctccgccagtcaaaaagatcacccaggaagacgtcaaagtgatgttatatttgctggaggaggtgtgtactgccttcctgatccagkcaagcccttattctagttttgtcctgtaggggtgggggtcttgtttatttcctgattggcagtctctctggggccccaggttagggtccttcttatggaa

SEQ ID NO: 24318 - DNA, 201 bp, Homo sapiens
gatgcccctaagctgtgagttcctgcctttgcacctgcaagtcctttctctgagcctcaatttcctcatttgttaagagggacacaggtgatgtgcttgcyggcagggttgctggaactaattgagaacactgcccttagccctggtgggctgggaactgggaagccccactccctgcaccctgactcccattcctccctc

SEQ ID NO: 24319 - DNA, 201 bp, Homo sapiens
cctaaaactcccaaatagctttccattggccaaaggataaaccccacccccttgcccactactgtggtctggcctgtgtgcactgttctgggccctccccstcccagtgtcttatgatggcctctgggcctttccagtcagcttggacccatgtttttccttctttgcctgggtgagcttcacttgccctgtggtcttagc

SEQ ID NO: 24320 - DNA, 201 bp, Homo sapiens
gccgcagcagcggacggcagactcgagatgcgcccgaggaggttgggccggtgctgcgcggggagccggctcggacccggggacccagcagcactcacctrtgcaccttcgccctcagccagtcccgctccggagccctctgcgcagccgcaggcacggggcactggacagagagtaggatcccgagccacctctggaacc

SEQ ID NO: 24321 - DNA, 201 bp, Homo sapiens
cactcaccctggtgccctgctcagtatcagtcaatgaacatttcttgaatggaagacctgagtgaggaatgcaaagccctgcaggacccactggcacagcrcagcagccgagggtgggggagacagaggcatctgggagggccagagctggtccctgaaggccaggggagccagggctgacctgtcctctgccctccccag

SEQ ID NO: 24322 - DNA, 201 bp, Homo sapiens
ctcggcagcccccacccctacgcgtggtccggcccggcggctggcgcaggttataaaggtcccgccgcagcagcggacggcagactcgagatgcgcccgargaggttgggccggtgctgcgcggggagccggctcggacccggggacccagcagcactcacctgtgcaccttcgccctcagccagtcccgctccggagccc

SEQ ID NO: 24323 - DNA, 201 bp, Homo sapiens
cgcttgccactagttgcttctcggcagcccccacccctacgcgtggtccggcccggcggctggcgcaggttataaaggtcccgccgcagcagcggacggcwgactcgagatgcgcccgaggaggttgggccggtgctgcgcggggagccggctcggacccggggacccagcagcactcacctgtgcaccttcgccctcagc

SEQ ID NO: 24324 - DNA, 201 bp, Homo sapiens
ctcctgtcctctgcacacgcaacaggtgcagggtgagtggctgcgtctgtttgtatgacccaggagactccattgcactgcctcctgggtagggggtgatragccagtctgaggctgtacttcccctggctgtctccattctaggcgccagggacccaggtgtccggagagcccagtttctgagcctggaggactgtgacc

SEQ ID NO: 24325 - DNA, 201 bp, Homo sapiens
tcccctggctgtctccattctaggcgccagggacccaggtgtccggagagcccagtttctgagcctggaggactgtgacccccttacctcaggctcctccrggggtaaaaaaaaaaaaaaaaaaaaaaaaaagccgggcgcggtggctgacgcctgtaatcccagccagcactttggcaggccgaggcgggcggatcacta

SEQ ID NO: 24326 - DNA, 201 bp, Homo sapiens
gggacccaggtgtccggagagcccagtttctgagcctggaggactgtgacccccttacctcaggctcctccaggggtaaaaaaaaaaaaaaaaaaaaaaaaaagccgggcgcggtggctgacgcctgtaatcccagccagcactttggcaggccgaggcgggcggatcactaggtcaggagttcgagaccagcctggccaa

SEQ ID NO: 24327 - DNA, 201 bp, Homo sapiens
tggtgaaacagaacagtgttttgatggaggagaacagcaagctggaagccctgctgggctcagccaaggaggaggtaaccgggtggggaggagaggatagsgggccaatctacacctgcctcatgccaggaccctctcctgtccctgcccactcccaacccatggctcctctctcttcctgccagattttatacctcagac

SEQ ID NO: 24328 - DNA, 201 bp, Homo sapiens
gaaaagcaacctgcaaggtggatgcaagccacaagctgctctgtgaacctgggcacctcacacagatgccactggcctgtgggtctctgaggggacccgcraatgggactgccaaattctctggtttgctccaggttattatagaaaattatttatatgaatagtaaaaataaaacacactttgtggcccccctgccaaaa

SEQ ID NO: 24329 - DNA, 201 bp, Homo sapiens
acggcagcagcaggaggtcgctcggctgcaggcccaggtgctgaagctgcagcagcgctgccggatggtgagtcgggtgtgtgtggaaccctcttgtcgtrgccccatgggaccctagcttccttcttcctgcctccactcggctccaccaggcctgaggtccctttctgtgtcagagtcagagacctcagagagcccctt

SEQ ID NO: 24330 - DNA, 201 bp, Homo sapiens
cagcagccgagggtgggggagacagaggcatctgggagggccagagctggtccctgaaggccaggggagccagggctgacctgtcctctgccctccccagyggaggccagccaacagatggctgagctgtcggaggtgctggtgctcaggctggaaaactatgaacggcagcagcaggaggtcgctcggctgcaggcccag

SEQ ID NO: 24331 - DNA, 201 bp, Homo sapiens
tttctctttgaaggaattatgagatgcccagaggggacacatccagcctaaggtaagcctgccaggggctcccctacaacctgccctcagctttcagcagscagacagcccacctgcctctggttctgccaccctgcaactccggagaaggccctgctatctcggctggctgaactgagaactgttctgggaaggagctgc

SEQ ID NO: 24332 - DNA, 201 bp, Homo sapiens
tacgtgccaggtggagcacccaggcctggatcagcccctcattgtgatctggggtatgtgactgatgagagccaggagctgagaaaatctattgggggttragaggagtgcctgaggaggtaattatggcagtgagatgaggatctgctctttgttagggggtgggctgagggtggcaatcaaaggctttaacttgctttt

SEQ ID NO: 24333 - DNA, 201 bp, Homo sapiens
aagctgttatttaattagccagtgaaaaactattaacaacttgtctattacctgttagtattattgttgcattaaaaatgcatatactttaataaatgtayattgtattgtatactgcatgattttattgaagttcttgttcatcttgtgtatatacttaatcgctttgtcattttggagacatttattttgcttctaatt

SEQ ID NO: 24334 - DNA, 201 bp, Homo sapiens
gccaaggagttcgaacctaaagacgtattgcccaatggggatgggacctaccagggctggataaccttggctgtaccccctggggaagagcagagatataygtgccaggtggagcacccaggcctggatcagcccctcattgtgatctggggtatgtgactgatgagagccaggagctgagaaaatctattgggggttgag

SEQ ID NO: 24335 - DNA, 201 bp, Homo sapiens
ccatctctaataaaaatacaaaaaattagctgggcgtggtggcagacgcctgtagtcccagctactcggaaggctgaggcaggagaatggcatgaacccargaggcagagcttgcagtgagccgagtttgcgccactgcactccagcctaggtgacagagtgagactccatctcaaaaaaataaaaataaaaataaaaaaa

SEQ ID NO: 24336 - DNA, 201 bp, Homo sapiens
agagccaggagctgagaaaatctattgggggttgagaggagtgcctgaggaggtaattatggcagtgagatgaggatctgctctttgttagggggtgggcygagggtggcaatcaaaggctttaacttgctttttctgttttagagccctcaccgtctggcaccctagtcattggagtcatcagtggaattgctgtttttg

SEQ ID NO: 24337 - DNA, 201 bp, Homo sapiens
gttctatgatcatgagagtcgccgtgtggagccccgaactccatgggtttccagtagaatttcaagccagatgtggctgcagctgagtcagagtctgaaasggtgggatcacatgttcactgttgacttctggactattatggaaaatcacaaccacagcaagggtatgtggagagggggcctcaccttcctgaggttgtc

SEQ ID NO: 24338 - DNA, 201 bp, Homo sapiens
ttcaccatgttggccaggctggtctcgaacccctgatctcaggtgatctgccttcctcggccgcccaaagtgctgggattacaagcgtgagccactgagcygggccaatttttgcattttacatagatgaattatatggtatgctaattatatcttaccaaaaattgaaaaaaaggaatagtactatcagccccaatgtgc

SEQ ID NO: 24339 - DNA, 201 bp, Homo sapiens
ctgatgagagccaggagctgagaaaatctattgggggttgagaggagtgcctgaggaggtaattatggcagtgagatgaggatctgctctttgttaggggrtgggctgagggtggcaatcaaaggctttaacttgctttttctgttttagagccctcaccgtctggcaccctagtcattggagtcatcagtggaattgctg

SEQ ID NO: 24340 - DNA, 201 bp, Homo sapiens
agcactttgagttttggtactacgtgtatccacattttacacatgacaagaatgaggcatggcacggcctgcttcctggcaaatttattcaatggtacackgggctttggtggcagagctcatgtctccacttcatagctatgattcttaaacatcacactgcattagaggttgaataataaaatttcatgttgagcagaa

SEQ ID NO: 24341 - DNA, 201 bp, Homo sapiens
tgactacagcctcaatgtcccaggcttaagtgatcttcccaacctcctgagtggctgggaccacaagtgtgtgccaccacacctgactaattttatttttyaattgttttgtgaagacagcatctccctatgtttcccaggctggtcttgaattcctgggctcaagccatcctcctgcctcggcctcccaaagtgctggga

SEQ ID NO: 24342 - DNA, 201 bp, Homo sapiens
ctggggtggaggtctctagggtgggaggctcctgagagaggcctacctcgggcctttccccactcttggcaattgttcttttgcctggaaaattaagtatrtgttagttttgaacgtttgaactgaacaattctcttttcggctaggctttattgatttgcaatgtgctgtgtaattaagaggcctctctacaaagtactg

SEQ ID NO: 24343 - DNA, 201 bp, Homo sapiens; identical to SEQ ID NO: 4103

SEQ ID NO: 24344 - DNA, 201 bp, Homo sapiens; identical to SEQ ID NO: 4104

SEQ ID NO: 24345 - DNA, 201 bp, Homo sapiens
gatacatctcagacaccactacattcagtagtttagatgcctagaataaatagagaaggaaggagatggctcttctcttgtctcattgtgtttcttctgaytgagcttgaatcacatgaaggggaacagcagaaaacaaccaactgatcctcagctgtcatgtttcctttaaaagtccctgaaggaaggtcctggaatgtg

SEQ ID NO: 24346 - DNA, 201 bp, Homo sapiens
ctggagagggactgccctgcacagctgcagcagttgctggagctggggagaggtgttttggaccaacaaggtatggtggaaacacacttctgcccctataytctagtggcagagtggaggaggttgcagggcacggaatccctggttggagtttcagaggtggctgaggctgtgtgcctctccaaattctgggaagggact

SEQ ID NO: 24347 - DNA, 201 bp, Homo sapiens; identical to SEQ ID NO: 4126

SEQ ID NO: 24348 - DNA, 201 bp, Homo sapiens
agagcacccaggactgtcatatggaagaaagacaggactgcaactcacccttcacaaaatgaggaccagacacagctgatggtatgagttgatgcaggtgygtggagcctcaacatcctgctcccctcctactacacatggttaaggcctgttgctctgtctccaggttcacactctctgcactacctcttcatgggtgcc

SEQ ID NO: 24349 - DNA, 201 bp, Homo sapiens
gatgggaggtctacacagacggagcaaccatgccaagtaggagagtataaggcatactgggagattagaaataattactgtaccttaaccctgagtttgcktagctatcactcaccaattatgcatttctaccccctgaacatctgtggtgtagggaaaagagaatcagaaagaagccagctcatacagagtccaagggtc

SEQ ID NO: 24350 - DNA, 201 bp, Homo sapiens
aggttcacactctctgcactacctcttcatgggtgcctcagagcaggaccttggtctttccttgtttgaagctttgggctacgtggatgaccagctgttcrtgttctatgatcatgagagtcgccgtgtggagccccgaactccatgggtttccagtagaatttcaagccagatgtggctgcagctgagtcagagtctgaa

SEQ ID NO: 24351 - DNA, 201 bp, Homo sapiens
caaggatctgcatttggacatgttaagtttgagattccagtcaggcttccaagtggtgaggccacataggcagttcagtgtaagaattcaggaccaaggcwgggcacggtggctcacttctgtaatcccagcactttggtggctgaggcaggtagatcatttgaggtcaggagtttgagacaagcttggccaacatggtga

SEQ ID NO: 24352 - DNA, 201 bp, Homo sapiens
tttccagatgagagataatggttcttgaaatccaatagtgcccaggtctaaattgagatgggtgaatgaggaaaataaggaagagagaagaggcaagatgrtgcctaggtttgtgatgcctctttcctgggtctcttgtctccacaggaggagccatggggcactacgtcttagctgaacgtgagtgacacgcagcctgca

SEQ ID NO: 24353 - DNA, 201 bp, Homo sapiens
cagatgtggctgcagctgagtcagagtctgaaagggtgggatcacatgttcactgttgacttctggactattatggaaaatcacaaccacagcaagggtaygtggagagggggcctcaccttcctgaggttgtcagagcttttcatcttttcatgcatcttgaaggaaacagctggaagtctgaggtcttgtgggagcagg

SEQ ID NO: 24354 - DNA, 201 bp, Homo sapiens; identical to SEQ ID NO: 4093

SEQ ID NO: 24355 - DNA, 201 bp, Homo sapiens
ggccacataggcagttcagtgtaagaattcaggaccaaggctgggcacggtggctcacttctgtaatcccagcactttggtggctgaggcaggtagatcayttgaggtcaggagtttgagacaagcttggccaacatggtgaaaccccatgtctactaaaaatacaaaaattagcctggtgtggtggcgcacgcctatagt

SEQ ID NO: 24356 - DNA, 201 bp, Homo sapiens; identical to SEQ ID NO: 4094

SEQ ID NO: 24357 - DNA, 201 bp, Homo sapiens
aaaagagaagagttaaagttgactttgttctttattttaattttattggcctgagcagtggggtaattggcaatgccatttctgagatggtgaaggcagakgaaagagcagtttggggtaaatcaaggatctgcatttggacatgttaagtttgagattccagtcaggcttccaagtggtgaggccacataggcagttcag

SEQ ID NO: 24358 - DNA, 201 bp, Homo sapiens
gcaggtgtgtggagcctcaacatcctgctcccctcctactacacatggttaaggcctgttgctctgtctccaggttcacactctctgcactacctcttcaygggtgcctcagagcaggaccttggtctttccttgtttgaagctttgggctacgtggatgaccagctgttcgtgttctatgatcatgagagtcgccgtgtg

SEQ ID NO: 24359 - DNA, 201 bp, Homo sapiens
gcctgttgctctgtctccaggttcacactctctgcactacctcttcatgggtgcctcagagcaggaccttggtctttccttgtttgaagctttgggctacrtggatgaccagctgttcgtgttctatgatcatgagagtcgccgtgtggagccccgaactccatgggtttccagtagaatttcaagccagatgtggctgca

SEQ ID NO: 24360 - DNA, 201 bp, Homo sapiens; identical to SEQ ID NO: 4099

SEQ ID NO: 24361 - DNA, 201 bp, Homo sapiens
atattgactgggagcagtatttcccaggcaaactgagtgggcctggcaagttggattaaaaagcgggttttctcagcactactcatgtgtgtgtgtgtggsggggggggcggcgtgggggtgggaagggggactaccatctgcatgtaggatgtctagcagtatcctgtcctccctactcactaggtgctaggagcactcc

SEQ ID NO: 24362 - DNA, 201 bp, Homo sapiens; identical to SEQ ID NO: 4117

SEQ ID NO: 24363 - DNA, 201 bp, Homo sapiens
atggtggaaatagggacctattcctttggttgcagttaacaaggctggggatttttccagagtcccacaccctgcaggtcatcctgggctgtgaaatgcamgaagacaacagtaccgagggctactggaagtacgggtatgatgggcaggaccaccttgaattctgccctgacacactggattggagagcagcagaaccca

SEQ ID NO: 24364 - DNA, 201 bp, Homo sapiens; identical to SEQ ID NO: 4119

SEQ ID NO: 24365 - DNA, 201 bp, Homo sapiens
acatgtgaggagaacaagctgatctgactgctctccaagtgacactgtgttagagtccaatcttaggacacaaaatggtgtctctcctgtagcttgttttyttctgaaaagggtatttccttcctccaacctatagaaggaagtgaaagttccagtcttcctggcaagggtaaacagatcccctctcctcatccttcctct

SEQ ID NO: 24366 - DNA, 201 bp, Homo sapiens
tgaggaaaataaggaagagagaagaggcaagatggtgcctaggtttgtgatgcctctttcctgggtctcttgtctccacaggaggagccatggggcactaygtcttagctgaacgtgagtgacacgcagcctgcagactcactgtgggaaggagacaaaactagagactcaaagagggagtgcatttatgagctcttcatg

SEQ ID NO: 24367 - DNA, 201 bp, Homo sapiens
ctatcactcaccaattatgcatttctaccccctgaacatctgtggtgtagggaaaagagaatcagaaagaagccagctcatacagagtccaagggtctttygggatattgggttatgatcactggggtgtcattgaaggatcctaagaaaggaggaccacgatctcccttatatggtgaatgtgttgttaagaagttagat

SEQ ID NO: 24368 - DNA, 201 bp, Homo sapiens
aaggagttcgaacctaaagacgtattgcccaatggggatgggacctaccagggctggataaccttggctgtaccccctggggaagagcagagatatacgtvccaggtggagcacccaggcctggatcagcccctcattgtgatctggggtatgtgactgatgagagccaggagctgagaaaatctattgggggttgagagg

SEQ ID NO: 24369 - DNA, 201 bp, Homo sapiens; identical to SEQ ID NO: 4105

SEQ ID NO: 24370 - DNA, 201 bp, Homo sapiens
ttagagccctcaccgtctggcaccctagtcattggagtcatcagtggaattgctgtttttgtcgtcatcttgttcattggaattttgttcataatattaakgaagaggcagggttcaagtgagtaggaacaagggggaagtctcttagtacctctgccccagggcacagtgggaagaggggcagaggggatctggcatcca

SEQ ID NO: 24371 - DNA, 201 bp, Homo sapiens
atttaaccaataatcttttgtatatttatacctgttaaaaattcagaaatgtcaaggccgggcacggtggctcacccctgtaatcccagcactttgggagkccgaggcgggtggtcacaaggtcaggagtttgagaccagcctgaccaacatggtgaaacccgtctctaaaaaaatacaaaaattagctggtcacagtcat

SEQ ID NO: 24372 - DNA, 201 bp, Homo sapiens
ccacagcaggatccgcacggggtttccacctcagaacgaatgcgttgggcggtgggggcgcgaaagagtggcgttggggatctgaattcttcaccattccwcccacttttggtgagacctggggtggaggtctctagggtgggaggctcctgagagaggcctacctcgggcctttccccactcttggcaattgttcttttg

SEQ ID NO: 24373 - DNA, 201 bp, Homo sapiens
agtgtctatggcccttgctttttatttaaccaataatcttttgtatatttatacctgttaaaaattcagaaatgtcaaggccgggcacggtggctcacccrtgtaatcccagcactttgggaggccgaggcgggtggtcacaaggtcaggagtttgagaccagcctgaccaacatggtgaaacccgtctctaaaaaaatac

SEQ ID NO: 24374 - DNA, 201 bp, Homo sapiens
aggacacaaaatggtgtctctcctgtagcttgtttttttctgaaaagggtatttccttcctccaacctatagaaggaagtgaaagttccagtcttcctggsaagggtaaacagatcccctctcctcatccttcctctttcctgtcaagtgcctcctttggtgaaggtgacacatcatgtgacctcttcagtgaccactcta

SEQ ID NO: 24375 - DNA, 201 bp, Homo sapiens
tcgtgcctgtggtagatggagacttcctcagtgacaccccagaggccctcatcaacgcgggagacttccacggcctgcaggtaactagtggctagctggcrtgaagctggctcctctgggtcccaacggtccctcccctccctgcagggacccaggcatgagggcttctccaggcccattcccagaagtcccagaagtcct

SEQ ID NO: 24376 - DNA, 201 bp, Homo sapiens; identical to SEQ ID NO: 4246

SEQ ID NO: 24377 - DNA, 201 bp, Homo sapiens
actgccctccgccggcggcggcgtgcacggcagcttcagacggatggggggctctcgagtcctgggggacgcgggctggcgagcctgtttgctggggctgsgctgggagcgtgcgcagctgatgggaacccgcgggcatcagcgctcggtgccagacattggatgagaaggggcagggttgggtggggagtggactaggca

SEQ ID NO: 24378 - DNA, 201 bp, Homo sapiens
gctgcctcaagaaagcgtcttccggttctccttcgtgcctgtggtagatggagacttcctcagtgacaccccagaggccctcatcaacgcgggagacttcmacggcctgcaggtaactagtggctagctggcgtgaagctggctcctctgggtcccaacggtccctcccctccctgcagggacccaggcatgagggcttct

SEQ ID NO: 24379 - DNA, 201 bp, Homo sapiens; identical to SEQ ID NO: 4249

SEQ ID NO: 24380 - DNA, 201 bp, Homo sapiens; identical to SEQ ID NO: 4248

SEQ ID NO: 24381 - DNA, 201 bp, Homo sapiens
ctggtagcctgccttcggacacgaccagcgcaggtcctggtgaaccacgaatggcacgtgctgcctcaagaaagcgtcttccggttctccttcgtgcctgwggtagatggagacttcctcagtgacaccccagaggccctcatcaacgcgggagacttccacggcctgcaggtaactagtggctagctggcgtgaagctgg

SEQ ID NO: 24382 - DNA, 201 bp, Homo sapiens
acaagtatggatgatacaggactgaggaacgggggacggctcaaaagaaatcaacatcgtctggggcatccaggtcccgatattccacaatggcccttggrtctccacgaaccatcctgtgaagtgagaggtacaggatgagagctgagggctcccaaaagggagtctgcaggcggcaacaaagcttgggcgtctgccctc

SEQ ID NO: 24383 - DNA, 201 bp, Homo sapiens
ccccgtcccctaggcctgctccagcccgtccttcttctttcttgctgggctccccaggctttcctgcctgctcctcctcctcctcctgctccaggatgcgragatcattctccgtgcctccttccatcttaatcacggctaccaacaaagggaacagaggtcatgaccccagggccctggctcctgtcaaccggcttctac

SEQ ID NO: 24384 - DNA, 201 bp, Homo sapiens
tccatctctattttttgggaaggggaggctcggcggaagccccgagttataattagcgccactcgggtttcctagttaatctccagcagcaccaccacccmccgctcagggcggcgggggctgggctaggagtgaccggcgggagaggggggagttcccacccggggaattttgatcctttggctggagatgccggaaccg

SEQ ID NO: 24385 - DNA, 201 bp, Homo sapiens
aaggctgatcgtacaaaaaattctcagagcttcataggacaaggtagtacaagtatggatgatacaggactgaggaacgggggacggctcaaaagaaatcwacatcgtctggggcatccaggtcccgatattccacaatggcccttgggtctccacgaaccatcctgtgaagtgagaggtacaggatgagagctgagggct

SEQ ID NO: 24386 - DNA, 201 bp, Homo sapiens
cgagcccccaggccccctccccaagttcccggctcctggctcggggcggggagcgccgaccttttctcggtctctactgccctccgccggcggcggcgtgyacggcagcttcagacggatggggggctctcgagtcctgggggacgcgggctggcgagcctgtttgctggggctgggctgggagcgtgcgcagctgatggg

SEQ ID NO: 24387 - DNA, 201 bp, Homo sapiens
ccattttacatctccattcccacaggtgtcctttcatccccaggagtgtcccacgtcaccttttctgcacccgtgccacctggacccctaaggggacggtmctctgccacactcccacatgcctctcctcccatgccacccgtctgtgtcgtggccggggatgcatgaccccttggccttgcgctaacttcaccagcctcg

SEQ ID NO: 24388 - DNA, 201 bp, Homo sapiens
accatgggtctattttctctttctctgcatccctcccctgatctcgtcctctctctgtccatggttccgggtctgtaactgttcatctctctggctctttstctgtccatctgtttctgtctacttgtctgtctgtgcctgtcgctccatcccacccccctctccctcacccccaggtgctggtgggtgtggtgaaggatg

SEQ ID NO: 24389 - DNA, 201 bp, Homo sapiens
gatcctttggctggagatgccggaaccgtagcagctgctgcccccaaaatagcgcccccgcccctgcagccggggatctccggagtcccgggaacgcaggmgtcccggctcgcccttcaggcggctctgcaaggccctcgagcccccaggccccctccccaagttcccggctcctggctcggggcggggagcgccgacctt

SEQ ID NO: 24390 - DNA, 201 bp, Homo sapiens
taggcaggatttgggggaccccgggacctgaggcttccacaccctgaatgcccagcccaccgccccccagggccccgggtctggccgacccaggagagcgrggctgcgccttcaggccgccgcaagctcccccagcggcgctgcccgtccgtgaggccgcgcccctgtcgggtggcctgttcgtggactgaggcttctggt

SEQ ID NO: 24391 - DNA, 201 bp, Homo sapiens
gcaggatttgggggaccccgggacctgaggcttccacaccctgaatgcccagcccaccgccccccagggccccgggtctggccgacccaggagagcggggmtgcgccttcaggccgccgcaagctcccccagcggcgctgcccgtccgtgaggccgcgcccctgtcgggtggcctgttcgtggactgaggcttctggtgcc

SEQ ID NO: 24392 - DNA, 201 bp, Homo sapiens
agtgaggaggagacgaggtagacatggagggggcggggcacagtggctcacccctgtaattccagccctttgggaggccaaggtgggaggatcccctgagrccaggagtttgagaccagactggacaacataacaagaccccgactcttaaaaagaaaaaaaatacaaaacttagccaggcacggtggctcgtgcctctag

SEQ ID NO: 24393 - DNA, 201 bp, Homo sapiens
aaggtgaggcaggaggattgcttgagcctgggaggttgaggctgcagtgagctatgatggcaccactgcactccagcctgagtggccctatctctggaaaaaaaaaaaaaaaaaaaaaagggagaccaagacaaaggagttggagctggattaagtcaaaccagtgatgattcactagcagtgacacattctctcacacac

SEQ ID NO: 24394 - DNA, 201 bp, Homo sapiens; identical to SEQ ID NO: 4251

SEQ ID NO: 24395 - DNA, 201 bp, Homo sapiens
aaaaaaaaaaaaaaagggagaccaagacaaaggagttggagctggattaagtcaaaccagtgatgattcactagcagtgacacattctctcacacacacaycagtttacctggatcgagaagaggacaatgaaatctagcattggatgggtgttgttaaaaaatgtgatgtttgtagacataggacccgtcctggttattt

SEQ ID NO: 24396 - DNA, 201 bp, Homo sapiens; identical to SEQ ID NO: 4252

SEQ ID NO: 24397 - DNA, 201 bp, Homo sapiens
ggcagggttgggtggggagtggactaggcaggatttgggggaccccgggacctgaggcttccacaccctgaatgcccagcccaccgccccccagggccccrggtctggccgacccaggagagcggggctgcgccttcaggccgccgcaagctcccccagcggcgctgcccgtccgtgaggccgcgcccctgtcgggtggcc

SEQ ID NO: 24398 - DNA, 201 bp, Homo sapiens
ggaggggagtgggagcccgccaggtgtaacccctctcttctccccctagcctcggaggctcccagcacctgcccaggcttcacccatggggaggctgctcsgaggcccggcctccccctgcccctcctcctcctccaccagcttctcctcctcttcctctcccacctccggcggctgtgaacacggcctcttcccctacgg

SEQ ID NO: 24399 - DNA, 201 bp, Homo sapiens
ggcctgttcgtggactgaggcttctggtgccctcactgcacgagctgggcccggcccagttccgggaagaggtgagggcagtggacccctgcggagcagaragggtgctcctctctgttccctgcatttgtctggatatgggtgtctgcctgatctctttcccctcctgcccgctggcctgtgtccttgtctctgcctgtc

SEQ ID NO: 24400 - DNA, 201 bp, Homo sapiens
cggtctctactgccctccgccggcggcggcgtgcacggcagcttcagacggatggggggctctcgagtcctgggggacgcgggctggcgagcctgtttgctggggctgggctgggagcgtgcgcagctgatgggaacccgcgggcatcagcgctcggtgccagacattggatgagaaggggcagggttgggtggggagtgg

SEQ ID NO: 24401 - DNA, 201 bp, Homo sapiens
tgccgggcggagctcgcgcctgcgtaatgaggcccgcaggcaggctagctggcacggcggaggggaggagaggggaggggaggggaggggaggggaggggmggggcggggcggggcgcggcggagcattgtgggagctcctcggtcggtgccggtcggtggctgcctattgcggcctgcggtgatcaacgaggcccgggga

SEQ ID NO: 24402 - DNA, 201 bp, Homo sapiens
cattcctgaagttagatctaagtatttactcacatttaatctactataaggaggtatgatgcttcttcaagtttggaagtcacccttgcctttactttccrgtttaatggattgagcttattttgaatatagtaaaataaaaattaatagcccacctgtattcaatttttaccatgtaccaagcactgtgttaccttcttt

SEQ ID NO: 24403 - DNA, 201 bp, Homo sapiens
agaaaatggacaacctgcaaaattacctttctaacagtataaagggaaattggaacataatgatttgattttcaccctattttgtatgttttctagtttartagtagaacccatggaaaactggctacagttgatgttgaattgggaccctcagcagagaggaggacctgttgaccttactttgaagcagccaagatgttt

SEQ ID NO: 24404 - DNA, 201 bp, Homo sapiens
agggtttcgctatgttgtccaggctggtctcgcactcctgacctcaggtgatctgcccgcctccacctcccaaagtgggattacaggcgtgagccattgcrtccagccctgatgcttatttgaaaaagaaaattatattcttagagctgattttttaaaaagtttatttagcaagctgtctcagtttgcttctctgtggtc

SEQ ID NO: 24405 - DNA, 201 bp, Homo sapiens
ggataattgcttgaattcaggaggtggaagttgtagtgagctgagagatcatgccactgcacatcagcctgcgtgacacagcaagactctgtctcaaaagaaaaaaaaaaaaaatagaactgtaagattcaacaatgtcatttcttggtatatatccaaaggattttaaagcaggcttgtgaagagatatttgcactccca

SEQ ID NO: 24406 - DNA, 201 bp, Homo sapiens
gggtagcttggccatagctatctgcatttatgtgtccttttgtatgcattactttggagataagtcattaaatctgatgctgattgtggttcatttcctcmgctgggttttgggaatatggtgtacagtcttggggcatgtgaaagtgtctgacactgatttaatctctccagcaagttgttgggctgtaagcagaagatt

SEQ ID NO: 24407 - DNA, 201 bp, Homo sapiens
tgggagagatgggagtttttatttctgtaaccagttacaggtagaaggcctggaaattaccgccagaccaactcaaaattacaaagtttttccgtagtttrtttatcttctaagctatatgtctatgtgtaagtttgcattcatctaaagacataagtgattaacttcttttaatctgtagctgaggtctgagtcttgaag

SEQ ID NO: 24408 - DNA, 201 bp, Homo sapiens
acttctcagaaggaagacttaaacatgaggtgccacatgatgatgttttggttaacaacaaattgtgtatactatggtagtcccataagattatactactrtatttttactatgtattttctatgtttacatgcacaaatacttaccattgtgttacagttgcctacagtattcagtacagtcacttgctgaacaggtatg

SEQ ID NO: 24409 - DNA, 201 bp, Homo sapiens
aggatcgcttgagccctggagatagaggttgcggtgagctgagatcatgccactgcactccagcctgggtgacagagtgagactctacctcaaaaaaaaawtttttttgttgttttttcctttatccacccatctgcacactggtataaatatatatatttttaagaaaaaagtcatctgtattcatttcctaagggttcc

SEQ ID NO: 24410 - DNA, 201 bp, Homo sapiens
tgaagtagcaggatcgcttgaggcccaggaggtcgaggctgcagtgagccaagattacactactgcacttcagcctgggttgacagagcaagactttcttaaaaaaaaaaaaaaaaaaaacccagagcagaaatgaaaaacctgtgaattagcagtgacaaatagtgaacagtaatattaattttttgttgataatttagt

SEQ ID NO: 24411 - DNA, 201 bp, Homo sapiens; identical to SEQ ID NO: 4277

SEQ ID NO: 24412 - DNA, 201 bp, Homo sapiens; identical to SEQ ID NO: 4279

SEQ ID NO: 24413 - DNA, 201 bp, Homo sapiens
aaggactgacttctaccatctatatcgtggtatatagcaaattttctgttgctgctgtcacaataaaagtaagaattagaaacacaactagacatacaaaccagtgattatgtggtttagaacagtgtttagtttccatagaggcaggctcctgggctactgttaacatggaggatcaaaatttttatacacagcctttct

SEQ ID NO: 24414 - DNA, 201 bp, Homo sapiens
agaactgccatttaactgtttgacatatgtcctaagaaggctcttaggataatgaagtaaatgggttatttgcagaatggatttggactcatccgtcagarttgtcagtaactaacatatgtggagttttgagtagtttttgatggaaaaaagtttgtcccctgtcatttcatgaatttgaaagtaatttatgaaatggta

SEQ ID NO: 24415 - DNA, 201 bp, Homo sapiens
atactgtcatgttcatgcagggaaaaaggcagaaagaaatatggcatctccttaaaattgcctgtgtaagtaattattaatgaattatttaatgtgacatkgagttgctattattccttgcaaaggggatttttatcagcatgaggtgggccctcttgaagacatgtatattttgcattgggatgacatccatgttccttg

SEQ ID NO: 24416 - DNA, 201 bp, Homo sapiens
taataaatttttgagatctattttataactttgtatttctaagattagacttttttcagtgttttaaatcagttttgcaagaactcagattccaagccctrtattttattaattcctactcttttgctaaaagctgaatgactatccatttctgttattttctcagcttaagatgtgccgtatccaaagccagtggctctt

SEQ ID NO: 24417 - DNA, 201 bp, Homo sapiens
tccagtaatcagagttgaaggaagtaaaatttaatactttacttacttttttgcctttattaaaggcatttaagttttttagcggatgttaatgtttacaratgtcaccacaatacaggtaatttccaatttgaagtgtagttgcttgcaaaagtatatctgacagacattttcaatgtattttctagaaggaacacatta

SEQ ID NO: 24418 - DNA, 201 bp, Homo sapiens
atcatctgcagccatttacctggtaagaaatggatgagaacttgggcatgcttaatgggaatggaaattttttcatttgtctttttttttctttctttaaktgtttaattgcctttgaaatatacaattaaatataattaaatggcaagaaatcttaatttgtgagaatcactttgtcaactgaggtagcttttgatttta

SEQ ID NO: 24419 - DNA, 201 bp, Homo sapiens
acttgagcatcagagtagatttgtacaaaatgtgaggtgaatttttcttttaactcaatgatttctgttacttcaaagtatattttaaactttatttaggrtctgggattcgatatttgcatgaaaacaaaattatacatcgagatctaaaacctgaaaacatagttcttcaggatgttggtggaaaggtaggtgaaacct

SEQ ID NO: 24420 - DNA, 201 bp, Homo sapiens; identical to SEQ ID NO: 4282

SEQ ID NO: 24421 - DNA, 201 bp, Homo sapiens; identical to SEQ ID NO: 4283

SEQ ID NO: 24422 - DNA, 201 bp, Homo sapiens
catgagatttgtcagccttttccagtttcaaatgctttttgcctctttttacttttatgagccttatcatgaaatttacatgccctcagtatggatttggwaattttattcccttgtattttattatgacttattttctcatttgaatattcttttagagtatagtaattaatgtgtggtcactattgcagcccagcaatt

SEQ ID NO: 24423 - DNA, 201 bp, Homo sapiens
tatcatgaaatttacatgccctcagtatggatttggtaattttattcccttgtattttattatgacttattttctcatttgaatattcttttagagtatartaattaatgtgtggtcactattgcagcccagcaatttgcagaacagatttttagatttctttctttttttagctgctcaacaaaccagaaaattgttgtg

SEQ ID NO: 24424 - DNA, 201 bp, Homo sapiens
tgaatattttgattcatgatgtgcctcttctagcaatggaatactgttctggaggagatctccgaaaggtagtgtggatgttttgagatgagagagagtamatcacaaactttagcaatgtttgaatcatgttaaatataataaactagaataagaatcggaaaaactatggtctgcttcctgttttgtaaataaagtttt

SEQ ID NO: 24425 - DNA, 201 bp, Homo sapiens
gagagtaaatcacaaactttagcaatgtttgaatcatgttaaatataataaactagaataagaatcggaaaaactatggtctgcttcctgttttgtaaatmaagttttattggaacacagccacattcatttctttacacattgtctatggctgctttcttatggctgcagaagtgagtagttttaacagagactatgtga

SEQ ID NO: 24426 - DNA, 201 bp, Homo sapiens
agtatattttagttaaggaagtttgcctcagtttctccagagttgtaaaggagcaggagagtagttgtctgtttcaagttgcattatccagtagaactttytgtgatgatgtagaaaccttctatatttctgttggccacatgaggttattgactacttgacatgtagctagtttggctagagaacgaattttgaataaat

SEQ ID NO: 24427 - DNA, 201 bp, Homo sapiens
aagatgttatttgcatttttcaccatgttgacattttcattgatggtgcaacataaaatggctttcaccttagtatgaatcaaggcactagcgccaaactrtgctagtagccgttatattttttaccaccatgcagtcacagtttttaaaaaatgacagtttcacttacaaatgtccttgataaagcagtaaaaatattat

SEQ ID NO: 24428 - DNA, 201 bp, Homo sapiens
tagtcaatgaagaaagggtccaaggacaggttactaatggtgtgtaaaggtgggaatagttttgtactgaaatactctggttgtgcatataagtagtaacrgaaatgtaagtcttaggaatatgataagaaattgtgtgaatcaacagagatgcttgcctgtaatcttttgatgtttttttcttttccttcagacacagag

SEQ ID NO: 24429 - DNA, 201 bp, Homo sapiens
aaaggatgcatgctggcagcttttgtgacttcttttcttggtccctgggtggggatggatgaattaatcactttttgttttattatggtaaagtatacatkacacaacatttatcactttatttttaagtgtacagttaggtggcattaagtacattgacgttgttgtacagccataaccctatctccagaatattccgac

SEQ ID NO: 24430 - DNA, 201 bp, Homo sapiens
gaaacaagaactgccatttaactgtttgacatatgtcctaagaaggctcttaggataatgaagtaaatgggttatttgcagaatggatttggactcatccrtcagagttgtcagtaactaacatatgtggagttttgagtagtttttgatggaaaaaagtttgtcccctgtcatttcatgaatttgaaagtaatttatgaa

SEQ ID NO: 24431 - DNA, 201 bp, Homo sapiens
cagcccggtcaacatggcaaaaccccatctctactaaaaatacaaaaattagccaggtgtggtggcgggtgcctgtaatcccagctacttgggaggccgarggaggagaattgcttgaacccgggaggcggaggttgcggtaagctgagatcataccactgcactccagcctgggcgactccgtctctaaataaataaata

SEQ ID NO: 24432 - DNA, 201 bp, Homo sapiens
taataatcttttcctgttgcttatttatttatttattttgagacagggtctcactctgtcacctaggctggagtgcagtggcatgtttttggctcactgcmacctgcgcctcccaggttcaagcgattctcttgcctcagcctcccgagtagttgggactaaaggtgtgcaccaccatgcccagctaatttttgtattttt

SEQ ID NO: 24433 - DNA, 201 bp, Homo sapiens
gtttgttatttttaaatgaattaagacacgagtatttttaaatttctgtttaattcctgaaaaaccctttggggttctcaagaattttctagtgtaaaggkgtcctgagaccaaaaagtttgagaactgcttatctagactattctcagaagcttggctgctcaggaaagaagagaggtgggtgagtagctaaaagttgat

SEQ ID NO: 24434 - DNA, 201 bp, Homo sapiens
gagtcatactaccagcatttctgttttcttttataaaacaaatcctttttaggaaacaaatacttgtttcctaaaaacatatacttgtcctgagcaaactmtgtgtatctcagagtaaacaatcaatagtgtccagttgggtgaatgaatttactctccagaactggttttattaatattattgatattttatttctattt

SEQ ID NO: 24435 - DNA, 201 bp, Homo sapiens
gggcatgtatcaggttcttagtaaattatttattgatatgaatgagagctatagatagttctattatgcagtgtacccagaaacaactctcatcaatagtstttacatttgtattgattgtttgtagtatacaggtttctaaaattgaaatgagaaattataatcatgtaatgttggagtacatggcgagatagctcactt

SEQ ID NO: 24436 - DNA, 201 bp, Homo sapiens
aaaaaaggaagcaacaaaacagttactgaaatatttcccttttgaaaaaatagcttagcaagtctgattgtatgcatattttccaactgtttattatgaayatctttagatatgtagaagagttgaaagaagtgtactgaacctaccactaaaaataatgatgaaacagtagcatttaattattatttttttttgcctcct

SEQ ID NO: 24437 - DNA, 201 bp, Homo sapiens
caaatttatcttttgaatatcttaacaattttgagcttgccaggttctcaatttagaaaggcttgcatagttttctttcacttattgaataaagtccagascctttcattggtactcaaaacctatcttggtttcatatcaacttacactcctggacttatctcttactaatgccctgagaggccatcattttaggtacat

SEQ ID NO: 24438 - DNA, 201 bp, Homo sapiens
tgtgtaaaagtagatgtccattataggattttctattgctataagtggcagctgtcatagtgtgaaatctgcctaaattgggaaggcatggaaagtctcargtagtataattgtattgcaaatccgtatcagttttgaagatttccctactccccttttaaacataaagatttatattaaagaaaagtctcttaataagag

SEQ ID NO: 24439 - DNA, 201 bp, Homo sapiens
ctttaggtgagagtgataaaacggttcttacttgatttggggcccttaagcaggttgctgctctgggattaggttgtcttataaaaaggtaactcaccacscataacaatgctttttcctgtttaaagagagacctagttcttctatcagatgatttcttaaggcagcatgaagtagccagacacaaaaagagttaagatc

SEQ ID NO: 24440 - DNA, 201 bp, Homo sapiens
cttacaaaagagacctgaatgagatccctcatcccttctgcatgtgaggacagagcaagaagatggtcatctaggaaccagaaagcaggccctcaaatctrccttgttcttggacttcccagcctccagaactataagaaataaatttctgttgtttttatggcacttagtctatggtattttgttatagtagtccaaatg

SEQ ID NO: 24441 - DNA, 201 bp, Homo sapiens
acatctcgcatttgtttcatacttgtcataggaatcatagcatagtttctgctctgaagggcatctgtgagcctcttgttatagggcacggggaaagagtmcacattatggagtttatagtttacagactttaattcagtttgcagcaccactatttacctatctgtgaacctgagcaaatgtctctctatctcaaggaca

SEQ ID NO: 24442 - DNA, 201 bp, Homo sapiens
ggttactataaactactgatttgttaaaacttgaggaaattaccataaaatgtctactgaatcaatttttcctgcatttagtcttaatgtcaattctgtayatttcctctttcattaagaaaaatagcagtggccaggcatggtggctcacgcctgtaatcctagcactttgggaggccaaggcaggtggattgcttgagc

SEQ ID NO: 24443 - DNA, 201 bp, Homo sapiens
tatatatgagagagagttctgaaaagacctgttataaaatcagtttcaggcacttttcccttgtatgctgttgtgtgtttgaaggtcagttttaaagcatkggtgtaatagtctcatggtttatctttttaaaaagcattgcctcaagagagctgtggataaatatatttaattagtaaagctaaaaagttttgttgtctt

SEQ ID NO: 24444 - DNA, 201 bp, Homo sapiens
gctgcggccgggcgcgggcgggccctgggagatgcgggagcggctgggcaccggcggcttcgggaacgtctgtctgtaccagcatcgggtgaggcggggcrtgagagggagcggcggtgggttggagcggcggtgggtttgagcgtctgtggaacacagggctgacagtgtgggatagatggttggtgggaccttgggcag

SEQ ID NO: 24445 - DNA, 201 bp, Homo sapiens
ttcttcaactaaaatggtataagatgagtggatatatttggttttagtcaatgaagaaagggtccaaggacaggttactaatggtgtgtaaaggtgggaayagttttgtactgaaatactctggttgtgcatataagtagtaacggaaatgtaagtcttaggaatatgataagaaattgtgtgaatcaacagagatgcttg

SEQ ID NO: 24446 - DNA, 201 bp, Homo sapiens
ggctggagtgcaatggcacaatcttggctcactgcaacccccacctcccgggtacaagcgattctcctgtctcagtctcccgagtagctgggattataggygcacaccaccacgcccagctaatttttgcatttttagtagagacagggtttcaccgtgttggccaggctgctcttgaactcctgacctcaagggatctgc

SEQ ID NO: 24447 - DNA, 201 bp, Homo sapiens
tttatatcttttatcttaacccaatttttaatttaaatggagatgtttattaattaaaattagtttcagagtttcagggatttttgaggaattttttgttyggaggctgatatgttacagaagaaaggttatatccactgactgatgtcttttatagatcactcctacagtgacagcacagagatggtgaaaatcattgtg

SEQ ID NO: 24448 - DNA, 201 bp, Homo sapiens
ttactcaatacaatgctctgtgaaatacttgttggcaatatgaacttgctttaaaatgggttcattattcaaataaaatattgtttcaagttgtagattaytgaagtcattaaattaccttcacttatcagagcgtgttttctcttttatagggaacagcgtgccattgatctatataagcagttaaaacacagaccttca

SEQ ID NO: 24449 - DNA, 201 bp, Homo sapiens
taagtcttcttagatataatgctaacttaacaaaaatgaagaacactttgatctcagcatcacaacaactgaaagctaaattggagttttttcacaaaagyattcagcttgacttggagagatacagcgagcagatgacgtatgggatatgtaagtgtctgtgtaatgtatttgaaaggagcatctggtttcttgaagcca

SEQ ID NO: 24450 - DNA, 201 bp, Homo sapiens
agggctgacagtgtgggatagatggttggtgggaccttgggcagtatttgggggccagtgggcttgtgtgtgtgtattagagagaaagatactatgcctgygtgtccaaagttgtatttgaggtactgggcatagatagagctgttgcggggaacttgggtatgactgtcaggctgtgaccaggtgtttagtgagtgtgac

SEQ ID NO: 24451 - DNA, 201 bp, Homo sapiens
atggaataagaggataaaaaggttgaagatgttaacaaatagtgatttaagtgatagaagttgtagctagagtaaaatattaaaatctaagatttcaaatrgagcaagtccaattctttttctttaatcaatatttctgggccaggcgtcgtggcacatgcctgtaatcccagccactttggaggctgaggcaggagaatt

SEQ ID NO: 24452 - DNA, 201 bp, Homo sapiens
attttttccccttatcctgtacatttgtccacggtcctaagttattacactccttaatgtcagtacttaccctgaggatgtgggtggggatacccatggtrtcctggggtgggaaatccaagttctttatctttttgtgtccctattcaaggtagtggggaccagggggcagtcaaaatcatagagccaagatacaagtaa

SEQ ID NO: 24453 - DNA, 201 bp, Homo sapiens
gttggccttttttggtttttaataaaagcatttatttcataggagtgttaagaattttccaagtataactaagttacaaactatttccctactcattatayctctggtccaaggtattgactcttaaatgccctaaaacttgaaattttttctgaattaaagttctggattaaaaacttcagatattttctcgaattatag

SEQ ID NO: 24454 - DNA, 201 bp, Homo sapiens
aggaatctattttttatctccacaagtttgccttttctgaacattccatataaatggaattatgtaatatatagtcttgtgtctgactttttttacttgcyttgtatttttgaagcccgtgcatgttgtagcatgtatcagtacttcattcgttttgattaccgattagttttttcactgtatatatctttttgcatttgt

SEQ ID NO: 24455 - DNA, 201 bp, Homo sapiens
tgttctttgggttttggtgattgttcactttagcccatacaaaagtttgggtcttttttcctcaacaaaagtttggactctgttatctgtaagagatatgstaatacacattgattttgttcatttgcatttcaaagtaggaaatctggtgcataagtatttagaaaacctaggattttcaaagatccttgaacaggattt

SEQ ID NO: 24456 - DNA, 201 bp, Homo sapiens
tatgattagtagaaatggacttttggtgttgtgttctgtatctcatacttgaagtttctatatggagttatatgagaactctgaaaaatggatttatatartttggaaggtgaaaaggtagatattaaatctccatgagatcattcaagagaagatttactttcttgaggatagggctctcacaggagaatgaaacttcac

SEQ ID NO: 24457 - DNA, 201 bp, Homo sapiens
gtcctggccagtgaagccatccttaatgttcctgataagtctgactggaggcagtgtcagatcagcaaggaagacgaggagaccctggctcgccgcttccrgaaagactttgagccctatgactttactctggatgactaaaacaaagggaagaactttttatgaactccacaggaagtagtaaagctttttttttttttt

SEQ ID NO: 24458 - DNA, 201 bp, Homo sapiens; identical to SEQ ID NO: 4286

SEQ ID NO: 24459 - DNA, 201 bp, Homo sapiens
gttgtgtagttacgatgatccatataaacttgagcatcagagtagatttgtacaaaatgtgaggtgaatttttcttttaactcaatgatttctgttacttyaaagtatattttaaactttatttagggtctgggattcgatatttgcatgaaaacaaaattatacatcgagatctaaaacctgaaaacatagttcttcagg

SEQ ID NO: 24460 - DNA, 201 bp, Homo sapiens
gtgcctgattctcatttccatggtggtaaaggcctgcatgggacatagatataactggtcacctgctcataacaaaaggaagattgaagggagtgagaacygtgggtaggctagcatgcagtctatcctagtttccttcttctctatgcaccaggtatcatcttatctctagcttcttttttcctctcaccctccaattca

SEQ ID NO: 24461 - DNA, 201 bp, Homo sapiens
cctagtttccttcttctctatgcaccaggtatcatcttatctctagcttcttttttcctctcaccctccaattcacactaccctatccaagctatgtcttscttccccacctataatatattttttctgtcctggcccctgggctcttctctctgtattcatacacagcctttattacaactctggtttgtgtcagagatt

SEQ ID NO: 24462 - DNA, 201 bp, Homo sapiens
tttgattttcacttaaaaaaggaagcaacaaaacagttactgaaatatttcccttttgaaaaaatagcttagcaagtctgattgtatgcatattttccaaytgtttattatgaacatctttagatatgtagaagagttgaaagaagtgtactgaacctaccactaaaaataatgatgaaacagtagcatttaattattatt

SEQ ID NO: 24463 - DNA, 201 bp, Homo sapiens
agatatgtagaagagttgaaagaagtgtactgaacctaccactaaaaataatgatgaaacagtagcatttaattattatttttttttgcctcctctttcaygcccctaaatgtaactatattctgagtctcttcttggttctctctttttccattacatttcctttcttttattaggcagcctcttcaactgtatagcttt

SEQ ID NO: 24464 - DNA, 201 bp, Homo sapiens
acttcccaggctcaagcagtcctcccatcttagcctcctgtgtagctgggacaagaggtgcaccaccatgcctggctaacttttacattttttgtagagamggggtctcactatgttgtccaggcttgtatcaaactcctgggcttaagcaatcctcccacctcagcctcccatagagctgggattataggcatgagccac

SEQ ID NO: 24465 - DNA, 201 bp, Homo sapiens
tgtatgtaggagcacgaatgtgtgagaagagggctgaaggggactgcctttgggaatgtgtgcgtccgtgtgtgtgtgtgtgtgtgtgtgtgtgtgtgtgygcgcgcgcgcgcgcgcttggaggccatatgatatcagtggggactggagtagacaaggaaggcttcatgatgggtccagagttaagcctttggaagcatg

SEQ ID NO: 24466 - DNA, 201 bp, Homo sapiens
tgagtcctgactatccctttgtaataatcttaggcaacttacttgacttttttgatgttcatatttcctcacctgtaaaacaggaatgtctcatagaactkctgtggaaatttgattagacaatgtatataaagtgcttgggaaataaatgttcagcaaatgttgcgtattattagctcaaatgttgcttattattagcta

SEQ ID NO: 24467 - DNA, 201 bp, Homo sapiens
gagcccaggaggtcaaggctacagtgagctgagatcataccactgtactccagcctgggtgacaagagcaagaccctgtctgaaaaaaaaggaaagcatcttgatgccactaaactgtacacttaaaaatggttaaggtggtaaattttatgctatgtgtgttttaccacaatcaaaaaactatttcatttcagttaacaa

SEQ ID NO: 24468 - DNA, 201 bp, Homo sapiens
tcgccatgtgggcctcttcatggggaagcttgaatgttttcatgacatggaagctagctttccccagaaagatcttttcctcagaaagagtgagtgatctragagagagagagagagagagagagtgaacgagcgagcaagatgaaaaccgacgtatcttttatgatctttacttggaagtgagactccatccttttccac

SEQ ID NO: 24469 - DNA, 201 bp, Homo sapiens
tttccatttcagacctcaccacactgaactgtagttttgtgtttagtttttttgtcccttctgctaaacagtggttccatcagagaaggaacagcacctgctttttttttctttttcttttttttcatttttcatacttaacccagctcctagacttcacctgtcttgttcaagtctgtttttccatcatagtatctagca

SEQ ID NO: 24470 - DNA, 201 bp, Homo sapiens
ttagtgaaaatagttgttggcctcttggaggtgttggaaccttggtgatgcctcttctcttaggaacctttcacgtatgcttggcaccaaatatctctgctttttttttttttaatccaaagacttcaggacattcctgaagttagatctaagtatttactcacatttaatctactataaggaggtatgatgcttcttcaa

SEQ ID NO: 24471 - DNA, 201 bp, Homo sapiens
cttaacctttacctcatacaagaccagcttgtcactgctccttatgcctcaaacccgttatctacctttgtgctttgacagatgctatccttctgcctggdtatccatttctgtgtatcttctcacctacactggcatatctttaagagcttttctttaaatggtctctgccacaaaatttgtcatttaaaggctatattc

SEQ ID NO: 24472 - DNA, 201 bp, Homo sapiens
tctgctggaaagagtactggatggggaatcagaggcttgaattctagattgagtaatttactgaccgttacctcaggcaaatctgcgtttcccatttcctycttctgcaaaatggggttgaaacctaactttcctactcagtgagtatattgtgacagtgtatttaagaggatgtttgtgaaaatgctttgaaaactataa

SEQ ID NO: 24473 - DNA, 201 bp, Homo sapiens
atcagaggcttgaattctagattgagtaatttactgaccgttacctcaggcaaatctgcgtttcccatttcctccttctgcaaaatggggttgaaacctarctttcctactcagtgagtatattgtgacagtgtatttaagaggatgtttgtgaaaatgctttgaaaactataaactattatgtacttgcaagatattatc

SEQ ID NO: 24474 - DNA, 201 bp, Homo sapiens
tctgtgccctaatgtgcattatacttaaatgcatgttaaaaaaagatatacttttacactttaaaatttgtagacacatagcaacacatgcaaattaatayacatgtgaaattgtatttcatatactattttcacatttaaaaaataacattatctcctcttatactgcttttattttactgaaatgtattcagtttagtc

SEQ ID NO: 24475 - DNA, 201 bp, Homo sapiens
acatgtatgtatagcacttagcatgtctgaggaaatgcagtatgactggagtgtagagtttcaggagagagaaaacctaaatataggagagagagaaaacstaaatataggtttttttgtttgtttttaataaaaacatgttaatgggcaataggtttgttatttttaaatgaattaagacacgagtatttttaaatttct

SEQ ID NO: 24476 - DNA, 201 bp, Homo sapiens
ctttgatctcagcatcacaacaactgaaagctaaattggagttttttcacaaaagcattcagcttgacttggagagatacagcgagcagatgacgtatggratatgtaagtgtctgtgtaatgtatttgaaaggagcatctggtttcttgaagccatctgttattttgccttcttaactcagccagttgttttacttacct

SEQ ID NO: 24477 - DNA, 201 bp, Homo sapiens
tgcagggaggtcctggccagtgaagccatccttaatgttcctgataagtctgactggaggcagtgtcagatcagcaaggaagacgaggagaccctggctcrccgcttccggaaagactttgagccctatgactttactctggatgactaaaacaaagggaagaactttttatgaactccacaggaagtagtaaagcttttt

SEQ ID NO: 24478 - DNA, 201 bp, Homo sapiens
aaaaaaaaattctgactcccagttttctggctaatgaatcagataccacagatacacagtgatagcatttgtttaggttatattttttaaaactttgaggyagccctgtcaacataccatgaagctcagaaataaactgctacccaggtagcttctttgagtgtcaccttgagtgacaaactgtaacaagattgtgtctgt

SEQ ID NO: 24479 - DNA, 201 bp, Homo sapiens
cttctcacatgactgctgtgaggattaaatgggaaaattataagcagagagtagcaaatattattattattgcatttaggcttaattattgtccaaagaawataccagcatgatgcataagcaactttcaactcctttagccattttctgaaatataacaattaatgatttttttttaaaatcgaggtcacattttaaact

SEQ ID NO: 24480 - DNA, 201 bp, Homo sapiens
tacagatcattcttccagttatcacagcaatcttatatttaggtattattttgcaaatgaggaagttgaagcttatagaatcacatagctggtggttggtraagtgtggatttgaaataaatactttctgactctaatatctgtgcttaattccattttgattctcaaacttggttatgtggcagaatcaccaggaaagct

SEQ ID NO: 24481 - DNA, 201 bp, Homo sapiens
cggataaacatgaaattccaagcaacctagttcaagggcctccttcctttaggtaatgaaagtttgatgaattgtcctactgtttctaaatatgtggttartcatccaagaaaaattgttcccttggccagaggctgcatttgtgtctagggcttgggttagtatgggttaaagatagccaagactattgttctcaagcac

SEQ ID NO: 24482 - DNA, 201 bp, Homo sapiens
gcaaaatacagcttccaattatacagctgcgtaaagtgtgggctgaagcagtgcactatgtgtctggactaaaagaagactatagcaggctctttcagggrcaaagggcagcaatgtaagtggattctgttgtttataagcacaatgcaatgtgcatcatatactcaagaattaatcttgccggttttcactaatcaatat

SEQ ID NO: 24483 - DNA, 201 bp, Homo sapiens
gttttattatggtaaagtatacataacacaacatttatcactttatttttaagtgtacagttaggtggcattaagtacattgacgttgttgtacagccatmaccctatctccagaatattccgacttttttgttgttgttgtacatctataaacttcccatagaatattctttgtgaaaaggtagaatttcacagagttga

SEQ ID NO: 24484 - DNA, 201 bp, Homo sapiens
ttataggtaatctttatatcttttatcttaacccaatttttaatttaaatggagatgtttattaattaaaattagtttcagagtttcagggatttttgagraattttttgtttggaggctgatatgttacagaagaaaggttatatccactgactgatgtcttttatagatcactcctacagtgacagcacagagatggtg

SEQ ID NO: 24485 - DNA, 201 bp, Homo sapiens
tctaacagtataaagggaaattggaacataatgatttgattttcaccctattttgtatgttttctagtttagtagtagaacccatggaaaactggctacasttgatgttgaattgggaccctcagcagagaggaggacctgttgaccttactttgaagcagccaagatgttttgtattaatggatcacattttgaatttga

SEQ ID NO: 24486 - DNA, 201 bp, Homo sapiens
gacaagagcaagaccctgtctgaaaaaaaaggaaagcatcttgatgccactaaactgtacacttaaaaatggttaaggtggtaaattttatgctatgtgtrttttaccacaatcaaaaaactatttcatttcagttaacaaaagtcagctagggccgggcgtggtggctcacacctataatcccagcactttgggaggcca

SEQ ID NO: 24487 - DNA, 201 bp, Homo sapiens
gctagctttccccagaaagatcttttcctcagaaagagtgagtgatctgagagagagagagagagagagagagtgaacgagcgagcaagatgaaaaccgaygtatcttttatgatctttacttggaagtgagactccatccttttccaccacattctgtttgttacagtgagtcactaagtacagcctacattcaagggga

SEQ ID NO: 24488 - DNA, 201 bp, Homo sapiens
gttgcctcttgcagagaccttttttggatgtagtgaccatggcccattttggccaccacttctgatcctggatgtatctttcagagctgcatatccggtcmccctcctctaccctactcggggcctcagagctgaggttcctgtctttacctgcagatttctctgaacaaaagaaaaggtaaactgatcagcggcccaggc

SEQ ID NO: 24489 - DNA, 201 bp, Homo sapiens
cggccaatgttcaacctttcatagccatcccaataggtctaagtcacagggaattttgaaatctgggttagaccacagagactttctctttgtggagggasggccacaagagataagggtttttgggcatacttgggtccatccacatcccaggcaagggtttttgggcatacttgggtccatccacatcccaggcctctc

SEQ ID NO: 24490 - DNA, 201 bp, Homo sapiens; identical to SEQ ID NO: 4287

SEQ ID NO: 24491 - DNA, 201 bp, Homo sapiens; identical to SEQ ID NO: 4288

SEQ ID NO: 24492 - DNA, 201 bp, Homo sapiens; identical to SEQ ID NO: 4290

SEQ ID NO: 24493 - DNA, 201 bp, Homo sapiens
ttaattttcccaagtgccaaatctggggttagattagggccagaactggaactaaaacacagatatcccgatgcccagttccacattcctcacacaccccyggtttaagaccccagtgccattaattcaggaataaaaggataagggatcagtgtctcagaaaatccaagctaaggatagttactgcctggcaaaccccta

SEQ ID NO: 24494 - DNA, 201 bp, Homo sapiens
aagtgatcagaccccaaccttcaagcccagatgactaggaaagtagtgggtggggagccatccagcatggtgctggaaagacacccgtgtggttctgttgyggtcttcttgcccttgacaacaaccccctgggagtggaatcattatccttttacagaaagggaggctagggctcagagaggtcaataaactgagtgggtc

SEQ ID NO: 24495 - DNA, 201 bp, Homo sapiens
aaccccgtctctgaattgctcacttcttcagaatctcctgtttcttctgttcgtctgaagttggcagccccatggacttctgtcgctggtcatacatcatyttttccaccatgctgcgagtctcactgtccaggtctgacagctgagggcaggcagtgacaggaatcggtgaagctctggaaacaacgaggcccctcacct

SEQ ID NO: 24496 - DNA, 201 bp, Homo sapiens
cagaaagggaggctagggctcagagaggtcaataaactgagtgggtcatccagccaggatcagactgacccaggctcaagtcccactctgctccttctcarcaggcttctccctggtcatgggatctggatgagctccttcccctgagcctgtttcctcctctcctctccttcctaccagggtacccagcaagccatgact

SEQ ID NO: 24497 - DNA, 201 bp, Homo sapiens; identical to SEQ ID NO: 4289

SEQ ID NO: 24498 - DNA, 201 bp, Homo sapiens
gaggccatgggtctggctctatgatgccagaccggatagtgggaggtacagggctctggccctggcactactctaagttagggaaggattggagttagtasccaaacacagtcctttcctgagtctctggatatttttcctatttgtcaactatatgccaggcaccatcttagacactaaggatgaaggaagccaaatggt

SEQ ID NO: 24499 - DNA, 201 bp, Homo sapiens
ctgcaacctccacctcctaggttcaagcaattctcagcctcagcctcctgagtagctgggattacaggcacataccaccacatctggctaattttttgtakttttagtagagacgggtttcaccatattggccaggctggtcttaaactcctggcctcatgtgatccgcctgccttggcctcccaaagtgtgattacaggc

SEQ ID NO: 24500 - DNA, 201 bp, Homo sapiens
ctagtggacagcaagaatttcgatgactacatgaagtcactcggtgagcaagccgcggggctcaggatgttggcttggggactggctggtggcgtgcctakccccacgcagcactcctgccgcatccctcctggttaagactggggaataggggagcgcggagatggcagcctggcctagagcaggtggggcctgttcaga

SEQ ID NO: 24501 - DNA, 201 bp, Homo sapiens
gagcaagccgcggggctcaggatgttggcttggggactggctggtggcgtgcctagccccacgcagcactcctgccgcatccctcctggttaagactgggsaataggggagcgcggagatggcagcctggcctagagcaggtggggcctgttcagagggggctttggtggtccaaatctggttagagaccacggtagggag

SEQ ID NO: 24502 - DNA, 201 bp, Homo sapiens
aaactcctggcctcatgtgatccgcctgccttggcctcccaaagtgtgattacaggcgtgagccaccacacttggcccaatagtagcttattctaatcccwgctctgccactgacttgctatggcactgctgttccttaagtatctctcatctaatgggatcagttatctgtgttcaccaaacagaactaagcgcaagact

SEQ ID NO: 24503 - DNA, 201 bp, Homo sapiens
atggtataagggaaggaaaaacactcaggatcttgaccaaattacttcctctctaaaggctcgttttttccaaatctctaaaataagaattacaatgcctrtcttaaggatttgctgtgcatatcagaaaaaaaaaattatgtatgtatacacacacacacacacacacacacacatacatacatatagccggcacatagt

SEQ ID NO: 24504 - DNA, 201 bp, Homo sapiens
ccctgcgagtgggaagaaaagtagaaactgcttagctaatgattgacctcagcccttcttctactgctttgggcttagatggagaggtcaaagctctcaayggcctctaccctatcttgggcgctatgcccagtaattctaggcaggcagtcattcttagaggagcagcccccagcccccacgaacacagcccagcagcta

SEQ ID NO: 24505 - DNA, 201 bp, Homo sapiens
gaggctggaggtgaactagatgtcttgcagggatagctgggaggcggattgcctgagctcttgtcctcacaccatcactagtttgggtcaaaggctgtgtsctctgtggcccagtgtccagaccccaccctgcccctcaattcctgactaagatcacagctcaggcctctaccctctttccacagtccattgtgacactgg

SEQ ID NO: 24506 - DNA, 201 bp, Homo sapiens; identical to SEQ ID NO: 4291

SEQ ID NO: 24507 - DNA, 201 bp, Homo sapiens
ttccccctaccctcaggtgtgggttttgctaccaggcaggtggccagcatgaccaagcctaccacaatcatcgaaaagaatggggacattctcaccctaaraacacacagcaccttcaagaacacagagatcagctttaagttgggggtggagttcgatgagacaacagcagatgacaggaaggtcaaggtaagtcaggga

SEQ ID NO: 24508 - DNA, 201 bp, Homo sapiens
gatgcgagggctatttaaagcggcagcccgggcagggagccgccgtcggagcccttgcacgcctgctctcttgtagcttctctcagcctagcccagcatcrctatggtggacgctttcctgggcacctggaagctagtggacagcaagaatttcgatgactacatgaagtcactcggtgagcaagccgcggggctcaggat

SEQ ID NO: 24509 - DNA, 201 bp, Homo sapiens
aagcctgtccctatagctttggcagaaatgagcctctgagtcttctggcaactggaccgtccaaaggaatcaagatcttagggtggggagagggctcttcytccctggccttgttctcagaacagtccagggaagggaggcagggtttgcacatggagaaacagagtcccaggaaggagggcctgccatactctacgcacg

SEQ ID NO: 24510 - DNA, 201 bp, Homo sapiens
ggtggcccgtgggtgtctggcaggggtctgagtcctccaaagcgatcatgaggggccctggtggctccgggacacataggatgttctgtataccccccagratataacatcccagcagtctctgctggaaagcccatttggtcacgtcctgactgaggcttggagctgcggggagaaatccgtctgtctcctggtccctcc

SEQ ID NO: 24511 - DNA, 201 bp, Homo sapiens
gccaagactgcctgttcctgaggccgctgtcccatgacccccccaccgccttacagtgttcctggctcctcagcaagcacggtcgctgctccagcgggtcyggcgagccaacaccttcttggaggaggtgcgcaagggcaacctggagcgagagtgcgtggaggagacgtgcagctacgaggaggccttcgaggctctgga

SEQ ID NO: 24512 - DNA, 201 bp, Homo sapiens
ctgcttggcttgctctgcagactgtgggctgcgacctctgttcgagaagaagtcgctggaggacaaaaccgaaagagagctcctggaatcctacatcgacrggcgcattgtggagggctcggatgcagagatcggcatgtcaccttggtgtgtcctggagccctgcgctaccattcactcctgggggcaggtgtgctgctg

SEQ ID NO: 24513 - DNA, 201 bp, Homo sapiens
tactgatgtgaccttgaacttgactctattggaaacctcatctttcttcttcagagcccctttaacaaccgctggtatcaaatgggcatcgtctcatgggstgaaggctgtgaccgggatgggaaatatggcttctacacacatgtgttccgcctgaagaagtggatacagaaggtcattgatcagtttggagagtagggg

SEQ ID NO: 24514 - DNA, 201 bp, Homo sapiens
ggggtaaagaatttgtgccgattaccagtccacaaacatgggttagtgtttgttctctaggcatccctgtcgggcccattgctcattcctggggttggtctttttttttttttctttctaagatggagtctcactcccttgcccaggctgttggagtgcagtggccctatctcagctcactgcaacctccgcctcctgggt

SEQ ID NO: 24515 - DNA, 201 bp, Homo sapiens
ccatgttggccaggctgatctcaaactcctgaccttgtgatcctcccgcctcggcctcccaaactgctgagattacaggggtgaggcactgcgcccggccwtttttttttttttttttgagatggagtctcactctgtcacccaggctggagtgcagtggcataatcttggctcactgcaacctccacctcctgggttcag

SEQ ID NO: 24516 - DNA, 201 bp, Homo sapiens
tgtgatcctcccgcctcggcctcccaaactgctgagattacaggggtgaggcactgcgcccggccttttttttttttttttttgagatggagtctcactctgtcacccaggctggagtgcagtggcataatcttggctcactgcaacctccacctcctgggttcaggcgattctctgcctcagcctctcatatagctggga

SEQ ID NO: 24517 - DNA, 201 bp, Homo sapiens
tgacaggctggggcaacctgaaggagacgtggacagccaacgttggtaaggggcagcccagtgtcctgcaggtggtgaacctgcccattgtggagcggccrgtctgcaaggactccacccggatccgcatcactgacaacatgttctgtgctggcaagtctgtgcagggcgggctgagggaacagtggggcccaagctggg

SEQ ID NO: 24518 - DNA, 201 bp, Homo sapiens
gtgatcctcccgcctcggcctcccaaactgctgagattacaggggtgaggcactgcgcccggccttttttttttttttttttgagatggagtctcactctgtcacccaggctggagtgcagtggcataatcttggctcactgcaacctccacctcctgggttcaggcgattctctgcctcagcctctcatatagctgggat

SEQ ID NO: 24519 - DNA, 201 bp, Homo sapiens
cctggcccaaaaccaggaaattaatgatgatacaatattattgtctaatctatagaccttattcaaatttttgttagtcttgctaatgtcttttatagggaaaaaaaaaaaaaaaagcgtgtttctcacccaggattcaatgaaggatctttctttgtcttctatgaccttgacatgtctgatgagtgcagtctggttatt

SEQ ID NO: 24520 - DNA, 201 bp, Homo sapiens
taccaatctgagaggtgagaaatagtatcttgaaattgttttaacggacatctttcaaattgaaaatgaggttgaacatcgtatcatatgattaaggaccttttttttttttttttttttttttgagatggagtctccctctgtcacctaggctggagtgcaatggcacgattttggctcactgcaacttccgccttctgg

SEQ ID NO: 24521 - DNA, 201 bp, Homo sapiens
tctattggaaacctcatctttcttcttcagagcccctttaacaaccgctggtatcaaatgggcatcgtctcatggggtgaaggctgtgaccgggatgggamatatggcttctacacacatgtgttccgcctgaagaagtggatacagaaggtcattgatcagtttggagagtagggggccactcatattctgggctcctgg

SEQ ID NO: 24522 - DNA, 201 bp, Homo sapiens
gtctgttccggtccatgtgtggtctcactcactctgctgcctccttgcccctcacccaccaggccaggatcaagtcactgtagcgatgactccacgctccraaggctccagtgtgaatctgtcacctccattggagcagtgtgtccctgatcgggggcagcagtaccaggggcgcctggcggtgaccacacatgggctccc

SEQ ID NO: 24523 - DNA, 201 bp, Homo sapiens
ctttgtcatgaaggtaagcttctctaaagcccagggcctggtgaacacatcttctgggggtggggagaaactctagtatctagaaacagttgcctggcagrggaatactgatgtgaccttgaacttgactctattggaaacctcatctttcttcttcagagcccctttaacaaccgctggtatcaaatgggcatcgtctca

SEQ ID NO: 24524 - DNA, 201 bp, Homo sapiens
tgtctgtgccctcagagagcttccttcctaggagggcacatccataaacagatctaaaacagcaatccctgaccagtgctgtgaagaaaaatgaagcacarggagagagaacggctgatgaagtgggcttctaaatagggtggccagacaaggtgggcagatcacttgaggtcaggagttcaagaccagcctggccaacat

SEQ ID NO: 24525 - DNA, 201 bp, Homo sapiens
tgggtttcaccgtgtcggccaggttggtctcgaacccctgacctcaagtgattcacccgcctcggcctcccaaagtgccgagaccacaggcgtgaacgtcygtgcccagccagctctggcgttttagattctggtctctaagaaatggcgttggggccaggcggctcctgtgggggttggctctcactaggcccttcttcc

SEQ ID NO: 24526 - DNA, 201 bp, Homo sapiens
attttttatttatatttatttatttactgacggagttccactcttgtctcccaggctggagtgtagttgtgcgatcttggctcactgcaaccccacctccygggttcaagcgactctcctgcctcagtctcctgagtagctgggattacaggctaatttttgtatttttagtagagactggtgggtttcaccgtgtcggcc

SEQ ID NO: 24527 - DNA, 201 bp, Homo sapiens
gtagggggccactcatattctgggctcctggaaccaatcccgtgaaagaattatttttgtgtttctaaaactatggttcccaataaaagtgactctcagcragcctcaatgctcccagtgctattcatgggcagctctctgggctcaggaagagccagtaatactactggataaagaagacttaagaatccaccacctggt

SEQ ID NO: 24528 - DNA, 201 bp, Homo sapiens
tatttactccccaacccccatacacacgcacacacattgatgataaataagttgcaggcttgcagaaattgacccatccaggtgaacagcctagtgatccsagcaagcgtcctgctgtgcagctataaaaacatgactcctccagcagctccaggcagccactaccagttaattacagatggcctaggaggccaaacctgg

SEQ ID NO: 24529 - DNA, 201 bp, Homo sapiens
tgtgaggaggagacataacatttactaaaacaacacaaaacaggagctgccgtagcctcactcccagcccttgtttttcaggatgtgttctgggccaagtrcacaggtgagcaccgggaaggatttgccccaggaagggaggcctggggaccccagtgagagaattctacccagagaatcttctgctgcacctagccatcc

SEQ ID NO: 24530 - DNA, 201 bp, Homo sapiens
atattaatgtacttggcatagtatcagtcaccagtgagctcagatagcagcaagaggctgcgggtagggaaatgccattcattcagtcactcagcaaatayttattgagcgcctatcacgttccaggcagcgttctagggtatacagcagggacccagacggacaatgtctgtgccctcagagagcttccttcctaggagg

SEQ ID NO: 24531 - DNA, 201 bp, Homo sapiens
cctggggccgacctacaggagaatttctgccgcaaccccgacagcagcaccacgggaccctggtgctacactacagaccccaccgtgaggaggcaggaatrcagcatccctgtctgtggtaagctgggggcagtggggcggcccatggccaaggcccgggggcttcatggggcctggcagcctgggatgggaaccaagaat

SEQ ID NO: 24532 - DNA, 201 bp, Homo sapiens
ttggcttgctctgcagactgtgggctgcgacctctgttcgagaagaagtcgctggaggacaaaaccgaaagagagctcctggaatcctacatcgacgggcrcattgtggagggctcggatgcagagatcggcatgtcaccttggtgtgtcctggagccctgcgctaccattcactcctgggggcaggtgtgctgctggacc

SEQ ID NO: 24533 - DNA, 201 bp, Homo sapiens
acctctgttcgagaagaagtcgctggaggacaaaaccgaaagagagctcctggaatcctacatcgacgggcgcattgtggagggctcggatgcagagatcrgcatgtcaccttggtgtgtcctggagccctgcgctaccattcactcctgggggcaggtgtgctgctggacccccaccctcaggccctgcctgcaggcctg

SEQ ID NO: 24534 - DNA, 201 bp, Homo sapiens
gggttcttagacctgggattgttacttctagggctggtgtagaggcagccccctcatcctcagctcctaatgcttcctgctgcccctcccaggcaggtgaygcttttccggaagagtccccaggagctgctgtgtggggccagcctcatcagtgaccgctgggtcctcaccgccgcccactgcctcctgtacccgccctgg

SEQ ID NO: 24535 - DNA, 201 bp, Homo sapiens
agacctgggattgttacttctagggctggtgtagaggcagccccctcatcctcagctcctaatgcttcctgctgcccctcccaggcaggtgatgcttttcyggaagagtccccaggagctgctgtgtggggccagcctcatcagtgaccgctgggtcctcaccgccgcccactgcctcctgtacccgccctgggacaagaa

SEQ ID NO: 24536 - DNA, 201 bp, Homo sapiens
gaccgctgggtcctcaccgccgcccactgcctcctgtacccgccctgggacaagaacttcaccgagaatgaccttctggtgcgcattggcaagcactcccrcaccaggtacagaactggtggcccgtgggtgtctggcaggggtctgagtcctccaaagcgatcatgaggggccctggtggctccgggacacataggatgt

SEQ ID NO: 24537 - DNA, 201 bp, Homo sapiens
gataagtacactgaggccccaggaggttattgcctagtagcccaactgtgcatgcacgcttaacctctgcaccaaatggcctccaaggcccgtaggggaaytggggggatctaggggatgggtgaggaatggcccagcccagtcccagccggtgcctgggtcccaacagaggaggccgtggaggaggagacaggagatggg

SEQ ID NO: 24538 - DNA, 201 bp, Homo sapiens
agctgacacactatggcgcacgtccgaggcttgcagctgcctggctgcctggccctggctgccctgtgtagccttgtgcacagccagcatggtaagggagygcttgcaggctggaacaggctggaggactggggtgtgggcccatgggctggggtctcctggctggacagagcacacagagctggcccctaagtaggtctc

SEQ ID NO: 24539 - DNA, 201 bp, Homo sapiens
cgcatcactgacaacatgttctgtgctggcaagtctgtgcagggcgggctgagggaacagtggggcccaagctgggagaactgagttgtgcctgggttcargccatgtgactttgagcaagttgcctaacctcttggtggctcagtttcttcctctgtaaaatggaggtaaaagtctctatcccataaggttatgggaggg

SEQ ID NO: 24540 - DNA, 201 bp, Homo sapiens
aggtgatgcttttccggaagagtccccaggagctgctgtgtggggccagcctcatcagtgaccgctgggtcctcaccgccgcccactgcctcctgtacccrccctgggacaagaacttcaccgagaatgaccttctggtgcgcattggcaagcactcccgcaccaggtacagaactggtggcccgtgggtgtctggcaggg

SEQ ID NO: 24541 - DNA, 201 bp, Homo sapiens
attgttacttctagggctggtgtagaggcagccccctcatcctcagctcctaatgcttcctgctgcccctcccaggcaggtgatgcttttccggaagagtmcccaggagctgctgtgtggggccagcctcatcagtgaccgctgggtcctcaccgccgcccactgcctcctgtacccgccctgggacaagaacttcaccga

SEQ ID NO: 24542 - DNA, 201 bp, Homo sapiens
aggagctgacacactatggcgcacgtccgaggcttgcagctgcctggctgcctggccctggctgccctgtgtagccttgtgcacagccagcatggtaaggragtgcttgcaggctggaacaggctggaggactggggtgtgggcccatgggctggggtctcctggctggacagagcacacagagctggcccctaagtaggt

SEQ ID NO: 24543 - DNA, 201 bp, Homo sapiens
gagagaattctacccagagaatcttctgctgcacctagccatccacccatccaccccttccccactccttccttggtccctcccatctgttcatccatctytctgtttctcaccaacatcccatccaccctgactccagctcatcctggccataccccaatcccaaaggtaaacacctgggtcttttccagcttgtgagac

SEQ ID NO: 24544 - DNA, 201 bp, Homo sapiens
agacagggccatcgaagggcgtaccgccaccagtgagtaccagactttcttcaatccgaggacctttggctcgggagaggcaggtgaggtagtgggcatcygaggggatgcggggctgcggggctggtggccaggacttgcccctcactgcttggcttgctctgcagactgtgggctgcgacctctgttcgagaagaagtc

SEQ ID NO: 24545 - DNA, 201 bp, Homo sapiens
gcggggctggtggccaggacttgcccctcactgcttggcttgctctgcagactgtgggctgcgacctctgttcgagaagaagtcgctggaggacaaaaccraaagagagctcctggaatcctacatcgacgggcgcattgtggagggctcggatgcagagatcggcatgtcaccttggtgtgtcctggagccctgcgctac

SEQ ID NO: 24546 - DNA, 201 bp, Homo sapiens
ttcaccatgttggccaggctgatctcaaactcctgaccttgtgatcctcccgcctcggcctcccaaactgctgagattacaggggtgaggcactgcgcccrgccttttttttttttttttttgagatggagtctcactctgtcacccaggctggagtgcagtggcataatcttggctcactgcaacctccacctcctgggt

SEQ ID NO: 24547 - DNA, 201 bp, Homo sapiens
cagcaccacgggaccctggtgctacactacagaccccaccgtgaggaggcaggaatgcagcatccctgtctgtggtaagctgggggcagtggggcggcccrtggccaaggcccgggggcttcatggggcctggcagcctgggatgggaaccaagaatactggctacccaggcacagtggctcatgcccgtaatcccagcac

SEQ ID NO: 24548 - DNA, 201 bp, Homo sapiens
caagaggtaaactacacctcagcctgtaaaatcacagagcaagggatgtggatgcaggcaggggtaaagaatttgtgccgattaccagtccacaaacatgsgttagtgtttgttctctaggcatccctgtcgggcccattgctcattcctggggttggtctttttttttttttctttctaagatggagtctcactcccttg

SEQ ID NO: 24549 - DNA, 201 bp, Homo sapiens
tttcttcttcagagcccctttaacaaccgctggtatcaaatgggcatcgtctcatggggtgaaggctgtgaccgggatgggaaatatggcttctacacacrtgtgttccgcctgaagaagtggatacagaaggtcattgatcagtttggagagtagggggccactcatattctgggctcctggaaccaatcccgtgaaaga

SEQ ID NO: 24550 - DNA, 201 bp, Homo sapiens
cctgctggccaagagaagccacagaatggaagctccatgagggcagggctgtgactgtcctattggttgatgtgtactgagcacccgacagtgcctgtcayatggtaggcacttagcgaatatttggaggccactgttgagtgaatgggagaactgctggttgcagaggaagaggggctgggtgaatgcaggttcaggatt

SEQ ID NO: 24551 - DNA, 201 bp, Homo sapiens
aaactaaagctgcagggtgccgggggagtggggcagcttcatttgcgactgctctttattctctccagtctttttttcaagtcgtctatgttagctgtggmggaggaggaggtcacagttcctgaagagtgagtctggttagaatccaggtctgaatgctggtgctgctcccgtgactcccggagctgagagagtttgctg

SEQ ID NO: 24552 - DNA, 201 bp, Homo sapiens
agctagcagggacaggtagaccagggccagttgaaaaggaccttcatcactttttcatcctgctggccaagagaagccacagaatggaagctccatgaggrcagggctgtgactgtcctattggttgatgtgtactgagcacccgacagtgcctgtcatatggtaggcacttagcgaatatttggaggccactgttgagtg

SEQ ID NO: 24553 - DNA, 201 bp, Homo sapiens
agtatctagaaacagttgcctggcagaggaatactgatgtgaccttgaacttgactctattggaaacctcatctttcttcttcagagcccctttaacaacygctggtatcaaatgggcatcgtctcatggggtgaaggctgtgaccgggatgggaaatatggcttctacacacatgtgttccgcctgaagaagtggataca

SEQ ID NO: 24554 - DNA, 201 bp, Homo sapiens
cagagttctgcctggcctggtgggatgcatggatgaacaaacaagtgggcattccagtcagaagaaacaatccgtggaaagacccagaggcatgagaagcygagctagcagggacaggtagaccagggccagttgaaaaggaccttcatcactttttcatcctgctggccaagagaagccacagaatggaagctccatgag

SEQ ID NO: 24555 - DNA, 201 bp, Homo sapiens
ctcaagcccaacagcctcctgttgggcaatttcctcttccagaatcaactccactacccatcctggggccgacctacaggagaatttctgccgcaacccckacagcagcaccacgggaccctggtgctacactacagaccccaccgtgaggaggcaggaatgcagcatccctgtctgtggtaagctgggggcagtggggcg

SEQ ID NO: 24556 - DNA, 201 bp, Homo sapiens
ccctcatcctcagctcctaatgcttcctgctgcccctcccaggcaggtgatgcttttccggaagagtccccaggagctgctgtgtggggccagcctcatcmgtgaccgctgggtcctcaccgccgcccactgcctcctgtacccgccctgggacaagaacttcaccgagaatgaccttctggtgcgcattggcaagcactc

SEQ ID NO: 24557 - DNA, 201 bp, Homo sapiens
ccagcgcacaggccaaggccctgagcaagcaccaggacttcaactcagctgtgcagctggtggagaacttctgccgcaacccagacggggatgaggagggygtgtggtgctatgtggccgggaagcctggcgactttgggtactgcgacctcaactattgtggtgagctgcctgggtagggggcctgagttgcagggacaa

SEQ ID NO: 24558 - DNA, 201 bp, Homo sapiens
gcctcctgttgggcaatttcctcttccagaatcaactccactacccatcctggggccgacctacaggagaatttctgccgcaaccccgacagcagcaccaygggaccctggtgctacactacagaccccaccgtgaggaggcaggaatgcagcatccctgtctgtggtaagctgggggcagtggggcggcccatggccaag

SEQ ID NO: 24559 - DNA, 201 bp, Homo sapiens
gagtctgtctggactagggcgtgcagcctgtgcccctgtccccgtcctccaggctgtctgactccaaagccctgcacggctttaggcccaggaagaaacasccagggggctgccatggcaggaaccagccctatcccctccctggtggcctgcaggacacactgtctcccagaccccaagggcaggcagtttcctgctcct

SEQ ID NO: 24560 - DNA, 201 bp, Homo sapiens
agctcctaatgcttcctgctgcccctcccaggcaggtgatgcttttccggaagagtccccaggagctgctgtgtggggccagcctcatcagtgaccgctgkgtcctcaccgccgcccactgcctcctgtacccgccctgggacaagaacttcaccgagaatgaccttctggtgcgcattggcaagcactcccgcaccaggt

SEQ ID NO: 24561 - DNA, 201 bp, Homo sapiens
ttcttggggtctctgcaggtacgagcgaaacattgaaaagatatccatgttggaaaagatctacatccaccccaggtacaactggcgggagaacctggacygggacattgccctgatgaagctgaagaagcctgttgccttcagtgactacattcaccctgtgtgtctgcccgacagggagacggcagccaggtgggccac

SEQ ID NO: 24562 - DNA, 201 bp, Homo sapiens
ggaaacctcatctttcttcttcagagcccctttaacaaccgctggtatcaaatgggcatcgtctcatggggtgaaggctgtgaccgggatgggaaatatgkcttctacacacatgtgttccgcctgaagaagtggatacagaaggtcattgatcagtttggagagtagggggccactcatattctgggctcctggaaccaa

SEQ ID NO: 24563 - DNA, 201 bp, Homo sapiens
aggactgcttcaaatgtcaccacttttgctgagacttcagggagcaccctccctcctgcactgtgttctgaaggcacctttagcacgacaaaaatggaacyctttgtttatttataagagacagggtctcccttttttgcccaggctgatcttgaactcctgggctcaggcaattctcccatctcagtctcccaaaggagt

SEQ ID NO: 24564 - DNA, 201 bp, Homo sapiens
tgggtcttttccagcttgtgagacagcgaggacgcctcgagataagcttgctgcatgtctggaaggtgagcaactgacacgggtttggggagcaggacatrgaggggagcctgggagaagagctcaggggtgggtttggagtgtggctggtggaggccgaggcagtccccagcatctgacattgctcccattcctggggtc

SEQ ID NO: 24565 - DNA, 201 bp, Homo sapiens
gagtcctccacggctacggtgagcctgggctgctcggacggtgccggggcctcagaccgggcccaactctagacacttccacagagaagcaagcgaggaaygccacagccccttcgctgctcacagcctcatttcaactctgagcccctcctcacagggctggcaagaggagcggcctcagcctttcctgggggtctctgt

SEQ ID NO: 24566 - DNA, 201 bp, Homo sapiens
cctcaagcccaacagcctcctgttgggcaatttcctcttccagaatcaactccactacccatcctggggccgacctacaggagaatttctgccgcaacccygacagcagcaccacgggaccctggtgctacactacagaccccaccgtgaggaggcaggaatgcagcatccctgtctgtggtaagctgggggcagtggggc

SEQ ID NO: 24567 - DNA, 201 bp, Homo sapiens
cataagcctgagtgagtgaggggccggccttcccaccatgggctgagaacagggagcaagcgtacctcaagcccaacagcctcctgttgggcaatttcctsttccagaatcaactccactacccatcctggggccgacctacaggagaatttctgccgcaaccccgacagcagcaccacgggaccctggtgctacactaca

SEQ ID NO: 24568 - DNA, 201 bp, Homo sapiens
ggaggaactcccctatcctcaaatattcttctccttttggaaacaaaagtaggaaactctgccacaaacctccccagagcctgccccctgcgtgaccaggrtaaaggaaagtgtgaggaggagacataacatttactaaaacaacacaaaacaggagctgccgtagcctcactcccagcccttgtttttcaggatgtgttc

SEQ ID NO: 24569 - DNA, 201 bp, Homo sapiens
agcccagtcccagccggtgcctgggtcccaacagaggaggccgtggaggaggagacaggagatgggctggatgaggactcagacagggccatcgaagggcrtaccgccaccagtgagtaccagactttcttcaatccgaggacctttggctcgggagaggcaggtgaggtagtgggcatccgaggggatgcggggctgcgg

SEQ ID NO: 24570 - DNA, 201 bp, Homo sapiens
agactgcctgttcctgaggccgctgtcccatgacccccccaccgccttacagtgttcctggctcctcagcaagcacggtcgctgctccagcgggtccggcragccaacaccttcttggaggaggtgcgcaagggcaacctggagcgagagtgcgtggaggagacgtgcagctacgaggaggccttcgaggctctggagtcc

SEQ ID NO: 24571 - DNA, 201 bp, Homo sapiens
ctcctgtgggggttggctctcactaggcccttcttccttccccaaagcttgctccaggctggatacaaggggcgggtgacaggctggggcaacctgaaggmgacgtggacagccaacgttggtaaggggcagcccagtgtcctgcaggtggtgaacctgcccattgtggagcggccggtctgcaaggactccacccggatc

SEQ ID NO: 24572 - DNA, 201 bp, Homo sapiens
cgctgtcccatgacccccccaccgccttacagtgttcctggctcctcagcaagcacggtcgctgctccagcgggtccggcgagccaacaccttcttggagraggtgcgcaagggcaacctggagcgagagtgcgtggaggagacgtgcagctacgaggaggccttcgaggctctggagtcctccacggctacggtgagcct

SEQ ID NO: 24573 - DNA, 201 bp, Homo sapiens
cagcccagtcccagccggtgcctgggtcccaacagaggaggccgtggaggaggagacaggagatgggctggatgaggactcagacagggccatcgaagggygtaccgccaccagtgagtaccagactttcttcaatccgaggacctttggctcgggagaggcaggtgaggtagtgggcatccgaggggatgcggggctgcg

SEQ ID NO: 24574 - DNA, 201 bp, Homo sapiens; identical to SEQ ID NO: 4328

SEQ ID NO: 24575 - DNA, 201 bp, Homo sapiens
cgttgtcattgacgtcggagaccagcacggttatgttgtacttggttttcagcctgggtgtccccaggtcagtgatagtgatggtaatgttgtactcggawctggtctctctgtccagcgcgccttctgacactagggtgtaaaaattctctacagatggtttcaggaagaaggggagattgttctcaatggaacacatca

SEQ ID NO: 24576 - DNA, 201 bp, Homo sapiens
gactgtagactttccggataggcctccgccatccttggcctcgatgtcgacttcataactattaatcgcttcaaaattcaaatatttgaccagttgcataycaccagtaattggatttagctgaaaagttttgcgaatttcttcagaagcatgaaaaaatgcatatgatattgtcccaaaacttcctgtatctaagtcaga

SEQ ID NO: 24577 - DNA, 201 bp, Homo sapiens
tacagatggtttcaggaagaaggggagattgttctcaatggaacacatcactcttccgttgtctccagagtctagatcagaaacactgaaaacagccagtwcagtctctcccgagttctcaggaatagggctgtttactgaagacaaggtcagttccggtgggttgtcgttgacatcaaccacctggactatgactgtaga

SEQ ID NO: 24578 - DNA, 201 bp, Homo sapiens
gcaccagcgcctcgctgctcaaagccggggagccacggtctgtggcgcccacgcggaactcgaacgcctgcagggcctcgtagtccagcgacctgagggcraacaggtggccgttgtccgcgttgatggagaccagggaagagaggggcaggtgcgggtcctggggcggcagcagcgagtaggttacctgggcgttggtgc

SEQ ID NO: 24579 - DNA, 201 bp, Homo sapiens
atgctgtttgttccctttggacacaacttgggcccccctcgcggccagttcctctacccttagtcccagatcctttgctaggttggctattaaaaagcccytctctttttcctcagccacagaatagcgtcttgactcggacccagccagagaccctcccagaaaaacaaagagaagcaagacttgcctttgtctaagaaa

SEQ ID NO: 24580 - DNA, 201 bp, Homo sapiens; identical to SEQ ID NO: 4401

SEQ ID NO: 24581 - DNA, 201 bp, Homo sapiens
ctggcagagtgctttctaggattttcagatgcatttcattttcaaagaataccggagaatggtcatttacatctatgatacggagctcgtttgtaacgaaytgcaaagggttttgcagtaatatctgaaaatgtagtatgcatggttctgtggggccgcatagctcctcccggtccaatttctcattcaggagcaaatcac

SEQ ID NO: 24582 - DNA, 201 bp, Homo sapiens
ggttacctgggcgttggtgcctgagtctctgtctgtggcgctgacactgccgatgtgcagggcggggctgttgttctcgcggacgaacagggtgtaggagrtttgggtgaaggcgggggcgttgtcattgacgtcggagaccagcacggttatgttgtacttggttttcagcctgggtgtccccaggtcagtgatagtgat

SEQ ID NO: 24583 - DNA, 201 bp, Homo sapiens
aaagccggggagccacggtctgtggcgcccacgcggaactcgaacgcctgcagggcctcgtagtccagcgacctgagggcaaacaggtggccgttgtccgygttgatggagaccagggaagagaggggcaggtgcgggtcctggggcggcagcagcgagtaggttacctgggcgttggtgcctgagtctctgtctgtggcg

SEQ ID NO: 24584 - DNA, 201 bp, Homo sapiens
ggttggctattaaaaagcccttctctttttcctcagccacagaatagcgtcttgactcggacccagccagagaccctcccagaaaaacaaagagaagcaasacttgcctttgtctaagaaatcgctctcctcccgcctccattgcactttccgtcacgctcttccagggaatgtcgccaagctgaacctcagacagagctg

SEQ ID NO: 24585 - DNA, 201 bp, Homo sapiens; identical to SEQ ID NO: 4397

SEQ ID NO: 24586 - DNA, 201 bp, Homo sapiens; identical to SEQ ID NO: 4399

SEQ ID NO: 24587 - DNA, 201 bp, Homo sapiens
ggtgcattgtcgtttatatctaagacctggatgtttatctgggctgtcccagaccgagggggagagccgccgtccagcgcggtgagcgttaagctgagttycggctgctcctcccgatcgagcgctttatccagtactagttccgggtacttccttccgtccctacgactgcgagtgagtacgtggaagtgggaattcgga

SEQ ID NO: 24588 - DNA, 201 bp, Homo sapiens; identical to SEQ ID NO: 4400

SEQ ID NO: 24589 - DNA, 201 bp, Homo sapiens
caaagggttttgcagtaatatctgaaaatgtagtatgcatggttctgtggggccgcatagctcctcccggtccaatttctcattcaggagcaaatcacctrtctgatgactgagctgaaaatgctgtttgttccctttggacacaacttgggcccccctcgcggccagttcctctacccttagtcccagatcctttgctag

SEQ ID NO: 24590 - DNA, 201 bp, Homo sapiens
ttacagtctctcaaacactgtggtactttctatctgcatttagtaagggggagaaaaaacaagtataaagtggaccagcgcagctactagtgttcaagggyaaccttagtttacctattataaaacaagtgacttaatatatttaataccacaaaataacatatttattgtgtaattctgagttctcttgggaaataacta

SEQ ID NO: 24591 - DNA, 201 bp, Homo sapiens
ccggtcccgtagcaggtcgcgctctcggggaaggtcgtactgcggaagggcgtacgcgatcgcgcggggacagcgctactacggctttggtcgcacagtgyacccggaggagcacagcagatggagggacagatccaggacgaggtcgcggagcagaaccccctttcgcttaagtgaaaaaggtgggtgggtcatttacct

SEQ ID NO: 24592 - DNA, 201 bp, Homo sapiens; identical to SEQ ID NO: 4403

SEQ ID NO: 24593 - DNA, 201 bp, Homo sapiens; identical to SEQ ID NO: 4404

SEQ ID NO: 24594 - DNA, 201 bp, Homo sapiens
aaagcagggactaaaagccccacttcgtcttacgttccgaaaggaaggcgtctgttgagcctttctctcagtcgtgagggaggcgtcgacggcgtgcggtwagttttctgctgacggggtctctcaggaccaccgcagtggtctctcaggagtgagggacgggaaacgtgccgggccccgcgtttggggaacgcagcgttt

SEQ ID NO: 24595 - DNA, 201 bp, Homo sapiens; identical to SEQ ID NO: 4415

SEQ ID NO: 24596 - DNA, 201 bp, Homo sapiens
ggatttagaaaccaagggtatgtgttttaaaattacactttttcttaacctgtctagctgtcggaaaaggtaacagaagatggaactcgaaatcccaatgraaaacctacccagcaaagaagcatagcttttagctctaatgtaagtatatccaggcattgaacactcaaaaattggatttaggatgtatttttgcatctt

SEQ ID NO: 24597 - DNA, 201 bp, Homo sapiens
ggtcgtactgcggaagggcgtacgcgatcgcgcggggacagcgctactacggctttggtcgcacagtgtacccggaggagcacagcagatggagggacagmtccaggacgaggtcgcggagcagaaccccctttcgcttaagtgaaaaaggtgggtgggtcatttacctttccatttgtggtaatgtatggtggcagtata

SEQ ID NO: 24598 - DNA, 201 bp, Homo sapiens; identical to SEQ ID NO: 4408

SEQ ID NO: 24599 - DNA, 201 bp, Homo sapiens; identical to SEQ ID NO: 4419

SEQ ID NO: 24600 - DNA, 201 bp, Homo sapiens; identical to SEQ ID NO: 4682

SEQ ID NO: 24601 - DNA, 201 bp, Homo sapiens; identical to SEQ ID NO: 4450

SEQ ID NO: 24602 - DNA, 201 bp, Homo sapiens; identical to SEQ ID NO: 4795

SEQ ID NO: 24603 - DNA, 201 bp, Homo sapiens; identical to SEQ ID NO: 4458

SEQ ID NO: 24604 - DNA, 201 bp, Homo sapiens; identical to SEQ ID NO: 4802

SEQ ID NO: 24605 - DNA, 201 bp, Homo sapiens; identical to SEQ ID NO: 4521

SEQ ID NO: 24606 - DNA, 201 bp, Homo sapiens; identical to SEQ ID NO: 4731

SEQ ID NO: 24607 - DNA, 201 bp, Homo sapiens
atgatagttaacggggcatggtggcacacacctttaaccccaacatttcgggaggccgaggcaggaggattgcttcagtctagtagtttgagaccagcttrtgcatcttttgtagagactttgtaaaattagctatgcatggtgatgcatgtctgtagtttcagctactcaagaaactgaggtgggaggatcacttaagcc

SEQ ID NO: 24608 - DNA, 201 bp, Homo sapiens
ttgtagtttcttttgaagatttattttttactaccattttttttgttggacttttaaaatgagtttggaagtgttccctctccttcaatttttttttttttggaagagtttgaaaacaattatcattgattcttctttaaaagtttggtagaattctccaggaaagatatctggttttgggcttttgttgttgttgttgtt

SEQ ID NO: 24609 - DNA, 201 bp, Homo sapiens
tctgttggctgcataaatgtcttcttttgagaagtgtctgttcatatcctttgcccactttttgatagggttttttgtttttttcttgtaaatgtgtttargttctttgtagattctggatattagccctttgtcagatgggtagattgcaaaaattttctcccattctgtaggttgcctgttcactctgattgtagtttc

SEQ ID NO: 24610 - DNA, 201 bp, Homo sapiens
ttatattagagatttggggatgaaattaccctaaattttcaggtgggggctaattccagtgaaaagtttgttttgttttttaaataagagatagaagatgagaaaacagacacagaggaaaaggccatgcgaagatggagacagagattggagtgatgtcaacagccaccaacacctggaaaaggcagaaacagattctcc

SEQ ID NO: 24611 - DNA, 201 bp, Homo sapiens; identical to SEQ ID NO: 4610

SEQ ID NO: 24612 - DNA, 201 bp, Homo sapiens; identical to SEQ ID NO: 4611

SEQ ID NO: 24613 - DNA, 201 bp, Homo sapiens
gcaagttccccctggccctgggcaggcccagagatgctacttgggagtcagggattggagtcaaaatacttagaaatttgcctgatattttatttgactayggctaagctggcactcaaaccacaagacaaagtctttcccattcttccctcccctttccacaggcagaggtgcctctccctgtggccagtactaccactg

SEQ ID NO: 24614 - DNA, 201 bp, Homo sapiens; identical to SEQ ID NO: 4882

SEQ ID NO: 24615 - DNA, 201 bp, Homo sapiens
gaggagcccaaaaagtgtcccggtgtcaatcttaatttccagtttaatggaatcgtggttgtgtcttctggtggcagcattcctccctctggaactaagamctctaggccagcagaacataatgtcacagggacagtaagcaaaaattttactagtgggtcactaggggtgatggtaagtggtgccacttccacttccacc

SEQ ID NO: 24616 - DNA, 201 bp, Homo sapiens
ggtttataaaatgatttgcaaacattttcttttgttccctctaacaccgctagtagataatggaaactcctttgatttggtctgtagataattttatgctktgttatatggaatatccacagcattttgtgaacttgaaaacaaaggaggaagcagcttgcatatgcatatcttgctagcagattggtagaatagagagag

SEQ ID NO: 24617 - DNA, 201 bp, Homo sapiens
gaaagacactgttaccctccctctcctgactcaaagcttggggcaatttgatacataaactatttctgtcttacactgacctgtatattaatatgtacttyggtacacaaacatttaatctagggagaaaattatttcagaaagtgcttgcttttgggagattttgccaggagagtgcatgactttaataaaggcaaattt

SEQ ID NO: 24618 - DNA, 201 bp, Homo sapiens
taaaatttccattggcttttttatattttcctttttttctgataagatttcctttattttcattccttaccaataagttttcctttatcttattgaatatdtagtagctactttaaagtcattgtccgctaattcccacatctgtgtcatctcaggtttggattcttgatggtctttacctttaggaatgcatcacatttt

SEQ ID NO: 24619 - DNA, 201 bp, Homo sapiens; identical to SEQ ID NO: 4523

SEQ ID NO: 24620 - DNA, 201 bp, Homo sapiens; identical to SEQ ID NO: 4683

SEQ ID NO: 24621 - DNA, 201 bp, Homo sapiens; identical to SEQ ID NO: 4524

SEQ ID NO: 24622 - DNA, 201 bp, Homo sapiens; identical to SEQ ID NO: 4525

SEQ ID NO: 24623 - DNA, 201 bp, Homo sapiens
gagaatctgacttcgacttgttttatacttatccctatacaatgcttcttcaatatcttttgccacttttcatttggacttcctactacctgttagtacaratgttacttgctcattttatgagttcacctaatgcttataactccctattgattatgcttttccaccttcagtctcaaaaattagatcattacacctgtt

SEQ ID NO: 24624 - DNA, 201 bp, Homo sapiens; identical to SEQ ID NO: 4477

SEQ ID NO: 24625 - DNA, 201 bp, Homo sapiens
tgctgcgtcaaatggtatttctgcctctagatctttgaggaatcgccacacagtctcccacaatgagtgaactaatttacaaccccaccaacagggtaaargtgttcctttttctccatctgttgtttctggacttgttaataattgccattctgactggtgtgagaagatatttcattgtggttttgatttgcatttacc

SEQ ID NO: 24626 - DNA, 201 bp, Homo sapiens; identical to SEQ ID NO: 4616

SEQ ID NO: 24627 - DNA, 201 bp, Homo sapiens; identical to SEQ ID NO: 4618

SEQ ID NO: 24628 - DNA, 201 bp, Homo sapiens
tttgttttatgagtaacacggagatagcatacaaacattccattgactaatacagaaaaaactcaaaagttttaattagatatgtttaaatagagatgagraaagtcaaaactttaactcttaaaagttatttttatcagtttggaaatatataaactcctccctatataaaatacaccagcacaaatttctctagtaagg

SEQ ID NO: 24629 - DNA, 201 bp, Homo sapiens; identical to SEQ ID NO: 4499

SEQ ID NO: 24630 - DNA, 201 bp, Homo sapiens; identical to SEQ ID NO: 4577

SEQ ID NO: 24631 - DNA, 201 bp, Homo sapiens
ctcaatgtttccactcctctggaaatacattaatagttaagtatgaattatgtgattcataattagacttttccagttttgtggttttgtggttaaaacgstaagatttttgttgctaatttttgaaccaaatcagcagtaagttatgatatccacacttgtaattttgttttgttattaggtgcagtagtagaattattt

SEQ ID NO: 24632 - DNA, 201 bp, Homo sapiens; identical to SEQ ID NO: 4612

SEQ ID NO: 24633 - DNA, 201 bp, Homo sapiens; identical to SEQ ID NO: 4737

SEQ ID NO: 24634 - DNA, 201 bp, Homo sapiens; identical to SEQ ID NO: 4587

SEQ ID NO: 24635 - DNA, 201 bp, Homo sapiens; identical to SEQ ID NO: 4509

SEQ ID NO: 24636 - DNA, 201 bp, Homo sapiens; identical to SEQ ID NO: 4526

SEQ ID NO: 24637 - DNA, 201 bp, Homo sapiens
gtactagtcttttctcacactgctataaaaacacctgagactggataatttagaaagaaaagaggtttaactggctcgcagttctgcaggctgtacaggaygcatgatgctggccatctgcttgtcttctggggaggcctcaggaaacttacaatcatggtggaaggcaaaggggaatcaagctcatcttacatggcatga

SEQ ID NO: 24638 - DNA, 201 bp, Homo sapiens
ctaaaacatagctgatagctccatagcagtgttttgtaactgctttggagtttttgcttacacaaaaactgtaagcctctctcataacatctatttatacwgataggagatcatattgttggatataggacttgacaaccttttgttttgtgtttctattgataatattttacaaagaggaaagatgagtaatttttatgt

SEQ ID NO: 24639 - DNA, 201 bp, Homo sapiens
gttcagttcctgcagctgctctcatgggttggtgttgaatgcctgcagcttttccaggcacagtgtgcaagctgcttagaactgctggtggattcccattytggggtcttgagggtggtggccctcttctcacagccattgcactccagcctgggcaacaagagtgaaactccatctcaaaaaaaaaaaaagaaagaaaga

SEQ ID NO: 24640 - DNA, 201 bp, Homo sapiens
tgtccttaagctggagaaactagggattatctgtcagagttttaacttcctcatgctgtgtcacaaccttgatcagctattaggccaaagcaacaaaaacrggaaactcacttcatgctgattcttttctccaagttttagtgccctgctctcccaaaactgcctccttttgtttattccccagagtccttagatatttgc

SEQ ID NO: 24641 - DNA, 201 bp, Homo sapiens
tcctcatgctgtgtcacaaccttgatcagctattaggccaaagcaacaaaaacaggaaactcacttcatgctgattcttttctccaagttttagtgccctsctctcccaaaactgcctccttttgtttattccccagagtccttagatatttgctttatgtattttggccagaagctatagttgttatctctggaagggtc

SEQ ID NO: 24642 - DNA, 201 bp, Homo sapiens
gattcttttctccaagttttagtgccctgctctcccaaaactgcctccttttgtttattccccagagtccttagatatttgctttatgtattttggccagragctatagttgttatctctggaagggtctgtttattatgagcttactttgatctactagactgagcttcagacattgtgttttgaaatttttgcttaaca

SEQ ID NO: 24643 - DNA, 201 bp, Homo sapiens
taaaacactgtaattagtcaatttaagtaaaataaattcaaggaagtggtctgaatttctcagtgagcatttagatatttatgggagtcatataaaataawttataaatgtgactgagggctttttattaaggaaaatgaaatattgctatggacatgattctgtgtgtttctttactacactatgaactaaaaattttgg

SEQ ID NO: 24644 - DNA, 201 bp, Homo sapiens; identical to SEQ ID NO: 4501

SEQ ID NO: 24645 - DNA, 201 bp, Homo sapiens
agaataaacacacagacatatacatgcacacactttcagaaatgcacttaaatattcaatcatggagtaaaaattaattatgaaatatctagacaatgaayattatgtagtttttattaagaaagaagcagaattatatatactgacatgaaaggatgttcattatatatgttaagtaaaaactaagttcatcatatatgt

SEQ ID NO: 24646 - DNA, 201 bp, Homo sapiens; identical to SEQ ID NO: 4502

SEQ ID NO: 24647 - DNA, 201 bp, Homo sapiens
acaccattctgttttaatttttatatcttaaagttatcattccagtgtctttggtttactgggtttataaaagaattgaccagtagctatataatagatayagaaaagtctgcctgggtgtggtggctcatacttgtaataatattatattataattgttctattttattattagttattgttgctaatcttttactgtac

SEQ ID NO: 24648 - DNA, 201 bp, Homo sapiens; identical to SEQ ID NO: 4503

SEQ ID NO: 24649 - DNA, 201 bp, Homo sapiens
tatatcttaaagttatcattccagtgtctttggtttactgggtttataaaagaattgaccagtagctatataatagatatagaaaagtctgcctgggtgtrgtggctcatacttgtaataatattatattataattgttctattttattattagttattgttgctaatcttttactgtacctaatttatacattaagcttt

SEQ ID NO: 24650 - DNA, 201 bp, Homo sapiens; identical to SEQ ID NO: 4504

SEQ ID NO: 24651 - DNA, 201 bp, Homo sapiens; identical to SEQ ID NO: 4583

SEQ ID NO: 24652 - DNA, 201 bp, Homo sapiens; identical to SEQ ID NO: 4552

SEQ ID NO: 24653 - DNA, 201 bp, Homo sapiens
tcaagcatgagcagaatgtgttagctgcagccctggcttcatagttgtaagcaatttctgagggtggaagaagagatgggaaagaatttatgatctaaccrttatctgggtctgtgtgtttattcagctctgtgcacctagaggaggctggcattctacgggctggtccaggagggcctgatcagcagtggccaacagtat

SEQ ID NO: 24654 - DNA, 201 bp, Homo sapiens
taaaaataagtaaagcctgccctgtacagaaaatctaataaagcaaatttgttggtgatgttccaagaaggttcaccagcttgggctttcaaccagcattracccaatcttgtgtccagagctgttgctgtaggtggtatcatgtatcaagctgaatagtgaggtgacattccccaagtcttctctcttgtcttttttgac

SEQ ID NO: 24655 - DNA, 201 bp, Homo sapiens
ctggtcttactcgcagcagaggcggcagagggtgtgttctggggagggcctgcccaaggcggacctcatggccttcagccccagccttccaccatgcccartggtagatgtggacggggaagatcagtctattggaggggaccactctaggaaggtgggttattacgttttcattttccttttgtgctttatgaataatat

SEQ ID NO: 24656 - DNA, 201 bp, Homo sapiens
aaaagactctgaaagtacagtcgttcatctttatattaagataatattttctgataggaaacgactatttaacatggattatcactggcgaggagagctgrgatcctggcgactactactcttgcttctgctcctcgcagcctggaaggtggggagcggccagctccactactccgtccccgaggaggccaaacacggcac

SEQ ID NO: 24657 - DNA, 201 bp, Homo sapiens
tccaccatgcccaatggtagatgtggacggggaagatcagtctattggaggggaccactctaggaaggtgggttattacgttttcattttccttttgtgcyttatgaataatattttctcttaccgcattttctcaaatatgtatcagaatatttcatttttgtctacattccatttatgcttgaatatttctagtgatac

SEQ ID NO: 24658 - DNA, 201 bp, Homo sapiens
gggttattacgttttcattttccttttgtgctttatgaataatattttctcttaccgcattttctcaaatatgtatcagaatatttcatttttgtctacawtccatttatgcttgaatatttctagtgatacctttgtaatataatttattccaggagttttaaaatttttttatcctacccagtgtgtcagcctttgatt

SEQ ID NO: 24659 - DNA, 201 bp, Homo sapiens
tttgaaataaaacttttcatctgattaatagtttgtaatggtttgtaattcttacttacatgatggccacatgatgtcgctctttaccgcaaattctttcrtaatcagcaaaaggaagtcattccttttcgcactggaaagacgctccactctctttcactctttggatgcacaacaatggccacacatcgagattgaaat

SEQ ID NO: 24660 - DNA, 201 bp, Homo sapiens
tgatcatcgccatctgcgcggtgtccagcttgctggtgctcacgctgctgctgtacactgcactgaggtgctcggcggcgcccaccgagggcgcatgtggsccggtgaagcccacgctggtgtgctctagcgcggtggggagctggtcttactcgcagcagaggcggcagagggtgtgttctggggagggcctgcccaagg

SEQ ID NO: 24661 - DNA, 201 bp, Homo sapiens
ggtgtctgcgtgggacgcggacgcgcaggagaacgccctggtgtcctactctctggtggagcggcggttgggcgagcgctcgctgtcgagctacgtgtcgrtgcacgcggagagcggcaaggtgtacgcgctgcagccgctggaccacgaggagctggagctgctacagttccaggtgagcgcgcgcgatgggggcgtgcc

SEQ ID NO: 24662 - DNA, 201 bp, Homo sapiens
caaggtgtacgcgctgcagccgctggaccacgaggagctggagctgctacagttccaggtgagcgcgcgcgatgggggcgtgccgcctctgggcagcaacktgacgctgcaggtgttcgtgctggacgagaacgacaacgctcccgcgctgctggcgtctcccgctggcagcgcgggcggtgcagtcagtgagctggtgct

SEQ ID NO: 24663 - DNA, 201 bp, Homo sapiens
gcgcgcgcgatgggggcgtgccgcctctgggcagcaacttgacgctgcaggtgttcgtgctggacgagaacgacaacgctcccgcgctgctggcgtctccsgctggcagcgcgggcggtgcagtcagtgagctggtgctgcggtcggtggttgcgggtcacgtggtggctaaggtgcgcgcagtggacgctgactctggat

SEQ ID NO: 24664 - DNA, 201 bp, Homo sapiens
cagtccaaatgagtattttgttcttgatattataaacaaaaaagacaaagacaaattcccagtgcttgttctgcggaagctgctggatcgtgaagaaaatyctcagctaaagttgttgttgacagcaactgatggaggcaaacctgaatttaccggatctgtttctctgctgatcctggtgttagatgccaatgataacgc

SEQ ID NO: 24665 - DNA, 201 bp, Homo sapiens
aacaattacaaaatcacctaactacactgtcttgcagctgcctttctttttttgtcttgtccacgtgagtatattgggagactttgtttaatgtctccacraattctagatagactgttcctgcagcatttctttttttaaattttgttttgataagcatttattttggcaatgattctagtaaatgaaactaaagtgccc

SEQ ID NO: 24666 - DNA, 201 bp, Homo sapiens
tgtttgatatctaaagggccatgctacatatagactgccaactaaggttttatctgatgataataaattgttgtatttcatgacgacagcaacaacaacartaatgtacttaactagtcactgtgcaaattgctttacatacattttctcatgtaatcataataataaccgtatgagttttgcttactattgttttcctta

SEQ ID NO: 24667 - DNA, 201 bp, Homo sapiens
ggctaagtaacatgtccatagccaaacagttagtcactggcaggagtgtgactgactccaaagtctatattcctaattactgtgttctactttttaatagrgagctcttgaaggtccaaggaaaggaatgcataatggtgtggtcaaggcattagtgttaatatttgtagaaagggtaattaacaacagtctgagcaatca

SEQ ID NO: 24668 - DNA, 201 bp, Homo sapiens
aggagaacagtaaagtgcttgagctggtgctgcgtaagggcctagaccgggagcaggcagccttgcaccacctggttctcacagccgtggatgggggcatyccagcccgctcgggtacggcacagatctctgtgcgtgtcctggacactaacgacaactctcctgcctttgaccagtccacttatcgcgtccagctacggg

SEQ ID NO: 24669 - DNA, 201 bp, Homo sapiens
cctgattgagagtagatttttctcatggacatttcagatagatttattcatttatcagaagtgcctggtgttagtcaatgctgagaaaccatgggaggcakattgtagattaagaaaaatgggggaataaatcaaagagtttccagaagtctttagatcgtagcatttgaaagcacgtaaaagggtttagctttaaataag

SEQ ID NO: 24670 - DNA, 201 bp, Homo sapiens
cttagttccttggcatataagcaccatcagttcctttctggccttccagggtcagaactctgggctccaaggaggtacaactgtgagtgagagagtagctrctgtgctagcaggctatgcatccagaactaaacagacctagcactttctgttgtactggaacccattaggtatgttctaaagttatgtttattttacttt

SEQ ID NO: 24671 - DNA, 201 bp, Homo sapiens
ctaggagggtctttaagagtatcacactgtgcctgctgagaatcatcgaattaacaagacctggcttcaaatttaatagataaataaaggtaagtatcctrcataaatacgatgatagtaaaagcaagaatattgtaagaggtgctagaaaggtacatcatagtgttattggaattggaaaaaaatctttgcctttttccc

SEQ ID NO: 24672 - DNA, 201 bp, Homo sapiens
ttaggtctctgtaatacttaaaacctgtgttgaaaaaattatttctactgaagtaaaagttgcccctatggcgaaactaaggaccacactcaatcaatcastggtacaatgtgtaccacagtagtacaaaatgtattcctattctccgaaacgactgaaataataaataaaaccaagtagtttacagtagagtgtgtgggg

SEQ ID NO: 24673 - DNA, 201 bp, Homo sapiens
tccaatagatgtccactgttaaaacaggaatcacaatattttagtgtatgtcatgaattagcacaattgatagtgaattagtataaaagttctaaggaaakatttagataaaatataaggactttgaggagtgaccgaaggatattacaattgaaactagaaattttgggaaagttcaaacgacatgcaaggaaaagaaga

SEQ ID NO: 24674 - DNA, 201 bp, Homo sapiens
ggtccagtgtctgctgctctcgcttcttctcctcgcagcctgggaggtggggagcggccagctccactactcagtctacgaggaggccagacacggcaccytcgtgggccgcatcgcgcaggacctggggctggagctggcggagctggtgcagcgcctgttccgggtggcgtccaaaagacacggggaccttctggaggt

SEQ ID NO: 24675 - DNA, 201 bp, Homo sapiens; identical to SEQ ID NO: 4621

SEQ ID NO: 24676 - DNA, 201 bp, Homo sapiens; identical to SEQ ID NO: 4623

SEQ ID NO: 24677 - DNA, 201 bp, Homo sapiens; identical to SEQ ID NO: 4625

SEQ ID NO: 24678 - DNA, 201 bp, Homo sapiens; identical to SEQ ID NO: 4626

SEQ ID NO: 24679 - DNA, 201 bp, Homo sapiens; identical to SEQ ID NO: 4627

SEQ ID NO: 24680 - DNA, 201 bp, Homo sapiens; identical to SEQ ID NO: 4628

SEQ ID NO: 24681 - DNA, 201 bp, Homo sapiens; identical to SEQ ID NO: 4629

SEQ ID NO: 24682 - DNA, 201 bp, Homo sapiens; identical to SEQ ID NO: 4630

SEQ ID NO: 24683 - DNA, 201 bp, Homo sapiens
tacagacctacgagctcagccccagcgagcacttcgagctggaccttaagcccctgcaggagaacagtaaagtgcttgagctggtgctgcgtaagggcctwgaccgggagcaggcagccttgcaccacctggttctcacagccgtggatgggggcatcccagcccgctcgggtacggcacagatctctgtgcgtgtcctgg

SEQ ID NO: 24684 - DNA, 201 bp, Homo sapiens; identical to SEQ ID NO: 4631

SEQ ID NO: 24685 - DNA, 201 bp, Homo sapiens; identical to SEQ ID NO: 4447

SEQ ID NO: 24686 - DNA, 201 bp, Homo sapiens; identical to SEQ ID NO: 4448

SEQ ID NO: 24687 - DNA, 201 bp, Homo sapiens
ctctggaaccccattaactttctcaagtataattaacaatttcttcttctggagtcccacaatactttacatatactttagttattgcatgtattaagttrgtttctagttgcttgagtgtatgtccaactagactgtgagcacactgagggaaggaatttggcttggaaagtaaaattggctcccagtgttttatctaaa

SEQ ID NO: 24688 - DNA, 201 bp, Homo sapiens
tcgaaaagggaagtaaatgcagcattttttttaattgttaaataaagggctgggcttggaaatgttcttaggtaatcctggtggatttggtatatcatgtytgagaaaatgtggagagtgaagggcaggtttaaaatttgtctcatgttagtttctgaagggagatagcctggcattgcacagtgcctcacatttctatcg

SEQ ID NO: 24689 - DNA, 201 bp, Homo sapiens
cacaagtgatgccaggagatggggcaacacatattgcctgccttgtatgcatctagcgtctgtgtctaagtgaaagcagattatatccagaacttccctgraaaatagaagaaagagcctgattggtgtgtatgtgtgtgttaggggttgaggggtgggtaatgttcctgccagtattcgtaaatcccacctgcttttcct

SEQ ID NO: 24690 - DNA, 201 bp, Homo sapiens
ctgaaattgtctatctccaagggcgtgggctaggcaaaggatgggagaagtcagtcctgaagatggtaatacttaaaggaaataagggggacaaaggatgyttgtgctactattgaaacaggaaattgagagctctgtagaagtcagactcaagaggcataataatagaaagttagggtatgaaaaggtgacttttaagaa

SEQ ID NO: 24691 - DNA, 201 bp, Homo sapiens
agggtctttcatggcaatattttaaaagaaactctgcccagatttcaaaggaacgtgaaaattttatcttcagaggcagtcagctttgcagttgaaaaggycattgcctaatctggagaaacatattcagttcaagcactggctagagactagaggcccccaggaaagggccataagattggtcactgccaggaagcctgt

SEQ ID NO: 24692 - DNA, 201 bp, Homo sapiens; identical to SEQ ID NO: 4457

SEQ ID NO: 24693 - DNA, 201 bp, Homo sapiens; identical to SEQ ID NO: 4459

SEQ ID NO: 24694 - DNA, 201 bp, Homo sapiens
cagtgggctcatgcctgtaatcttagcattttgggaggctaaagtggacagattgcctgagctcaggagttcgagaccagcctgggcaacatgatggaacmccatctctactaaaatacaaaaaaaaaaaaaaaaaaaaaaattagccaggcatggtggcatgtgcctgtagtcccagctactcaggaggctgaggcacga

SEQ ID NO: 24695 - DNA, 201 bp, Homo sapiens
agaaggattgttgagctgaaggcaagttaaaagaagcagatacaggctgggtgcagtgggctcatgcctgtaatcttagcattttgggaggctaaagtggrcagattgcctgagctcaggagttcgagaccagcctgggcaacatgatggaacaccatctctactaaaatacaaaaaaaaaaaaaaaaaaaaaaattagcc

SEQ ID NO: 24696 - DNA, 201 bp, Homo sapiens
aagtgcgagtaattggggggctggattatgaggaagcctcctcctaccagatctatgtgcaggcgactgaccggggtccagtgcccatggcaggtcactgyaaggtgctggtggacatcgtggacgtgaatgacaatgccccagaggtggtgctcacggacctgtatagcccagtgcctgagaatgctacacccaacacca

SEQ ID NO: 24697 - DNA, 201 bp, Homo sapiens
gtgaataaacagatacattttttgcctttgtgaatcttacagtggtagagaataataggccaagggggtgctgcttggctaggaatgtcatagaatgcctktccaaggaggttacatttaatacagacttgaagagtgaggagtcatgctaagaatggatgagaggctcacgcctgtaatcccagcactttgggaggccga

SEQ ID NO: 24698 - DNA, 201 bp, Homo sapiens
caaattctttcgtaatcagcaaaaggaagtcattccttttcgcactggaaagacgctccactctctttcactctttggatgcacaacaatggccacacatmgagattgaaatgaagggataaaaacattcctataaattcgaaggcaagttttgctgactagaaaaacaagccaataatttgaaatggtgtgcccgaatgg

SEQ ID NO: 24699 - DNA, 201 bp, Homo sapiens
aggatagttacatttaatctataaatcaaccctatggggcgggcactcttatgaactttttttacggatgaaaactgaggcccagagatatgaaataattwgccaaacatcaccataatttacatgatgtagccaggtttaagcctactattctgattacagagcctaagatcctacagagaacagggagtatatttttac

SEQ ID NO: 24700 - DNA, 201 bp, Homo sapiens
tctcccttcccagcctcaaaggaatacagtgagtagattttccttagacagaaaggaaaagaaccttccatttttggctgtgccaagaagctcagaaaggygataatataaaaaatatatagttaattgggaattgaatttacaaaatacattgtgtggtgatgcaatagaaagctcataattggaacgagattgagatgg

SEQ ID NO: 24701 - DNA, 201 bp, Homo sapiens
gtgagtagattttccttagacagaaaggaaaagaaccttccatttttggctgtgccaagaagctcagaaaggtgataatataaaaaatatatagttaattsggaattgaatttacaaaatacattgtgtggtgatgcaatagaaagctcataattggaacgagattgagatggtatattcccggagaggaagtctgggatc

SEQ ID NO: 24702 - DNA, 201 bp, Homo sapiens
taactctttgagaacagggtacttgtcctaatattattcatatttatatccctaattcctaatttaatgtctaatttattgtaaataagttttttttttttgagacagagttttgctcttgttgcccaggctggagtgcaatggcacaatctcagctcactgcaacctctgcctcctgggttcaagtgattctcctgcctc

SEQ ID NO: 24703 - DNA, 201 bp, Homo sapiens; identical to SEQ ID NO: 4806

SEQ ID NO: 24704 - DNA, 201 bp, Homo sapiens
ccaatttgctgttggtatctatgttttctaaacaatacaatatacattcttatacatatttcttatgcatgcttgctagtatttatacaggataaatttcmagaagtagaattacagaatcataggatataaaaatatcaaattggcaaattggcattcacgtacctgtggttggactgcacttgttacatacttccctct

SEQ ID NO: 24705 - DNA, 201 bp, Homo sapiens; identical to SEQ ID NO: 4808

SEQ ID NO: 24706 - DNA, 201 bp, Homo sapiens
aatgggacccagggtctgtctatgttataatcaattcaaaccctaggtaaataaggtaagctaggctgcctttcttgagacagtccccagattgttttcayagggcccaaacactctcagcaaccatgaacagtggatgttgtgggacctcagaagatggaattggaaattcaggggactaagtcagagattatttgacat

SEQ ID NO: 24707 - DNA, 201 bp, Homo sapiens; identical to SEQ ID NO: 4811

SEQ ID NO: 24708 - DNA, 201 bp, Homo sapiens
cttaccctttcatccacatgatgtcgctggacaccggaaggtttttctcccttcccagcctcaaaggaatacagtgagtagattttccttagacagaaagraaaagaaccttccatttttggctgtgccaagaagctcagaaaggtgataatataaaaaatatatagttaattgggaattgaatttacaaaatacattgtg

SEQ ID NO: 24709 - DNA, 201 bp, Homo sapiens; identical to SEQ ID NO: 4814

SEQ ID NO: 24710 - DNA, 201 bp, Homo sapiens
aatgtgtgaaaagttagatatcaatgaatgaatattcttaaatgtataaactttaatcttgctggatataggataaaatttacattaaaacactgtaatthgtcaatttaagtaaaataaattcaaggaagtggtctgaatttctcagtgagcatttagatatttatgggagtcatataaaataatttataaatgtgactg

SEQ ID NO: 24711 - DNA, 201 bp, Homo sapiens; identical to SEQ ID NO: 4816

SEQ ID NO: 24712 - DNA, 201 bp, Homo sapiens; identical to SEQ ID NO: 4472

SEQ ID NO: 24713 - DNA, 201 bp, Homo sapiens
tgtgtaaaaggttttttcccaaaaataatcagatgcctttcaaattattaagtaacatgcagctaagggcccatttttactggcaactttaagggcattcrttgattctaatcagccaggatttgctatttatggatgttgcacaattcaactaaaagtcacatttgtccaaaaaatatacgagttgaagcaattcattag

SEQ ID NO: 24714 - DNA, 201 bp, Homo sapiens; identical to SEQ ID NO: 4817

SEQ ID NO: 24715 - DNA, 201 bp, Homo sapiens; identical to SEQ ID NO: 4553

SEQ ID NO: 24716 - DNA, 201 bp, Homo sapiens
caccgagtttaatgtaaagttccccagttgctgtgctttacttcctccaagtgcgcagactccccacgttgctcagctgctgctgggggatatgggagggstgatggtggtgatcccagagtgtctctccaaccctcttcaatgcctcttttagtgatacgttgttaaatctaggtactacgattgctcacctgatgtttg

SEQ ID NO: 24717 - DNA, 201 bp, Homo sapiens
gtctctccaaccctcttcaatgcctcttttagtgatacgttgttaaatctaggtactacgattgctcacctgatgtttggtttttgtaatgacgcttttcygtgtgcagatagttgttacaatttggtgttcatgtggcgggggaggggggggatggtgtaggcttctgttccactatcttgctccacctcaatagtctga

SEQ ID NO: 24718 - DNA, 201 bp, Homo sapiens
aaatctaggtactacgattgctcacctgatgtttggtttttgtaatgacgcttttccgtgtgcagatagttgttacaatttggtgttcatgtggcgggggrggggggggatggtgtaggcttctgttccactatcttgctccacctcaatagtctgatgtgcagaagctctttagtttaattaggccccatttgccaattt

SEQ ID NO: 24719 - DNA, 201 bp, Homo sapiens
cgacgtgggcgccaactcagtacagacctacgagctcagccccagcgagcacttcgagctggaccttaagcccctgcaggagaacagtaaagtgcttgagstggtgctgcgtaagggcctagaccgggagcaggcagccttgcaccacctggttctcacagccgtggatgggggcatcccagcccgctcgggtacggcaca

SEQ ID NO: 24720 - DNA, 201 bp, Homo sapiens
ggcttctgttccactatcttgctccacctcaatagtctgatgtgcagaagctctttagtttaattaggccccatttgccaatttttgtttttgctgcaagwgcgtttggcatctttgtcatgaaatctttgccagggcctatgcccagaatgatattttctaggttttattctacggtttgtatagttttaggttttacat

SEQ ID NO: 24721 - DNA, 201 bp, Homo sapiens
caatattatcttttttttttttttttgagacagattctcattctgttgcccaggctggagtaaagtggtacaatcttggctcactgcaatctctgcctccygggttcaagcgattctcccacctcagcctcccgagtagcggggattacaggcacccaccaccacacccggctaatttttatacttttagtagagacaggg

SEQ ID NO: 24722 - DNA, 201 bp, Homo sapiens
ttaagtcatgagggcagagccctcatgaatgggattggtgcccttataaaagaggcccagagaggtgccttgcctctttcaccatgtgaggacacagcaaraatgtgacatccatgaaccaaaaagtggcccctccccagacactaaatctgctggtgcctgaatcatgaactttcaagcctctagaacagtgaaaaataa

SEQ ID NO: 24723 - DNA, 201 bp, Homo sapiens
gcgcatgtatacatatgtaacaaacctgcacgttgtgcacatgtaccctagaacttaaagtataataataataataataataataataataataataataaagcgagggtgggtatctagcctattcttatcctgcctcatggtgttttctaaatatttacagaaagaaaatttacagagtagtttcctggtcaaactcta

SEQ ID NO: 24724 - DNA, 201 bp, Homo sapiens
tggtgcctgaatcatgaactttcaagcctctagaacagtgaaaaataaatctctcttgtttattaactacacagcatatggcattttgttataatatcctkaacagactaagacagatatcgtttaggttagttggtttttagtgttgttcacatctttcatttcctagtgatcttctgcctagttgttgtccattattgg

SEQ ID NO: 24725 - DNA, 201 bp, Homo sapiens
ggcgcatgtatacatatgtaacaaacctgcacgttgtgcacatgtaccctagaacttaaagtataataataataataataataataataataataataataaagcgagggtgggtatctagcctattcttatcctgcctcatggtgttttctaaatatttacagaaagaaaatttacagagtagtttcctggtcaaactct

SEQ ID NO: 24726 - DNA, 201 bp, Homo sapiens
agctctattatgttatagtagagctcatactatattatggtttcaaaggtaataagaaaaatatcatcagatcatcattatggtagctattttaagggaayttaataaaaatttaacagttatcatcaaacactggccacctcaattttaaacagtaaacacacgaattactcccataaaaattataagcataacaggaca

SEQ ID NO: 24727 - DNA, 201 bp, Homo sapiens
tggcgcatgtatacatatgtaacaaacctgcacgttgtgcacatgtaccctagaacttaaagtataataataataataataataataataataataataataaagcgagggtgggtatctagcctattcttatcctgcctcatggtgttttctaaatatttacagaaagaaaatttacagagtagtttcctggtcaaactc

SEQ ID NO: 24728 - DNA, 201 bp, Homo sapiens
atatatacagtatatatataagattttagaaaggaggataaatatatattacatgataaaacttatagtcaatataattttacacttgtaaaatcccagaraaccaaaggaaaaaatagaactaaaaaagagttcaatgaaatgattagtttaaaaaaataaatataaaaaatgtaattttcccacataccttcaaaatgt

SEQ ID NO: 24729 - DNA, 201 bp, Homo sapiens; identical to SEQ ID NO: 4530

SEQ ID NO: 24730 - DNA, 201 bp, Homo sapiens
atggcgcatgtatacatatgtaacaaacctgcacgttgtgcacatgtaccctagaacttaaagtataataataataataataataataataataataatawtaaagcgagggtgggtatctagcctattcttatcctgcctcatggtgttttctaaatatttacagaaagaaaatttacagagtagtttcctggtcaaact

SEQ ID NO: 24731 - DNA, 201 bp, Homo sapiens
ctgcctagttgttgtccattattggaagtggagtattaaagtctccagttatgactattgaattgtctatttctcccttcatttctgccagtttttgcttcatgtgttttggggctctattattagatgcaagtatgtttttagttgctatatcttcctgattggtccttttgtcattataaaatgtccttcttgatttct

SEQ ID NO: 24732 - DNA, 201 bp, Homo sapiens
ctagggcctggaatgcgggcctcatgactctactcaatgccctatcctactgtggctgagctggtatccaagatgcaagacaaagtcctctttactctttkctctcctctccttaagcagaaggaaggagtgacttttgttgctgcaagcttcactgcctgggattaggggaggggtggcacaagcactcccttagctgcc

SEQ ID NO: 24733 - DNA, 201 bp, Homo sapiens
ctcatttcaacagtagacacctggcaaggctgtgcatgcacctttcattgcaggtcagccactggtatgataagaacttgtgtccaatttcccgcaatttyagctctttctctacaggagataagactctcactcagggcaatcttagcaggtttgaggttcagtatctgcttctgaagctaggaattagaatccctaagt

SEQ ID NO: 24734 - DNA, 201 bp, Homo sapiens
gtggaaaggctgatggcagtgtgggttggggaggacatgttgccactactggggatgagaaagctgtttcttctggcaaaaaaagtttcatcagaatttayaatctcagtgtccccagcttcatcagggtccttttacatatccccattccaagtttcaggatcccattcttttccaatcaatgccctcatttcaacagta

SEQ ID NO: 24735 - DNA, 201 bp, Homo sapiens
tgggtcatatggctcgagaaacagagcaacttgcacacagcctggacgtgttgtagagtcttctcctgttctgtactacattaaaaagtgagagccttttkggttactcgataaatgggctggagtaacatacccaaatgaggaatgtgttgcctccaaaatccaatagtcccaaataagcctctttcgtggttgtaggag

SEQ ID NO: 24736 - DNA, 201 bp, Homo sapiens
cccttttctaagagcaaagatggaaatgtggagagaggagaaaaatggttcccattacattattgtgttctggacttagagatattgttctgccccaggtytaagaatattgttccaagagttgggagcaggcagcagaggacagtactctttagatcacccagaggccaatctgtaaggattcaatcctggggcatggta

SEQ ID NO: 24737 - DNA, 201 bp, Homo sapiens
aattaaagctcataagaattaagtggctttcttacattcacacagctagtaaaaatgttttttgctcaccattgtattcccattgtcaagcaggatgcctrgcacacaatgatgctcaataaattttgttaaattcattaataaatgcagtggtaaaggcagtatttgaactcatgtctgcttgctgctgaactctataca

SEQ ID NO: 24738 - DNA, 201 bp, Homo sapiens
gagtgggtcgttgctgggtcaagttttataagtctttaaatcccatactgttgcctcctggactgtagaaatagtctcttagaacaagagaaaggaagacratagctaccatttattgagaactgtgataagcactttacatatgttgcatacttaactttgagagaagtacattattattcccatgtttcagataaaaaa

SEQ ID NO: 24739 - DNA, 201 bp, Homo sapiens; identical to SEQ ID NO: 4805

SEQ ID NO: 24740 - DNA, 201 bp, Homo sapiens; identical to SEQ ID NO: 4807

SEQ ID NO: 24741 - DNA, 201 bp, Homo sapiens; identical to SEQ ID NO: 4809

SEQ ID NO: 24742 - DNA, 201 bp, Homo sapiens; identical to SEQ ID NO: 4810

SEQ ID NO: 24743 - DNA, 201 bp, Homo sapiens; identical to SEQ ID NO: 4812

SEQ ID NO: 24744 - DNA, 201 bp, Homo sapiens
ctctcagccaaagtgagtaatttttatttattctttccaaaatgtctttgtttttcattcctcaatgtttccactcctctggaaatacattaatagttaaktatgaattatgtgattcataattagacttttccagttttgtggttttgtggttaaaacgctaagatttttgttgctaatttttgaaccaaatcagcagta

SEQ ID NO: 24745 - DNA, 201 bp, Homo sapiens
cctcaatgtttccactcctctggaaatacattaatagttaagtatgaattatgtgattcataattagacttttccagttttgtggttttgtggttaaaacsctaagatttttgttgctaatttttgaaccaaatcagcagtaagttatgatatccacacttgtaattttgttttgttattaggtgcagtagtagaattatt

SEQ ID NO: 24746 - DNA, 201 bp, Homo sapiens; identical to SEQ ID NO: 4605

SEQ ID NO: 24747 - DNA, 201 bp, Homo sapiens; identical to SEQ ID NO: 4607

SEQ ID NO: 24748 - DNA, 201 bp, Homo sapiens; identical to SEQ ID NO: 4608

SEQ ID NO: 24749 - DNA, 201 bp, Homo sapiens
aagctgatcttatagaagcagagagtataacagtgattaccagagatgggtagggcagtagtaaggaggagagattgaggagaggttggtcaatgggtacraagttacaattagataggaagaataagttctggtgttttattgaacagtagagtgtagttaagaataatgtatatttcaaaatattatagaatagaggat

SEQ ID NO: 24750 - DNA, 201 bp, Homo sapiens
caggcacagaaagacaaatactgcatgatctcattcatgtggaatgtaaaaaagctgatcttatagaagcagagagtataacagtgattaccagagatggrtagggcagtagtaaggaggagagattgaggagaggttggtcaatgggtacgaagttacaattagataggaagaataagttctggtgttttattgaacagt

SEQ ID NO: 24751 - DNA, 201 bp, Homo sapiens
ggcagcctcagggcgttgtcctagaaaacaccgtttaaggagagaagtgttagtgtctcggggcgtctcccaggctccgccctgcgcccgcagccagcgtkgtggtcgagaccccagcccgctgctactggagacagcacctctcgcgcccgggcgggcggcctcgtctctgcacccctaggcggcgctgcgctcctcaac

SEQ ID NO: 24752 - DNA, 201 bp, Homo sapiens; identical to SEQ ID NO: 4579

SEQ ID NO: 24753 - DNA, 201 bp, Homo sapiens; identical to SEQ ID NO: 4580

SEQ ID NO: 24754 - DNA, 201 bp, Homo sapiens; identical to SEQ ID NO: 4581

SEQ ID NO: 24755 - DNA, 201 bp, Homo sapiens; identical to SEQ ID NO: 4582

SEQ ID NO: 24756 - DNA, 201 bp, Homo sapiens; identical to SEQ ID NO: 4585

SEQ ID NO: 24757 - DNA, 201 bp, Homo sapiens
acaagaaaggaaataaaatgaagatattttcttagtacaaatgtataaatgcacaaacatgtttttaacaaagaaggaggaaatactcacgacaattaaartcctcatttctgcaactggttgtgtggttcatagctggtattgatgactaccttcctctactactcattctgtattccctttgccttcagcaagcacctc

SEQ ID NO: 24758 - DNA, 201 bp, Homo sapiens
aagaagggagaaagggaacataagagaacatttgagtgaggaggaaggagtcagagaaggctttgtgatagagatcacagatttagttggatctttaataygatataccatttaataaaaaacagtgtattctctagcctatacttttaatgaataccattttggtgaaggtgtcttctttgggaatgacaccctaaaaca

SEQ ID NO: 24759 - DNA, 201 bp, Homo sapiens
tcacccccttcccaccctttccccctaagtccccaaagtccattgtattatacttatgcctttgcatcctcatagcttagctcccacttatgaatgagaamatgtggtgtttggttttccattcctgagtttcttcacttagaataatggtctccagttccatccaggttgctgagaatgccattatttcattccttttta

SEQ ID NO: 24760 - DNA, 201 bp, Homo sapiens
atgcttttgcattatcaatgcaagtgtaaatatagtgaaaaatgcaaataatgttttaacattattttgaaaattatattcacctcataaacacccaaagsgtccatagaccacacttcgagagctaccgttctaattctatcatttcttcttttttttaattaattgtaacatttctgtaatgggtcttcaactatttga

SEQ ID NO: 24761 - DNA, 201 bp, Homo sapiens
gacagcatttttattgaggaaaggatgcattttaaaaaacaagtttttcaaaaatatagggaggattgtggttacttctagaaacagtagtgcagtcaggraaaattcagcacaatatgtatcagtggaattcatctgatcaaacttaaaatattattccttgcattatagttctgagcaggtaccatagataatagttct

SEQ ID NO: 24762 - DNA, 201 bp, Homo sapiens
caactatttgattagcctgaggtacagttcacacaggaaaggcaggataaatgtttgattcttcccctttgtttagcagtattcaaaacaatgaattgatkcctggccatcttacaaaaaggaccaaggccttttttaggtgtcattatgaactcattgacttaaacatatttgatatggcccaatccatgtcaattatct

SEQ ID NO: 24763 - DNA, 201 bp, Homo sapiens; identical to SEQ ID NO: 4508

SEQ ID NO: 24764 - DNA, 201 bp, Homo sapiens
tcttacattcctatttctcccatacgtcaaatcccagttttcattaacgtcaacagaattactcatttgttatcccacgggactcaaacaatggacttagraaacaatttcagcactacagaaataatatgatactgtagcagtttaagtttttgtcattcttttcatttataaggcacatccttacaaatgcccagtagg

SEQ ID NO: 24765 - DNA, 201 bp, Homo sapiens
tttgtcaaaggtcttttctgcatctattgagataatcatgtggtttttgtctttggttctgtttatatgctggattacatttattgatttgcatatattgyatcccagggatgaagcccacttgatcatggtggataagctttttgatgtgctgctggattcggtttgccagtattttattgaggacttttgcatcaatgt

SEQ ID NO: 24766 - DNA, 201 bp, Homo sapiens
ttttgtcaaaggtcttttctgcatctattgagataatcatgtggtttttgtctttggttctgtttatatgctggattacatttattgatttgcatatattscatcccagggatgaagcccacttgatcatggtggataagctttttgatgtgctgctggattcggtttgccagtattttattgaggacttttgcatcaatg

SEQ ID NO: 24767 - DNA, 201 bp, Homo sapiens
ttcttcctacccatgagcatggaatgttcttccatttctttgtatcctcttttatttcattgagcagtggtttgtagttctccttgaagaggtccttcacrtcccttgtaagttggattcctaagtattttattctctttgaagcagttgtgaatgggagttcactcatgatttggctctctgtttgtctgttattggtgt

SEQ ID NO: 24768 - DNA, 201 bp, Homo sapiens
tctctgatggccagtgatgattagcattttttcatgtgtcttttggctgcataaatgtcttcttttgagaagtgtctgttcatatcctttgcccacttttkgatggggttgtttgtttttttcttgtaaatttgtttgagttcattgtagattctggatattagccctttgtcagatgagtaggttgcgaaaattttctcc

SEQ ID NO: 24769 - DNA, 201 bp, Homo sapiens
aataggaagcatagagaaaatggattgtcagtgtaactgcgtgttggaggctaaaaagaatgttagaggagtaatataaataggtgaatgactctagagtrtctggaagggcatattttaaatggttgactatgtagtctaattatgtgaagaggtaaataaagaaatgtagggccagatagaaagaattagaagagaaat

SEQ ID NO: 24770 - DNA, 201 bp, Homo sapiens
taagtagagacagggtttctccatgttggccaggctggtctcgaactcctgacctcaggtgatccgcctgcctcggcctcccaacatgctgggattacagrcgtgagccactgtgcctggccaatgtactgcattttatttatccagtgcaccattgatgggcatttaggattattctctgtctttgctattgtgaatagt

SEQ ID NO: 24771 - DNA, 201 bp, Homo sapiens
atgtcgctgtcgtccacaaaatagctttttagaacaaaggcatcagccagtttctcaaggactaggaagtagcgtcattctgagatctcagccatttcgayaaaaaatagatataagaaataggacagaaaatgtcagatcgtatgtgcgttctagaccgctgattcgtcgatttgtaaaacaagagaaggataagatggt

SEQ ID NO: 24772 - DNA, 201 bp, Homo sapiens
aacatcctaccgtgcacaggacagccgcccaacaataaagaattagctcaaaatgtcagtagttccactgttgagaaactctgctttaaagagtcttggacttagttctgacgtgaagttaagttgctcagtaccaatttattcctttcaaggcttcattttaagatttgttagtacacattcagagcagcttttagtgta

SEQ ID NO: 24773 - DNA, 201 bp, Homo sapiens; identical to SEQ ID NO: 4598

SEQ ID NO: 24774 - DNA, 201 bp, Homo sapiens; identical to SEQ ID NO: 4599

SEQ ID NO: 24775 - DNA, 201 bp, Homo sapiens; identical to SEQ ID NO: 4600

SEQ ID NO: 24776 - DNA, 201 bp, Homo sapiens; identical to SEQ ID NO: 4601

SEQ ID NO: 24777 - DNA, 201 bp, Homo sapiens
cgtgcattacgtattcagatactgctttgcttcatcctctctaaaatttaacaccgaggagtttaagaaatgaagataaggaactcgaattatttttaaaytttggatcaatgtaaaggcaatctaatatttggaaaatacttgcaatgttgttctcctggcgagaagatcctggagcccagtgcctgctgctttctcttc

SEQ ID NO: 24778 - DNA, 201 bp, Homo sapiens; identical to SEQ ID NO: 4871

SEQ ID NO: 24779 - DNA, 201 bp, Homo sapiens; identical to SEQ ID NO: 4874

SEQ ID NO: 24780 - DNA, 201 bp, Homo sapiens; identical to SEQ ID NO: 4876

SEQ ID NO: 24781 - DNA, 201 bp, Homo sapiens; identical to SEQ ID NO: 4879

SEQ ID NO: 24782 - DNA, 201 bp, Homo sapiens; identical to SEQ ID NO: 4880

SEQ ID NO: 24783 - DNA, 201 bp, Homo sapiens; identical to SEQ ID NO: 4528

SEQ ID NO: 24784 - DNA, 201 bp, Homo sapiens
gcaatatacaaattcaatacaattcgtatcaaaatttcaatgaattttttacagaaatataaaaaacttccctaaaatttgcatggaaccacaaaacaccycaaatacccaaagcaatattgagcaaagtaaataaataaataaaacaaaacatacaaacaaaaaaataaagctgaagacatcatactacctggcttcaaa

SEQ ID NO: 24785 - DNA, 201 bp, Homo sapiens
ttccatacaatacacattcttccccactttgagttttttcacttaaaaatataaacgagattatttcatagtagtatagtatttacacatattccatactkcttaatggtgtcttttgattagcaattaatgagctccaatttatcaatattatcttttttttttttttttgagacagattctcattctgttgcccaggct

SEQ ID NO: 24786 - DNA, 201 bp, Homo sapiens
ttcttgtgtgtccaacatgctattaaaagtattccttgagttgttaattttggttattgtgtttttcattttaaaaattataattattactgatcaagtcwgccatgatattttttataggtttctgttccctgcaattttttttttcaagacaagtcttgctccgtcgctcaggcgtgatcatagctcactgcaatcttg

SEQ ID NO: 24787 - DNA, 201 bp, Homo sapiens
aaccctggaggtggaggctgcagtaagccaagatcatgccactgcactccagcctgggtcacagagtgagactctgtctcaaaaaaaaaaaaaaaaaaaaraaagaaagaattaaattttgggaagtcattattagcaatattgtgtagtatccattggacaggatgagagtagaggaaaggagatcattaaaatatacag

SEQ ID NO: 24788 - DNA, 201 bp, Homo sapiens
tgggagatacagtaaaataataaatagatgctatcaaggttcatggaaatgttgagttcagtatgcaaaatgtcatgtaaatagacgtagacaataatcaktttaatttgttgatctgagtggggctgaattctaaatatagactttgattcatctgcataaggaagctggattatggataaaaccatctatgaacaatgt

SEQ ID NO: 24789 - DNA, 201 bp, Homo sapiens
gcttgaacccgggaggtggaggttgcagtgagatgagatcatgctactgtactccagctctgggtgacagagcaagacttcgtcttgaaaaaaaaaaaaaraaaaaagaaaggtcttcccaactcctatattgaacattcattaattaaatgcatttaataaatacttattgagtgttctctatgtgccaggcatgttcta

SEQ ID NO: 24790 - DNA, 201 bp, Homo sapiens
gaattaaagagttaaagtaattaagaaaacagagacagaactactgagtaccccccaaaagcaattatcttcaaaatatggaaaaccagattgggatacaraaaggtttcttgttaaagataaaggaggcctgagtaagtttatatctcatgggaaaatggtaccagagaagaaaaggttgaagattagaagagttgaaaa

SEQ ID NO: 24791 - DNA, 201 bp, Homo sapiens
ctggggaagctgccgcctccggccctgcccggctgcctccgccgcggccagtggctatggagcaggcgggcaccagacctgcggcgacagagcatccacgrctccggcggcccatgccctggctgctgctactgcctctcctgctgctgttgctgctgctgctacctggccctgcggcctcccagctgcgatactctgtgc

SEQ ID NO: 24792 - DNA, 201 bp, Homo sapiens
taagtttatatctcatgggaaaatggtaccagagaagaaaaggttgaagattagaagagttgaaaattaaagggccaaggctggttttttgttggtttgtwttgttttgttttgtttttaaagagggttttactctgtcgctcaggctggagtgcagtgatgtgatcactgctcactgcagccttgacaccccgggctcaa

SEQ ID NO: 24793 - DNA, 201 bp, Homo sapiens
cacgccaggctaattttttgtatttttagtagagacgaggtttcaccgtgttagccaggatggtctagatctcctgacctcgtgatccaccggcctcggcytcccaaagtgctggccgagtgccaccgcacccggccgaaaggtattttttttaacagaagaaaatcagattattcctagatcagaaagaagctccattgt

SEQ ID NO: 24794 - DNA, 201 bp, Homo sapiens
gttttgttttgtttttaaagagggttttactctgtcgctcaggctggagtgcagtgatgtgatcactgctcactgcagccttgacaccccgggctcaagcratcctcctacctcagcctcctgagtagctgggattacaagcacgtgccaccacacctggctaatttttaattttttatagagatggagtctcactgtgtt

SEQ ID NO: 24795 - DNA, 201 bp, Homo sapiens
attttttatttttttgagacggagtctcgctctgttgcccaggctggagtgcagtggcacgatctcggctcactgcaagctccgcctcccaggttcacgcyattctcctgcctcagcctccggagtagctgggactacaggtgcccgccaacacgccaggctaattttttgtatttttagtagagacgaggtttcaccgtg

SEQ ID NO: 24796 - DNA, 201 bp, Homo sapiens; identical to SEQ ID NO: 4823

SEQ ID NO: 24797 - DNA, 201 bp, Homo sapiens; identical to SEQ ID NO: 4884

SEQ ID NO: 24798 - DNA, 201 bp, Homo sapiens; identical to SEQ ID NO: 4825

SEQ ID NO: 24799 - DNA, 201 bp, Homo sapiens
actccacaaaaacactcttggaactaataaacaaaataaagttgaaagataaaaaatcaacgtacaaaaatcaatagcatttctatacactattgaactayctgaaaaataaatcaagaaaaccatgctatttacaatagctatgagaaaataaaaatacttaggaataaatttaaccaagaggatgaaagacctgcaagt

SEQ ID NO: 24800 - DNA, 201 bp, Homo sapiens
cataattatctttggtcttatataaagaaaaccctacagactccacaaaaacactcttggaactaataaacaaaataaagttgaaagataaaaaatcaacktacaaaaatcaatagcatttctatacactattgaactacctgaaaaataaatcaagaaaaccatgctatttacaatagctatgagaaaataaaaatactt

SEQ ID NO: 24801 - DNA, 201 bp, Homo sapiens
atagactaatggattgcatcaaactaaaaagctcctgcacagcaaagaaaacaagagtgaagggacaatccacagaatgggagaaaatatttgcaaaccayagatctgataaggagttaacataccaaatatataaggaactcaaacaactcaatagtaagaaaacaaataacacgatttaaaagatgggtaaaggatgtg

SEQ ID NO: 24802 - DNA, 201 bp, Homo sapiens
tgtcttgtgctggttttcaaggggaatgcttccaggttttgcccattcagtgtggtattggctgtgggtttatcatatatatggctcttattattttgagrtatgttccttcaatacctagtttattgagcatttttaacatgaagggatgttgaattttatcgaaggccttttctgaatccattgagataatcatgtggg

SEQ ID NO: 24803 - DNA, 201 bp, Homo sapiens
gacattcttgccttaaccctgatcttatgagaaaagtgttccatattttacaattaagtatgtgctactcataggtttttcccaaatactttattaaattkaggaagtacccttttctggtttgctcagagttttatcatgattcattgttgaatttcatcaattttcttttaatctattgatatgagcatatgatttttc

SEQ ID NO: 24804 - DNA, 201 bp, Homo sapiens; identical to SEQ ID NO: 4455

SEQ ID NO: 24805 - DNA, 201 bp, Homo sapiens
ttgttagatttaacttgtattttagtaaatatttttacatctgtgttcatgtagaatatctgtaaataattttgtaaagaatatcttttcttcttgagggrtaatgttttcattaggttttagtatttctaacctaataaaatgacttaggaggtgttccttcctctattttctgaaaggttgtgtaatattggtgttatt

SEQ ID NO: 24806 - DNA, 201 bp, Homo sapiens
ataatctgtagtgataacatctttttcatttttgatattggtgatttgtgttctatcctcttttttatcaataagtctagctgagaatttatcaattttgytgatttttttcgaatagccagcttttggctttgttgatatattttctattgtttggtttctatttcattaatttctgcttttgtctgtattatttgcctt

SEQ ID NO: 24807 - DNA, 201 bp, Homo sapiens
gtgtgatattaatgtggccattctagtctcatgttttctgttttcatggcatattgctttttgttcattttacttttgtttctttaaagtatgcccttgtwgaagcgtattgttggatcttgctgttttacccattttgataatatctgctttttaactgaagtgcttagcccattcacattagtgtaatatttgatatgt

SEQ ID NO: 24808 - DNA, 201 bp, Homo sapiens
tctgtttacctagtcatttaccatttctagtgccattaatttgttcctaaagagctgagtttatccataatgtctttttgcttcaacctgaaaaactttayttagcagtttttgtaatgcatatatgctgcagtgatttatcttagttttcctttatctgaagatctatttatcttccatttgaatgatatagaattctgg

SEQ ID NO: 24809 - DNA, 201 bp, Homo sapiens
tgcagtgatttatcttagttttcctttatctgaagatctatttatcttccatttgaatgatatagaattctgggggattgacagattttattttcttccayttaaaaaaaatgttattctactgtcttctaatgctcatagtttctgatgagaagtgtgtagtcatttaagtcattattccctgtgtgcgatatgattgtt

SEQ ID NO: 24810 - DNA, 201 bp, Homo sapiens
gcagtgatttatcttagttttcctttatctgaagatctatttatcttccatttgaatgatatagaattctgggggattgacagattttattttcttccacktaaaaaaaatgttattctactgtcttctaatgctcatagtttctgatgagaagtgtgtagtcatttaagtcattattccctgtgtgcgatatgattgttt

SEQ ID NO: 24811 - DNA, 201 bp, Homo sapiens
cattgacttttgcctcttttagctccatttttcccaagatcaggcagtgagttttaatttcaaatattatatttttattgctaaaatttccattggctttyttatattttcctttttttctgataagatttcctttattttcattccttaccaataagttttcctttatcttattgaatatatagtagctactttaaagtc

SEQ ID NO: 24812 - DNA, 201 bp, Homo sapiens
tttaacgagtttttactttgcaccatgcacttatgctatgtgctgtataaggatagttacatttaatctataaatcaaccctatggggcgggcactcttakgaactttttttacggatgaaaactgaggcccagagatatgaaataatttgccaaacatcaccataatttacatgatgtagccaggtttaagcctactatt

SEQ ID NO: 24813 - DNA, 201 bp, Homo sapiens
atgcaagtccgaaatccagtagggcagttattaaatcttaaagctccaaataatcttcattgactccatgtctcacatccagggcacactcgtgtgagggrtgggctcccaaggccttgggaagctccactcctgtggctttgtggggttcagttcctgcagctgctctcatgggttggtgttgaatgcctgcagcttttc

SEQ ID NO: 24814 - DNA, 201 bp, Homo sapiens
tttttttgagacagagttttgctcttgttgcccaagctggagtgcaatggtaagatctcggctcactgcaacctccttctccagggttcaagtgattctcmtgcctcaaactcccgagtagctgggattacaggtgcctgccaccatgcccagctaatttttgtatttttagtagagacagggtttcaccatgttgggcag

SEQ ID NO: 24815 - DNA, 201 bp, Homo sapiens
gatcccagcactttgggaggctgaggcgggtggattgcctgaacccaggagtttgagaacagcctgggcaacatggcaaaaccccatctctacaaaaaaaatataaaaattagccgggtgtggtggcatgcacttgtagtctcagctacttgggaggctgaggcacgagagtcacttgaacctggaaggtggaggttgcag

SEQ ID NO: 24816 - DNA, 201 bp, Homo sapiens
agtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctcaa

SEQ ID NO: 24817 - DNA, 201 bp, Homo sapiens
cagtcattttggtggggccattattctgcctaccacccggtctttcatgttcaggcagaggtggctctgtgtgtgtgtgtgtgtgtgtgtgtgtgtgtgtgtgtaagttaatttcagtagagaatgagctagagtagagaaagagaattaaggtgagatgtgtcatggaagaacagtgactgatgatgctaactttgctca

SEQ ID NO: 24818 - DNA, 201 bp, Homo sapiens
ctttaattcttgatctgtgttcagattttgcctttcaaatgtttcattattggggctttggacatattgcacctgtattaaaagaaggatttgagtgaggratttagtgcttcatagtcaatagtcaatgagtctccttttggctcgcctccttcttagggaaaggaactggttgtagggtgttaggcagaatttgggtgt

SEQ ID NO: 24819 - DNA, 201 bp, Homo sapiens
gtgcgagactctgtctcagaagaataaataaatgaataaaataacataacttccttatcccattttcaaattgaaaaaaaaaagccaaatgtgctcctatkcgggtttcaattaagatattatgagatttgagtagggtaagaaataaaataaaaattgaaattaaaatgccatttcttttttgcattgtaatacattgaa

SEQ ID NO: 24820 - DNA, 201 bp, Homo sapiens
atctgtgtgaggaccctgatgaactaattttcttctaaagtgctatatatgtagatatcatcatagagttacacatgaaatggctcattcaatacttttttagatgcctggaaatatttaagggagtaactaatcaattagcagcattcctgggagaacattgtcttgtcattttaacagaaaactctctttgtgattttg

SEQ ID NO: 24821 - DNA, 201 bp, Homo sapiens; identical to SEQ ID NO: 4556

SEQ ID NO: 24822 - DNA, 201 bp, Homo sapiens; identical to SEQ ID NO: 4675

SEQ ID NO: 24823 - DNA, 201 bp, Homo sapiens; identical to SEQ ID NO: 4474

SEQ ID NO: 24824 - DNA, 201 bp, Homo sapiens; identical to SEQ ID NO: 4679

SEQ ID NO: 24825 - DNA, 201 bp, Homo sapiens
acataattatctttggtcttatataaagaaaaccctacagactccacaaaaacactcttggaactaataaacaaaataaagttgaaagataaaaaatcaaygtacaaaaatcaatagcatttctatacactattgaactacctgaaaaataaatcaagaaaaccatgctatttacaatagctatgagaaaataaaaatact

SEQ ID NO: 24826 - DNA, 201 bp, Homo sapiens
aaacttttcatctgattaatagtttgtaatggtttgtaattcttacttacatgatggccacatgatgtcgctctttaccgcaaattctttcgtaatcagcraaaggaagtcattccttttcgcactggaaagacgctccactctctttcactctttggatgcacaacaatggccacacatcgagattgaaatgaagggata

SEQ ID NO: 24827 - DNA, 201 bp, Homo sapiens; identical to SEQ ID NO: 4529

SEQ ID NO: 24828 - DNA, 201 bp, Homo sapiens
ctggtgggtctacttctgtaacggttgtgggtcatgaattattttttactcagacataattatctttggtcttatataaagaaaaccctacagactccacmaaaacactcttggaactaataaacaaaataaagttgaaagataaaaaatcaacgtacaaaaatcaatagcatttctatacactattgaactacctgaaaa

SEQ ID NO: 24829 - DNA, 201 bp, Homo sapiens
tgtcctgggtcttaaaaggacataaaattgaaaatgattgcatttaacaaattgcagacagatatagattgcattttgaaaatcaacgaatggatctaaartttacattggccacatgatgtcgctgtacaccacaaagtcttgtcaatagaagggagctactgatcactaaaagtgaaggaggaagctccattttgtcac

SEQ ID NO: 24830 - DNA, 201 bp, Homo sapiens
aattccacaaacttctctttatattggtttatgccttctttagatgattgtgaataagagtattatcttaacctctctggtgggtctacttctgtaacggwtgtgggtcatgaattattttttactcagacataattatctttggtcttatataaagaaaaccctacagactccacaaaaacactcttggaactaataaac

SEQ ID NO: 24831 - DNA, 201 bp, Homo sapiens
tcacatctgtaagttatttcagtgccttggaagatcatttatctggccacagataattgacttacttacatcagttttttttttttttgagatggagtctygctctgttgcccaggctggagtgcagtggcatgatctcggctcactgcaacctccgcctcctgggttcacgccattgtcctgcctcagcttcccgagtag

SEQ ID NO: 24832 - DNA, 201 bp, Homo sapiens
tcacaggaccctagtgaggttggtattgatgaagaaactgggtcccaaaaaggtgatggaatttatccgaagctccaggaagcttctttttaccatggctstgtttcttgaggttaaagaacatgatttaccaggctctgtttcttgagagaccaagagtggatccctgtagtccccattagaattctccttctagtttga

SEQ ID NO: 24833 - DNA, 201 bp, Homo sapiens
gagttggcatattatttcagtacatatctaaccttatgtactcctcacaggaccctagtgaggttggtattgatgaagaaactgggtcccaaaaaggtgayggaatttatccgaagctccaggaagcttctttttaccatggctgtgtttcttgaggttaaagaacatgatttaccaggctctgtttcttgagagaccaag

SEQ ID NO: 24834 - DNA, 201 bp, Homo sapiens
atagaattcagtattatccttggtttcggacattcagcaggggtccgaaggtgggcgaggtgagcccactttgggaggccaaagtgggcagattgcttgaycccaggagttcaggaccagtctgggcaacatggtgaaatgctgtccttacaaaaaatacaaaaattatctgggcatgatagtgcatgactgtagtcccag

SEQ ID NO: 24835 - DNA, 201 bp, Homo sapiens
tttactgggtttataaaagaattgaccagtagctatataatagatatagaaaagtctgcctgggtgtggtggctcatacttgtaataatattatattataattgttctattttattattagttattgttgctaatcttttactgtacctaatttatacattaagctttatcatgggtatgtatgtataggaaaaaatgcag

SEQ ID NO: 24836 - DNA, 201 bp, Homo sapiens
ctctcttcctatttgaataccctttatttctttctctttcctaattgccatagccagaacttccaatactatgctgaataggagtggtgaaagagggcatmcttgtcttgtgctggttttcaaggggaatgcttccaggttttgcccattcagtgtggtattggctgtgggtttatcatatatatggctcttattattttg

SEQ ID NO: 24837 - DNA, 201 bp, Homo sapiens
cttgaggcctccccagccatactgaactgtgagtcaattaaacctctttcttttataaattacccagtctcaggcagttctttatagcagtgtgagaacarattaatacacatatgaattttaacatagttttttcgaaatctgtgatgaatgtcaatggaagtttaataggaataccattgaatctataaattactttga

SEQ ID NO: 24838 - DNA, 201 bp, Homo sapiens
cccagtgggaggtaattgaatcatgggggcaattatcccatacagttctcatgatagtgagtgagttctcattaggtctgatggttttataagggcttttycctttttgcttggcacctctccttcctgccaccatgtgaagaaagacgtgtttgctttcccttccaccatgattctaagtttcttgaggcctccccagcc

SEQ ID NO: 24839 - DNA, 201 bp, Homo sapiens
ctagttataggtctagaagcaaacaggggtggtggggggtgggtcctgaggagaatcaacattatcttgcctggcaactgcctcaggggaagccatcactrttgcctcaggcagtgcagggtttttctcctcagacaaatgtggaaaggctgatggcagtgtgggttggggaggacatgttgccactactggggatgagaa

SEQ ID NO: 24840 - DNA, 201 bp, Homo sapiens
tccaatcagcaaaatgtcatcaaggtaatgaaccagtgtgatatcttatggaagggaaaatcaatcaagttctctccaaacaagattatgacacaaagccrgagagttgatatacccctgaggtaggatggtaaagatatattgctggccttgctgactgaaggcaaattgcttctggtgggccttatggacaggaatgga

SEQ ID NO: 24841 - DNA, 201 bp, Homo sapiens; identical to SEQ ID NO: 4578

SEQ ID NO: 24842 - DNA, 201 bp, Homo sapiens
cacactctccaatgagatttgaaatgtcctgggtcttaaaaggacataaaattgaaaatgattgcatttaacaaattgcagacagatatagattgcatttkgaaaatcaacgaatggatctaaaatttacattggccacatgatgtcgctgtacaccacaaagtcttgtcaatagaagggagctactgatcactaaaagtg

SEQ ID NO: 24843 - DNA, 201 bp, Homo sapiens; identical to SEQ ID NO: 4452

SEQ ID NO: 24844 - DNA, 201 bp, Homo sapiens; identical to SEQ ID NO: 4453

SEQ ID NO: 24845 - DNA, 201 bp, Homo sapiens
acagtgatctttgccccataattgtaaaatgagatattagaatcatccttatttatcttaaccacctactccactgtacagttcctataattccacaaacwtctctttatattggtttatgccttctttagatgattgtgaataagagtattatcttaacctctctggtgggtctacttctgtaacggttgtgggtcatga

SEQ ID NO: 24846 - DNA, 201 bp, Homo sapiens
atggaaaaaatgctgggtttattcctcctgttattgtattttacaagtctgtcgagggtccacagtgatctttgccccataattgtaaaatgagatattaraatcatccttatttatcttaaccacctactccactgtacagttcctataattccacaaacttctctttatattggtttatgccttctttagatgattgtg

SEQ ID NO: 24847 - DNA, 201 bp, Homo sapiens
gttgtaagccagtgtggattgggagtccataccccttatttatctattctgtgtatcctattaataacagtaattatcaggttattttgcctttgaacacsttagtaagtctgagcatttacatggaaaaaatgctgggtttattcctcctgttattgtattttacaagtctgtcgagggtccacagtgatctttgcccca

SEQ ID NO: 24848 - DNA, 201 bp, Homo sapiens
gagtcatgatgttttactggttataaaatggaaagagttttccctgggagaatatggagactaacaggtattcatgagaagagagtaacttaagtgagtayacagaaaattccaaatgtacctagaaatgaggaatagtccactttgggtaaagcacatggttcccataagagagagtgtgatataaagcaagaaaagtaa

SEQ ID NO: 24849 - DNA, 201 bp, Homo sapiens; identical to SEQ ID NO: 4684

SEQ ID NO: 24850 - DNA, 201 bp, Homo sapiens
gatttacattagatgcacaccaagctgctttcggagagtccagatttatggggataagagcatcactaggtatatcaacagccctagggtggatacctttragcctgtaaatttggctctgtgttggacgatgaaccatggaatacagaagaagctcccttctctcagctaaagcctattagcaaaaatagagccctgagg

SEQ ID NO: 24851 - DNA, 201 bp, Homo sapiens; identical to SEQ ID NO: 4518

SEQ ID NO: 24852 - DNA, 201 bp, Homo sapiens
ctatttcttgtacattaatacttttcactattctaattatggtgatgcctttagctattaagaatttctgggattgaaatgtgtcagaagttagttattargtattgtggattctgaagctctctaaatcaagtcctccctttaccaatttttgtatgtgtagccattggtaaaggatttgttattcagttccttggcatt

SEQ ID NO: 24853 - DNA, 201 bp, Homo sapiens
ccatattgatatggtttggctgtgtccccacccaaatctcaccttgaattgtagttcccataatccccacatgttgtgggagggacccagtgggaggtaaytgaatcatgggggcaattatcccatacagttctcatgatagtgagtgagttctcattaggtctgatggttttataagggctttttcctttttgcttggca

SEQ ID NO: 24854 - DNA, 201 bp, Homo sapiens; identical to SEQ ID NO: 4460

SEQ ID NO: 24855 - DNA, 201 bp, Homo sapiens
ctataaaggctcttttttggttccatattgatatggtttggctgtgtccccacccaaatctcaccttgaattgtagttcccataatccccacatgttgtgrgagggacccagtgggaggtaattgaatcatgggggcaattatcccatacagttctcatgatagtgagtgagttctcattaggtctgatggttttataagg

SEQ ID NO: 24856 - DNA, 201 bp, Homo sapiens; identical to SEQ ID NO: 4464

SEQ ID NO: 24857 - DNA, 201 bp, Homo sapiens
gtgtgtggtgttatttctgagttctctattctgttccactggtctacacgtctgtttttgtaccagtaccgtgctgttttggttactgtagttttgtggtrtatatgaagtcaatcaagtagcatgatgcctccagctttgttcttttgcttaggatcggcttggctataaaggctcttttttggttccatattgatatgg

SEQ ID NO: 24858 - DNA, 201 bp, Homo sapiens
aggcacttttgtcatgaaatctttgcctgtgcctatgtcctgaatggtattgcctagcttttcttctagggtttttatagtttcatacttttatgaattamgtctttaattaatcttgagttaatttttgtataagatgtaaggaaagggtccagtttcaattttctgcatatggctagccaattctcccagcaccattta

SEQ ID NO: 24859 - DNA, 201 bp, Homo sapiens; identical to SEQ ID NO: 4681

SEQ ID NO: 24860 - DNA, 201 bp, Homo sapiens
tgggattgctgcgtcaaatggtatttctgcctctagatctttgaggaatcgccacacagtctcccacaatgagtgaactaatttacaaccccaccaacagkgtaaaggtgttcctttttctccatctgttgtttctggacttgttaataattgccattctgactggtgtgagaagatatttcattgtggttttgatttgca

SEQ ID NO: 24861 - DNA, 201 bp, Homo sapiens
ctctgcctccctgagagcaggcatgcacaggtatgtatttccctcctcattcactcagaagtaaccttaacttggtatggctcagataaactgcatctccmtaggccagaagcagctgtcaaaactaaaaagctttaggtactttgccaggaaaatgcaattattttgtccccatgtttattccttgaaagatcgcaaatg

SEQ ID NO: 24862 - DNA, 201 bp, Homo sapiens
taggatgatttatattcctttgggtacatacccagtaatgggattgctgcgtcaaatggtatttctgcctctagatctttgaggaatcgccacacagtctyccacaatgagtgaactaatttacaaccccaccaacagggtaaaggtgttcctttttctccatctgttgtttctggacttgttaataattgccattctgac

SEQ ID NO: 24863 - DNA, 201 bp, Homo sapiens
aggaaacttacaatcatggtggaaggcaaaggggaatcaagctcatcttacatggcatgagcaggagcaggagcaagagagagagaagggggaagtgatamacacttttaaacaacaagatctcatgagaactctctcactattatgagaacaacattaagggggaaatccacccccatgatccaatcacctctcacaggc

SEQ ID NO: 24864 - DNA, 201 bp, Homo sapiens
gcctgcagcttttccaggcacagtgtgcaagctgcttagaactgctggtggattcccattttggggtcttgagggtggtggccctcttctcacagccattkcactccagcctgggcaacaagagtgaaactccatctcaaaaaaaaaaaaagaaagaaagaaatttcctctgccagataccctaaactcatcattctcaaa

SEQ ID NO: 24865 - DNA, 201 bp, Homo sapiens
tggattatatcttgatattattaatgtgttattcttgagattcatcattctgtttgtattagtccattattgcactgttataaagaaacacccaagactcrgtaatttataaagaaaagaggtttaattggctcacagttccacaggctgtaggaagcatgatgccggccatctgcttggcttctggggagccttcaagaa

SEQ ID NO: 24866 - DNA, 201 bp, Homo sapiens
ctaaaatttccattggcttttttatattttcctttttttctgataagatttcctttattttcattccttaccaataagttttcctttatcttattgaatawatagtagctactttaaagtcattgtccgctaattcccacatctgtgtcatctcaggtttggattcttgatggtctttacctttaggaatgcatcacattt

SEQ ID NO: 24867 - DNA, 201 bp, Homo sapiens
aggctgggaggctaagccagtctaatctctccacgttcttctgtctgcttttattctggctgcactggcagctgattagatcgcacccacccagactgagrgtaagtgtgtctttcccagtccactgacacaaatgttagtctcctttgataacaccctcacagacacacccaggaacaatactttgcatccttcaatcca

SEQ ID NO: 24868 - DNA, 201 bp, Homo sapiens
acatcaacgacaactcaccgcgtttcccgcggcccaactaccagcttcaggtaagcgaatcggtggcgcctggagcgcgctttcacatagagagtgcgcasgaccccgacgtgggcgccaactcagtacagacctacgagctcagccccagcgagcacttcgagctggaccttaagcccctgcaggagaacagtaaagtgc

SEQ ID NO: 24869 - DNA, 201 bp, Homo sapiens; identical to SEQ ID NO: 4475

SEQ ID NO: 24870 - DNA, 201 bp, Homo sapiens; identical to SEQ ID NO: 4476

SEQ ID NO: 24871 - DNA, 201 bp, Homo sapiens
cctgatcttatgagaaaagtgttccatattttacaattaagtatgtgctactcataggtttttcccaaatactttattaaatttaggaagtacccttttcyggtttgctcagagttttatcatgattcattgttgaatttcatcaattttcttttaatctattgatatgagcatatgatttttcttcgttttactaatatg

SEQ ID NO: 24872 - DNA, 201 bp, Homo sapiens
tgtgaaatatatatatatatatatataccaatggaatactcatcagccattagaaagaatgaaatcctgtcattcgtgacaatatggatgaatctggaggwcattatgtttagttaaataagccaggcacagaaagacaaatactgcatgatctcattcatgtggaatgtaaaaaagctgatcttatagaagcagagagta

SEQ ID NO: 24873 - DNA, 201 bp, Homo sapiens
atatatccaaaggaaatgaaatcagtatgtcaaagacctatccgcactcccatgttcattgcagcattattcatgatagttcagatatagaatcaacttargtgttcatagtggatgaatagataaagaaaatgtgaaatatatatatatatatatataccaatggaatactcatcagccattagaaagaatgaaatcctg

SEQ ID NO: 24874 - DNA, 201 bp, Homo sapiens
acactgatctgagcaatgatgttttttatatgaccctgaaagcacaggcaataaaagcaaaaatagactaatggattgcatcaaactaaaaagctcctgcrcagcaaagaaaacaagagtgaagggacaatccacagaatgggagaaaatatttgcaaaccatagatctgataaggagttaacataccaaatatataagga

SEQ ID NO: 24875 - DNA, 201 bp, Homo sapiens
tgcatttattaaaatatatgttgttctgattttaaaatatatccctaccaattgtgaagatatcggctaatccaataaaaaagcaaaaccatattttgtakaattatggtcgtattctgttaaataaacttttaaatcctattgggttgtaatctgtagtctgggaagggctctgcctaacgattcagacccctaccagat

SEQ ID NO: 24876 - DNA, 201 bp, Homo sapiens
aagatgaaagatcaataacactgatctgagcaatgatgttttttatatgaccctgaaagcacaggcaataaaagcaaaaatagactaatggattgcatcaractaaaaagctcctgcacagcaaagaaaacaagagtgaagggacaatccacagaatgggagaaaatatttgcaaaccatagatctgataaggagttaaca

SEQ ID NO: 24877 - DNA, 201 bp, Homo sapiens
tccctaaaatttgcatggaaccacaaaacaccccaaatacccaaagcaatattgagcaaagtaaataaataaataaaacaaaacatacaaacaaaaaaatraagctgaagacatcatactacctggcttcaaaatatacttcaaagctataataatcaaaacagcatggtactggcataaaagacatgtagaccaatggag

SEQ ID NO: 24878 - DNA, 201 bp, Homo sapiens
tttatgttcatagcttggaaaaattaatactgtttaaaatgtccatattacccaaagcaatatacaaattcaatacaattcgtatcaaaatttcaatgaaktttttacagaaatataaaaaacttccctaaaatttgcatggaaccacaaaacaccccaaatacccaaagcaatattgagcaaagtaaataaataaataaa

SEQ ID NO: 24879 - DNA, 201 bp, Homo sapiens
ttctttctcttttttttttttttcagatggagtctcgctctgttgcctaggctggagtgtagtgacaggattttggctcactgcaacctccgcctcccggrttcaagcaattctctgcctcagcctcgggagtagctgggattacaggcgcccaccaccacgcctggctaattttttgtatttttagtagagacgaggttt

SEQ ID NO: 24880 - DNA, 201 bp, Homo sapiens
ttgaatctataaaaatatgaagcttgttaacattgacaatattgagacagacaaccgattaacaaggtatattcttccatttatcttttttttttttttttgagacggagtctcgctctgtcgcccaggctggagtgcagtggcgcagtctcggctcactgcaagctccgcctcccgggttcatgccattctcctgcctca

SEQ ID NO: 24881 - DNA, 201 bp, Homo sapiens
tactaaaagaaaatactggattacacactctccaatgagatttgaaatgtcctgggtcttaaaaggacataaaattgaaaatgattgcatttaacaaattrcagacagatatagattgcattttgaaaatcaacgaatggatctaaaatttacattggccacatgatgtcgctgtacaccacaaagtcttgtcaatagaag

SEQ ID NO: 24882 - DNA, 201 bp, Homo sapiens; identical to SEQ ID NO: 4584

SEQ ID NO: 24883 - DNA, 201 bp, Homo sapiens
agttgttacaatttggtgttcatgtggcgggggaggggggggatggtgtaggcttctgttccactatcttgctccacctcaatagtctgatgtgcagaagytctttagtttaattaggccccatttgccaatttttgtttttgctgcaagtgcgtttggcatctttgtcatgaaatctttgccagggcctatgcccagaat

SEQ ID NO: 24884 - DNA, 201 bp, Homo sapiens; identical to SEQ ID NO: 4516

SEQ ID NO: 24885 - DNA, 201 bp, Homo sapiens
atttctaccaactatagataaatgaaaattcacctttaaatgtctcttatcctccatgaaactcatcaaaaacaacaaaaagtacagcagacaaaaaaaaagtcttatctttaatgaaactttgtaaaacatttgaacctcaaccatgatgtgtatgaagataagttactaagtgccatgaagattggaccaagatatgaa

SEQ ID NO: 24886 - DNA, 201 bp, Homo sapiens; identical to SEQ ID NO: 4465

SEQ ID NO: 24887 - DNA, 201 bp, Homo sapiens; identical to SEQ ID NO: 4527

SEQ ID NO: 24888 - DNA, 201 bp, Homo sapiens
tagaaagctgaaatatccccattacagtttttgagtcaatacaaaaagtagataggtgttatagataaagaaataggttttcatcgatttgaaaattagamctccgagaagaaactcaggtaagaatgccattaaaatagttttagttgtttttgaaaataacatcaacaaaatgtcactattaaacagtgaaattggaat

SEQ ID NO: 24889 - DNA, 201 bp, Homo sapiens
taaattttcttgtgttagtatatttctaaaggcttttagtgaattaaatggagacactttaatatactacacagttttaaatctaaatttttttctcaagraagaacttctgtttacacaatgatgcttaaacatgactgaaatatctaaaggagaggttaactggatcagtcaagaaaataatctgtaacatttgattga

SEQ ID NO: 24890 - DNA, 201 bp, Homo sapiens; identical to SEQ ID NO: 4551

SEQ ID NO: 24891 - DNA, 201 bp, Homo sapiens
gtttggagtctcaatccttattttttacttgaatatgattcattttaggccttgtgctctaatttggcaataccgtttattgtttcttgatttcccagttkggaaaaaaatcgagaataacaattgcatttagaattgcatctttgttcatctttagtttatcactactttatttaatactactttaataatactactgta

SEQ ID NO: 24892 - DNA, 201 bp, Homo sapiens
ttcttcctgatgttctccctcccattgctcccccaacaggccccagtgtgtgttgttccccttcatattttcatgtgtactcatcattcagctcccacacrtagtgggacgatgtggtatttggttttctgttcctgcattattatgctgaggataatggcttccagctccatccatgtccctgcaaaggacaagatcttg

SEQ ID NO: 24893 - DNA, 201 bp, Homo sapiens; identical to SEQ ID NO: 4586

SEQ ID NO: 24894 - DNA, 201 bp, Homo sapiens
catcccagggatgaagcctacttgatcatggtgaataagctttttgatgtgctgctggatttggtttgccagtatcttattgaggatttttgcattgatgyttatcagggatatcagctggaagttttcctttttgttgcatctctgccaggttttggtatcaggatgatgctggccttaaaggagttagggaggagtacc

SEQ ID NO: 24895 - DNA, 201 bp, Homo sapiens
tggacttcctactacctgttagtacagatgttacttgctcattttatgagttcacctaatgcttataactccctattgattatgcttttccaccttcagtytcaaaaattagatcattacacctgttgtcttttatggaacctcttttattctcttattcacttgtttggagtctcaatccttattttttacttgaatatg

SEQ ID NO: 24896 - DNA, 201 bp, Homo sapiens
gatatcagctggaagttttcctttttgttgcatctctgccaggttttggtatcaggatgatgctggccttaaaggagttagggaggagtacctccttttcyattgtttggaatagcttcagaagaattggtaccagctcctctttgtacctctgatagaattcagctgtaaatctgtctggtcctgggctttgtttgcttg

SEQ ID NO: 24897 - DNA, 201 bp, Homo sapiens
tacagcacacacacacttttaaatacttcaacatctcaatgttttgatgatcataaatctgaaaggatctgatttttctataaaatgtaacttgggtggtraagaggttaatggtaagttgtcttgaatcagattgaaatcccatcgtaccaagagataatatcgttttacttaacctctatgtgtttataaaaagcgaat

SEQ ID NO: 24898 - DNA, 201 bp, Homo sapiens
caggtcatcaaacattatcactgatgcttggaaagaagcactttttataatttaaaaataccttttattcttcaacttctgctggcttaaagagcactaartccacatatcctaggaggcatggctgtccaatatatactatgtgtacattgatttatgaaccaataaatgtttcatacacagttgagattttaaatgagc

SEQ ID NO: 24899 - DNA, 201 bp, Homo sapiens
tccatattcctaatgaaattggaatttttccaaaagatgaggcctggtcttggatgactacattttcacttgaaacatttattttgggtaattataacacygaactcgacaagtaaatgttacacttggaaagaacttttttagcttttccaaccaaaggcagatgtattgcaataaaataactgtcttaaacggtcctct

SEQ ID NO: 24900 - DNA, 201 bp, Homo sapiens; identical to SEQ ID NO: 4531

SEQ ID NO: 24901 - DNA, 201 bp, Homo sapiens
ttgtgatagaaaaaaagagagaaaaaacacagaagcaaaattgaagaatttgtaaatcatttctaaataatttcaataaaatgagctttgaaagggaaaawttttagataacattatctcatcaaaatgccttaaagtatattttaatattcagtaagaacagtgtatattaacatggctaatttagaggatttatatttt

SEQ ID NO: 24902 - DNA, 201 bp, Homo sapiens; identical to SEQ ID NO: 4442

SEQ ID NO: 24903 - DNA, 201 bp, Homo sapiens
atgttatttcaggatctcaagaaacagagccatggtaaaaagaagcttcctggagcttctgataaattccgtcacctttttgggacccagtttcttcatcmataccaacctcattagggtcctgtgagaagtacatgaggtgagatatgtactgaaataatatgccaactcttaagtgccaagacattaggatgcaagggg

SEQ ID NO: 24904 - DNA, 201 bp, Homo sapiens
tttttgaaatatatttttaaaacccctatccaaatcaatgaatgctttggctaaaacctacttgggaatgagggtgttctttagtgccaaatactcatctkattttagtccatggctaaaatcccaagagttacagaggagaaatagggccaaacaaggtttctattaaaataagaggtcccaagtgatgaatggaaactt

SEQ ID NO: 24905 - DNA, 201 bp, Homo sapiens; identical to SEQ ID NO: 4572

SEQ ID NO: 24906 - DNA, 201 bp, Homo sapiens; identical to SEQ ID NO: 4719

SEQ ID NO: 24907 - DNA, 201 bp, Homo sapiens; identical to SEQ ID NO: 4443

SEQ ID NO: 24908 - DNA, 201 bp, Homo sapiens
ttatttggatgaatttaaaaatgacacatgccatcttacagatatgctgtagactgtgaaaatgaaaaaaaaaacctcgtgtttagagtagacactgtttsatggattaggtaggttttcatctggactttgaaatgtatgtaagattttataaggaggagagaaaataagaagctgtttgtattagaattacacagataa

SEQ ID NO: 24909 - DNA, 201 bp, Homo sapiens; identical to SEQ ID NO: 4721

SEQ ID NO: 24910 - DNA, 201 bp, Homo sapiens
agtcactggcaggagtgtgactgactccaaagtctatattcctaattactgtgttctactttttaatagagagctcttgaaggtccaaggaaaggaatgcrtaatggtgtggtcaaggcattagtgttaatatttgtagaaagggtaattaacaacagtctgagcaatcacattctaacaactagtaaggttggcaggagc

SEQ ID NO: 24911 - DNA, 201 bp, Homo sapiens
ttatatcattcttatgtctttgcattctcatagcttagctctcacttgtatgtgagaatatacaatatttggttttcgatttctgagttacttcacttagraaaatggcgtccaggtccacccaagctgctgcaaaagctattattttatttagtttatggctgagtagtattgcatggtgtatatataccacattttctt

SEQ ID NO: 24912 - DNA, 201 bp, Homo sapiens
cagcccaggcctatctccaagtcttaacacgtcagaaagaaatgaacaaccagaagcaaatttggatctttctggtaatgtaagtccaactttcgagtttyggctttaaatatttttcatatttaacttgtctaatcatcttttcaaatatcactttaaaaaatgtcttcaaggtgttcactaacgttgaaataaatcata

SEQ ID NO: 24913 - DNA, 201 bp, Homo sapiens; identical to SEQ ID NO: 4724

SEQ ID NO: 24914 - DNA, 201 bp, Homo sapiens; identical to SEQ ID NO: 4725

SEQ ID NO: 24915 - DNA, 201 bp, Homo sapiens; identical to SEQ ID NO: 4726

SEQ ID NO: 24916 - DNA, 201 bp, Homo sapiens; identical to SEQ ID NO: 4727

SEQ ID NO: 24917 - DNA, 201 bp, Homo sapiens; identical to SEQ ID NO: 4446

SEQ ID NO: 24918 - DNA, 201 bp, Homo sapiens; identical to SEQ ID NO: 4505

SEQ ID NO: 24919 - DNA, 201 bp, Homo sapiens
ggaagcatccatattcctaatgaaattggaatttttccaaaagatgaggcctggtcttggatgactacattttcacttgaaacatttattttgggtaattrtaacactgaactcgacaagtaaatgttacacttggaaagaacttttttagcttttccaaccaaaggcagatgtattgcaataaaataactgtcttaaacg

SEQ ID NO: 24920 - DNA, 201 bp, Homo sapiens
gtggagactacccagtctttatgttaatggttgataaatcatcctttcagtatcattatcattaggccaatgtgtgcaggcctcccactgcagagattgaytacttttttctggcatctaattctatgcgtgggaatacattttccattaatgtgagctcactcaattttacctggaagcatccatattcctaatgaaatt

SEQ ID NO: 24921 - DNA, 201 bp, Homo sapiens
ttaatttgaaaatattaacatttaaaaatcacactggggtttttcaggtggtgggactttttcttcatttaagtggagactacccagtctttatgttaatsgttgataaatcatcctttcagtatcattatcattaggccaatgtgtgcaggcctcccactgcagagattgactacttttttctggcatctaattctatgc

SEQ ID NO: 24922 - DNA, 201 bp, Homo sapiens
gttatcaggcaaaaatagagagtattgagaaaagagaccctctcaattttgtttaatttgaaaatattaacatttaaaaatcacactggggtttttcaggyggtgggactttttcttcatttaagtggagactacccagtctttatgttaatggttgataaatcatcctttcagtatcattatcattaggccaatgtgtgc

SEQ ID NO: 24923 - DNA, 201 bp, Homo sapiens; identical to SEQ ID NO: 4883

SEQ ID NO: 24924 - DNA, 201 bp, Homo sapiens
gatctcatatcaagatcctcatctttgttacatctgcaaagacctttattccaaataaggtcacttatttaaacctcagaaaagtgatgtcttttggggtrtctttgacccaaaacaggtaccaagagatatcaagtgcagtgggaggaaggatatttgctgagcatggcttcttaatctcttttccccgttgtgggggaa

SEQ ID NO: 24925 - DNA, 201 bp, Homo sapiens
ccagacctgcggcgacagagcatccacggctccggcggcccatgccctggctgctgctactgcctctcctgctgctgttgctgctgctgctacctggcccwgcggcctcccagctgcgatactctgtgccagaggagcaggcacccggcgcgctcgtgggcaacgtggctcgcgcgctggggcttgagctgcggcgcttgg

SEQ ID NO: 24926 - DNA, 201 bp, Homo sapiens
gaggcagtcagctttgcagttgaaaaggtcattgcctaatctggagaaacatattcagttcaagcactggctagagactagaggcccccaggaaagggccrtaagattggtcactgccaggaagcctgtcaatgagtgtgtggactggagaggaatctttctctgcctcagcacttggagtctccgttattcacaatcaga

SEQ ID NO: 24927 - DNA, 201 bp, Homo sapiens
tgggccgcatttcttctgaagactttaggggaaatttttttcttggatcttccagcttctggtagctcttggcattgcttggcttgtggcagcataactcyagttcctgcctctgtcttcacatttccttctttcctgtgttactatatgccttctctttttctgtcttttataaggggcaaccatcattggatttatggc

SEQ ID NO: 24928 - DNA, 201 bp, Homo sapiens
gccgggttgcttgcgcatcaaccatctgggtgcgcccagtccgcgctacctggagctggacctgacgagtggagcgctcttcgtcaacgagcgcattgatmgggaggcgctgtgtgagcagcggcctcgctgcctgctcagcttggaagtgctggcgcacaaccccgtggcggtgagcgccgttgaggtggaaatattgga

SEQ ID NO: 24929 - DNA, 201 bp, Homo sapiens
aagaaaatgtcccagttcctcaaaatatgagacaaactttgcaggattataaaattggaaaaaatagatcagaaaatcacaaaataatttctctttccaaytcacattactgtgtccccaaagcttcatttgctaacagtattaatggccaggcttaggattgcctttacatacattcaatatttctttatttagttttct

SEQ ID NO: 24930 - DNA, 201 bp, Homo sapiens
gcgctacctggagctggacctgacgagtggagcgctcttcgtcaacgagcgcattgatcgggaggcgctgtgtgagcagcggcctcgctgcctgctcagcytggaagtgctggcgcacaaccccgtggcggtgagcgccgttgaggtggaaatattggacatcaacgacaactcaccgcgtttcccgcggcccaactacca

SEQ ID NO: 24931 - DNA, 201 bp, Homo sapiens
ttactgatgattgtgtaaaggttgagaaatatactgggcagcacgttttatagcagttttgcaaaacccacggaaatatccttgatgtagacatcattgtrtttggtagtcattcagtcaagggcataatgttaaattttatttcctatgtttgcttctgaagttacttaaatattaaatgaatatatttttgtttgtcaa

SEQ ID NO: 24932 - DNA, 201 bp, Homo sapiens; identical to SEQ ID NO: 4513

SEQ ID NO: 24933 - DNA, 201 bp, Homo sapiens
gtcacctttcttggcatactctgaattcattgtaagaggatttccctgaatttagcttaaatgcagcctgtaatcttctgattttctgttgacagtttctrtggttttgatgagatgtaaagtagccttttcaagtccttcatgtctttaagttaaatgacagtacttccaaagcatgcattcattttctggatctaaaat

SEQ ID NO: 24934 - DNA, 201 bp, Homo sapiens
aagcacctcccattcctcccattcactcacaaatgttctaaaaccctttacttttttagctcattcgatccttccaacgattttatgaagtgaagactttmgtcacattttgtggataaaggtgctgaggctcgcaaaacctaagttcagtattattactaagttttcttcaaatttcccgaggatatccaaaaacttgct

SEQ ID NO: 24935 - DNA, 201 bp, Homo sapiens; identical to SEQ ID NO: 4717

SEQ ID NO: 24936 - DNA, 201 bp, Homo sapiens; identical to SEQ ID NO: 4517

SEQ ID NO: 24937 - DNA, 201 bp, Homo sapiens
gagacagagtcttggcctgtcacccaggctggagtataggtgtgaatatggctcactgcagcctcgaccttctgggctcaagcaatcctcacacatcagcytcctgagtagcttggaccatagatgtgcgccaccgtgtctgactagtttttaggtgttttttttttttggaagagatgggggtctcactatgttgcacat

SEQ ID NO: 24938 - DNA, 201 bp, Homo sapiens; identical to SEQ ID NO: 4718

SEQ ID NO: 24939 - DNA, 201 bp, Homo sapiens
gttgcttattaaacatcagcatttaaccccagactctaatctgttggtagattttacccccagtgagcttatttcataaatcacttgtgcagtgaggattytgaagtaactatttggcaatagggcagaatttctctttggaaatttctgaacttgatactgaatgttgttggcactcccttcagagtctccataaaaaga

SEQ ID NO: 24940 - DNA, 201 bp, Homo sapiens
cattttaaaaacctcccagatgccagaagcctgctagactctgactatatagctacgcttttatgaatatctgaagatatgcatgtgtctaatgagcaaarcagatataatccctttcatagagtttactgtctgacaaagaaagaattaggatacatgcaacagtatgtaataaagtgcaaaatctagtactgtgtagct

SEQ ID NO: 24941 - DNA, 201 bp, Homo sapiens; identical to SEQ ID NO: 4722

SEQ ID NO: 24942 - DNA, 201 bp, Homo sapiens
agagtttactgtctgacaaagaaagaattaggatacatgcaacagtatgtaataaagtgcaaaatctagtactgtgtagctacttaaaacatattatatgytttcttcctttccttttccctgcctgatcttactgccataagaaatcttgtaactgtgattctgtcaaatgaatctaagaaggatgttgttgctgatgga

SEQ ID NO: 24943 - DNA, 201 bp, Homo sapiens; identical to SEQ ID NO: 4723

SEQ ID NO: 24944 - DNA, 201 bp, Homo sapiens; identical to SEQ ID NO: 4473

SEQ ID NO: 24945 - DNA, 201 bp, Homo sapiens; identical to SEQ ID NO: 4676

SEQ ID NO: 24946 - DNA, 201 bp, Homo sapiens
aggcttagcattgcatgtatttgctatttcggggatccagttaggaaacacttattaagcacctcccattcctcccattcactcacaaatgttctaaaacsctttacttttttagctcattcgatccttccaacgattttatgaagtgaagactttcgtcacattttgtggataaaggtgctgaggctcgcaaaacctaag

SEQ ID NO: 24947 - DNA, 201 bp, Homo sapiens
gctgtcgtatgaattgcagtcggcggcggttggtgcacgcatcccgtttcgcgtggggctgtacacgggcgagatcagtacgacgcgcgctctggatgagrctgactcgccacgccagcgcctactggtgctggtgaaggaccatggcgagccgtcgctgacggccacggccactgtgcttgtgtcgcttgtggagggcag

SEQ ID NO: 24948 - DNA, 201 bp, Homo sapiens
atggcattctttcagtgttaatactctccatgccctgtctccagctcttagaaattatagatgctaagttaatgcagagtttagaagtgtatttgttattwtatcaaataggtttatgaaatatatacttccccctctgatattttgaaaaaaaatcttccttaatgtcttatattataagtaatataaaaaacttagtaa

SEQ ID NO: 24949 - DNA, 201 bp, Homo sapiens
cgacatagggatatcttgtactgtgtgtgtgtgtatatatatgtatatatgtgtatatatatatgtatatatatatgatgggctctccttacatatatatmtatatatgtacttatgtatatataagccaggcatggtggtacatgcctttagtccctactgtagtgctacttgggagggtgaggtgggaggacggcttga

SEQ ID NO: 24950 - DNA, 201 bp, Homo sapiens
aggacggcacatagcgtcttcgcggtccctattgcgcaggacctgggtctggagcttgtggagctgataccgcgcctgtttcagttggattccaaaagcckcagaaaccttctggaggtaaatctgcagaatggcatttttgtgagttctctgatagacctcgaggagctgtgtgggaggatctcggagtgcagcatccac

SEQ ID NO: 24951 - DNA, 201 bp, Homo sapiens
tattgttggctgggaagctcataacaactgacaaatgatttgtgaccaaataactgtttttacttgactaagccatgatagagcagaattagcatcacggrataaatcctataattttgttaatacagtggttggataatgtaattctaatctgttggttttggagaacctcctggggttctgacaacggtgtcaaaattt

SEQ ID NO: 24952 - DNA, 201 bp, Homo sapiens
aaattttgttgcatcttctttttttcctcctaaatcctaagggtatatgaaaagacaaagaaaattcaagcaagttacaacttcaggcaaagaaaactctsataagcaattcctgtattttacttagcattttctatgaaattccatttccacaagcactaaggtaatttaccatttagttgaattgtttgattaattttc

SEQ ID NO: 24953 - DNA, 201 bp, Homo sapiens
cattcctgattgagagtagatttttctcatggacatttcagatagatttattcatttatcagaagtgcctggtgttagtcaatgctgagaaaccatgggargcagattgtagattaagaaaaatgggggaataaatcaaagagtttccagaagtctttagatcgtagcatttgaaagcacgtaaaagggtttagctttaaa

SEQ ID NO: 24954 - DNA, 201 bp, Homo sapiens
aaattaccctttatctaataatagcattaagcacagtgtcttttatatttcttttgacaatcatcattttgagcatcatcaagtgctaccgctacactgcrtatggcactgcatgctgtggaggcttctgtggagtaagggaaaggtcccctgcagaactgtacaaacaagccaacaacaatattgatgccaggataccgc

SEQ ID NO: 24955 - DNA, 201 bp, Homo sapiens
ccacttttgaaaatgaaaaataggaaagaaacttggtgatgatattagacaatttaaataattagcctgatgacatcaaaattcaaatatgtttttaattrcttaacgttttatagtttatttaagttatcttatacttgtagagccattcttggttactctttcctggtgttgtaaaggtgtcatatttcagttgccttt

SEQ ID NO: 24956 - DNA, 201 bp, Homo sapiens
ttacttaacgttttatagtttatttaagttatcttatacttgtagagccattcttggttactctttcctggtgttgtaaaggtgtcatatttcagttgccyttattattatatgcagtaggaatgaatggcaacaaattattggtttaaagattttgacttgagtattaatagacttacaaaatctatgtgtacttgttca

SEQ ID NO: 24957 - DNA, 201 bp, Homo sapiens; identical to SEQ ID NO: 4557

SEQ ID NO: 24958 - DNA, 201 bp, Homo sapiens; identical to SEQ ID NO: 4445

SEQ ID NO: 24959 - DNA, 201 bp, Homo sapiens; identical to SEQ ID NO: 4494

SEQ ID NO: 24960 - DNA, 201 bp, Homo sapiens; identical to SEQ ID NO: 4496

SEQ ID NO: 24961 - DNA, 201 bp, Homo sapiens; identical to SEQ ID NO: 4500

SEQ ID NO: 24962 - DNA, 201 bp, Homo sapiens
ttctgtttttaatttttaattaattttacaaaattacatattttcattttattgtgtttcttattttaatctctttgcttctttaatattcataatttaastgaaattagaaatcactgtccacaatctgcacctcagaatttttgtcttcaaaccaaaatattcttggatatgtcgttttctgttgcattttaattcaga

SEQ ID NO: 24963 - DNA, 201 bp, Homo sapiens; identical to SEQ ID NO: 4454

SEQ ID NO: 24964 - DNA, 201 bp, Homo sapiens
attctctcatttttctttatgattctatcctttaaactatcgaatgtctcatctttcttggtcattcttactcattttgaacttttatgtatttgtctaayattaatgaaggaaatatgtaggtacaatggaggccatggagcaccacacttaatatttttctttttctataatattttatatgactgatgaaccttgaaa

SEQ ID NO: 24965 - DNA, 201 bp, Homo sapiens
gcactggcaaagtagaagcagccagataatgacagactcaatacaaatgataagagaaaaacaaaagtagaagttgactctcacttttttagtttgttcarctgagaagatgacattgccattaaccaacctgcagaacaaggttggagaaacagtttgtgtgtatttgagcaggtagggaatggagatgaacatttaaga

SEQ ID NO: 24966 - DNA, 201 bp, Homo sapiens
aaattaaatcacaaaacaacagtatatatacacatatattttcaatggactaaaatacctttgattactatgttcttcatttgaagaaatagtgaaaaatrctaatatatccaaaagaattgaaagcagggtctcaaagaaatatatgcacacccatgttcatggcagcactgttcacaacagtcaagaaatggaagcaac

SEQ ID NO: 24967 - DNA, 201 bp, Homo sapiens; identical to SEQ ID NO: 4798

SEQ ID NO: 24968 - DNA, 201 bp, Homo sapiens; identical to SEQ ID NO: 4510

SEQ ID NO: 24969 - DNA, 201 bp, Homo sapiens
tgaacccgggaggtggaggttgcagtgagatgagatcatgctactgtactccagctctgggtgacagagcaagacttcgtcttgaaaaaaaaaaaaaaaaraaagaaaggtcttcccaactcctatattgaacattcattaattaaatgcatttaataaatacttattgagtgttctctatgtgccaggcatgttctacac

SEQ ID NO: 24970 - DNA, 201 bp, Homo sapiens
ccgtaagttattgggggtacaggtggtatttgattacatgagtaagttctttggtggtgatttgtgagattttggtgcatccatcacctgagcagtatacrttgcaccatatttgcaatcttttatccctcgccaccccccactcttgcccccaagtccccaacgtccattgtataggatttttgaatttgtgaattaatg

SEQ ID NO: 24971 - DNA, 201 bp, Homo sapiens; identical to SEQ ID NO: 4514

SEQ ID NO: 24972 - DNA, 201 bp, Homo sapiens
gtgagattttggtgcatccatcacctgagcagtatacattgcaccatatttgcaatcttttatccctcgccaccccccactcttgcccccaagtccccaaygtccattgtataggatttttgaatttgtgaattaatgcctttacatcactttgagcatatcctcagctataatgttctccaatgttgcttctgttccatt

SEQ ID NO: 24973 - DNA, 201 bp, Homo sapiens
aagaaaaaaaaagcagttgtagaactcctttaagtatttcttgtaggacttatctagttgtagtgtacttcctcagtttttgcttgtttgggaaatacttyatttctccttcatttctgaagtatagctctgcttggtatagtatttttggctgatagttttaaaaaatttcagcactttggatatatcatctcattctat

SEQ ID NO: 24974 - DNA, 201 bp, Homo sapiens
ccaatcatatcattactgagtctctctaattctgatttgtgtattcttgcatagcttttcattattttctaaaaatgtttaagttgttttcaaatattacrtagcaatttgtggaattttttttcttgtgtgtatttatttcctttagtgtaattatttgtcctctcctttaaaaataattttatatcagatttgcccata

SEQ ID NO: 24975 - DNA, 201 bp, Homo sapiens; identical to SEQ ID NO: 4462

SEQ ID NO: 24976 - DNA, 201 bp, Homo sapiens; identical to SEQ ID NO: 4466

SEQ ID NO: 24977 - DNA, 201 bp, Homo sapiens; identical to SEQ ID NO: 4467

SEQ ID NO: 24978 - DNA, 201 bp, Homo sapiens; identical to SEQ ID NO: 4469

SEQ ID NO: 24979 - DNA, 201 bp, Homo sapiens; identical to SEQ ID NO: 4470

SEQ ID NO: 24980 - DNA, 201 bp, Homo sapiens; identical to SEQ ID NO: 4471

SEQ ID NO: 24981 - DNA, 201 bp, Homo sapiens
acagtagaaacctacctttctgcactttttggttttccactttaagttatattatatagtgtgtgtgtgtgtgtgtgtgtgtgtgtgtgtgtgtgtgtgtgtgtgtgtgtttgacagagttttactctgtcgccctctctggagtgcagtggtgcaatctcagctcactgcaaaatccgcctctctggtacaagcagttct

SEQ ID NO: 24982 - DNA, 201 bp, Homo sapiens; identical to SEQ ID NO: 4829

SEQ ID NO: 24983 - DNA, 201 bp, Homo sapiens; identical to SEQ ID NO: 4830

SEQ ID NO: 24984 - DNA, 201 bp, Homo sapiens; identical to SEQ ID NO: 4833

SEQ ID NO: 24985 - DNA, 201 bp, Homo sapiens
tgggcaaggcaaagccaaaggtggcctttacaagattattaaatctggtcttccagggtatctaatctgtgtgaggaccctgatgaactaattttcttctmaagtgctatatatgtagatatcatcatagagttacacatgaaatggctcattcaatacttttttagatgcctggaaatatttaagggagtaactaatcaa

SEQ ID NO: 24986 - DNA, 201 bp, Homo sapiens; identical to SEQ ID NO: 4834

SEQ ID NO: 24987 - DNA, 201 bp, Homo sapiens
tggatcacttggtagctctatttttggctttttgaggaaactccaaactgttctccatagtgcttgtactaatttacattcccaccaacaatgtacaaagkttccctttttttcacctctccagcattttttattgcctgtcatttggataaaagccattttaactgtggtaagatgatatctcattgtagttttgatttg

SEQ ID NO: 24988 - DNA, 201 bp, Homo sapiens; identical to SEQ ID NO: 4560

SEQ ID NO: 24989 - DNA, 201 bp, Homo sapiens
ctgagaatgccattatttcattcctttttatggctgagtagtattccatggtgtattatatatataatacatatattttatatatatgtatattacaattyctttatacacttgttgattggtggctatttggtctgattccaaatttttacaattgtgaattgtgctgctataaacttgtgtgttcaagtatctttttca

SEQ ID NO: 24990 - DNA, 201 bp, Homo sapiens
agtgtttcttgtgggcaacagatcattgggtcatgttttttcatccattcagccactttatttctttttattggagagtttagtccatttacattcaatawtttcatttaagtaggaacttcctcctgccattttgtaatttgttttctcgtggtttcatggtcatctctcccttctttccatcttctttttcatgaaaat

SEQ ID NO: 24991 - DNA, 201 bp, Homo sapiens; identical to SEQ ID NO: 4492

SEQ ID NO: 24992 - DNA, 201 bp, Homo sapiens; identical to SEQ ID NO: 4493

SEQ ID NO: 24993 - DNA, 201 bp, Homo sapiens; identical to SEQ ID NO: 4677

SEQ ID NO: 24994 - DNA, 201 bp, Homo sapiens; identical to SEQ ID NO: 4680

SEQ ID NO: 24995 - DNA, 201 bp, Homo sapiens; identical to SEQ ID NO: 4574

SEQ ID NO: 24996 - DNA, 201 bp, Homo sapiens; identical to SEQ ID NO: 4824

SEQ ID NO: 24997 - DNA, 201 bp, Homo sapiens
tacggtttggagccacatgatgtcgctctttaccacaaaatacatgagagaaggaggaagaagggaaaattccttctattcttactggaaggaaccatatrcactctttggagtctgaaatatggaggatgcagctgcacttgactgaccgattaaaagatttcccttgactttgagaaacgatatttaatcagaacaaaa

SEQ ID NO: 24998 - DNA, 201 bp, Homo sapiens
actttgaggagtgaccgaaggatattacaattgaaactagaaattttgggaaagttcaaacgacatgcaaggaaaagaagatacgtttacgtatttaatasttacacgtttagccacatgatgtcgctgtccaccacaaggtctttctccacaaaagaaataacagcgtgcattacgtattcagatactgctttgcttcat

SEQ ID NO: 24999 - DNA, 201 bp, Homo sapiens
caattattttgaatactttgtcaagtaattcacatagctctatttctttaggtttggtttctggaggtgtgtttgtgtgtgtgtgtgtgtgtgtgtgtgtgggcacgcactatttgattgggccatgtttcctgttttctcatattccttattactttgtgttgatatctatacatttcaaaaaaacaaaaaacaacaaca

SEQ ID NO: 25000 - DNA, 201 bp, Homo sapiens
acaattattttgaatactttgtcaagtaattcacatagctctatttctttaggtttggtttctggaggtgtgtttgtgtgtgtgtgtgtgtgtgtgtgtgtgggcacgcactatttgattgggccatgtttcctgttttctcatattccttattactttgtgttgatatctatacatttcaaaaaaacaaaaaacaacaac

SEQ ID NO: 25001 - DNA, 201 bp, Homo sapiens
gtaaaagcgttactatttctccacatcctctccagcacgtgttgtttcctgactttttaatgattgccattctaactggtgtgagatggtatctcattgtrgttttgatttgcatttctctgatgaccagtgatgatgggcattttttcatgtgtctgttggctgcataaatgtcttcttttgagaagtgtctgttcatat

SEQ ID NO: 25002 - DNA, 201 bp, Homo sapiens
ccttgaggaatcgccacactgtcttccacaatggttgaactagtttacactcccaccaacggtgtaaaagcgttactatttctccacatcctctccagcaygtgttgtttcctgactttttaatgattgccattctaactggtgtgagatggtatctcattgtagttttgatttgcatttctctgatgaccagtgatgatg

SEQ ID NO: 25003 - DNA, 201 bp, Homo sapiens
cggtgtctgcgtgggacgcggacgcgcaggagaacgccctggtgtcctactctctggtggagcggcggttgggcgagcgctcgctgtcgagctacgtgtcrgtgcacgcggagagcggcaaggtgtacgcgctgcagccgctggaccacgaggagctggagctgctacagttccaggtgagcgcgcgcgatgggggcgtgc

SEQ ID NO: 25004 - DNA, 201 bp, Homo sapiens; identical to SEQ ID NO: 4828

SEQ ID NO: 25005 - DNA, 201 bp, Homo sapiens; identical to SEQ ID NO: 4831

SEQ ID NO: 25006 - DNA, 201 bp, Homo sapiens; identical to SEQ ID NO: 4546

SEQ ID NO: 25007 - DNA, 201 bp, Homo sapiens; identical to SEQ ID NO: 4835

SEQ ID NO: 25008 - DNA, 201 bp, Homo sapiens; identical to SEQ ID NO: 4548

SEQ ID NO: 25009 - DNA, 201 bp, Homo sapiens; identical to SEQ ID NO: 4549

SEQ ID NO: 25010 - DNA, 201 bp, Homo sapiens
aattagttggactcccatttaagtttccctaccactggagagaaatagtaaccaactgaaacctggttaatactcattgacagtgtgggaggtctaacacrtaaaatagatatttttcttgactcctctccttcccctcacttccattttctttatttccttttttggcactatcctttgttgctcccttgtccatgaagt

SEQ ID NO: 25011 - DNA, 201 bp, Homo sapiens; identical to SEQ ID NO: 4506

SEQ ID NO: 25012 - DNA, 201 bp, Homo sapiens; identical to SEQ ID NO: 4838

SEQ ID NO: 25013 - DNA, 201 bp, Homo sapiens; identical to SEQ ID NO: 4820

SEQ ID NO: 25014 - DNA, 201 bp, Homo sapiens
tccccaaggcttcacaagaagtaaacaaaacaaacaaaaactatttgattattgagccaaggagtcaatgtgagaatagtttttcaccttcattatcaaawgcctgtgtggagctgaatgtggtggctgacacctgtgatcctagcactttggggaggcagaggtgggaatattgcttgaggccaggagttcaagaccagc

SEQ ID NO: 25015 - DNA, 201 bp, Homo sapiens; identical to SEQ ID NO: 4515

SEQ ID NO: 25016 - DNA, 201 bp, Homo sapiens; identical to SEQ ID NO: 4571

SEQ ID NO: 25017 - DNA, 201 bp, Homo sapiens
tgtatttgcactaattatttggaagtacgtttaatatacacttttgttttgggatgcgtaatactatagatcaaaatctatggtttatgttggctactctycatttttggaggaggactttgctaactggagcaatggattcacctttcttctatagtgtatttacaaaatcaaatatttacatttccatattttgataat

SEQ ID NO: 25018 - DNA, 201 bp, Homo sapiens; identical to SEQ ID NO: 4520

SEQ ID NO: 25019 - DNA, 201 bp, Homo sapiens
attttgataatcaatacctataaatgttatagtaaacaaatttaatatatatgttacctaatattttattctatgtattgtcctcattttataaaatatasctgtgtcaaaatcatctgttcaattttgcctttttatctttagtctagaacttgaattttaagcatttcttttacatctatttatcttctttttatcata

SEQ ID NO: 25020 - DNA, 201 bp, Homo sapiens; identical to SEQ ID NO: 4461

SEQ ID NO: 25021 - DNA, 201 bp, Homo sapiens
tttggggctctattattagatgcaagtatgtttttagttgctatatcttcctgattggtccttttgtcattataaaatgtccttcttgatttctagtaacrctttttgtcttgtctgttttgtctgatattagtgtagtcactccagctatcttgtggttgctgtttgtacaatatatgttttcccattcttttactttca

SEQ ID NO: 25022 - DNA, 201 bp, Homo sapiens
gcccttagaacttaaagtcatattttggttctcaaatcagttccaagagtaggtgatctagccctttcattctaaacactacacatgtagtactagagtayaatattgtatttgcttattttttcagagtcagggtcttgctatgttttctagactggggtgcagtggggcaatcatagctcactctaaccttgaactctt

SEQ ID NO: 25023 - DNA, 201 bp, Homo sapiens
caggactaaatctgagagtgagcagatgcaccattatttcaagattgaacctaaggatgtggcaaggtaaggagaaaagtcaggatgacaagttgccctgyagccgccagttctcatcagttgaagatatattaaaactatggtacacataagccactccatcaaacagtaaatatggctatactgcaagcagtaaaaaag

SEQ ID NO: 25024 - DNA, 201 bp, Homo sapiens; identical to SEQ ID NO: 4575

SEQ ID NO: 25025 - DNA, 201 bp, Homo sapiens; identical to SEQ ID NO: 4602

SEQ ID NO: 25026 - DNA, 201 bp, Homo sapiens; identical to SEQ ID NO: 4576

SEQ ID NO: 25027 - DNA, 201 bp, Homo sapiens
aaatatcttgtgattctgctttcaattttttatttgcattcagataattactcatacatgtatatatacatatatagagagagacctggtaggctttttgytattatttcttttccaaagtttgaagggatttccaaaaggtactggtgactgaaagtaccttttggcagtccctgcaaatctaatggttttaatagctgt

SEQ ID NO: 25028 - DNA, 201 bp, Homo sapiens
aaatataaggactttgaggagtgaccgaaggatattacaattgaaactagaaattttgggaaagttcaaacgacatgcaaggaaaagaagatacgtttacrtatttaatacttacacgtttagccacatgatgtcgctgtccaccacaaggtctttctccacaaaagaaataacagcgtgcattacgtattcagatactgc

SEQ ID NO: 25029 - DNA, 201 bp, Homo sapiens
ggatagtgtttggaataacctatatcctggacatttcttagattgttctttggatcaacaatgcccttgtctatgcaatagttaataagctacattttttktttgtttgtttgtttttgttgagacagtcttgctctgtcacctaggctggagtgcagtggtgtgatctcagctcactataacctctgccacccgggttca

SEQ ID NO: 25030 - DNA, 201 bp, Homo sapiens
ggcttgtaagttattcttcctcaagtaatgatgttaactgcaaataaaataaatttacatatgttaaaattttctgtacttaatattttcacaatataatrgaatccagcatataagatatgcttagtaaatgctgactgaatgaataaatatgtgcatatatgaattggatggtaacactgttcaacacagagggaaaaa

SEQ ID NO: 25031 - DNA, 201 bp, Homo sapiens
aaggaattataaatgtggagattattttccttatggaattatggaagggtgtagacccagctctgtctgaaaccagtaattaattacccatttccatgtaygagtcagtacaggattctctggtttatttttgcttaaatcggttaacttgggatttactgttagagtatgattaacataaatacacatttccatagatgg

SEQ ID NO: 25032 - DNA, 201 bp, Homo sapiens; identical to SEQ ID NO: 4836

SEQ ID NO: 25033 - DNA, 201 bp, Homo sapiens
gggcaacgtggctcgcgcgctggggcttgagctgcggcgcttggggccgggttgcttgcgcatcaaccatctgggtgcgcccagtccgcgctacctggagytggacctgacgagtggagcgctcttcgtcaacgagcgcattgatcgggaggcgctgtgtgagcagcggcctcgctgcctgctcagcttggaagtgctggc

SEQ ID NO: 25034 - DNA, 201 bp, Homo sapiens
atggagtgaggaggatttattagttgctgcctgaagaaaagggaaatgctccaaaaaatttggttgtttccagactcaaatagagcctgcctttcattgaytctgttgcccttaaagcttcacggtgaagatgcagttgcttccaaaaggcttctttctggtgcctaagcctccttatacttgcttcagagccctttccgt

SEQ ID NO: 25035 - DNA, 201 bp, Homo sapiens
gctgggtgagcatagacaaactgcctgaattcatattttcttaattaccctttctgtaaattgggtgtagtaataataataacacctattttattgagttmccatgagaactaaaggagaaaaaaagaactgagcatagtgcttgacatatagttaataaatgtctaatcttttttttttgagacagagtctcgctctgtc

SEQ ID NO: 25036 - DNA, 201 bp, Homo sapiens
atagaaaatagcagcatgacaaattaaatgtgtcattggggaagtgagattgtataatgaactgagtttcctggtcagtcctgctggaactgtgcctttcrgcaaaatgagtttgatgatttcattccaaagatcaagttgcagcaattttcatcatgaatgttacccaatcatagaaaaattggcaacatttctcagcag

SEQ ID NO: 25037 - DNA, 201 bp, Homo sapiens
ctctctgatatttgaatttggggttgtgctttcacagtgagaaagtctaaacctatttcttgtacattaatacttttcactattctaattatggtgatgcytttagctattaagaatttctgggattgaaatgtgtcagaagttagttattaagtattgtggattctgaagctctctaaatcaagtcctccctttaccaat

SEQ ID NO: 25038 - DNA, 201 bp, Homo sapiens
attccatctacatacaggagaacaatttgccaggtgtgttgctctgtactgtgcaagccacagacccagatgaaaaggagaatgcagaggtgacctactcycttctggagagggagattcaagggctgccagtcacctcctatgtctccattaacagtgccagtggcagcctttatgctgtcaactcctttgactatgaga

SEQ ID NO: 25039 - DNA, 201 bp, Homo sapiens
ctgggagatgaagagaaaggacgttttagtgagtgctttttttgcacatgaggcaatagatttcaaattcctgtggaagaaatgtgagaacctgggaagastgaatattcagaactgagcagcagaggcaatgacacagcatggaaagatttcctctgatccttctaccttctcttttactgaagtgaatttgttgtctct

SEQ ID NO: 25040 - DNA, 201 bp, Homo sapiens; identical to SEQ ID NO: 4444

SEQ ID NO: 25041 - DNA, 201 bp, Homo sapiens
ttttggcatgttatttaaacaattacaaaatcacctaactacactgtcttgcagctgcctttctttttttgtcttgtccacgtgagtatattgggagactytgtttaatgtctccacgaattctagatagactgttcctgcagcatttctttttttaaattttgttttgataagcatttattttggcaatgattctagtaa

SEQ ID NO: 25042 - DNA, 201 bp, Homo sapiens
gtttgttacccaggtaaacatgtgccatggtggtttgctgcacagatcaacccatcacctaggtattaagcccagcatccattaggtattcttcctgatgrtctccctcccattgctcccccaacaggccccagtgtgtgttgttccccttcatattttcatgtgtactcatcattcagctcccacacgtagtgggacgat

SEQ ID NO: 25043 - DNA, 201 bp, Homo sapiens
accagggcctgcctacaaaattggggattacaatgtgacatgagctttgggcggggacacagatccaaaccatgtcattctgccactgccctcaccctccycgaaatctcatgacgttcttacattgcaaaatacaattatcccttcccaatggtccctcaaagtctgaactcattccagcattaagccaaaagtccaaag

SEQ ID NO: 25044 - DNA, 201 bp, Homo sapiens; identical to SEQ ID NO: 4573

SEQ ID NO: 25045 - DNA, 201 bp, Homo sapiens
aaaaactttacttagcagtttttgtaatgcatatatgctgcagtgatttatcttagttttcctttatctgaagatctatttatcttccatttgaatgatayagaattctgggggattgacagattttattttcttccacttaaaaaaaatgttattctactgtcttctaatgctcatagtttctgatgagaagtgtgtagt

SEQ ID NO: 25046 - DNA, 201 bp, Homo sapiens
aggaatgcatcacatttttctggtattctatgttaggtaattttggattatatcttgatattattaatgtgttattcttgagattcatcattctgtttgtrttagtccattattgcactgttataaagaaacacccaagactcggtaatttataaagaaaagaggtttaattggctcacagttccacaggctgtaggaagc

SEQ ID NO: 25047 - DNA, 201 bp, Homo sapiens; identical to SEQ ID NO: 4497

SEQ ID NO: 25048 - DNA, 201 bp, Homo sapiens
tttgtttagattttttatgattatgtcttggtagtttgtatgtttctaggaattaatcaatttcttctaggttattgaattttttggtatatgattttaawagcctcttataattgtggcatcaggtgtaatgccacctcttttgtttctgacttccagtctttttgtttttttcttagtctagctaaggggcttgtcagt

SEQ ID NO: 25049 - DNA, 201 bp, Homo sapiens
atgccggccatctgcttggcttctggggagccttcaagaatcatggtggaaggcaaaaggaaagcggctcatcttacatggccggtgcaggagcaagggasggggggaagtgctacgcacttttaaacaaccagatttcacgagatctctctcactgttatgagaatagcaccaagggggaaacctgccccatgatctaat

SEQ ID NO: 25050 - DNA, 201 bp, Homo sapiens
ttccagtattgatttctagttttattccactgtggtcagaaaagatatttagtaggatttcaaccttcttgaatttgttaagacttgttttgtgacctgaygtgtgatttatcctggaaaatgctctgagtgtgcttgagaagactgtatatttgctgctgttgggtggaattttctgtatatgtctgttagttccatttc

SEQ ID NO: 25051 - DNA, 201 bp, Homo sapiens
catctgcttggcttctggggagccttcaagaatcatggtggaaggcaaaaggaaagcggctcatcttacatggccggtgcaggagcaagggagggggggawgtgctacgcacttttaaacaaccagatttcacgagatctctctcactgttatgagaatagcaccaagggggaaacctgccccatgatctaatcacctccc

SEQ ID NO: 25052 - DNA, 201 bp, Homo sapiens
ttagtctagaacttgaattttaagcatttcttttacatctatttatcttctttttatcatatttgtgtagcactgacttctttttaacttactttgttgaratgtatttgccatgttcatgaagaattaatatgaacaatttaaaatagtttaaatggcagtttaatagtattttttattttgttccttgtttgtataaga

SEQ ID NO: 25053 - DNA, 201 bp, Homo sapiens
cacaggcataatacagccaggctctttgctaaagcataaggaaagtgacctttgctccagtcctcagtaagttcctcatctccatctgagacctcctcagmctggacttctttgtccatttcactatcagcacttcggtcccaatcattcaagtagtctctaggaagttctaagctctccctcatcttccctccacactat

SEQ ID NO: 25054 - DNA, 201 bp, Homo sapiens; identical to SEQ ID NO: 4449

SEQ ID NO: 25055 - DNA, 201 bp, Homo sapiens; identical to SEQ ID NO: 4451

SEQ ID NO: 25056 - DNA, 201 bp, Homo sapiens
aaaaaaaaaaaataataaataaagaaagaaagacattctcaggaatgggacccggcagtctatgttttaacaagccttctatgtgataccaatgtactgtraagttttaagaactggtctaaggtaaatattcctgaggttgtcttatatcattacagggtcagaatgcatgcaaggaagccatctgtttatggttcttgt

SEQ ID NO: 25057 - DNA, 201 bp, Homo sapiens
gattccatcctcttacgctgtgtattcccatctcttccatgctgcatcccaccacccttcaatgttattacaataaaattaagatcaaataatttattcarctaatttttcttgttttggacaaaatagacatcctaatacatttatagccaaagtttaatctagacactaaaaggagcatattttgcctttaggctctgt

SEQ ID NO: 25058 - DNA, 201 bp, Homo sapiens
aaggtggaatataaaaaaaattatagaaagataaatttttgttcagatgcatctactgcagcaatttgggaggctaaggtgaaaggatcgtttgagcccaraagtttgagaccagctgggcaacatagtgagaccttgtctctacaaaaaattaaaaattagctgggcgtgggggcgcttggcctagaagttcaaggacag

SEQ ID NO: 25059 - DNA, 201 bp, Homo sapiens; identical to SEQ ID NO: 4507

SEQ ID NO: 25060 - DNA, 201 bp, Homo sapiens; identical to SEQ ID NO: 4511

SEQ ID NO: 25061 - DNA, 201 bp, Homo sapiens
tagtcccaattactcaggaggctgaggcgagagaatcgcttgagcctgggacattgaggctgcagtgaactgtgatggcacaactgcatttcagcccgggwgacagcaagattctgtctcaaaaaaaaaaaaaaaaaaaagagtagtttaactactccctactttttattcaatattggacatctacattgggatatttat

SEQ ID NO: 25062 - DNA, 201 bp, Homo sapiens; identical to SEQ ID NO: 4456

SEQ ID NO: 25063 - DNA, 201 bp, Homo sapiens
attttgtgcgtggagatgattgatcaatggcaaacttattttacgctccagatagctaaaacaaacgttgatattttgatacataactcattacattttamttcagggtttataaaaaagtaatctctaaaatcagaatttgaatgaattttgatgcaagaggcattccagaggagtagagaagtatagaaacagaattta

SEQ ID NO: 25064 - DNA, 201 bp, Homo sapiens
agctctaattggtcttcctattttgtcttttccatcataatagccctcactctaccagtcagggagccaatgtgggggttctgctagctgctaagtatacstatgccaattatgcattctggcactggggaaatgaccacaggatgagtccagggacccactggacccactctaagtcagacttcagctaaaactccataa

SEQ ID NO: 25065 - DNA, 201 bp, Homo sapiens
tggtgctggacagcgctctggaccgcgagagggtgtcggcctatgagctggtggtgaccgcgcgggacgggggctcgcctccgctgtgggccacggccagsgtgtctgtggaggtggccgacgtgaacgacaacgcgcctgcgttcgcgcagtccgagtacacggtgttcgtgaaggagaacaacccgccaggctgccaca

SEQ ID NO: 25066 - DNA, 201 bp, Homo sapiens
acacggtgttcgtgaaggagaacaacccgccaggctgccacatcttcacggtgtctgcgtgggacgcggacgcgcaggagaacgccctggtgtcctactckctggtggagcggcggttgggcgagcgctcgctgtcgagctacgtgtcggtgcacgcggagagcggcaaggtgtacgcgctgcagccgctggaccacgagg

SEQ ID NO: 25067 - DNA, 201 bp, Homo sapiens
cctctaggccagcagaacataatgtcacagggacagtaagcaaaaattttactagtgggtcactaggggtgatggtaagtggtgccacttccacttccacyccttgattcctggacctgtgaattccggctatgggagaaacagtaccatatattggatgctgattcagagcatacacaaccttctggagaattttgcccc

SEQ ID NO: 25068 - DNA, 201 bp, Homo sapiens
gaaggtggaatataaaaaaaattatagaaagataaatttttgttcagatgcatctactgcagcaatttgggaggctaaggtgaaaggatcgtttgagcccrgaagtttgagaccagctgggcaacatagtgagaccttgtctctacaaaaaattaaaaattagctgggcgtgggggcgcttggcctagaagttcaaggaca

SEQ ID NO: 25069 - DNA, 201 bp, Homo sapiens
gtgttcgtgctggacgagaacgacaacgctcccgcgctgctggcgtctcccgctggcagcgcgggcggtgcagtcagtgagctggtgctgcggtcggtggktgcgggtcacgtggtggctaaggtgcgcgcagtggacgctgactctggatacaacgcgtggctgtcgtatgaattgcagtcggcggcggttggtgcacgc

SEQ ID NO: 25070 - DNA, 201 bp, Homo sapiens
actttcttacatatctttagtttaggatctggaatatagtatatgttcaatcactttttaaaaacatatgggggtcttgctatgttgcacaggctggactwgaacttctgggttcaactgatcctccatttcagcctttcaagtagctgagactacaggcaggctccaccactcccagcttcaatcaataattttaaataa

SEQ ID NO: 25071 - DNA, 201 bp, Homo sapiens
tctactttcttacatatctttagtttaggatctggaatatagtatatgttcaatcactttttaaaaacatatgggggtcttgctatgttgcacaggctggwctagaacttctgggttcaactgatcctccatttcagcctttcaagtagctgagactacaggcaggctccaccactcccagcttcaatcaataattttaaa

SEQ ID NO: 25072 - DNA, 201 bp, Homo sapiens
tcccatttttatttaaagtaattattgatagggcataacttactgttgcctctttgttaattgttgtttgcagcttgtagactttttgctcctctttcctyctcttactgtcttcctttgtgttttattgagaattgtaatgctatgtttttgttcctttcctgttttcttttgtatatcttccataggtattttctttgt

SEQ ID NO: 25073 - DNA, 201 bp, Homo sapiens
ttctgtcatatcattgattctgttacataaagtgctaaattttgatatctcatattatgctactatggcttacattagaaataatatatgtcaaataaaawctcatctagatcaatagacttttcctttgtggattcttttttaaaactaccaagtttgagaatatgaatatatttgtttttcatattgttctgcaatgaa

SEQ ID NO: 25074 - DNA, 201 bp, Homo sapiens
tataacacacatccttgacttattacctcaattaaatcaataattttaataattccaggcaacgctaagaccttgaatcattataccatttacttgtaccmtactttttgttactgatatgcctttcaattatttatatgttctagacacacagtacattattatcattgttttgttaacacctatatatgtttctttctg

SEQ ID NO: 25075 - DNA, 201 bp, Homo sapiens
ttatttattttataaaatgataataaaatttattttatagttgaaaagcctatttctgtcatatcattgattctgttacataaagtgctaaattttgatayctcatattatgctactatggcttacattagaaataatatatgtcaaataaaaactcatctagatcaatagacttttcctttgtggattcttttttaaaac

SEQ ID NO: 25076 - DNA, 201 bp, Homo sapiens
caaatggataacattaaggttaaattaagggcgaagttgatatttggccctgacttttatatgaaggtaacatttttgcaagtaaattgtagacgtaattwaaaaaacccagctaaaacaaaggtggtattgagaaagaggaagagcaagtggtctatattgtcagaaaaataagattcatattggagagtaattgaaaat

SEQ ID NO: 25077 - DNA, 201 bp, Homo sapiens; identical to SEQ ID NO: 4797

SEQ ID NO: 25078 - DNA, 201 bp, Homo sapiens
gctgcagttctaggtgagagcgcgcgacgcgggcatgccgcctctgagcagcaatgtgacgctgccaggtattagtgctggaacgacaactttgtctgcgytgctggcgccttgggtgggctggcggcgctgtgagtgagctggtgcggtattcagtggatgcaggccacttggtggcgaaggtgcgcacggtggactcca

SEQ ID NO: 25079 - DNA, 201 bp, Homo sapiens
acacttttattaagctaacgctttgattttatccattttgtgtaagaactctgatcatcatagtttttatctgtggttcccttttcagacttgtgattccrggaggcaatagtgttcatttattgtcccccttttaaaccattgaggaataaaggacaaaaacaatagttatcagcctgaatacttctggttgttatggtt

SEQ ID NO: 25080 - DNA, 201 bp, Homo sapiens
tctcaaatatgtatcagaatatttcatttttgtctacattccatttatgcttgaatatttctagtgatacctttgtaatataatttattccaggagttttraaatttttttatcctacccagtgtgtcagcctttgattggtacttaaatttttttaaataacaatttattctgaatacactaatattttccaatacaaat

SEQ ID NO: 25081 - DNA, 201 bp, Homo sapiens
aggaataaaggacaaaaacaatagttatcagcctgaatacttctggttgttatggttattgatttatttactaccgatctaaataatggaaaaatagtgaytcaacagaatttagaccttgtgatcaagtaaatttatatgaaaactgcattcctctggcattgcggctctcttatttctgtttgaatttcacttgatggt

SEQ ID NO: 25082 - DNA, 201 bp, Homo sapiens
gcattgcggctctcttatttctgtttgaatttcacttgatggtcttctcttcatggagtctaaatctatttctttgtattagtgttttcattgtttctacmcagtaatttaaactattcactattttgtatgtgtgtgtgtgtgtgtgtgacagggtcttgctctgtcacccatgctggagtacagtggtgcaataatggc

SEQ ID NO: 25083 - DNA, 201 bp, Homo sapiens
aaagtcaaaaacctgtctgataatcaatagaattatttaccattaagccataatatgtcattcacataagcagaccaagtttgctgctcttgttgaaagaatattcagttttgtggaaaaatctataaatatctttgaccttcaaagatggtaactgtaatctgtttttattgctttgtttttatgcttacatgcatgtat

SEQ ID NO: 25084 - DNA, 201 bp, Homo sapiens
taatatgtcattcacataagcagaccaagtttgctgctcttgttgaaagaatattcagttttgtggaaaaatctataaatatctttgaccttcaaagatggtaactgtaatctgtttttattgctttgtttttatgcttacatgcatgtatatttaaaaccttcctagcatattattaaagttttaaatatcctatttata

SEQ ID NO: 25085 - DNA, 201 bp, Homo sapiens
gtttgctgctcttgttgaaagaatattcagttttgtggaaaaatctataaatatctttgaccttcaaagatggtaactgtaatctgtttttattgctttgyttttatgcttacatgcatgtatatttaaaaccttcctagcatattattaaagttttaaatatcctatttatattgggaaatacctgaagttgatagggga

SEQ ID NO: 25086 - DNA, 201 bp, Homo sapiens; identical to SEQ ID NO: 4799

SEQ ID NO: 25087 - DNA, 201 bp, Homo sapiens
agttgctgggactataggcacacaccaccatgcccaactaatttttgtattttttgtagagatggggtcttaccatgttgcccaggctggtctcaaactcytgagatatcgagaaatactattttctttacaaattgtttgctactatttagagtcaactacagagatttttttgggtaaataatgtgatgacaaatttaa

SEQ ID NO: 25088 - DNA, 201 bp, Homo sapiens
tccgcacccacattccaatcattcacggaataggatcgactccataatgactgtgatgctggaaaaaatttactaaatatgtacttacagaaaagggtgaytgctcataaaatacctcaggcaagcgatcccttaaaactgattgtcccaactcagaggccctcattttctgcaatggtgattatcggaccaagaggcccg

SEQ ID NO: 25089 - DNA, 201 bp, Homo sapiens; identical to SEQ ID NO: 4793

SEQ ID NO: 25090 - DNA, 201 bp, Homo sapiens
aaatatggtaagtataatgtagaggaaaatacaaaatacaacttttatcccccatttttttcattcaactatacctcaatattcagtgacagggccacctyaatctccgcccatgaaaacgcatctagaggagtgtcacaagtttttcacagtgacatttttgcttactgatacaagacagtgatggtgactgatgatgtc

SEQ ID NO: 25091 - DNA, 201 bp, Homo sapiens; identical to SEQ ID NO: 4559

SEQ ID NO: 25092 - DNA, 201 bp, Homo sapiens
attcatggtatactacacagccttaaaaaaagaaaatcctgtcatttatgacaggaaaaaaaaataagataatccaatgtaccatttgttgaaaatacttkttctttttattgcattatcttgacatctttgtaaaaagtcggttgaccataaatgtgtgggcttaattctggactctatttcactcctttgatctatatg

SEQ ID NO: 25093 - DNA, 201 bp, Homo sapiens
gctggagctgctgcagttctaggtgagagcgcgcgacgcgggcatgccgcctctgagcagcaatgtgacgctgccaggtattagtgctggaacgacaactwtgtctgcgctgctggcgccttgggtgggctggcggcgctgtgagtgagctggtgcggtattcagtggatgcaggccacttggtggcgaaggtgcgcacgg

SEQ ID NO: 25094 - DNA, 201 bp, Homo sapiens
gttttggagaacctcctggggttctgacaacggtgtcaaaatttatttatgtgttttcaagaaataatagcactaggtctgttagaatatcagtggatgaygtgcactagtaagacattaaactatgcactctaatacttatatgactaacaggacatacaggcagattgtatgtcctgactgatatagtaaaagtcaggc

SEQ ID NO: 25095 - DNA, 201 bp, Homo sapiens
ttttgaaattttctttccacgtagtatcatcccatctgaagatttgagcaaagatcatttacttctgagtcattcttcatatttagttattcttactacaygtagagtggtggtattacagactttcttgagaatcatatctagctatttcccccccgtatagaggcataacataccatttggcacaatattcaaagagtc

SEQ ID NO: 25096 - DNA, 201 bp, Homo sapiens
agactcaaaagtgattaaaccatcataccacttatgaaactttataaatataataaaggtgaatattagatagggcatacattactcatctccagatgaartttttggaataactgaagatcttttaaagacttgggaatgttttcagtacaggttaaaattttgtaaattattattttatatcacataaataacaaattt

SEQ ID NO: 25097 - DNA, 201 bp, Homo sapiens
taccacttatgaaactttataaatataataaaggtgaatattagatagggcatacattactcatctccagatgaagtttttggaataactgaagatctttkaaagacttgggaatgttttcagtacaggttaaaattttgtaaattattattttatatcacataaataacaaatttgcattttagataattcaaattactt

SEQ ID NO: 25098 - DNA, 201 bp, Homo sapiens
agtagaagttgactctcacttttttagtttgttcaactgagaagatgacattgccattaaccaacctgcagaacaaggttggagaaacagtttgtgtgtayttgagcaggtagggaatggagatgaacatttaagaaaatgttactttgaagtcctaagagaataccgttgtgattggaaatatgggtctggatctcagaa

SEQ ID NO: 25099 - DNA, 201 bp, Homo sapiens
tataaatatcttatctacatctcaagtcacattgagggaaatttattaatatgatgtgcttattcaaaatctgatatatcagttaccaatatttttcaccytcaccgattttattcttatgtgattgttatgtttccttttggagtcaatggctgttgtgtgaggaggtcttgaaaaatattacaggaagaggacagtacc

SEQ ID NO: 25100 - DNA, 201 bp, Homo sapiens
ttacaaattgtttgctactatttagagtcaactacagagatttttttgggtaaataatgtgatgacaaatttaaatcatttcacagaaaatacccttattygcctttcctatttaacctacgtttttggtaagaattttgtagaaatttggaggagctcttaattgcctactatgaaggcattcatgatgaatccatggag

SEQ ID NO: 25101 - DNA, 201 bp, Homo sapiens
ggtttactgggtttataaaagaattgaccagtagctatataatagatatagaaaagtctgcctgggtgtggtggctcatacttgtaataatattatattataattgttctattttattattagttattgttgctaatcttttactgtacctaatttatacattaagctttatcatgggtatgtatgtataggaaaaaatgc

SEQ ID NO: 25102 - DNA, 201 bp, Homo sapiens
caagcatagctttaaaaacagaaattgccccgagtactaaggatgagcaataatgaaattaaaacatattgtaataacattacacaaactatattggagaytacaaagaagagattattcatagattataaagcttggaaagaatcaaaacaacacatttctggaaacagattgtataaatgctacaaaagagaaaaatat

SEQ ID NO: 25103 - DNA, 201 bp, Homo sapiens
aaatgcaaggggcaaaaaaatactacatcaatggaaaatatgaagactgagtcatacttacacttacacgttcatgcgcatggtgtcgctcttcactgagmacgtttccgcgaagaaagccgccgtttctttcttcctgcagaaaatatagcagaaagcggaatacctcttgcgaatccttccgcactaggaagccataaa

SEQ ID NO: 25104 - DNA, 201 bp, Homo sapiens
tatgttaagtaaaaactaagttcatcatatatgttaagtaaaaaaaagtcacaaattaagagaaagtgttaattgatttgagagtttgtgtatttttttttcctattttgtgctgaaaagctgaagttggcatcaaccaaggcatattgttatctatgtatcaagctaaataatttaaagatctttaagactattaattca

SEQ ID NO: 25105 - DNA, 201 bp, Homo sapiens
ggtaccagctcctctttgtacctctgatagaattcagctgtaaatctgtctggtcctgggctttgtttgcttggtgggctatttattattgcttcaatttstaatttaatatttttaaatcttgggttaaatggttgaatgaatgtgtgaaaagttagatatcaatgaatgaatattcttaaatgtataaactttaatctt

SEQ ID NO: 25106 - DNA, 201 bp, Homo sapiens; identical to SEQ ID NO: 4495

SEQ ID NO: 25107 - DNA, 201 bp, Homo sapiens; identical to SEQ ID NO: 4498

SEQ ID NO: 25108 - DNA, 201 bp, Homo sapiens
tgtacattagtagaaattgagtttagtttttattattttgtgcgtggagatgattgatcaatggcaaacttattttacgctccagatagctaaaacaaacrttgatattttgatacataactcattacattttaattcagggtttataaaaaagtaatctctaaaatcagaatttgaatgaattttgatgcaagaggcatt

SEQ ID NO: 25109 - DNA, 201 bp, Homo sapiens
ggccaaattgaggcctgagaatagtttccatttatgaagcactcattctccttaaggtactattgcaagcacttactatattataattcactcaaccaccrtattactattaggccaaagttataaaattggaacatgagggagggagaggttaaacgattttcccaagtcatgtggctagtgagtaggataataggaatc

SEQ ID NO: 25110 - DNA, 201 bp, Homo sapiens
ctggctaatgtcaaaagaaactttcctcccacaaagttttcactcacttgatcttggattttaaaatcagatataacctgagagattatcatttttctccrtttaataatgaatcaggccaggcatggtggctcatgcctataatcccaacacctgtgtgggccatgacaggaggattgcttgagcccaggagttcaagat

SEQ ID NO: 25111 - DNA, 201 bp, Homo sapiens
tgtctgatgttgaagctaatgatctctaaattctagtgatgactagatcttcggagttataaacacctcacagatagttgatgcttgacattagtgtctarataaaccttattaaatctcaaaataatgagaaagagaagtaagttaagtgtcagaacttaaatggaactaaagttgtcatttaataaaatattagtatac

SEQ ID NO: 25112 - DNA, 201 bp, Homo sapiens
gtatcactgttatatttctatgaagggtgttgacatttttgttttagtagagaataaacttgattagactaaaaatgcaaaatctttcttgcttctgcttygtagcagttcaaacttcagtttagttcttttagctttagcctttgctctttatatgtgattcagggacggcagagatgtgggaagaatttgatcatagaa

SEQ ID NO: 25113 - DNA, 201 bp, Homo sapiens
ggtaagcttatattttaaaaaattgtcttagtaaacactttagccttccttgcagttgtttgtttaagacatctttcctgccaatttcaaattattctttwctttaattttaattttgctagttgttatcgaatttaacaactctgctgtggacattatgtgttggattatccttcagagtgaaatcttaactcacaaacc

SEQ ID NO: 25114 - DNA, 201 bp, Homo sapiens
ctctaggcacatcagtgttcccctctcatatatcccatgaaaaatatcttgtgattctgctttcaattttttatttgcattcagataattactcatacatrtatatatacatatatagagagagacctggtaggctttttgttattatttcttttccaaagtttgaagggatttccaaaaggtactggtgactgaaagtac

SEQ ID NO: 25115 - DNA, 201 bp, Homo sapiens
tcctgtctaatttacttttcttcagaattctgctttctgatttttgtttttgctttgaaatatttttatattaattatactgattcatttctcttcttttratttgtgtttgcaggagatgtcctcttcccagccttttattttaaaccttttagtattatgggcatattccacaagttctttgctactgtctcactgagt

SEQ ID NO: 25116 - DNA, 201 bp, Homo sapiens
ttcttcacaaaaaagaaaaaaaaagcagttgtagaactcctttaagtatttcttgtaggacttatctagttgtagtgtacttcctcagtttttgcttgttkgggaaatactttatttctccttcatttctgaagtatagctctgcttggtatagtatttttggctgatagttttaaaaaatttcagcactttggatatatc

SEQ ID NO: 25117 - DNA, 201 bp, Homo sapiens
cctacctcttgtatagaaacaacccagatccaaagtggccagaaagttactttaccttctgaatttgtggtctttttcagaatctctacctgttaattctscatgactttattagtcattagatacttttataattttaaaatatctccaattgtatggttggttcaaattaccagttctgcatactggtaatgtaagtcc

SEQ ID NO: 25118 - DNA, 201 bp, Homo sapiens
tcctttaacctcagcctccaaaagtgctgcagttacaagcatgcgccaccatacctggccttgttttgatttttaggtaccacaaataagtaagaacataygatatttgtctttctgtgcctggtttatgtcacttataatgacatccagtttcatccaggttgttgcaaatgactggatcttgttttttttatggctgaa

SEQ ID NO: 25119 - DNA, 201 bp, Homo sapiens
gataccctaaactcatcattctcaaatttaatgttccgcagattcctacagcacaggcataatacagccaggctctttgctaaagcataaggaaagtgacmtttgctccagtcctcagtaagttcctcatctccatctgagacctcctcagcctggacttctttgtccatttcactatcagcacttcggtcccaatcattc

SEQ ID NO: 25120 - DNA, 201 bp, Homo sapiens
ggtggccctcttctcacagccattgcactccagcctgggcaacaagagtgaaactccatctcaaaaaaaaaaaaagaaagaaagaaatttcctctgccagrtaccctaaactcatcattctcaaatttaatgttccgcagattcctacagcacaggcataatacagccaggctctttgctaaagcataaggaaagtgacct

SEQ ID NO: 25121 - DNA, 201 bp, Homo sapiens
tgaaggtggaatataaaaaaaattatagaaagataaatttttgttcagatgcatctactgcagcaatttgggaggctaaggtgaaaggatcgtttgagccsagaagtttgagaccagctgggcaacatagtgagaccttgtctctacaaaaaattaaaaattagctgggcgtgggggcgcttggcctagaagttcaaggac

SEQ ID NO: 25122 - DNA, 201 bp, Homo sapiens
atattccgaagtgtattagtcagggttctctagagggacagaattaataggctagatgtgtatataaaggggagtttattaaggagtattaactcacacamtcacaaggcccaacaataggccatctgcaagctgaggagcaaggaatccaatctgagtcccaaagctgaagaacttggaatccgatgttcaaggggagga

SEQ ID NO: 25123 - DNA, 201 bp, Homo sapiens
ttttatgtatatcttaaaatatttgaattacttttgttttgaaaacaatagtatctttactttccctaaaccttgataagggattcatatctcttattatyaattttgggaaaaaataattcataaacctggtctattatgaaatgtttgctaattgagccaagagagcacatgcattcatctaaaacattcatataatca

SEQ ID NO: 25124 - DNA, 201 bp, Homo sapiens
ttgaaggtggaatataaaaaaaattatagaaagataaatttttgttcagatgcatctactgcagcaatttgggaggctaaggtgaaaggatcgtttgagcmcagaagtttgagaccagctgggcaacatagtgagaccttgtctctacaaaaaattaaaaattagctgggcgtgggggcgcttggcctagaagttcaagga

SEQ ID NO: 25125 - DNA, 201 bp, Homo sapiens
gtatctttagaaaatcatagaggctattgaaacaccacattttcccaactagatatgcgatcaccttaaattaatacattttattaggcaatggaaggaarcaaacattttctgcagggtaaatatttaggaaatattaggtaagtccctctgagctattaaacaattaagatacaactattccctttaaaatatatattc

SEQ ID NO: 25126 - DNA, 201 bp, Homo sapiens; identical to SEQ ID NO: 4468

SEQ ID NO: 25127 - DNA, 201 bp, Homo sapiens
ggggaaatgtctagagactttttttgtatctttagaaaatcatagaggctattgaaacaccacattttcccaactagatatgcgatcaccttaaattaatrcattttattaggcaatggaaggaaacaaacattttctgcagggtaaatatttaggaaatattaggtaagtccctctgagctattaaacaattaagataca

SEQ ID NO: 25128 - DNA, 201 bp, Homo sapiens
tgtctttatatattaaatttctttatgtaagaaaatgtattgtggtttatttattgggaagtcttcattccccattaatacccaggatgattcaaagatcrtgattaccaagaattagaataaaaattaagctaaaacccaagttttcaacattgaacttgaaatacatcttaattggggaaatgtctagagacttttttt

SEQ ID NO: 25129 - DNA, 201 bp, Homo sapiens
gtgtttgtgtgagtgtagttcttcaatagagagggagcgtaaagctattttcactagattgattttttgtttagacaaacaggatgaaaataactttatgratataggaggcaaggaaagtttttaaatggctaccattatgtctttatatattaaatttctttatgtaagaaaatgtattgtggtttatttattgggaag

SEQ ID NO: 25130 - DNA, 201 bp, Homo sapiens; identical to SEQ ID NO: 4832

SEQ ID NO: 25131 - DNA, 201 bp, Homo sapiens; identical to SEQ ID NO: 4678

SEQ ID NO: 25132 - DNA, 201 bp, Homo sapiens
tgttttgtttccattagcaaggaatatcttttcccatgtctttattttccagtctatgtgtatcttcataggtgaagtgtttcttgtgggcaacagatcaytgggtcatgttttttcatccattcagccactttatttctttttattggagagtttagtccatttacattcaataatttcatttaagtaggaacttcctcc

SEQ ID NO: 25133 - DNA, 201 bp, Homo sapiens; identical to SEQ ID NO: 4479

SEQ ID NO: 25134 - DNA, 201 bp, Homo sapiens; identical to SEQ ID NO: 4478

SEQ ID NO: 25135 - DNA, 201 bp, Homo sapiens
ttcttcatgatagatttttatacaccttccagtgagtgaatactactgctagtaaaccactttaaatcaagttcaagacttgaagctccttggctacttaractacgtattctcagataaaaatatgcaggatatctggtatctagttacaagtttataggattaaattttcctttcctattttccttctggcctttttgg

SEQ ID NO: 25136 - DNA, 201 bp, Homo sapiens
tttatgtgtgccaacttttatttgacttttgatggtccatatcctgaaaatgatatttgccaggatatcctgagatcttggatggaaatacctttcttcaygatagatttttatacaccttccagtgagtgaatactactgctagtaaaccactttaaatcaagttcaagacttgaagctccttggctacttaaactacgt

SEQ ID NO: 25137 - DNA, 201 bp, Homo sapiens
ttttcactagactagaaaggaaacataagtaagcgataggaaggctgatgaatctagaagttagaaggaaaattagctatttaaaaggaaaaatataggaatgacagaggaaaaaacaacccttcaaaccaaatttttaaacatatatgaatgattaacaaaataatagagatatactgttcatatgtgcaggaatattgt

SEQ ID NO: 25138 - DNA, 201 bp, Homo sapiens
gattggtgcccttataaaagaggcccagagaggtgccttgcctctttcaccatgtgaggacacagcaaaaatgtgacatccatgaaccaaaaagtggcccctccccagacactaaatctgctggtgcctgaatcatgaactttcaagcctctagaacagtgaaaaataaatctctcttgtttattaactacacagcatatg

SEQ ID NO: 25139 - DNA, 201 bp, Homo sapiens; identical to SEQ ID NO: 4685

SEQ ID NO: 25140 - DNA, 201 bp, Homo sapiens
cttgttctttttgcttaggattgctttgactatttgggctcttttttttttccatatgaatgttaggatagtttgtttttctaattctatgaaaaataatrttggtagtttgataggaacatcattgaatctgtgaattgctttggacagtatggttatcttaacaatgttgtttcttcctacccatgagcgtggaaggtc

SEQ ID NO: 25141 - DNA, 201 bp, Homo sapiens
atttctctttggaaatttctgaacttgatactgaatgttgttggcactcccttcagagtctccataaaaagaaaccaaattttttttttttttttttttttgagatggagtctcactctgttgccaggctggagtgcagtggcgtaatcccggctcactgcaacctccgcctcccaagttaaagtgattcttctgcctcag

SEQ ID NO: 25142 - DNA, 201 bp, Homo sapiens
tgtgataggatcctctggaaatgcatgtcacaagtgataaagctgtagtatttagacatcatactgaagctaaagtttgctttggctgtatgatgtggcarctcttctgtagagggctgtcagagggagtggatgatggtgaggcagagagattaagtaccaatttgtctggttggtccagggaggtattagaatgagtgg

SEQ ID NO: 25143 - DNA, 201 bp, Homo sapiens
gcgcgcgcgccaggaaagcccacgctggtgtgctccagcgccgtggggagctggtcttactcgcagcagaggcggcagagggtgtgctctggggaggaccyccccaagacggacctcatggccttcagccctagcttatctcaaggtccagactccgcagaagagaaacagctctcagaatcagaatacgtaggaaaggtg

SEQ ID NO: 25144 - DNA, 201 bp, Homo sapiens
ggctgggaggagataaggggaggaaagatcacttttcatgacaacttacaacttgattccacttataagccatttattttcagaaacaagtaatgggtgargacacaggccaggtccacaatttgtgcacttgagagattaaggcctccgagatcaaattaccacagcaaactgagacagaattattgtagggatgtttgg

SEQ ID NO: 25145 - DNA, 201 bp, Homo sapiens
gcttaattctggactctatttcactcctttgatctatatgtttatcctttcactaaaagtagactgtcttgatattgtagctttataaatttgaaaatcasctgtgaaatcctccaaccttgttctacttgtaaacattgttttggctattataggtcatttaaattttcatataaattttagaatcaacttttcaatttc

SEQ ID NO: 25146 - DNA, 201 bp, Homo sapiens; identical to SEQ ID NO: 4519

SEQ ID NO: 25147 - DNA, 201 bp, Homo sapiens; identical to SEQ ID NO: 4522

SEQ ID NO: 25148 - DNA, 201 bp, Homo sapiens
tttcctgttttcttttgtatatcttccataggtattttctttgtggttaccatggggcttacattttaaaactcttataaaaatgtattttaaactgatarcatctttactacaatcacaaaacaaaactcattatgtttacttctcccctacccaaattttatgttattgatgtcataaatacatctttttatattgtgt

SEQ ID NO: 25149 - DNA, 201 bp, Homo sapiens
cgatccaaatattagtgaaaagtcatgataatagagatagtaaaaatcttataagggaactggtaaatatatctttaaagattgtatcagaaacaattctrtgacaatatcttgtttctttacaagtttgaattccagaaatcaagtgaatttcctctgactttgcattttctggtaatttcttttttcttatcaagctat

SEQ ID NO: 25150 - DNA, 201 bp, Homo sapiens
tgcatttacctgaattagagttctagtgttatgacaacattgggaaaagagtaaatatgaaaaaagtagaacaaaatctcaaattaatagttgaatatatrtataaaatattagcatacacatatgataactttttcatatgcccttgcagtatttttagattggagataaaccatcaaaactatagaacaaaatatttaa

SEQ ID NO: 25151 - DNA, 201 bp, Homo sapiens
ttttattctctttgtagcaattgtgaatgggagttcattcataatatggctgtctacttgcttgttgtttgtgcataggaatgctagcaatttttgcacaytgattttgtatcctgagactttgctgaagttgcttatcagcttaagaagcttttgggctgagacaatggggttttccagatataggatcatgtcatctgc

SEQ ID NO: 25152 - DNA, 201 bp, Homo sapiens
tttttctatttgtttgtgtccactgtgatttccttgagcagtggtttgtcattctccttgaagaggtccttcacttccctttttagctgtattcctaggtrttttattctctttgtagcaattgtgaatgggagttcattcataatatggctgtctacttgcttgttgtttgtgcataggaatgctagcaatttttgcaca

SEQ ID NO: 25153 - DNA, 201 bp, Homo sapiens
ctccatccatgtccctgcaaaggacaagatcttgttcctttttatggatgcatagtattccatggtgtatatgtaccacattttctttatccagtctatcwttgatgggcatttgggttgatcccatgtttttgctattgtgaatagtgctgcaatgaacatacacatgcaggtatctttataataggatgatttatattc

SEQ ID NO: 25154 - DNA, 201 bp, Homo sapiens
tgggacgatgtggtatttggttttctgttcctgcattattatgctgaggataatggcttccagctccatccatgtccctgcaaaggacaagatcttgttcstttttatggatgcatagtattccatggtgtatatgtaccacattttctttatccagtctatcattgatgggcatttgggttgatcccatgtttttgctat

SEQ ID NO: 25155 - DNA, 201 bp, Homo sapiens; identical to SEQ ID NO: 4620

SEQ ID NO: 25156 - DNA, 201 bp, Homo sapiens
gagtttctgaattaccctcccttctagctttctttatacaccattctttgtagctgaagttttaagccccttgtcaaaagggagattcaagtttctgctgrggacatctcagtgtcacaaagggccaaggaagtagggtctcaccaactttgccacctgactcagctcaaaggtgataggtcacctgtgtgactgagagct

SEQ ID NO: 25157 - DNA, 201 bp, Homo sapiens
gagactggatgaactggacagtgggggtagggagaaagggagtggccgtgttcctgcggtccgctgggatccggcaggtccagggtgaaggagatggggcwggagaggctgagcagtccgggttcgctgtccgccacttcggcgcggaatcagagcaggacttgctgagccctcctaccgctccctttccccctccccctc

SEQ ID NO: 25158 - DNA, 201 bp, Homo sapiens
aagttctaaggaaagatttagataaaatataaggactttgaggagtgaccgaaggatattacaattgaaactagaaattttgggaaagttcaaacgacatrcaaggaaaagaagatacgtttacgtatttaatacttacacgtttagccacatgatgtcgctgtccaccacaaggtctttctccacaaaagaaataacagc

SEQ ID NO: 25159 - DNA, 201 bp, Homo sapiens; identical to SEQ ID NO: 4728

SEQ ID NO: 25160 - DNA, 201 bp, Homo sapiens
aagaaaatactggattacacactctccaatgagatttgaaatgtcctgggtcttaaaaggacataaaattgaaaatgattgcatttaacaaattgcagacrgatatagattgcattttgaaaatcaacgaatggatctaaaatttacattggccacatgatgtcgctgtacaccacaaagtcttgtcaatagaagggagct

SEQ ID NO: 25161 - DNA, 201 bp, Homo sapiens
tcaaagtcttttctctgacagcatctgtctctaaaggccgaacaacgggagatgcagcggaattggattaaaagactctgaaagtacagtcgttcatcttyatattaagataatattttctgataggaaacgactatttaacatggattatcactggcgaggagagctgggatcctggcgactactactcttgcttctgct

SEQ ID NO: 25162 - DNA, 201 bp, Homo sapiens
cacctcctgggttcaagcggttctcctgcctcagcctcctgagtagctgggactgtgcaggcacacaccacaaagcccagctatttttcttttttttttttgtattttaagtagagatggggttttgacgtgttggccaggctggtctcgaactcctggtcttaagtgatccacctgccttggcctcccaaagtgctagta

SEQ ID NO: 25163 - DNA, 201 bp, Homo sapiens; identical to SEQ ID NO: 4558

SEQ ID NO: 25164 - DNA, 201 bp, Homo sapiens
tccactttgggtaaagcacatggttcccataagagagagtgtgatataaagcaagaaaagtaatatgagaaaaaccttttgtataactttgagtactagaygagtaattttgacactcttcaaagtcatttgaaagctgtcaaaaagtgtgaagcaatacgaataaaaagtattaacggaagatgactgcaaggattaaat

SEQ ID NO: 25165 - DNA, 201 bp, Homo sapiens; identical to SEQ ID NO: 4554

SEQ ID NO: 25166 - DNA, 201 bp, Homo sapiens
ggtggaatataaaaaaaattatagaaagataaatttttgttcagatgcatctactgcagcaatttgggaggctaaggtgaaaggatcgtttgagcccagamgtttgagaccagctgggcaacatagtgagaccttgtctctacaaaaaattaaaaattagctgggcgtgggggcgcttggcctagaagttcaaggacagtt

SEQ ID NO: 25167 - DNA, 201 bp, Homo sapiens
aggtggaatataaaaaaaattatagaaagataaatttttgttcagatgcatctactgcagcaatttgggaggctaaggtgaaaggatcgtttgagcccagwagtttgagaccagctgggcaacatagtgagaccttgtctctacaaaaaattaaaaattagctgggcgtgggggcgcttggcctagaagttcaaggacagt

SEQ ID NO: 25168 - DNA, 201 bp, Homo sapiens; identical to SEQ ID NO: 4613

SEQ ID NO: 25169 - DNA, 201 bp, Homo sapiens
gctgtttccaatggctctgcttaactgagacctgagagtgattgctccatctgtggtggcatatgggctgaaactgcctagcagcatgtcagaagtggggygttcgcaggacatccttgtccaggttggcagttgagcttggcaggtgaccgctgagaccccttccaactccaccacttcaggaatctctttttttttttt

SEQ ID NO: 25170 - DNA, 201 bp, Homo sapiens
aattattcgagcatggtggtgtgtgcctgtagtcacaactacttgggaggctaaggcaggaggatcacttgagcccaggagttcaaggctgcactgagccrtgacggtgcgactgcattctagccacagaatgagaccctgtctctaaagcaaaaaagagaaggagaataagtgaggtacttgagcaagtgggtgaggatg

SEQ ID NO: 25171 - DNA, 201 bp, Homo sapiens
gcctcggcctcccaaagtgctgggattacaggtgtgagccaccgcacctggccagtggagttccttcttaagtacatgtattgacatctttaaaaagggcragaggatttacaggaaactatcaggtcagtaatggcaggggccgtccacagtgggtggctgagtccccctatttttctgctggtgtgcggggaggtcatt

SEQ ID NO: 25172 - DNA, 201 bp, Homo sapiens
aaaatggaatgcagaattaagtgtatgcaccttgccagaaacagggtttggggtttacattagatgctcagataggtcattgatccccaaaacactaaggwctctgacttctagacagatagtagttaagaaccaaagctttggagcttgagtgctggatttaagacccatgactgtcacagctgtgcaacctcagacaaa

SEQ ID NO: 25173 - DNA, 201 bp, Homo sapiens
aggtgtgagccaccgcacctggccagtggagttccttcttaagtacatgtattgacatctttaaaaagggcgagaggatttacaggaaactatcaggtcartaatggcaggggccgtccacagtgggtggctgagtccccctatttttctgctggtgtgcggggaggtcatttcctgccacccatgtttccccaccctgaa

SEQ ID NO: 25174 - DNA, 201 bp, Homo sapiens
tggtctcatttctgattttaaaatggctctggctgtgatgtggagaagaggcagggtgagcctcatctgcagcaactgctaactgcccacatccccccagmcttctcaaaaatttgccactcccctgctcaaagaccctcaaaagctgcccactgcttagaggacaggcctttgacctgaggtcctcacttgggcttcagg

SEQ ID NO: 25175 - DNA, 201 bp, Homo sapiens
cctggtctcatttctgattttaaaatggctctggctgtgatgtggagaagaggcagggtgagcctcatctgcagcaactgctaactgcccacatccccccrgacttctcaaaaatttgccactcccctgctcaaagaccctcaaaagctgcccactgcttagaggacaggcctttgacctgaggtcctcacttgggcttca

SEQ ID NO: 25176 - DNA, 201 bp, Homo sapiens
taatcccagcacttttggaggctgaggcgggcagatcacttgagatcaggagttcgagaccagcctggtcagtatgatgaaaccccatctctactaaaaayacaaaaattagttgggcatggtggcttgcctgtagtcccagctactggggaggctgaggcaggagaatcacttgagcctaggaggtagaggttgcagtga

SEQ ID NO: 25177 - DNA, 201 bp, Homo sapiens
taatttcaaagtagataagcataaataatactttatgatactgaaattgtgatgtgatatgagaatagctgtgagttttgttttgctggggacaggatcastgatgctgtcattactggggtctcttccctccattctttttttaaaattgtattttattttatttttaaaattttaaaataaatagagacagggtatcac

SEQ ID NO: 25178 - DNA, 201 bp, Homo sapiens; identical to SEQ ID NO: 4899

SEQ ID NO: 25179 - DNA, 201 bp, Homo sapiens
gccaagtgatatctcttcccttctgctgtcttcccttctgccatccttcacatggtggcattgtatccttagacttgccacccatgccctcaggttggccrttgcacactgtcttacataaagcaggaaggaaaggaaaggctgctacgagagagtgtaccttgtgcatctcttttttaatcaggaagcaaacatctttct

SEQ ID NO: 25180 - DNA, 201 bp, Homo sapiens
agtccccctatttttctgctggtgtgcggggaggtcatttcctgccacccatgtttccccaccctgaatccaccttcctcacattcccattggagggacamtctctggacatatgggacctggggtcccacagggctgcattccaatgcctgctgtgccactcgccagctgtgtgatgttgggcatatcccataacctctt

SEQ ID NO: 25181 - DNA, 201 bp, Homo sapiens
cctgccacccatgtttccccaccctgaatccaccttcctcacattcccattggagggacactctctggacatatgggacctggggtcccacagggctgcawtccaatgcctgctgtgccactcgccagctgtgtgatgttgggcatatcccataacctctttgtgcctcagtttcctcatctgtaacacaggagtgacaag

SEQ ID NO: 25182 - DNA, 201 bp, Homo sapiens; identical to SEQ ID NO: 4900

SEQ ID NO: 25183 - DNA, 201 bp, Homo sapiens; identical to SEQ ID NO: 4901

SEQ ID NO: 25184 - DNA, 201 bp, Homo sapiens
tgggacaacaggcgcttgccaccacacctggctaattttcttattttaatttaattttattttattttttgggacagagtggagtctcaaaaaccaagctrgagtgcagtggtgcgatctcgactcactgcaatctctgcctcccgggttcaagcgattctcctgccttagcctcccgactagctgggattacaggcgtgt

SEQ ID NO: 25185 - DNA, 201 bp, Homo sapiens
tcctgggctaaagagatcctcccatttcaacttccagagcagctgggacaacaggcgcttgccaccacacctggctaattttcttattttaatttaatttwattttattttttgggacagagtggagtctcaaaaaccaagctagagtgcagtggtgcgatctcgactcactgcaatctctgcctcccgggttcaagcgat

SEQ ID NO: 25186 - DNA, 201 bp, Homo sapiens
ctgacaaaagggtgagttattcaacagattaccagcatgagtaactgatgcttacctgccggggatctctggaagaccatgcatggcacatgcccagttatgcctgcaaaggagagggagctggggtatttgtccaccagctcccatctgtcattggctgagagctgcttccaggagcattaattctccagcacttccagc

SEQ ID NO: 25187 - DNA, 201 bp, Homo sapiens
acaatcttgcctaacagtaacctccgcctcccgggttcaagcaattcttctgcctcagcctccagagtagctgggattacaggcgcatgccactatgcccrgctaattttttgtatttttggtagagatggggtttcaccatgttggtcaggctggtctcgaactcctgacctcatgatctgcctgcctcagcctcccaaa

SEQ ID NO: 25188 - DNA, 201 bp, Homo sapiens
cacaatcttgcctaacagtaacctccgcctcccgggttcaagcaattcttctgcctcagcctccagagtagctgggattacaggcgcatgccactatgccyggctaattttttgtatttttggtagagatggggtttcaccatgttggtcaggctggtctcgaactcctgacctcatgatctgcctgcctcagcctcccaa

SEQ ID NO: 25189 - DNA, 201 bp, Homo sapiens
tgaaacagataacaatgtatgggaccctcattcattatttcagcaaatatttgctgagttcctcctacatggctagccctgtgctagacactggggaatcrgcgatgaacaaagcagatagaaatccccactcttgtggagctgacattctggagggagagacaaaaagcaaacatataaagaaagaaagaaatcacatgg

SEQ ID NO: 25190 - DNA, 201 bp, Homo sapiens
tcctactggggagactgaaaatacatatcaatcacaaacaggtggttttccatagtgacccactctctgaatgcactagaccagggtggaggccagagatsttctggggtgctttttgcaagggggaccaggataaggctctccaaggagggaaaatttgaggggggccctgactggggagaatgagctggccagggataa

SEQ ID NO: 25191 - DNA, 201 bp, Homo sapiens
ttttgagacggagtctcactctgtcacccaggctggagtatagtggcacaatcttgcctaacagtaacctccgcctcccgggttcaagcaattcttctgcytcagcctccagagtagctgggattacaggcgcatgccactatgcccggctaattttttgtatttttggtagagatggggtttcaccatgttggtcaggct

SEQ ID NO: 25192 - DNA, 201 bp, Homo sapiens
attggaatttattgagacaatacatataaagtgcatattccagcctcttgcaaataccaagtgccatttatgtatcagttagtgtttgctgtgtaacaaaygaccccgaaatgtagagggttacaacaactttatttagcttatgcttctgcaggctggcatttggggctgggctcagcagtgagggtggcgggggaggct

SEQ ID NO: 25193 - DNA, 201 bp, Homo sapiens
atacgtatttactgagcagctactacacaccttgagagtagagctgagaacatatcgacaaggaccccacttttttcttttttttttttttttttttttttgagacggagtctcactctgtcacccaggctggagtatagtggcacaatcttgcctaacagtaacctccgcctcccgggttcaagcaattcttctgcctca

SEQ ID NO: 25194 - DNA, 201 bp, Homo sapiens
ctggcctcatataagcatttctgtctccatttatcatccatctttccctcttgaaggtcagtttcaccaaggcaggcatctttgtctcgttcactgttgtrgcctcagggccaggcacagtgagtcaaacatagaaggtgctcaataaatatgtgtttatttattgaaaccatgggcagaggctaattcagaagcggtctg

SEQ ID NO: 25195 - DNA, 201 bp, Homo sapiens
cctgagctcaagcgatcctccctcctcagcctcctaaagtgctgggattacaggcgtgagccaccgcacccggcttccatatcctttctaattggtcatgrcttgggataatggtgttgcttttaattatcatcatccataaagactttttcttactcaacagatctgagcttgtatttggtgcccaggacatgtgctggg

SEQ ID NO: 25196 - DNA, 201 bp, Homo sapiens
gtcctctcagtcaataatacgtatttactgagcagctactacacaccttgagagtagagctgagaacatatcgacaaggaccccacttttttctttttttyttttttttttttttttgagacggagtctcactctgtcacccaggctggagtatagtggcacaatcttgcctaacagtaacctccgcctcccgggttcaag

SEQ ID NO: 25197 - DNA, 201 bp, Homo sapiens
cgcacccggcttccatatcctttctaattggtcatggcttgggataatggtgttgcttttaattatcatcatccataaagactttttcttactcaacagayctgagcttgtatttggtgcccaggacatgtgctgggttcccgaaatcccaaagacacagaccctaccctcagggatttctcattctagcaacatagactg

SEQ ID NO: 25198 - DNA, 201 bp, Homo sapiens
ttcccgaaatcccaaagacacagaccctaccctcagggatttctcattctagcaacatagactgatcaattactgattataacgttagaaggcatgtctgmagtagacagccatcaggacatggtgatttcaggctgggctttgaagaatgaataggagtttttcaagtgtcgaaactgaaccctgaccaacctttgcttt

SEQ ID NO: 25199 - DNA, 201 bp, Homo sapiens
aaggctctccaaggagggaaaatttgaggggggccctgactggggagaatgagctggccagggataagcaagatggagtcatcccacatccccttacaacrctgggtgcctgggcaactgggggcatttgggggcatgtggtaggagccagaggaatttgcgacgattgccctgatggagtcaggagacctgggtttgaat

SEQ ID NO: 25200 - DNA, 201 bp, Homo sapiens
ggctgaagtgcagtggcgcggttacggctcactgcagcctccaattcctgggctaaagagatcctcccatttcaacttccagagcagctgggacaacaggygcttgccaccacacctggctaattttcttattttaatttaattttattttattttttgggacagagtggagtctcaaaaaccaagctagagtgcagtggt

SEQ ID NO: 25201 - DNA, 201 bp, Homo sapiens
ctaaaaccggcatcctactggggagactgaaaatacatatcaatcacaaacaggtggttttccatagtgacccactctctgaatgcactagaccagggtgsaggccagagatcttctggggtgctttttgcaagggggaccaggataaggctctccaaggagggaaaatttgaggggggccctgactggggagaatgagct

SEQ ID NO: 25202 - DNA, 201 bp, Homo sapiens
tcctgggcccagtgctgccgagcagtccctctggagtgcagggtggcagggacttgcccctctagtctgcccctttgcagtcctctcagtcaataatacgyatttactgagcagctactacacaccttgagagtagagctgagaacatatcgacaaggaccccacttttttcttttttttttttttttttttttttgagac

SEQ ID NO: 25203 - DNA, 201 bp, Homo sapiens
cagcaagtttaagatctggaggtggcactgagctttggaggagcagggggcaatgaggtggccggtgtgacgaggactcaatgtgcaagagggagagtggyggggagatgaggtggaggggtggtcggcggtcagatcgtggagggtctcggacgagggtcctgaccctgggtctccagtcctgggaagtggagcccaggc

SEQ ID NO: 25204 - DNA, 201 bp, Homo sapiens
aaaagcaaacatataaagaaagaaagaaatcacatggatctggatgacagtgagtgctgggaagaaaataaaagcagaggaaggggatggagcgatgggcrgggggcaacggtagggagggtgtcggggaaaactttttggagaatgtgacgatgaaagtgaacaaggagaagtcaaccgtgttgagatgatggcagctaa

SEQ ID NO: 25205 - DNA, 201 bp, Homo sapiens
actggggactcggcagtgaatgggacagaccctggctgtcaggatgacagacaatttaaaaagggacagatgtcccacgctggcttgtcctttgcaccccyggcacttcgtgaggagcagcggccagttcttgtatatagactggcccttggtgtacatttgtctgacgtttccaaatgatgtatgcatccttggcaggaa

SEQ ID NO: 25206 - DNA, 201 bp, Homo sapiens
tgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagca

SEQ ID NO: 25207 - DNA, 201 bp, Homo sapiens
tgatgttgggcatatcccataacctctttgtgcctcagtttcctcatctgtaacacaggagtgacaagagcacccgcccacagggctatgacagtacaagktgtgtgatacagatgagctcccctgtttggcccacatgtgtcctaaaagccatgtgccctttctcttgagtgccccaggccacagagatccccatctgcc

SEQ ID NO: 25208 - DNA, 201 bp, Homo sapiens
ggtcagtgcggataactatacactggacctgtgggctgggcagcagctgctgtggaagggctccttcaagcccagcgagcatggtgagcagggcggagtgyggcaggggtggctgggtgtgttcccacagctgcctgggctgagggtggggtgggcaggggaggaggtggggtcatagcaacagcaggaggaagccgcctg

SEQ ID NO: 25209 - DNA, 201 bp, Homo sapiens
gcagcagctgctgtggaagggctccttcaagcccagcgagcatggtgagcagggcggagtgcggcaggggtggctgggtgtgttcccacagctgcctgggytgagggtggggtgggcaggggaggaggtggggtcatagcaacagcaggaggaagccgcctgtattttcccaaatctgatgggattcctgcccctgcctgg

SEQ ID NO: 25210 - DNA, 201 bp, Homo sapiens
atatctcttcccttctgctgtcttcccttctgccatccttcacatggtggcattgtatccttagacttgccacccatgccctcaggttggccgttgcacaytgtcttacataaagcaggaaggaaaggaaaggctgctacgagagagtgtaccttgtgcatctcttttttaatcaggaagcaaacatctttctagaagctt

SEQ ID NO: 25211 - DNA, 201 bp, Homo sapiens
cctcccacctttgaaacggagctggtcgcagtagaccaccaagcccccttcagcccagctgtttccacccctgaacttaagtgcccaggaaggcgtattgrgatgaggtgtgcttgctggaaggcatgcctgctgctgattgaaaaccgaactgggaacattccttccattctgtgtccactggtcagctgctgcggcttt

SEQ ID NO: 25212 - DNA, 201 bp, Homo sapiens
atctcttcccttctgctgtcttcccttctgccatccttcacatggtggcattgtatccttagacttgccacccatgccctcaggttggccgttgcacactrtcttacataaagcaggaaggaaaggaaaggctgctacgagagagtgtaccttgtgcatctcttttttaatcaggaagcaaacatctttctagaagcttcc

SEQ ID NO: 25213 - DNA, 201 bp, Homo sapiens
tttatatctctcaggtctggtttcccctttggcactgggccaggtatggggaaagagcaggaatggggcagttggctcacacagcagaggctcagaaagcrgggggcatggggggaaggagtgcacagatgctagagagtggggcaagttttgtttggtcaataaatctccttctcatgccccaggcctgtgcaagaccta

SEQ ID NO: 25214 - DNA, 201 bp, Homo sapiens
tgtaccttgtgcatctcttttttaatcaggaagcaaacatctttctagaagcttccctagcaaaattccccttacatctcattggccaagactgttacatrttacatggttactgttattacttgctcattgcaaggaagactgggaactcaaatgcctggaaaaaggaacaggataatcgtgattggctcaagccttagg

SEQ ID NO: 25215 - DNA, 201 bp, Homo sapiens
cttgacggttctaataagagtcctaaggctgctgctcagtggcctggcttcgatgctgtgccagcctctgaaccaatcactggctgtgggtggagagaggrtgctggtggagggccctgcttgtccagggaggagtcacatacctgcctctagggctgcaggtgggctcagctccatccaaaccagatgaactgaaaataa

SEQ ID NO: 25216 - DNA, 201 bp, Homo sapiens
tggcttcgatgctgtgccagcctctgaaccaatcactggctgtgggtggagagagggtgctggtggagggccctgcttgtccagggaggagtcacataccygcctctagggctgcaggtgggctcagctccatccaaaccagatgaactgaaaataaggcaggagtggcttccccaggggaaactggggaagaggaagcag

SEQ ID NO: 25217 - DNA, 201 bp, Homo sapiens
tgtatacttgtcggcaaatagccactatcctgaacactcccctccttttttttaatatacaggatctcactctgtggcccaggctggtgtgcagtggtgcratcatagctcactgcaccttcaaactcctgagctcaagtgatcctcccatcttagcctcccgagtagctgatactacagatgtgcattaccacgcctggc

SEQ ID NO: 25218 - DNA, 201 bp, Homo sapiens; identical to SEQ ID NO: 4915

SEQ ID NO: 25219 - DNA, 201 bp, Homo sapiens
acatgcccagctaattttccttttttttaattcttgtagagatgtttgagacggcttgggctctgttgcccaggctgttctcaaactcctgagctcaagcratcctccctcctcagcctcctaaagtgctgggattacaggcgtgagccaccgcacccggcttccatatcctttctaattggtcatggcttgggataatgg

SEQ ID NO: 25220 - DNA, 201 bp, Homo sapiens
tgcctcagcctcctgagtagctgggattacaggtgcccgccaccacacccagctaatttttgtatttttagtagagacagagtttcaccatgttggccagrctggtcttgaactcctcacctcaagtgatccacccacttcggcctcccaaagtgctgggattacaggcatgagccaccatgcccagccccatctctcttt

SEQ ID NO: 25221 - DNA, 201 bp, Homo sapiens
gcgatgaacaaagcagatagaaatccccactcttgtggagctgacattctggagggagagacaaaaagcaaacatataaagaaagaaagaaatcacatggrtctggatgacagtgagtgctgggaagaaaataaaagcagaggaaggggatggagcgatgggcagggggcaacggtagggagggtgtcggggaaaactttt

SEQ ID NO: 25222 - DNA, 201 bp, Homo sapiens
tccatggctgtatctccagaacccagcacagaaccaggtgcttgggaaagttttgaattgattctcatctgccattggcatggggaagggaactagcttgyatgaaacagataacaatgtatgggaccctcattcattatttcagcaaatatttgctgagttcctcctacatggctagccctgtgctagacactggggaat

SEQ ID NO: 25223 - DNA, 201 bp, Homo sapiens
ttcttctgcctcagcctcctgagtagctgggattacaggtgcccgccaccacacccagctaatttttgtatttttagtagagacagagtttcaccatgttrgccaggctggtcttgaactcctcacctcaagtgatccacccacttcggcctcccaaagtgctgggattacaggcatgagccaccatgcccagccccatct

SEQ ID NO: 25224 - DNA, 201 bp, Homo sapiens
tcgtgaaaactcaatgaaagaagattcttcaacgtggtaggtgcagtggcagctggcagtaccctgaccctgccaccgcacagccctctcagcattgctcrtcctgcactgtggatatcagttgagccacgtgtctcctgccctgggctgtgagctccataggcagggtctccatggctgtatctccagaacccagcacag

SEQ ID NO: 25225 - DNA, 201 bp, Homo sapiens
caaagatgtgattcaaagtggggatcatcggggccatcttaggtttgtctgcagtgatcactgtgccatctctctctctctcttttttttttttttttttygagacgaagtcgtcactctgtcacccaggctggagtgcagtggcatgatctcagcttaccacaatctctgcctcccaggttcaaatgattcttctgcctc

SEQ ID NO: 25226 - DNA, 201 bp, Homo sapiens
acaagttgtcaagtttgtgtgagataaaggtgcacttggttcgttcttgtctaatggcccccgcacccatgggtatttcttcagcttccacagtcatcccracactagctgggaagctccagcagccctggtcctggccccagctctgtgggcgctggccctcaactttgcctgcactgtgcttttgtgctattccccttg

SEQ ID NO: 25227 - DNA, 201 bp, Homo sapiens
ttgattatctcacataaaatgaagtcttacaaatggacctactgggttttgtacagcagccaagtgatatctcttcccttctgctgtcttcccttctgccrtccttcacatggtggcattgtatccttagacttgccacccatgccctcaggttggccgttgcacactgtcttacataaagcaggaaggaaaggaaaggct

SEQ ID NO: 25228 - DNA, 201 bp, Homo sapiens
acaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcct

SEQ ID NO: 25229 - DNA, 201 bp, Homo sapiens
gcagaggcccagtccctggagccaggagcctgggaggcaagccctggggctggatagcaaatcccaggagctagagacctggcttctcacctggctctgcmctaggcaagtccctttgcttcctggccccccacccctcacatcagagaaggggagttatctctgcatgccgctcctcctctgtaaaggtagggctgtggg

SEQ ID NO: 25230 - DNA, 201 bp, Homo sapiens
cacttcctctcaaattctattggtgaaaatggtcacatgactacacatagccacaaaggaggctgggaactttctcacttggaacctacatcccagaaacractcttttcagtgaggtatcccacaggtctttcgcagtagaaatattgattatctcacataaaatgaagtcttacaaatggacctactgggttttgtaca

SEQ ID NO: 25231 - DNA, 201 bp, Homo sapiens
ggaagtgggccgcatcacttcctctcaaattctattggtgaaaatggtcacatgactacacatagccacaaaggaggctgggaactttctcacttggaacstacatcccagaaacaactcttttcagtgaggtatcccacaggtctttcgcagtagaaatattgattatctcacataaaatgaagtcttacaaatggacct

SEQ ID NO: 25232 - DNA, 201 bp, Homo sapiens
ctatgttgcccaggctgcttttgacctcctgggctccagtgatcttcccatcttggcttcccaaagtgctgggattacaagtgggagccagtgttcctggycccttcctccattcttaatggaaggagatgctaggtgtgagaggttagggaaagtaaagatgtaatttctttcccatccaagttctcagacccctgaatt

SEQ ID NO: 25233 - DNA, 201 bp, Homo sapiens
tattgaaatgcagttataaaacatttaaacacatttttaatctagagatatatgtgcttctttattaagatctataaataataagttctaggggtagctcrcataaatactgtaatttcaaagtagataagcataaataatactttatgatactgaaattgtgatgtgatatgagaatagctgtgagttttgttttgctgg

SEQ ID NO: 25234 - DNA, 201 bp, Homo sapiens; identical to SEQ ID NO: 4892

SEQ ID NO: 25235 - DNA, 201 bp, Homo sapiens
tgaaacccccatctgtacaaaaattagccaggcatggtggcatgcacctgtagtcccaggtactgggaaggctgaggtgggaggatcacttgagcccaggrgtttgaggctgcagtgagccgtgatcgtaccactttactcccacctgggtgacagagcaagagcccatctctaaaaataaataaatacaatgaaataaaa

SEQ ID NO: 25236 - DNA, 201 bp, Homo sapiens; identical to SEQ ID NO: 4894

SEQ ID NO: 25237 - DNA, 201 bp, Homo sapiens
cctgccgtggtgtatctgccaggtaggcaggctaggctgcagtaacacacaagcccacaatttccatggcttaacactataggaatatatttcttgctcaygtaacaagctaacgtgaatgttgctggtttgtaggtggtttccctccctgtagaaatctggggagtgaggttctttccatcttgtggtgccatcattctc

SEQ ID NO: 25238 - DNA, 201 bp, Homo sapiens
taaggaggctgtttccaatggctctgcttaactgagacctgagagtgattgctccatctgtggtggcatatgggctgaaactgcctagcagcatgtcagargtggggtgttcgcaggacatccttgtccaggttggcagttgagcttggcaggtgaccgctgagaccccttccaactccaccacttcaggaatctcttttt

SEQ ID NO: 25239 - DNA, 201 bp, Homo sapiens
aagcctcttctcccactgcatctgtgatctctcctgaaatgtagcacccacacatccctgagaagctagctgcggcacgtgtgtgtgcacatgggcatgcrtaagtctgggcgtgccttccacaacagattaaggatatcaatcctgacgccatgctgggatgttttagtgaatcttgacagggttgttgactcccctgtt

SEQ ID NO: 25240 - DNA, 201 bp, Homo sapiens
ccttcaagtgtgcccaagtcactcggagagcatccagcaggggcctagagctcctgaggtggccttaagttcttatgatgccccagacactgcacacagtrcttcagaggcaacacctccgttcctgtttgctgcaagcctgtgaggttagccttggaaccattcctgtgccacagaaacacagccagagcaccaaaagag

SEQ ID NO: 25241 - DNA, 201 bp, Homo sapiens
aacttaagtgcccaggaaggcgtattgagatgaggtgtgcttgctggaaggcatgcctgctgctgattgaaaaccgaactgggaacattccttccattctdtgtccactggtcagctgctgcggctttggatggtcttgaccgtggaaggctgaccttcttctggtacccggagtccctgcaggaatcccccttgagcttg

SEQ ID NO: 25242 - DNA, 201 bp, Homo sapiens
gtggagggggagttttggcttgggcattgaaggatgcataggagttttctagatggggaaagaagggaacggtagaccaggcagagggaactgcatgatawaaggtttatgggtgtgaaaattcatggaatgtttgaggattatggggttgggggatgtgggaatatgtgtagcgataaagcaccaaacaaagccaaaagt

SEQ ID NO: 25243 - DNA, 201 bp, Homo sapiens
gcccaggaaggcgtattgagatgaggtgtgcttgctggaaggcatgcctgctgctgattgaaaaccgaactgggaacattccttccattctgtgtccactsgtcagctgctgcggctttggatggtcttgaccgtggaaggctgaccttcttctggtacccggagtccctgcaggaatcccccttgagcttgctgggctgt

SEQ ID NO: 25244 - DNA, 201 bp, Homo sapiens
atagaaggtgctcaataaatatgtgtttatttattgaaaccatgggcagaggctaattcagaagcggtctgaggaccttacctcccagtgatgatgcaccrtggccccaggcaggccaggaagagagaagggttgtgtttctccgtaggtcccccagcttcccaggccatcccaggccattccctggtcatttgccctcag

SEQ ID NO: 25245 - DNA, 201 bp, Homo sapiens
ccaggcagagggaactgcatgataaaaggtttatgggtgtgaaaattcatggaatgtttgaggattatggggttgggggatgtgggaatatgtgtagcgawaaagcaccaaacaaagccaaaagtttagttagagccctgaatgcctgcctcataatggtttccatattttatatgcctactatgtgccaggcacattgct

SEQ ID NO: 25246 - DNA, 201 bp, Homo sapiens
gctgattgaaaaccgaactgggaacattccttccattctgtgtccactggtcagctgctgcggctttggatggtcttgaccgtggaaggctgaccttcttytggtacccggagtccctgcaggaatcccccttgagcttgctgggctgtggtgacaggagtttaaaacatgcgttgtattccagtgatgcatgatatgaca

SEQ ID NO: 25247 - DNA, 201 bp, Homo sapiens
acatgaagaagtgtggttcagaacacctgggctgttaaggaccttcactggcttctggaatggcaaatagacagtcaggagggttgcaggggagacagagrcagaagccgaatgaggtcattagcagaccagaggctttcccgcccttccccttggcaatcccagcctggggtgggcttctctggggttggtttcctgttt

SEQ ID NO: 25248 - DNA, 201 bp, Homo sapiens
gggcatggctccctgacaagggagagaggaaaaagctgttgagtgaagaagactgcttcagtttccccatctgtataatgggaggagtaagggctgtcgtraaaactcaatgaaagaagattcttcaacgtggtaggtgcagtggcagctggcagtaccctgaccctgccaccgcacagccctctcagcattgctcatcct

SEQ ID NO: 25249 - DNA, 201 bp, Homo sapiens
aagattcttcaacgtggtaggtgcagtggcagctggcagtaccctgaccctgccaccgcacagccctctcagcattgctcatcctgcactgtggatatcarttgagccacgtgtctcctgccctgggctgtgagctccataggcagggtctccatggctgtatctccagaacccagcacagaaccaggtgcttgggaaagt

SEQ ID NO: 25250 - DNA, 201 bp, Homo sapiens
atgaggatgcggaggcacagagaagataagggacttgtcctgtgtcacacagcaaggagccatccggctcctaagttggtgcatttgacttctgtgcttcyggaaagaaagagcagcaagtttaagatctggaggtggcactgagctttggaggagcagggggcaatgaggtggccggtgtgacgaggactcaatgtgcaa

SEQ ID NO: 25251 - DNA, 201 bp, Homo sapiens
caccgtgcccagctaatttttgtatatttagtagagatggggtttcactgcgttggccaggctggtctcaaactcctgacctcagatgatccactcgcctyggcctcccaaagtgctgggattacaggtgtgagccaccgcacctggccagtggagttccttcttaagtacatgtattgacatctttaaaaagggcgagag

SEQ ID NO: 25252 - DNA, 201 bp, Homo sapiens
agcagccgggactacaggcacctgccaccgtgcccagctaatttttgtatatttagtagagatggggtttcactgcgttggccaggctggtctcaaactcytgacctcagatgatccactcgcctcggcctcccaaagtgctgggattacaggtgtgagccaccgcacctggccagtggagttccttcttaagtacatgta

SEQ ID NO: 25253 - DNA, 201 bp, Homo sapiens
ctctgtcacccagggtggaacacagtggcgtgatcttggctcactgcaacctccgcctcctgggttctagcgattctcctgcctcagcctcctgagcagcygggactacaggcacctgccaccgtgcccagctaatttttgtatatttagtagagatggggtttcactgcgttggccaggctggtctcaaactcctgacct

SEQ ID NO: 25254 - DNA, 201 bp, Homo sapiens
gctacttgggaggctgaggtaggagaatggcttgaacccaggagaaggaggttgcagtgagcttagatcatgctactgccctccagcctgggcgacagagygagattacgtctcaaaaaaataaaaataaataaaaataaaaagattttttaaaaggctgaagtttgggttactttggctcatacactttgccttcactgt

SEQ ID NO: 25255 - DNA, 201 bp, Homo sapiens
gaggccgggtgtggtggttcatgcctataatcccagcactttgggaggccgagcccagcggatcaccggaggtcaggagttcgagaccagcctggacaacrtggtaaaaccccgtctctactaaaaatacaaaaaattagtctggcatggtggcaggcgcctgtaatcccagctacttgggaggctgaggtaggagaatgg

SEQ ID NO: 25256 - DNA, 201 bp, Homo sapiens
ctgggcttttatatcataggatgcctctaatggcaatcctgccattagatacacctgccgtggtgtatctgccaggtaggcaggctaggctgcagtaacamacaagcccacaatttccatggcttaacactataggaatatatttcttgctcacgtaacaagctaacgtgaatgttgctggtttgtaggtggtttccctcc

SEQ ID NO: 25257 - DNA, 201 bp, Homo sapiens
tgtggccaaaggtgtgaaggatgcagctgtaaaagctgaagtttgaggccgggtgtggtggttcatgcctataatcccagcactttgggaggccgagcccrgcggatcaccggaggtcaggagttcgagaccagcctggacaacatggtaaaaccccgtctctactaaaaatacaaaaaattagtctggcatggtggcagg

SEQ ID NO: 25258 - DNA, 201 bp, Homo sapiens
ccattcttcccctgtggccagacacttcccctggctgagtctctgggcttttatatcataggatgcctctaatggcaatcctgccattagatacacctgcygtggtgtatctgccaggtaggcaggctaggctgcagtaacacacaagcccacaatttccatggcttaacactataggaatatatttcttgctcacgtaac

SEQ ID NO: 25259 - DNA, 201 bp, Homo sapiens
atgaatcaaaataaagaaaaatactcagtaaatcatcataaagtacagagatgtggccaaaggtgtgaaggatgcagctgtaaaagctgaagtttgaggcygggtgtggtggttcatgcctataatcccagcactttgggaggccgagcccagcggatcaccggaggtcaggagttcgagaccagcctggacaacatggta

SEQ ID NO: 25260 - DNA, 201 bp, Homo sapiens
gtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggct

SEQ ID NO: 25261 - DNA, 201 bp, Homo sapiens
ggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggc

SEQ ID NO: 25262 - DNA, 201 bp, Homo sapiens
tagagggttgtccaaggaaggccacatccagaagcatctcccaggacagttgttgtgtagctcaccctctggactttgtgggtctgggtgttgtttcatgwttatagagagagctctgtgaacgtggaggacctgttgtcggcagagacacaaatggccagggcatggctgggcagccgcagtggctcaggcctgtaatcc

SEQ ID NO: 25263 - DNA, 201 bp, Homo sapiens
tttcatctgaggctcaattggggaagggtcacttctaagctcatacaatattggtgacattcagtccctggcaggctgttgaactgagagcctcagtttcstgctggctgttggttgtagttaaccctgaattccttcccatgtgccctttgcaaagccatcaaggcagagagacttgcctagcaagtaggatattacagt

SEQ ID NO: 25264 - DNA, 201 bp, Homo sapiens
aggaggccgaggcaggaggatcgcttgagcccaggagttcgaggtcagcttgggcaacatagggagaccttgtctctacaaataataaaatattagccagrtgtggcagtgcacgcctgtagccccagctactcaggaggccgaggtgggaggatcccttgaactcaggaggtcaaggctgcagtgaactgtgatcgcgcc

SEQ ID NO: 25265 - DNA, 201 bp, Homo sapiens
ggcacaggccaccacgccaggctaattttttgtatttttagtagcgacagggtctcgccatgttgtccgggctggtctggatctcctggcttcaagtgatmcccctggctcagcctcccaaggtgctgggattacaggcttgagccaccgcatccagcccagatctgagatttgcacccagtatttgaactcccaagcctg

SEQ ID NO: 25266 - DNA, 201 bp, Homo sapiens
ttttgttgttgttgttgttgttgagacagagtctcactctatcacccaggctggaatgcaggggcgtgatcatggctcactgcatccttgacttcctgggmtcaggtgattctcccacctctgcctcccaggtagctgggactacaggcacaggccaccacgccaggctaattttttgtatttttagtagcgacagggtct

SEQ ID NO: 25267 - DNA, 201 bp, Homo sapiens
gtgacggacccaccagaaccccagacttcaccactaggcagcatatccagtgagaacagatctgaggcttgccatcaaaattgcacttgtaaggccgggcrctgtggtggctcgcggctgtaatcccagccctttgggaggccgaggtgggcagatcacttgaggtcaggagttcgagaccggcctggccaacatggtgaa

SEQ ID NO: 25268 - DNA, 201 bp, Homo sapiens
gtttccacccctgaacttaagtgcccaggaaggcgtattgagatgaggtgtgcttgctggaaggcatgcctgctgctgattgaaaaccgaactgggaacaktccttccattctgtgtccactggtcagctgctgcggctttggatggtcttgaccgtggaaggctgaccttcttctggtacccggagtccctgcaggaatc

SEQ ID NO: 25269 - DNA, 201 bp, Homo sapiens
attttttgtatttttagtagcgacagggtctcgccatgttgtccgggctggtctggatctcctggcttcaagtgatccccctggctcagcctcccaaggtrctgggattacaggcttgagccaccgcatccagcccagatctgagatttgcacccagtatttgaactcccaagcctgtgctctttttcctcccatggacat

SEQ ID NO: 25270 - DNA, 201 bp, Homo sapiens
gggtctcgccatgttgtccgggctggtctggatctcctggcttcaagtgatccccctggctcagcctcccaaggtgctgggattacaggcttgagccaccrcatccagcccagatctgagatttgcacccagtatttgaactcccaagcctgtgctctttttcctcccatggacatttctctcagagatggtctcccaaac

SEQ ID NO: 25271 - DNA, 201 bp, Homo sapiens
ttaaaaaacagacaaaccgcaagtagttctttggaagctcagatttctcttttgtttcttagtaaaacatttcccagttcccagctcccttccagggtgtragatttcttcggtaacttacatctagctgttgcttcttgtttgctcatgtttagaaagaaagacaaaagagagtgagaattttctctcccttccccagtc

SEQ ID NO: 25272 - DNA, 201 bp, Homo sapiens
tgacaggagtttaaaacatgcgttgtattccagtgatgcatgatatgacatgcatcacaggaataaaaacctgaggtctcatggatatgattgcttcaaargagaccaagttttaaaacagatgaatcaaaataaagaaaaatactcagtaaatcatcataaagtacagagatgtggccaaaggtgtgaaggatgcagctg

SEQ ID NO: 25273 - DNA, 201 bp, Homo sapiens; identical to SEQ ID NO: 4912

SEQ ID NO: 25274 - DNA, 201 bp, Homo sapiens
gtgtaacaaatgaccccgaaatgtagagggttacaacaactttatttagcttatgcttctgcaggctggcatttggggctgggctcagcagtgagggtggygggggaggctgggctgggctgggctgggcagatctgaattgagctgacccgtccccgtagcctccctccgtgtctgacagttggcttttttttttttttt

SEQ ID NO: 25275 - DNA, 201 bp, Homo sapiens
gtggaggggtggtcggcggtcagatcgtggagggtctcggacgagggtcctgaccctgggtctccagtcctgggaagtggagcccaggctgtaccatggckgacctcagctcatggcttcccctcccacttccagcctacagggagcccttcgagcagcacctcctgctgggcgtcagcgtttcctgcattgtcatcctgg

SEQ ID NO: 25276 - DNA, 201 bp, Homo sapiens
cagcctacagggagcccttcgagcagcacctcctgctgggcgtcagcgtttcctgcattgtcatcctggccgtctgcctgttgtgctatgtcagcatcacsaagtgagtcctgggcccagtgctgccgagcagtccctctggagtgcagggtggcagggacttgcccctctagtctgcccctttgcagtcctctcagtcaa

SEQ ID NO: 25277 - DNA, 201 bp, Homo sapiens
tgcacttgtaaggccgggcactgtggtggctcgcggctgtaatcccagccctttgggaggccgaggtgggcagatcacttgaggtcaggagttcgagaccrgcctggccaacatggtgaagctccatctctactaaaaatacaacaattaactgggtgtagtggcgcacacctgtaatcccagctactagggaggctgagg

SEQ ID NO: 25278 - DNA, 201 bp, Homo sapiens
gcatgtctgaagtagacagccatcaggacatggtgatttcaggctgggctttgaagaatgaataggagtttttcaagtgtcgaaactgaaccctgaccaamctttgcttttgcagacactggaagaattgtcttaccaagctcttgccctgttttctggagcacaacatgaaaagggatgaagatcctcacaaggctgcca

SEQ ID NO: 25279 - DNA, 201 bp, Homo sapiens
cagaaccccagacttcaccactaggcagcatatccagtgagaacagatctgaggcttgccatcaaaattgcacttgtaaggccgggcactgtggtggctcrcggctgtaatcccagccctttgggaggccgaggtgggcagatcacttgaggtcaggagttcgagaccggcctggccaacatggtgaagctccatctctac

SEQ ID NO: 25280 - DNA, 201 bp, Homo sapiens
tgttggccaagctggtctcgaactcctgaactcaggtgatccacccgcctcagcgtcccaaagtgctgggattacaggcatgagccactgagcccggcctyctcctttatcttaattgaaataattcagaaatggaaagtcaaatactgcatgttctcacttataagtaagagttaaataatgtgtacacatgggcattat

SEQ ID NO: 25281 - DNA, 201 bp, Homo sapiens
cacccggctaatttttcgtatttttagtagagaccggttttcatcatgttggccaagctggtctcgaactcctgaactcaggtgatccacccgcctcagcstcccaaagtgctgggattacaggcatgagccactgagcccggcctcctcctttatcttaattgaaataattcagaaatggaaagtcaaatactgcatgtt

SEQ ID NO: 25282 - DNA, 201 bp, Homo sapiens
ccacacccggctaatttttcgtatttttagtagagaccggttttcatcatgttggccaagctggtctcgaactcctgaactcaggtgatccacccgcctcrgcgtcccaaagtgctgggattacaggcatgagccactgagcccggcctcctcctttatcttaattgaaataattcagaaatggaaagtcaaatactgcat

SEQ ID NO: 25283 - DNA, 201 bp, Homo sapiens
aaagtttagttagagccctgaatgcctgcctcataatggtttccatattttatatgcctactatgtgccaggcacattgctcagggtcacacagctggaartggcagggctgagtttttgttgttgttgttgttgttgagacagagtctcactctatcacccaggctggaatgcaggggcgtgatcatggctcactgcatc

SEQ ID NO: 25284 - DNA, 201 bp, Homo sapiens
aagcgattctcctgtctcagcctcccgagtagttgggattaatggtgcctgccaccacacccggctaatttttcgtatttttagtagagaccggttttcaycatgttggccaagctggtctcgaactcctgaactcaggtgatccacccgcctcagcgtcccaaagtgctgggattacaggcatgagccactgagcccggc

SEQ ID NO: 25285 - DNA, 201 bp, Homo sapiens
tgtttgtttgtttgtttgttttctttgagacagagtttcgctcttgttgcccaggctggagtgcagtggcacaatctcggctcactgcaacctctgcctcscgggttcaagcgattctcctgtctcagcctcccgagtagttgggattaatggtgcctgccaccacacccggctaatttttcgtatttttagtagagaccg

SEQ ID NO: 25286 - DNA, 201 bp, Homo sapiens
ctggagttgcaggcagtggagttctgtcctaagcagtgggcacctaaacccgatggcataaaagctgggcgggtgtccacctgcatctgccacagcactgyaggcaccaactgtggctcatactgagtgggataaattccagaaagaaacattaggaacttactatagaattttggggctagagctactcattcattcccc

SEQ ID NO: 25287 - DNA, 201 bp, Homo sapiens
atccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctgc

SEQ ID NO: 25288 - DNA, 201 bp, Homo sapiens
cctggagttgcaggcagtggagttctgtcctaagcagtgggcacctaaacccgatggcataaaagctgggcgggtgtccacctgcatctgccacagcactrcaggcaccaactgtggctcatactgagtgggataaattccagaaagaaacattaggaacttactatagaattttggggctagagctactcattcattccc

SEQ ID NO: 25289 - DNA, 201 bp, Homo sapiens
aatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctg

SEQ ID NO: 25290 - DNA, 201 bp, Homo sapiens
gaggtgggaggatcccttgaactcaggaggtcaaggctgcagtgaactgtgatcgcgccactccactccagcctgcgtgagaaagtgagaccctgtcaaamaaaaagagaaggtgatggggaaagaacacagaacagcataagagggggttggggaagctgggtggagtgggggggattgcagttgaaagtagggaagtca

SEQ ID NO: 25291 - DNA, 201 bp, Homo sapiens
aaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctct

SEQ ID NO: 25292 - DNA, 201 bp, Homo sapiens
ttaatattttcatatttctagatctgccttcaggcatggctggatccagcttctaggaacctgtccagctctgcgccctgctttattctgtactggcttcrtttttaggcaggctcttccctcatgtagtggcagatatgcctactagttgctccaggcctacatcccaaagccacagtgggaaaagggttttttttcttg

SEQ ID NO: 25293 - DNA, 201 bp, Homo sapiens
tgagaaagtgagaccctgtcaaaaaaaaagagaaggtgatggggaaagaacacagaacagcataagagggggttggggaagctgggtggagtgggggggaytgcagttgaaagtagggaagtcagggaaggcctcattgagctgacttggaggaagcgggaaccgtgcagatgtctggggaaggctcattcttggcagaga

SEQ ID NO: 25294 - DNA, 201 bp, Homo sapiens
gtgtgatacagatgagctcccctgtttggcccacatgtgtcctaaaagccatgtgccctttctcttgagtgccccaggccacagagatccccatctgcccrctgtcccacacactggtctgtcatttgttccttgaggtttgtgagggccggctctgtgcatcccaggggcccaggctgggcctggttggctctcagggag

SEQ ID NO: 25295 - DNA, 201 bp, Homo sapiens; identical to SEQ ID NO: 4895

SEQ ID NO: 25296 - DNA, 201 bp, Homo sapiens; identical to SEQ ID NO: 4896

SEQ ID NO: 25297 - DNA, 201 bp, Homo sapiens
atggaggcgcctgagtggtctcatgctcaggtggtttagcaaactcagtgtacatcctgccaattccagtcctgccatggccactgacaagctaggagggygctgaaaggagaaggaccccgatgtctcctccagcccatccatctcctctctcccattggccaaacccaaccggaaactaaaggccaagggtacccggtg

SEQ ID NO: 25298 - DNA, 201 bp, Homo sapiens; identical to SEQ ID NO: 4897

SEQ ID NO: 25299 - DNA, 201 bp, Homo sapiens
tgacagctcacttgaataaccctattattgaagagaataatactgactcaagagacagtgacccgtgtcagttcccttttgaggccaacgggttaaggagraagtccccatacagctgactcgtttactaattcctcttaatgaagagagcagaggccacaccccaggcttagactttcccaagaaaacaagatcagtttg

SEQ ID NO: 25300 - DNA, 201 bp, Homo sapiens
gcaagtccctttgcttcctggccccccacccctcacatcagagaaggggagttatctctgcatgccgctcctcctctgtaaaggtagggctgtgggccacrtctgtgtttcccagtttgggggacacaagtgatcgtaggtggcacattgacagctcacttgaataaccctattattgaagagaataatactgactcaaga

SEQ ID NO: 25301 - DNA, 201 bp, Homo sapiens
gtacatcctgccaattccagtcctgccatggccactgacaagctaggagggcgctgaaaggagaaggaccccgatgtctcctccagcccatccatctcctstctcccattggccaaacccaaccggaaactaaaggccaagggtacccggtgatgaagactgtggtatcagcctcctgagcacagagagggcagaaagggg

SEQ ID NO: 25302 - DNA, 201 bp, Homo sapiens
ccccaccctcagctccctctgtaataggaaaatctctgaactctctgtagttgctccagcaatcttttggaactttgcttctttcttgtgaaaaaacctcyccttggctcactttgcaccaggtttccccaaatgtgcttccaaccacaagcagaaatggagctgccagtaaccaggaagaaactgccgggggctgaggaa

SEQ ID NO: 25303 - DNA, 201 bp, Homo sapiens
gttgggagtctggacatagcttagccaggttctctgctttagagtctcgtgaggctataatcaaggtgtgggatggggctgcagtttcatctgaggctcarttggggaagggtcacttctaagctcatacaatattggtgacattcagtccctggcaggctgttgaactgagagcctcagtttcgtgctggctgttggttg

SEQ ID NO: 25304 - DNA, 201 bp, Homo sapiens; identical to SEQ ID NO: 4902

SEQ ID NO: 25305 - DNA, 201 bp, Homo sapiens
caaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctc

SEQ ID NO: 25306 - DNA, 201 bp, Homo sapiens
atttttttttgtatttttggtagagacaggtttcaccatgttggccaggctggttgtgaactcctaaagtgctgggattacagatgtgagccaccacgccyggccccagtacacactttttggagggtatttgacgttatgtaccaggagtgctggggaaaagtacacacttgactccgtgagattctgcttcttagcatt

SEQ ID NO: 25307 - DNA, 201 bp, Homo sapiens; identical to SEQ ID NO: 4903

SEQ ID NO: 25308 - DNA, 201 bp, Homo sapiens; identical to SEQ ID NO: 4904

SEQ ID NO: 25309 - DNA, 201 bp, Homo sapiens; identical to SEQ ID NO: 4905

SEQ ID NO: 25310 - DNA, 201 bp, Homo sapiens
tgtggtggtgggcacctgtaatcccagctactcgggaggctgaggcagaagaatcgcttgaacccgggaggtggaggttgcagtgagctgagattgcaccrctgcactccagccttggagacagagcgagactctgtctcggaaaaacaaacaaacaagcaaacaaacaaacaaataaatggccagggcaggggagggttg

SEQ ID NO: 25311 - DNA, 201 bp, Homo sapiens
catggtgaaaccccgtctctactaaaaatacaaaaattagccaggtgtggtggtgggcacctgtaatcccagctactcgggaggctgaggcagaagaatcrcttgaacccgggaggtggaggttgcagtgagctgagattgcaccgctgcactccagccttggagacagagcgagactctgtctcggaaaaacaaacaaac

SEQ ID NO: 25312 - DNA, 201 bp, Homo sapiens
ggctctgccctaggcaagtccctttgcttcctggccccccacccctcacatcagagaaggggagttatctctgcatgccgctcctcctctgtaaaggtagrgctgtgggccacatctgtgtttcccagtttgggggacacaagtgatcgtaggtggcacattgacagctcacttgaataaccctattattgaagagaataa

SEQ ID NO: 25313 - DNA, 201 bp, Homo sapiens
tggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttg

SEQ ID NO: 25314 - DNA, 201 bp, Homo sapiens
aggcaagccctggggctggatagcaaatcccaggagctagagacctggcttctcacctggctctgccctaggcaagtccctttgcttcctggccccccacycctcacatcagagaaggggagttatctctgcatgccgctcctcctctgtaaaggtagggctgtgggccacatctgtgtttcccagtttgggggacacaag

SEQ ID NO: 25315 - DNA, 201 bp, Homo sapiens
cattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactcg

SEQ ID NO: 25316 - DNA, 201 bp, Homo sapiens
atgtctccgacactctgctgctgacctggagcaacccgtatccccctgacaattacctgtataatcatctcacctatgcagtcaacatttggagtgaaaaygacccggcagatgtgagtgggcatgctttgacgtttttctgtgacctctggggaacagggtgggtgaccagcagaggcccagtccctggagccaggagcc

SEQ ID NO: 25317 - DNA, 201 bp, Homo sapiens
ccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactc

SEQ ID NO: 25318 - DNA, 201 bp, Homo sapiens
cgaccaaaaatctgggtggtggctgtggtttgtaggccggggctgggctgggtgatgggggagtcactgcatagatcctcacatagaggccgcttctcccrcagtgaaacccagggccccaggaaacctgacagttcacaccaatgtctccgacactctgctgctgacctggagcaacccgtatccccctgacaattacct

SEQ ID NO: 25319 - DNA, 201 bp, Homo sapiens
catcctgccaattccagtcctgccatggccactgacaagctaggagggcgctgaaaggagaaggaccccgatgtctcctccagcccatccatctcctctcwcccattggccaaacccaaccggaaactaaaggccaagggtacccggtgatgaagactgtggtatcagcctcctgagcacagagagggcagaaaggggtgg

SEQ ID NO: 25320 - DNA, 201 bp, Homo sapiens
gccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcact

SEQ ID NO: 25321 - DNA, 201 bp, Homo sapiens
  misc_feature (1)...(201): n = A,T,C or G, or insertion/deletion polymorphism (see Tables 1-2)
gcggttcctggaggcatgtcccggacacagctgtggggcccagccagcctacaggtgaccagcctaacccagcccctgtgtctgcagagcccacacgtgtntccctgagaacaacggaggcgcggggtgcgtgtgccacctgctcatggatgacgtggtcagtgcggataactatacactggacctgtgggctgggcagca

SEQ ID NO: 25322 - DNA, 201 bp, Homo sapiens
ggccggggctgggctgggtgatgggggagtcactgcatagatcctcacatagaggccgcttctcccgcagtgaaacccagggccccaggaaacctgacagktcacaccaatgtctccgacactctgctgctgacctggagcaacccgtatccccctgacaattacctgtataatcatctcacctatgcagtcaacatttgg

SEQ ID NO: 25323 - DNA, 201 bp, Homo sapiens
gccactgacaagctaggagggcgctgaaaggagaaggaccccgatgtctcctccagcccatccatctcctctctcccattggccaaacccaaccggaaacyaaaggccaagggtacccggtgatgaagactgtggtatcagcctcctgagcacagagagggcagaaaggggtggagacaaagaggggcgcagatagtgggc

SEQ ID NO: 25324 - DNA, 201 bp, Homo sapiens
ggagtgcagtggctcaatcttggctcactgcaagctccgcctcccgggttcaagccattctcctgcctcagcctcctgagtagctgggactacaggcaccygccaccacgcccagctaattttttgtatttttagtagagactgagtttcaccatgttagccaggatggtctcgatctcctgacctcatgatctgcctgcc

SEQ ID NO: 25325 - DNA, 201 bp, Homo sapiens
tcacctgtcaataattcagagatcaacaccttttccttttgtttttcaggattaagaaagaatggtgggatcagattcccaacccagcccgcagccgcctsgtggctataataatccaggatgctcaggtaggagtaggcgtggatgaggacatgtgggactgtgtacatgaagaagtgtggttcagaacacctgggctgt

SEQ ID NO: 25326 - DNA, 201 bp, Homo sapiens
agaatgaataggagtttttcaagtgtcgaaactgaaccctgaccaacctttgcttttgcagacactggaagaattgtcttaccaagctcttgccctgtttyctggagcacaacatgaaaagggatgaagatcctcacaaggctgccaaagagatgcctttccagggctctggaaaatcagcatggtgcccagtggagatca

SEQ ID NO: 25327 - DNA, 201 bp, Homo sapiens
gcactttgggagcccagcgcaggcagatcacttgagccctgggctattgaggctgcagtgagctgggattgtgccactgcactccagcctgggcaacagartgggaccctgtctcaaaaaagaagaaaaaaagggtaattaataaacactaaagttctatgtagaattttagcaacattattgttattataatcttctttg

SEQ ID NO: 25328 - DNA, 201 bp, Homo sapiens
tgggagggtgggagaggggtgaaggaagagaagttacttaatgggcatagtgtacaccatttgggtgacggacccaccagaaccccagacttcaccactakgcagcatatccagtgagaacagatctgaggcttgccatcaaaattgcacttgtaaggccgggcactgtggtggctcgcggctgtaatcccagccctttgg

SEQ ID NO: 25329 - DNA, 201 bp, Homo sapiens
ttaaaaagggcgagaggatttacaggaaactatcaggtcagtaatggcaggggccgtccacagtgggtggctgagtccccctatttttctgctggtgtgcrgggaggtcatttcctgccacccatgtttccccaccctgaatccaccttcctcacattcccattggagggacactctctggacatatgggacctggggtcc

SEQ ID NO: 25330 - DNA, 201 bp, Homo sapiens
ctagctcgagggcagaggcttggtgtgatggaatggcactccttaaactgctacatattttccctttaatttggccaagaacaagttgtcaagtttgtgtragataaaggtgcacttggttcgttcttgtctaatggcccccgcacccatgggtatttcttcagcttccacagtcatcccgacactagctgggaagctcca

SEQ ID NO: 25331 - DNA, 201 bp, Homo sapiens
atggtttgctgctgtttatatggtgttagaggggaggtcccatctccagggacatgttatgtaagatacagtggagcgcatggtgggagtgttggtccacrtggcacatggatacggctggaatactggactagaccagcagttctcacactttttggtctcaggaccctttttcacacttaaaaatgagtgaggacccaa

SEQ ID NO: 25332 - DNA, 201 bp, Homo sapiens
ctgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgagg

SEQ ID NO: 25333 - DNA, 201 bp, Homo sapiens
ccagccccatctctctttaaaaaacaaacaaacaaacaaaaaacataaaaagaagcagagaacacatacacatctgcatcttcccttgtttacttaacaayagatcttggaagtcacttctcagtagaggctaggttgggcagagcattggattctaggccagtgagtttggacttgaccatggagacactaggaagccca

SEQ ID NO: 25334 - DNA, 201 bp, Homo sapiens
acaaaaaacataaaaagaagcagagaacacatacacatctgcatcttcccttgtttacttaacaatagatcttggaagtcacttctcagtagaggctaggytgggcagagcattggattctaggccagtgagtttggacttgaccatggagacactaggaagcccatgaaggacagagagagatgcctcgaccctgccagt

SEQ ID NO: 25335 - DNA, 201 bp, Homo sapiens
accctatttgaaatacttacgtatattaacccatttccttatcaccacaaccctgcgggaagggagataggcacttttattatcttcattttgcagatgasgacattgaggtccagagaggttatgtcacttacttaaggtcacacagccaggaagtggtagtagggactcttacccttgttttacagatgagattgaatt

SEQ ID NO: 25336 - DNA, 201 bp, Homo sapiens; identical to SEQ ID NO: 4916

SEQ ID NO: 25337 - DNA, 201 bp, Homo sapiens
ggatgggaggagattcagagcactcctctgtggccacttttgccatcgaccacagtccctgtaaatattaggacaatgtaattaattcccaggaatctgargctcagaaagcgtaagtgacctgttggacttctgatctgtgtgatgtcgaggcttgtaccccttcctgagcattgccgtactccaggccgggctgcaagg

SEQ ID NO: 25338 - DNA, 201 bp, Homo sapiens; identical to SEQ ID NO: 4917

SEQ ID NO: 25339 - DNA, 201 bp, Homo sapiens; identical to SEQ ID NO: 4918

SEQ ID NO: 25340 - DNA, 201 bp, Homo sapiens
cagccttcccagtagctggggctacaggcatgtgccacctctaataacttttctttaatttacaatagtattagtttgttctcatgctgctctaaggacaygcccaagactgggtaatttataaaggaaagaggtttgactcacagttctgcagggctggggaggcttcaggaaacatattatcatggcggaaagggaagc

SEQ ID NO: 25341 - DNA, 201 bp, Homo sapiens
aactcctgacctcatgatctgcctgcctcagcctcccaaagtgctgggattacaggtgtgagccactgcacccaaccaggactccacatttctaaaaccgscatcctactggggagactgaaaatacatatcaatcacaaacaggtggttttccatagtgacccactctctgaatgcactagaccagggtggaggccagag

SEQ ID NO: 25342 - DNA, 201 bp, Homo sapiens
tctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggat

SEQ ID NO: 25343 - DNA, 201 bp, Homo sapiens
cttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatta

SEQ ID NO: 25344 - DNA, 201 bp, Homo sapiens; identical to SEQ ID NO: 4886

SEQ ID NO: 25345 - DNA, 201 bp, Homo sapiens; identical to SEQ ID NO: 4887

SEQ ID NO: 25346 - DNA, 201 bp, Homo sapiens
gcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatt

SEQ ID NO: 25347 - DNA, 201 bp, Homo sapiens; identical to SEQ ID NO: 4889

SEQ ID NO: 25348 - DNA, 201 bp, Homo sapiens; identical to SEQ ID NO: 4890

SEQ ID NO: 25349 - DNA, 201 bp, Homo sapiens; identical to SEQ ID NO: 4891

SEQ ID NO: 25350 - DNA, 201 bp, Homo sapiens; identical to SEQ ID NO: 4893

SEQ ID NO: 25351 - DNA, 201 bp, Homo sapiens
gcacaggatgcttcgttacactggtgcccaggacataatcacgtacacaagacacacagttacggggcagactggggatatacggcacaccagcatgcagsgttcaccagtaaaggtggtattccatgattattctaaggtagatgggctgtgctttgtttccattggcttagtccagggattggcaaactatggcccgtg

SEQ ID NO: 25352 - DNA, 201 bp, Homo sapiens
attaaaacaattaaaaattttttttcttactgaaatggaggtctcactgtgttgcccaggctgctctcaaactcctgggctccagtgatcctcctgcctcmgcctcccaaagtgctgggattacaagcgtgagccgctgtatccggcccaaaatggagaaattttaagtcccaacaacatgcaagcccgcattcaacaaat

SEQ ID NO: 25353 - DNA, 201 bp, Homo sapiens; identical to SEQ ID NO: 4898

SEQ ID NO: 25354 - DNA, 201 bp, Homo sapiens
gtattatgatgaaaagagttttacctggtgggcccagaccacactttgagaaccactggactagacccttgattgaggagtacggtgttgagagtggagtyctctgtgatggtggatggaccaggacacatggcataggagtcaggtggttccctgggctactccatggtgcacaggatgcttcgttacactggtgcccag

SEQ ID NO: 25355 - DNA, 201 bp, Homo sapiens
acagtcatcccgacactagctgggaagctccagcagccctggtcctggccccagctctgtgggcgctggccctcaactttgcctgcactgtgcttttgtgytattccccttggtcctgtttgggtgcaagtccccctcacgcattgagttcctgggccgctcaggctgctcctgtgtctccccagggaacatgaaggtctt

SEQ ID NO: 25356 - DNA, 201 bp, Homo sapiens
ttaaactgctacatattttccctttaatttggccaagaacaagttgtcaagtttgtgtgagataaaggtgcacttggttcgttcttgtctaatggcccccrcacccatgggtatttcttcagcttccacagtcatcccgacactagctgggaagctccagcagccctggtcctggccccagctctgtgggcgctggccctc

SEQ ID NO: 25357 - DNA, 201 bp, Homo sapiens
cttaacatggtaagcccttatgcaagttgttgtcagctgagatgggcgtggcactgagcatgggagcatggaggcgcctgagtggtctcatgctcaggtgrtttagcaaactcagtgtacatcctgccaattccagtcctgccatggccactgacaagctaggagggcgctgaaaggagaaggaccccgatgtctcctcca

SEQ ID NO: 25358 - DNA, 201 bp, Homo sapiens
cagaaggatgccagaagagaaggtactttggggaggggcgggaatcaggagttagttttggacatgagataagcttggaatatttatttgctatctaagayagctccttaacatggtaagcccttatgcaagttgttgtcagctgagatgggcgtggcactgagcatgggagcatggaggcgcctgagtggtctcatgctc

SEQ ID NO: 25359 - DNA, 201 bp, Homo sapiens
tgccaccacgccaggctaattttgtatttttaatagagatggggtttcttcatgttggtcaggctggtctggaactcctaatatcagatgatccacccacytcagcctcccaaagtgctgggattacaggcgtgagccactgcacccagcctagttggctgacttttacctgggacagtgcaggtgcctgagccatgtgcc

SEQ ID NO: 25360 - DNA, 201 bp, Homo sapiens
gtgagtgggcatgctttgacgtttttctgtgacctctggggaacagggtgggtgaccagcagaggcccagtccctggagccaggagcctgggaggcaagcyctggggctggatagcaaatcccaggagctagagacctggcttctcacctggctctgccctaggcaagtccctttgcttcctggccccccacccctcacat

SEQ ID NO: 25361 - DNA, 201 bp, Homo sapiens
ataagagggggttggggaagctgggtggagtgggggggattgcagttgaaagtagggaagtcagggaaggcctcattgagctgacttggaggaagcgggamccgtgcagatgtctggggaaggctcattcttggcagagaggccctgcactgagcctggcgggagggttgagcacaggagggaatgtggtggaggagagtg

SEQ ID NO: 25362 - DNA, 201 bp, Homo sapiens
acgtttttctgtgacctctggggaacagggtgggtgaccagcagaggcccagtccctggagccaggagcctgggaggcaagccctggggctggatagcaawtcccaggagctagagacctggcttctcacctggctctgccctaggcaagtccctttgcttcctggccccccacccctcacatcagagaaggggagttatc

SEQ ID NO: 25363 - DNA, 201 bp, Homo sapiens
gtagctgggactagagatgcacaccattgcacccaatagagcaatacgtttctgttctttgtaaattacctgctctaaggtatttttgttatagcagcctrtatggactaagctgacttgtaacgttacttgagactttaaagtgttccggtcactgttggagggctctgtctgtgttagctcatttaatccccacaacac

SEQ ID NO: 25364 - DNA, 201 bp, Homo sapiens
ggaggcaagccctggggctggatagcaaatcccaggagctagagacctggcttctcacctggctctgccctaggcaagtccctttgcttcctggccccccrcccctcacatcagagaaggggagttatctctgcatgccgctcctcctctgtaaaggtagggctgtgggccacatctgtgtttcccagtttgggggacaca

SEQ ID NO: 25365 - DNA, 201 bp, Homo sapiens
aaacttcatcccattgtagtcatattaagagatggggcctttggagaagtgattaagtcatgagggctctgtggttggtcatgaatggggttagtgccctyatgaacgggctgaaggaagtgtgtttgccccttctgtcatatgaagacacagcagcatggcatcgtccgtgaggaatgggctctcaccagatctggatct

SEQ ID NO: 25366 - DNA, 201 bp, Homo sapiens
aggtccagagaggttatgtcacttacttaaggtcacacagccaggaagtggtagtagggactcttacccttgttttacagatgagattgaattatctcacraaaactcagaaaggttaaacaacttgcctaagtaacatacagctaattagtcgaggagcctgacgcatgttgctctagcctggtcacagttacagaggtg

SEQ ID NO: 25367 - DNA, 201 bp, Homo sapiens
tacagatgagattgaattatctcacgaaaactcagaaaggttaaacaacttgcctaagtaacatacagctaattagtcgaggagcctgacgcatgttgctstagcctggtcacagttacagaggtggcaagcaatggcctgaacaggacgaacaaccaaatacccaggctggtggctcttaaacatggtggggtcagctaa

SEQ ID NO: 25368 - DNA, 201 bp, Homo sapiens
cttgcctaagtaacatacagctaattagtcgaggagcctgacgcatgttgctctagcctggtcacagttacagaggtggcaagcaatggcctgaacaggaygaacaaccaaatacccaggctggtggctcttaaacatggtggggtcagctaacgacagcaaccagggtgggcactggtgcccctcgcccccggctggtgc

SEQ ID NO: 25369 - DNA, 201 bp, Homo sapiens
tctgccttctcttccctgcattcggtaattgccctgtgacattagccttcaagggacggcaggaggaggggtgttctggaaacgtggactgctggccaagmcccctgagtttcactggtgtgtcaggtacatggtgataccccttgggagtgctgttatagttaacaaccagagcagccgtgcctgttgttaaaatcttga

SEQ ID NO: 25370 - DNA, 201 bp, Homo sapiens
caatcctgccattagatacacctgccgtggtgtatctgccaggtaggcaggctaggctgcagtaacacacaagcccacaatttccatggcttaacactatrggaatatatttcttgctcacgtaacaagctaacgtgaatgttgctggtttgtaggtggtttccctccctgtagaaatctggggagtgaggttctttccat

SEQ ID NO: 25371 - DNA, 201 bp, Homo sapiens
tatcaatcacaaacaggtggttttccatagtgacccactctctgaatgcactagaccagggtggaggccagagatcttctggggtgctttttgcaaggggsaccaggataaggctctccaaggagggaaaatttgaggggggccctgactggggagaatgagctggccagggataagcaagatggagtcatcccacatccc

SEQ ID NO: 25372 - DNA, 201 bp, Homo sapiens
ggaagggctccttcaagcccagcgagcatggtgagcagggcggagtgcggcaggggtggctgggtgtgttcccacagctgcctgggctgagggtggggtgrgcaggggaggaggtggggtcatagcaacagcaggaggaagccgcctgtattttcccaaatctgatgggattcctgcccctgcctgggcctcagtcctccc

SEQ ID NO: 25373 - DNA, 201 bp, Homo sapiens
gtgccaccacgccaggctaattttgtatttttaatagagatggggtttcttcatgttggtcaggctggtctggaactcctaatatcagatgatccacccayctcagcctcccaaagtgctgggattacaggcgtgagccactgcacccagcctagttggctgacttttacctgggacagtgcaggtgcctgagccatgtgc

SEQ ID NO: 25374 - DNA, 201 bp, Homo sapiens; identical to SEQ ID NO: 4907

SEQ ID NO: 25375 - DNA, 201 bp, Homo sapiens
gattacaggcatgtgccaccacgccaggctaattttgtatttttaatagagatggggtttcttcatgttggtcaggctggtctggaactcctaatatcagrtgatccacccacctcagcctcccaaagtgctgggattacaggcgtgagccactgcacccagcctagttggctgacttttacctgggacagtgcaggtgcc

SEQ ID NO: 25376 - DNA, 201 bp, Homo sapiens
aattttcttgcctcagcctcccaagtagctgggattacaggcatgtgccaccacgccaggctaattttgtatttttaatagagatggggtttcttcatgtyggtcaggctggtctggaactcctaatatcagatgatccacccacctcagcctcccaaagtgctgggattacaggcgtgagccactgcacccagcctagtt

SEQ ID NO: 25377 - DNA, 201 bp, Homo sapiens
gacagttggctttttttttttttttctttttctgagacggagttttgctcttattgcccaggagtgcaatggcgtgatcttggctcactgcaacctctgcytcctgggttcaagcaattttcttgcctcagcctcccaagtagctgggattacaggcatgtgccaccacgccaggctaattttgtatttttaatagagatg

SEQ ID NO: 25378 - DNA, 201 bp, Homo sapiens
gtctgacagttggctttttttttttttttctttttctgagacggagttttgctcttattgcccaggagtgcaatggcgtgatcttggctcactgcaacctstgcctcctgggttcaagcaattttcttgcctcagcctcccaagtagctgggattacaggcatgtgccaccacgccaggctaattttgtatttttaataga

SEQ ID NO: 25379 - DNA, 201 bp, Homo sapiens
ccgtccccgtagcctccctccgtgtctgacagttggctttttttttttttttctttttctgagacggagttttgctcttattgcccaggagtgcaatggcrtgatcttggctcactgcaacctctgcctcctgggttcaagcaattttcttgcctcagcctcccaagtagctgggattacaggcatgtgccaccacgccag

SEQ ID NO: 25380 - DNA, 201 bp, Homo sapiens
aaaccctgtctctactaaaaatacaaaattagttgggtgtgtggcccatgcctgtaatcccagctactcagaaggctgaggcaggagaatcgcttgaaccygggaggcggaggttgcagtgagccgagatcgcgccattgcactccagcctgggcaacaagagtgaaactctgtctcaaaaaaataaaatgaaataaaata

SEQ ID NO: 25381 - DNA, 201 bp, Homo sapiens
cttgctcacgtaacaagctaacgtgaatgttgctggtttgtaggtggtttccctccctgtagaaatctggggagtgaggttctttccatcttgtggtgccrtcattctccaggacaaagattcttacctacttttgtgtcctggtttcctttggcagcctggtgaagcctatggacctcatttcagaatatttttaaatac

SEQ ID NO: 25382 - DNA, 201 bp, Homo sapiens
acggtgtttcaccatattggccaggctggtctcgaacttctgacctcaggtgatacacctgccttggcctcccaaagtgctgggattacaggcgtgagccrccatgcctggcctcatataagcatttctgtctccatttatcatccatctttccctcttgaaggtcagtttcaccaaggcaggcatctttgtctcgttcac

SEQ ID NO: 25383 - DNA, 201 bp, Homo sapiens
gaaaaggcatggaggtgggactgagtttggtgtgtttaagaagtgcaggtggcagccgggctcagtggctcacgcctgtaatcccagcactttgggaggcygaggcaggcggatcacctggggtcgggagttcaagaccagcctgaccagcatggagaaaccctgtctctactaaaaatacaaaattagttgggtgtgtgg

SEQ ID NO: 25384 - DNA, 201 bp, Homo sapiens
taacaagctaacgtgaatgttgctggtttgtaggtggtttccctccctgtagaaatctggggagtgaggttctttccatcttgtggtgccatcattctccmggacaaagattcttacctacttttgtgtcctggtttcctttggcagcctggtgaagcctatggacctcatttcagaatatttttaaatacataaaatccc

SEQ ID NO: 25385 - DNA, 201 bp, Homo sapiens
agtagagacggtgtttcaccatattggccaggctggtctcgaacttctgacctcaggtgatacacctgccttggcctcccaaagtgctgggattacaggcrtgagccgccatgcctggcctcatataagcatttctgtctccatttatcatccatctttccctcttgaaggtcagtttcaccaaggcaggcatctttgtct

SEQ ID NO: 25386 - DNA, 201 bp, Homo sapiens
ctacttttgtgtcctggtttcctttggcagcctggtgaagcctatggacctcatttcagaatatttttaaatacataaaatcccagcctgggcaatatagwgaaacccccatctgtacaaaaattagccaggcatggtggcatgcacctgtagtcccaggtactgggaaggctgaggtgggaggatcacttgagcccagga

SEQ ID NO: 25387 - DNA, 201 bp, Homo sapiens
tttagtagagacggtgtttcaccatattggccaggctggtctcgaacttctgacctcaggtgatacacctgccttggcctcccaaagtgctgggattacargcgtgagccgccatgcctggcctcatataagcatttctgtctccatttatcatccatctttccctcttgaaggtcagtttcaccaaggcaggcatctttg

SEQ ID NO: 25388 - DNA, 201 bp, Homo sapiens
ctttctttctaagatatacattcaataatataaatttccctctaagcactgcttttgctacgtctcaccgattttgataggctatattttcatttttattkagttaaaaatatttttagtttctcttgtgatttcttctttgatccatatgttattcggaagtgtgtttttaaatctccaaatacttggaaattttctggc

SEQ ID NO: 25389 - DNA, 201 bp, Homo sapiens
gaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcat

SEQ ID NO: 25390 - DNA, 201 bp, Homo sapiens
attaattagtgccttctctctcatttttttgattcgcctaggtagagatttatcaatttcattgatcttttcgaagaaccaatttttgatttcattgattytcctcgattaattttctatttttaatttcattgatgtatgctccaattttgtatttttttcttctgcttgttttagacatatattgcttttctgtttcta

SEQ ID NO: 25391 - DNA, 201 bp, Homo sapiens
gccttaacctcctgggctcaagtgatcctcctgcctcagccttcccagtagctggggctacaggcatgtgccacctctaataacttttctttaatttacartagtattagtttgttctcatgctgctctaaggacatgcccaagactgggtaatttataaaggaaagaggtttgactcacagttctgcagggctggggagg

SEQ ID NO: 25392 - DNA, 201 bp, Homo sapiens
gagtttggacttgaccatggagacactaggaagcccatgaaggacagagagagatgcctcgaccctgccagtcctttagaaagatcacccagtgctttttrtataccaaaccctatttgaaatacttacgtatattaacccatttccttatcaccacaaccctgcgggaagggagataggcacttttattatcttcatttt

SEQ ID NO: 25393 - DNA, 201 bp, Homo sapiens
tggtgccatcattctccaggacaaagattcttacctacttttgtgtcctggtttcctttggcagcctggtgaagcctatggacctcatttcagaatatttwtaaatacataaaatcccagcctgggcaatatagtgaaacccccatctgtacaaaaattagccaggcatggtggcatgcacctgtagtcccaggtactggg

SEQ ID NO: 25394 - DNA, 201 bp, Homo sapiens; identical to SEQ ID NO: 4913

SEQ ID NO: 25395 - DNA, 201 bp, Homo sapiens
aaacgtggactgctggccaagccccctgagtttcactggtgtgtcaggtacatggtgataccccttgggagtgctgttatagttaacaaccagagcagccktgcctgttgttaaaatcttgacctaattgtatacttgtcggcaaatagccactatcctgaacactcccctccttttttttaatatacaggatctcactct

SEQ ID NO: 25396 - DNA, 201 bp, Homo sapiens
tttatttttaaaattttaaaataaatagagacagggtatcactatgttgcccaggctgcttttgacctcctgggctccagtgatcttcccatcttggcttyccaaagtgctgggattacaagtgggagccagtgttcctggccccttcctccattcttaatggaaggagatgctaggtgtgagaggttagggaaagtaaag

SEQ ID NO: 25397 - DNA, 201 bp, Homo sapiens
cctgagctcaagtgatcctcccatcttagcctcccgagtagctgatactacagatgtgcattaccacgcctggctattttaaaaggtttttgcctgtaatdccagctactcaggaggctgaggcatgagaatcacttgaacccgggaggcagaggttgcagtgagcgcagattgtgccactgcactccagcctgggcgaca

SEQ ID NO: 25398 - DNA, 201 bp, Homo sapiens
ttctctagcctcagccttctaagtagctgggactacagtcatacaccaacatgcccagctaattttccttttttttaattcttgtagagatgtttgagacrgcttgggctctgttgcccaggctgttctcaaactcctgagctcaagcgatcctccctcctcagcctcctaaagtgctgggattacaggcgtgagccaccg

SEQ ID NO: 25399 - DNA, 201 bp, Homo sapiens
aatgcactagaccagggtggaggccagagatcttctggggtgctttttgcaagggggaccaggataaggctctccaaggagggaaaatttgaggggggccytgactggggagaatgagctggccagggataagcaagatggagtcatcccacatccccttacaacactgggtgcctgggcaactgggggcatttgggggca

SEQ ID NO: 25400 - DNA, 201 bp, Homo sapiens
cacagctaggaaatcctggagccaggatttgaacccgggtctgacctaagagctcccagccgccgtgatatatcagcttatgtcatcctgacacctacgcrgatgtcggctcgaatccactttgcctgagcattgtctcagagaaatctaatttaaaaattaggcagcaaatagaaaatatatttgactgctagagatgca

SEQ ID NO: 25401 - DNA, 201 bp, Homo sapiens
ggggggccctgactggggagaatgagctggccagggataagcaagatggagtcatcccacatccccttacaacactgggtgcctgggcaactgggggcatytgggggcatgtggtaggagccagaggaatttgcgacgattgccctgatggagtcaggagacctgggtttgaatcctggccttggagcttggtagctggcg

SEQ ID NO: 25402 - DNA, 201 bp, Homo sapiens
agttgggaggctcaatgattatcccaattttacagataaggaaacaggtccagagaggttgaggattagcctagaaccacacagctaggaaatcctggagycaggatttgaacccgggtctgacctaagagctcccagccgccgtgatatatcagcttatgtcatcctgacacctacgcagatgtcggctcgaatccactt

SEQ ID NO: 25403 - DNA, 201 bp, Homo sapiens
tttgggggcatgtggtaggagccagaggaatttgcgacgattgccctgatggagtcaggagacctgggtttgaatcctggccttggagcttggtagctggyggccgacaagttgctgaaacccctgagcctggggttcctgctttgcagagtgacagtgatggtgagaacatatttcatcagccagaagaggccaaatcac

SEQ ID NO: 25404 - DNA, 201 bp, Homo sapiens
aaatcatgatactttatcttctatttacaaagataaaagtacaccagaaaatggttaatgtttaagcgctttcatatttggctctgtctttttagcagacraaaaccactttggtagtgccagtgtgactcatccacaatgatttctccagtgctcatcttgttctcgagttttctctgccatgttgctattgcaggacgg

SEQ ID NO: 25405 - DNA, 201 bp, Homo sapiens
gttgtaacatttttctctctgtttctccatagaaagatcccttttatttcctgcatcatctgaaaataagttgtatatattacgatacttgcccataaagmcttcagcctgaatatactaagaacaaggacattttatatcatcacttcatatgttttggattattaacaataataatccaaaccattctaataacataac

SEQ ID NO: 25406 - DNA, 201 bp, Homo sapiens
ggtgttgggattacaggcacgagccatcatgcccggcttcacaatcccttatcttaatcacagtataattaaatctacctatgacctggaagcaccccctmatctgccactgcttcaacttgtcccacccttccagatcaaaccaatgttaatcttacatgtattgattgatgtattgtgtctccctaaaatgtataaaag

SEQ ID NO: 25407 - DNA, 201 bp, Homo sapiens
tagtgagataaactacaacacctgatgctgcagttggccttcgaactgcaactgatactcatcttcttcctccaccaccatccatttcgtattctcctcayccttggctggctcttctgttggtctcagtggctcttctggtggtgtgacaaagaccttcatccttgaggggtctgaaaggcctctatgcctttctgatgt

SEQ ID NO: 25408 - DNA, 201 bp, Homo sapiens
aaggcgggtggatcatgaggtcaggagatcgagaccatcttggctaacacggtgaaaccccgtctctactaaaaatacaaaaaattagccgggcgcggtggcgggcgcctgtagtctcagctactcgggaggctgaggctggagaatggcgtaaacccagggggcggagcctgcagtgagcagagatcgcgccactgcact

SEQ ID NO: 25409 - DNA, 201 bp, Homo sapiens
ggaaaaagggaggggagaagggagggaaggaaggagaagggagggagggaaggaagaagggagggagggaagaaggaggaaaggagtgcatagttttccarttgaagtataatcaagtaaacacacagatcttaaatatttggcttgatggcttttgaaaattgcatgtagccaagtaacaaccacctaaaatagaatata

SEQ ID NO: 25410 - DNA, 201 bp, Homo sapiens
actcaggaggctaaggcaggagaattgcttgaacccagaaggcagaggttgcagtgagccaagatcacaccactgcattctagcctgggcaacagagtgaracactgtctcaaaacaaaacaaaacaaaacaaaaaacaaacaaaaaaaacaaaagagcctttatcatctagttcctacccactctccacctttgtttgct

SEQ ID NO: 25411 - DNA, 201 bp, Homo sapiens
tttcatgttatagctattgagcagaacttttcatatacagtttgtacaagcagctgtcaaatcacttagaagtaccatatcccaagccacagttcggtatsttactcccaaggatgccagtagataactcatcaaatgctttactaaaagagggatatacattgtagctaaagtgttgcccttttctactaacctaataac

SEQ ID NO: 25412 - DNA, 201 bp, Homo sapiens
tgaaaactggaacatcattttagagaggtggagactgagaacagagagtaggtgtttgtccaaagtttatatgccaaggctgtgagtgaaacaggagcttygatcttttggtgttccatctacaacatacacaaaacaaaagatggagaatgagaagtccaggcaaccccggaaacaacaagtttctgtcaaaagcaataa

SEQ ID NO: 25413 - DNA, 201 bp, Homo sapiens
gtctctgatgccagaaagtaagaaccagccagaggctgaagctgtccttggctctaggtttagaaatctttcaaaaacattgacaatcttgttttagcagstgggagaggacagtagggagcagacaaagctaagaagagaggagtctgagaagtgtccagctagtgggagagaagggaatgataactgattaaaaatacc

SEQ ID NO: 25414 - DNA, 201 bp, Homo sapiens
tgatactttatcttctatttacaaagataaaagtacaccagaaaatggttaatgtttaagcgctttcatatttggctctgtctttttagcagacgaaaacmactttggtagtgccagtgtgactcatccacaatgatttctccagtgctcatcttgttctcgagttttctctgccatgttgctattgcaggacggagtaag

SEQ ID NO: 25415 - DNA, 201 bp, Homo sapiens
ctcaagctgatgtgtctcagggaattttagacctctggatataaaccaagatcacccaaatgagagcaagcggaggttatttattcagagcttgctatagsaagggaggcagccattaacagttgtgtttggcagagactcaaagtcaaagtcagacagaggagtgggaaagctttataatagaaaaaaggaaaggcttca

SEQ ID NO: 25416 - DNA, 201 bp, Homo sapiens
tatgaagacagaaaccatctcccaaagatttcataacagagccacataagtggaaagtaaatgattaaagaatgtgggtctcagagttccattcaaatcaygatactttatcttctatttacaaagataaaagtacaccagaaaatggttaatgtttaagcgctttcatatttggctctgtctttttagcagacgaaaacc

SEQ ID NO: 25417 - DNA, 201 bp, Homo sapiens
caggcaagtcgatcatgtgggcattgaagatgaagacatgaaatacaactgatactcctgaagattggaactgaaaggcaggaactattcctactttttcygtatctcaatggtctctcccatttccgtctctctgcttattcatcttgaacatggcttgatatacaccagaccctctcagttacaggattcatcaccaac

SEQ ID NO: 25418 - DNA, 201 bp, Homo sapiens
tctttaaagatgagggatttaagggtttggattctccactcaccagctgtggaaccctgcagtgattcacctgcatcattggttgggaggctccatgagcyatagatgagtactaagtttgtcaggaagacagcattatacgatggaaaagaagtcaatagcattaacatgaagcaatgctcaatggagaagatatttgag

SEQ ID NO: 25419 - DNA, 201 bp, Homo sapiens
catcattggttgggaggctccatgagccatagatgagtactaagtttgtcaggaagacagcattatacgatggaaaagaagtcaatagcattaacatgaarcaatgctcaatggagaagatatttgagatgtcagtgatggattattttactccttgatagaatgaattttccttttgcaggttttatctgaatggcgctg

SEQ ID NO: 25420 - DNA, 201 bp, Homo sapiens
tatacagaggatgctcagtgtatagatggcactatcgaagtccccaaatgcttcaagggtaagtctgcattggaacgtttagctaggactcccacttgccygtcatcataatcagagcctttgttctataatgattgtcaaaaaccagatgaggccaggtgcggtgggtcacgcctgtaatcccagcactttgggaggctg

SEQ ID NO: 25421 - DNA, 201 bp, Homo sapiens
taaattaccagaatgcaggggtaagtgcaatgatcagacaaaatacgcatggtagggcaagatcccatttgtgaaaggtattgaaaattctgactatcatrgagtgtttccaatgaactcattcaacagctgtttattgagcatctaccatgtgccaggcagtgtgctgggcactgtggattcccgatgaatgagacctgg

SEQ ID NO: 25422 - DNA, 201 bp, Homo sapiens
aaaaaataaaataaaataaaaaagaaagcctgggcacggtggctcatgcttgtaatcccagcactttgggaggctgaggcaggcagatcacttgagatcargagtttatgaccagcctgggcaacatagggagacccccatctctacaaaaaataaagaaataagaaataaggctgggcgtggtggctcacgcttgtaatc

SEQ ID NO: 25423 - DNA, 201 bp, Homo sapiens
ggagtgcaatgagtgatctcagctcactgcaacctctgcctcctgggttcaaatgattctcctgtcttagcttcccaagtagctgggattacaggcgcccrccactacacccggctacttttttgtatttttagtagagatggggtttcaccatgttggccaggctggtctcgaactcctggcctcaagtgatccacctgc

SEQ ID NO: 25424 - DNA, 201 bp, Homo sapiens
gacatacatgccaatttatcccattagtggtgacattaattttgattacttaattaagatggtgtctgccaggttcttcccctctaagtttctctttgtcycctttataataaatagttattttatgtggagacatgtttaaggctgtatgaacatttctcatcctacttgtatcccctgattctagcatcaattgatact

SEQ ID NO: 25425 - DNA, 201 bp, Homo sapiens
aatgattatcttgcctcagcctcccaagtagctgggattacaggcacctgccatcatgcctggctaggttttgtagtttttgtaaagacagggtttcaccmtgttggctaggctggtcttgaactcctgacctcaagcgatctttctttcttcctgaagtgctgggattacaggcattagccaccacggcctggccaagaa

SEQ ID NO: 25426 - DNA, 201 bp, Homo sapiens
agtttttttttcttcttcgagtcccaagttgttaatttcaaatcaattttcaaattcctgaaacagatctagaaacctgtctagacagatccaagacataytaagaatggatgaggaggactttgtattgatctgacgtaagagaagatagagaattcaaggatagctctaaggtcctaactggagctataggagcttgca

SEQ ID NO: 25427 - DNA, 201 bp, Homo sapiens
aagtgctgggattacaggcatgagccaaagtacccagtcagaatgctatattttcattggaaatagactgcattgcttttattcattggtgtcagtaggcygtaagaaaatgaataatgaagattactcagtttggttcacttttgtcatcctgaaaaagagatggttctttgctttatattagaaacagtcatcttggcc

SEQ ID NO: 25428 - DNA, 201 bp, Homo sapiens
ggaaatgatacaattacctgcacgacacatggaaattggactaaattaccagaatgcaggggtaagtgcaatgatcagacaaaatacgcatggtagggcamgatcccatttgtgaaaggtattgaaaattctgactatcatggagtgtttccaatgaactcattcaacagctgtttattgagcatctaccatgtgccaggc

SEQ ID NO: 25429 - DNA, 201 bp, Homo sapiens
tgggaggcggaggcaggcagatcacaaagtcaggagattgagaccatcccggccaacatggtgaaaccctatctctactaaaaatacaaaagttagctggrcgtggtggcgtgtgcctgtaatcccagctactcgagaggctgaggcaggagaattgcttgaaccaggaattggaggttgcagtgagcagagatcgcgcca

SEQ ID NO: 25430 - DNA, 201 bp, Homo sapiens
caaaaaaaaaaaaaaaaaaaaagcaagtggaaagtaaagcaatttcaaataaataattgtttaagaagacctgaacaagcaaaaacgaaagtttttaaagkacaaattaagtaaaattttcactcagcagtaggaatcacgatggttcctacagttttcacttaaaacagatttataccgattatgtaaatttgcttcttt

SEQ ID NO: 25431 - DNA, 201 bp, Homo sapiens
aattaagcacaaggtaactataaattgcattccagttacaggaacacacagtgattcagtggtgtgacagagacaaggatgtaactatttcatgactattsgatagcactatttattactaatatgtcttattgaataaatgttttagaagtaaaatgcccattcccatcaagaccagacaatggatttgtgaactatcct

SEQ ID NO: 25432 - DNA, 201 bp, Homo sapiens
ttgccatgttggccatgttggtcttgaactcctgatctcaggtgatccacctgcctcggcctcccaaggtgttgggattacaggcacgagccatcatgccyggcttcacaatcccttatcttaatcacagtataattaaatctacctatgacctggaagcaccccctaatctgccactgcttcaacttgtcccacccttcc

SEQ ID NO: 25433 - DNA, 201 bp, Homo sapiens
ctacagttttcacttaaaacagatttataccgattatgtaaatttgcttctttatttagaggtagggtcttgctctgttgcccaggccggagtgcagtggygtgatcacagctcactgtaacttcgatctcctggggccaagtgatcctctcagtctcctgagcagctgagactatagatgagcgccaccagatctggcta

SEQ ID NO: 25434 - DNA, 201 bp, Homo sapiens
tgtaggggaagagaaggccatcttggaagctatgaataatggttctattgacagagaactgcaattagcaatcatattaccattacttactatatatattyttggatttttcttgccttgaccaatttgtgtaggtgtactcatctactgtttcaaatgctatactctctttcagaaagacttcctgaactcttaagtcct

SEQ ID NO: 25435 - DNA, 201 bp, Homo sapiens
atgttggccaggctggtcctgaacccctgacctcaggtgatccacccgccttggcctcccaaagtgctgggagtacaggcgtgagccaccactgctcctgrccaagggtcaggtttgttatgcagagttaagtccaggccttctccatcctttaggagtttctagtgattttctttatagatgtaaatttccttacaaaag

SEQ ID NO: 25436 - DNA, 201 bp, Homo sapiens
tgaactttaaaatgcaaatagagatttgttaaccatctgctttgtgccctctttcagcctgtcccaagccagatgatttaccattttccacagtggtcccrttaaaaacattctatgagccaggagaagagattacgtattcctgcaagccgggctatgtgtcccgaggagggatgagaaagtttatctgccctctcacag

SEQ ID NO: 25437 - DNA, 201 bp, Homo sapiens
atagaaatttacctgtttatgtttttttttagcccaaagaaaagtaacattttttatctttgtatcacagccagagtatgtccttttgctggaatcttagraaatggagccgtacgctatacgacttttgaatatcccaacacgatcagtttttcttgtaacactgggtaagaactttcatggaactaagcagttaacaga

SEQ ID NO: 25438 - DNA, 201 bp, Homo sapiens
ttccagttacaggaacacacagtgattcagtggtgtgacagagacaaggatgtaactatttcatgactattggatagcactatttattactaatatgtctyattgaataaatgttttagaagtaaaatgcccattcccatcaagaccagacaatggatttgtgaactatcctgcaaaaccaacactttattacaaggataa

SEQ ID NO: 25439 - DNA, 201 bp, Homo sapiens
aagaaaatgagggtcttatcatttccctaatgttttctcccatcacttaaacctcacactaaatggtttcattcacataatcacatgtattctatatactygtaaaatgtatttggtttggcttagctatttaccacatttaagaaatgattgtttctcttagaatgtttatctttttctcccccaacagaacacagttct

SEQ ID NO: 25440 - DNA, 201 bp, Homo sapiens
gtttatctttttctcccccaacagaacacagttctctggctttttggaaaactgatgcatccgatgtaaagccatgctaaggtggttttcagattccacayaaaatgtcacacttgtttcttgttcatccaaggaacctaattgaaatttaaaaataaagctactgaatttattgccgcacccattgcagtgttagcttca

SEQ ID NO: 25441 - DNA, 201 bp, Homo sapiens
acatgtattttttttaattgagacaggttttagctctgttgcccaggctggagtgcagttgtgtgatctcagctgactgcaacctctgcctctgagttcargtgatcctcctgcctcagcctcctgagtagctaggactacaagcgtgtgccaccatgcgtggctaatttttgtatttttggtagagatggggtttcacta

SEQ ID NO: 25442 - DNA, 201 bp, Homo sapiens
gtggggtctgagcttctgcatttccaacaagctattttcccaggctatgcccgtgctgctagcccctggaccacattttgagcagcagggatctagggaaktcaaggtaaatcgcattttggtcagcactatcttcttttatgctagtataacttgttgaagctccatagtactcaggtcagggtgacaagccactactat

SEQ ID NO: 25443 - DNA, 201 bp, Homo sapiens
catgcgatgtttggaaatgatacaattacctgcacgacacatggaaattggactaaattaccagaatgcaggggtaagtgcaatgatcagacaaaatacgyatggtagggcaagatcccatttgtgaaaggtattgaaaattctgactatcatggagtgtttccaatgaactcattcaacagctgtttattgagcatctac

SEQ ID NO: 25444 - DNA, 201 bp, Homo sapiens
catgccttggcctcccaagtagccgggattacaggtgcccgtcaccatacttggctaatttttgtatttttagtagagacggagtttcaccatgatcatcyggctggtctgaaatgcctgacctcaagtaatctgcctgcctcagtctctcaaagtgctgggcttacaggtgtaagccactgctcctggccaagagttatt

SEQ ID NO: 25445 - DNA, 201 bp, Homo sapiens
cagcatggaggagctaccaataacagtagtaacttgtacctttctgggcactcaactatgggccaggcactggtctcctgctacatatgtgtcatctgacytcattctcccaagtcctaaaaagtaggttcctttttttttcaatttcacctagacgtatcaactgttaatatgttgtaacatttttctctctgtttctcc

SEQ ID NO: 25446 - DNA, 201 bp, Homo sapiens
gattattaacaataataatccaaaccattctaataacataacaacaacgatatcatgcaacatttatctcagatgcaaattttcccaattgacccagaagkatctcttatacatgagttttgttttatgcaggatctaatcaagaatcacacctttaatttagttgtcatgtctctctagtctcctataataataattatt

SEQ ID NO: 25447 - DNA, 201 bp, Homo sapiens
acctttaatttagttgtcatgtctctctagtctcctataataataattattattattattttgaaatggtgtctcactctgtcacccaggctggagtgcastggtgcaattttggctcactgcaacatctacctcccaggtttgagcaattctcctgcctcagcctcccaagtagctgggaatataggcacctgccaccac

SEQ ID NO: 25448 - DNA, 201 bp, Homo sapiens
ctcctataataataattattattattattttgaaatggtgtctcactctgtcacccaggctggagtgcagtggtgcaattttggctcactgcaacatctayctcccaggtttgagcaattctcctgcctcagcctcccaagtagctgggaatataggcacctgccaccacgcccagctaatttttataattttagtagaga

SEQ ID NO: 25449 - DNA, 201 bp, Homo sapiens
gatacttagtcagttgaggggtgctagatcaccttttggtaaaggcactgctttttctttggaatagtaagcaacctgtgggtgatactttgaaaccatgygaatatccactgttgggcagtcatggtagaatccaatgatgatccttgaatctgtcaattatgacattggaggctgaaaaatggtgactttctaattcta

SEQ ID NO: 25450 - DNA, 201 bp, Homo sapiens
attggaggctgaaaaatggtgactttctaattctatcttttccttctacatttattcactggcttccctctatagagaagagctttccctccatccaccaktttttagtattattatagacacatggattcttattttttttttgagttggagtctcactctgttgcccaggctggagcataatggtgcaatctcagctca

SEQ ID NO: 25451 - DNA, 201 bp, Homo sapiens
ttgaatctgggaggtggaggttgcagtgagctgagatggtgccactgcattccagcctgggcgatagagtgagactgcatctcaataaataaataaataaacaaacaaacaaacaaacaaacaaatcctactttcaagcactttcacgtaaaacacctgcaatacaatatttttcatagaatgggccacagaccccctcct

SEQ ID NO: 25452 - DNA, 201 bp, Homo sapiens
ggagcataatggtgcaatctcagctcactgcaagcttcacctcctgggtttgagtgattctcctgccttagcctcctgagtggctgggattacaggtgcaygccaccacacccggctaatttttgttagtagagatggggttttgtcatgttggccaggctggtcttgaacttctgacctcctcagcatccacctcagcct

SEQ ID NO: 25453 - DNA, 201 bp, Homo sapiens
gtagctgggactacagatgcatgccaccacacccgggtaatttttgtatttttggtagagacagagtttcgccatgttggctaggctggtctcgaactccygacttcaggtgatctgcccgcctcagcctcccaaagtgctgggattacaggcatgagccaccacacctggcaccaaaacattgttaagtgaaataaacat

SEQ ID NO: 25454 - DNA, 201 bp, Homo sapiens
taatatgtatgcttggatgacaatgaactaagctgacttgaagcctcattttggttttatagactaaataaattgtacaacattgtgtgtgtgtgtgtgtktgtcttttacagagtttcactcttgttgtccaggctggagtgcaatggcatgatctcagctcattgcaacctccgcctcccgggttcaagcgattctcct

SEQ ID NO: 25455 - DNA, 201 bp, Homo sapiens; identical to SEQ ID NO: 4936

SEQ ID NO: 25456 - DNA, 201 bp, Homo sapiens
tggattattttactccttgatagaatgaattttccttttgcaggttttatctgaatggcgctgattctgccaagtgcactgaggaaggaaaatggagcccrgagcttcctgtctgtgctcgtaagtctgtgggcaaggtgatcagctggtttgcccagaacctttctggttttagcactcaaagtctcacatctggaatct

SEQ ID NO: 25457 - DNA, 201 bp, Homo sapiens
gtatctgtattttccaaagagaattttattagcggaagtgaacttccagttggcaagtgttgccagggaaatggctctgagcaacgacattacttccctcmttgcttcccttatcagtcagttaatagctatttctggagcactgactgtgtcaggcactggtctacgtgctggggatgcagccagtaaagacagagtcag

SEQ ID NO: 25458 - DNA, 201 bp, Homo sapiens
cactgactgtgtcaggcactggtctacgtgctggggatgcagccagtaaagacagagtcagcccttgagaggcatgtgttgtgtgggacatttattggccrtaataaggatggcaccatgtctgagaggctgaaaaagagacccagagccagtgagcgagacatagggtttattgaggacttctacatggagtggtccagg

SEQ ID NO: 25459 - DNA, 201 bp, Homo sapiens
tgtgtctgaacacagcctaattcaattacacttcagctgtgtcactagcaggtcaggctaaacttgtggttgatggaaacatctggaacttcttcaagctsatgctgcttcctcctccacttcacctgcatgctgagatttgcagtgatcttgtgaaatgtatcctgtggtttccggctgaagtggtaaggtttttgagat

SEQ ID NO: 25460 - DNA, 201 bp, Homo sapiens
gggtgtttcatgttatagctattgagcagaacttttcatatacagtttgtacaagcagctgtcaaatcacttagaagtaccatatcccaagccacagttcrgtatcttactcccaaggatgccagtagataactcatcaaatgctttactaaaagagggatatacattgtagctaaagtgttgcccttttctactaaccta

SEQ ID NO: 25461 - DNA, 201 bp, Homo sapiens
aaagaaaaagaaaaaaatccattttttcacacattgaatctttctttcttctctaaaactggtacccattaacccaaagtctgtgctcagaatccactgaraacaagtttaaaactccttccacataatggtttttgaaatatttggagactttcttagtcttctccagggtaggctttcatgatactttgacttattatc

SEQ ID NO: 25462 - DNA, 201 bp, Homo sapiens
tcacttagaagtaccatatcccaagccacagttcggtatcttactcccaaggatgccagtagataactcatcaaatgctttactaaaagagggatatacaytgtagctaaagtgttgcccttttctactaacctaataacaatgtcaaaaaacataattggatttaatttgttgaaaccttcaaatgttttgaagagagtt

SEQ ID NO: 25463 - DNA, 201 bp, Homo sapiens
cagtagataactcatcaaatgctttactaaaagagggatatacattgtagctaaagtgttgcccttttctactaacctaataacaatgtcaaaaaacatawttggatttaatttgttgaaaccttcaaatgttttgaagagagttcatattatttttcagtcatcatttcacattcatctacatacccataaaccatttgt

SEQ ID NO: 25464 - DNA, 201 bp, Homo sapiens
ccatgcctggctaatttttgtatcttttagtagagacagggttttgccatgttggccatgttggtcttgaactcctgatctcaggtgatccacctgcctcrgcctcccaaggtgttgggattacaggcacgagccatcatgcccggcttcacaatcccttatcttaatcacagtataattaaatctacctatgacctggaa

SEQ ID NO: 25465 - DNA, 201 bp, Homo sapiens
tggtgacttacacctgtagtcccagctacttgagaggctgaggatcacttgagtttgggaagttgaagatacagagagtggagatcatcccactgtattcyagcctgggtgacagagtgagaccctgtttcaaaaataaatataaataaatatatataaagatttaagcttaaggccgggcgcagtggctcacacctgtaa

SEQ ID NO: 25466 - DNA, 201 bp, Homo sapiens
gaatggaatgctacatggtgataaagtttctttcttctgcaaaaataaggaaaagaagtgtagctatacagaggatgctcagtgtatagatggcactatcraagtccccaaatgcttcaagggtaagtctgcattggaacgtttagctaggactcccacttgcccgtcatcataatcagagcctttgttctataatgattg

SEQ ID NO: 25467 - DNA, 201 bp, Homo sapiens
ttctcccatcacttaaacctcacactaaatggtttcattcacataatcacatgtattctatatacttgtaaaatgtatttggtttggcttagctatttacyacatttaagaaatgattgtttctcttagaatgtttatctttttctcccccaacagaacacagttctctggctttttggaaaactgatgcatccgatgtaa

SEQ ID NO: 25468 - DNA, 201 bp, Homo sapiens
cggctaatttttgttagtagagatggggttttgtcatgttggccaggctggtcttgaacttctgacctcctcagcatccacctcagcctcccaaagtgccrggatgaccgaagtgagccactgtgcctggccacatgaattctgttttatttaatgtgtggtagaaccaaaattgagccaagcagtctgactctggagttt

SEQ ID NO: 25469 - DNA, 201 bp, Homo sapiens
cttgaatctgggaggtggaggttgcagtgagctgagatggtgccactgcattccagcctgggcgatagagtgagactgcatctcaataaataaataaataaacaaacaaacaaacaaacaaacaaatcctactttcaagcactttcacgtaaaacacctgcaatacaatatttttcatagaatgggccacagaccccctcc

SEQ ID NO: 25470 - DNA, 201 bp, Homo sapiens
gtactcatctactgtttcaaatgctatactctctttcagaaagacttcctgaactcttaagtcctgattacaagtattctctctttcagcatcttgtaaaktacctgtgaaaaaagccactgtggtgtaccaaggagagagagtaaagattcaggaaaaatttaagaatggaatgctacatggtgataaagtttctttctt

SEQ ID NO: 25471 - DNA, 201 bp, Homo sapiens
gcttgaatctgggaggtggaggttgcagtgagctgagatggtgccactgcattccagcctgggcgatagagtgagactgcatctcaataaataaataaataaacaaacaaacaaacaaacaaacaaatcctactttcaagcactttcacgtaaaacacctgcaatacaatatttttcatagaatgggccacagaccccctc

SEQ ID NO: 25472 - DNA, 201 bp, Homo sapiens
ctataatgattgtcaaaaaccagatgaggccaggtgcggtgggtcacgcctgtaatcccagcactttgggaggctgaggcgggtggatcacctgaggtcasgagtttgagagcagcctggccaaaaaggtgaaagtctgtctctactaaaaatacaaaaattaattgctgtggtgccgggtgcctgtaatcgcagctactt

SEQ ID NO: 25473 - DNA, 201 bp, Homo sapiens
tgcttgaatctgggaggtggaggttgcagtgagctgagatggtgccactgcattccagcctgggcgatagagtgagactgcatctcaataaataaataaataaacaaacaaacaaacaaacaaacaaatcctactttcaagcactttcacgtaaaacacctgcaatacaatatttttcatagaatgggccacagaccccct

SEQ ID NO: 25474 - DNA, 201 bp, Homo sapiens
aagcagtgagctgcagatggcgtccccacttgcattttcctttccaattttttttttttttgagacaaggtctcactgtcacccaggctgaagtgcagtgktgcgatcacatctcattgcagcctctactttctgggctcaagtgaccctttcacctcagccttctgagtagctgagattacatgcacgcaccaccatgtc

SEQ ID NO: 25475 - DNA, 201 bp, Homo sapiens
aaattgcttgaatctgggaggtggaggttgcagtgagctgagatggtgccactgcattccagcctgggcgatagagtgagactgcatctcaataaataaayaaataaacaaacaaacaaacaaacaaacaaatcctactttcaagcactttcacgtaaaacacctgcaatacaatatttttcatagaatgggccacagacc

SEQ ID NO: 25476 - DNA, 201 bp, Homo sapiens
tttggtttggcttagctatttaccacatttaagaaatgattgtttctcttagaatgtttatctttttctcccccaacagaacacagttctctggctttttsgaaaactgatgcatccgatgtaaagccatgctaaggtggttttcagattccacataaaatgtcacacttgtttcttgttcatccaaggaacctaattgaa

SEQ ID NO: 25477 - DNA, 201 bp, Homo sapiens
tacctcatcttggtcccacattatagagaactcaccccaagtgacaaaacaactcatggcaatgataattggtctaaagatctaacatttcccctttctcmagcaattcgtagagtttgaaaagtatccattagagcaaagtatccattagagcaaaatattttaaggagaatgataccaggtttgtgtgagataaagaag

SEQ ID NO: 25478 - DNA, 201 bp, Homo sapiens
attattgtagacacatggagtctttttttttttttttgagatggagtctcactctgttgcctagctggagtgtaatggtggaatctcagttccctgcaacyttcacctcccaggttcgagtgattacagatgtgagccaccatgcccacccctttttgtgctctgtctagccaaggctcttctcattgcaaaaaccaacca

SEQ ID NO: 25479 - DNA, 201 bp, Homo sapiens
aaaattggcttcgaagacataatgttacatttttctttctttttttttttttcctttctttttgctctgtcacccaggctagagtgcagtggtgcgatctyggctcactgcaacctccacctcctgggttcaagcaattctcctgcctcagcttcccaagtagctgggattacaggcgcctaccaccacacccagataatt

SEQ ID NO: 25480 - DNA, 201 bp, Homo sapiens
atccttaagctaaacatcaagactggtctatattttgttttcagcctttaggttggactttcaaatgcaaatcgattttagtcctgcttttttttttttttgagacggagtctcgctctgtcgcccaggctggagcgcagtggtgcagtctcggctcactgcaagctccacctcctgggttcacaccattctcctgcctca

SEQ ID NO: 25481 - DNA, 201 bp, Homo sapiens
tggttaatgtttaagcgctttcatatttggctctgtctttttagcagacgaaaaccactttggtagtgccagtgtgactcatccacaatgatttctccagygctcatcttgttctcgagttttctctgccatgttgctattgcaggacggagtaagtactttttgcttttgaaaaaataattaatatatccaaccccttcg

SEQ ID NO: 25482 - DNA, 201 bp, Homo sapiens
gcagggagcaagagaaggagctgggaggaggtgccacacacttaaacaaccagatctcatgaggactcaactcacacgtgccaaggaaatggtgctactcyattcctgagaaatctgcccataatccattcacctctcaccaggtcacaccttcaaccctgggaattacacttcagcatgagatttgggggcacaaatatt

SEQ ID NO: 25483 - DNA, 201 bp, Homo sapiens
catgagatttgggggcacaaatattcaaactctaccaataagtcagaagaaaactaacaattaaataatcggtctctctctttgtcagctttcaaccttakgtttagaaacttcatccttgtaaatcggaacaaaaattgggctaacctttcaggaaggcaactaggcagtatgtttgaagattcttaaatgttttaccct

SEQ ID NO: 25484 - DNA, 201 bp, Homo sapiens
gacgtgggcggatcacttgaggccaggaatccgagaccagtctggccaacatggtgaaaccctgcttttgtaaaaatacaaaaaattagccaggtatgggyggtgggcacctgtaatcccagttacttgggaggctgagacaggagaacagcttgaacccaggaggcggaagttgcagtgaataagatagcaccattgcat

SEQ ID NO: 25485 - DNA, 201 bp, Homo sapiens
acatggtgataaagtttctttcttctgcaaaaataaggaaaagaagtgtagctatacagaggatgctcagtgtatagatggcactatcgaagtccccaaakgcttcaagggtaagtctgcattggaacgtttagctaggactcccacttgcccgtcatcataatcagagcctttgttctataatgattgtcaaaaaccaga

SEQ ID NO: 25486 - DNA, 201 bp, Homo sapiens
atctacatgatgtaagattgtgtagacattaaagaaaaaagcaagctttgaagacacaaataataatctgggaaagtgctcatgatatgaaaataaaatayacaacaatataccgaatatgattccaattctgattatgacatatacaaatgctgaaaagaaataaccctaaatggtgatattataggatttttagtcatt

SEQ ID NO: 25487 - DNA, 201 bp, Homo sapiens
cgaactcctggtctcatgtgatccacctgcctcggcctcccaaagtgctgggattacaggcatgagccaccgtgcccggcctctatgctgtacttcgaatycatcccatgtaatattccccttcctccatcctttttttttctttcccaacctgagctcatcagaaaaacttcctgggaagtcatattagtttctctggct

SEQ ID NO: 25488 - DNA, 201 bp, Homo sapiens
atgctgtacttcgaattcatcccatgtaatattccccttcctccatcctttttttttctttcccaacctgagctcatcagaaaaacttcctgggaagtcayattagtttctctggctgcctcctcatcttctgcaccagatcgtcagcaaatgcatttccagaatcttattatcaagctctcatctgttaaacctcattcc

SEQ ID NO: 25489 - DNA, 201 bp, Homo sapiens
atcagaaaaacttcctgggaagtcatattagtttctctggctgcctcctcatcttctgcaccagatcgtcagcaaatgcatttccagaatcttattatcargctctcatctgttaaacctcattcccttttaggttttctggtgatgagatcatccccataatttctttctaattctcacaatatgtttttctaaatagtc

SEQ ID NO: 25490 - DNA, 201 bp, Homo sapiens
agagatggttctttgctttatattagaaacagtcatcttggccaactctttaaagatgagggatttaagggtttggattctccactcaccagctgtggaascctgcagtgattcacctgcatcattggttgggaggctccatgagccatagatgagtactaagtttgtcaggaagacagcattatacgatggaaaagaagt

SEQ ID NO: 25491 - DNA, 201 bp, Homo sapiens
aagagcagcacatgttctggttcatcagaatggccagtttcatattgttcatctcacagatgaacaccacagaagatgccattggtttggagagtggaatkaatggaagatgagtttatgtggcaacatactacggtttttcttcttccagtctctctttctccctgcactactctctgatcccagtgtgtcttctacact

SEQ ID NO: 25492 - DNA, 201 bp, Homo sapiens
atttataaagaaaaaggtttaattggcccatagttccacaggttgtacaggaaccatgatgttggtgtctgctcagcttttggagacacttcaggaaacawaatcatggcagaaggcgaagtgagagcaggctgcttcttacatggcaggagcaggagcaagagagtgagtgtgggaggtgccacacacttttaaacaact

SEQ ID NO: 25493 - DNA, 201 bp, Homo sapiens
tttataaagaaaaaggtttaattggcccatagttccacaggttgtacaggaaccatgatgttggtgtctgctcagcttttggagacacttcaggaaacatwatcatggcagaaggcgaagtgagagcaggctgcttcttacatggcaggagcaggagcaagagagtgagtgtgggaggtgccacacacttttaaacaacta

SEQ ID NO: 25494 - DNA, 201 bp, Homo sapiens
ggatatgtctcccttttggaatgggaatgtttgtcttatgcctgtcccaccattgaattttggaagtagataacttgtttgatttcacaggctcacagctsgcaggaatttaaggtaaattatgccttgagtctcatccccctcagataccaaaatctatgtgttactggaaaggggtcccaatctagacccaagagaggg

SEQ ID NO: 25495 - DNA, 201 bp, Homo sapiens
ttgtttaaagtaaattttgttttcatgttgaattttctcttactgtgcttcttttatgtgtgagcactgtttttctgcatagttttgaacttcaaggagcrgagtggtagaaaatgtgcaaacccccaaaataaggtctagacattggattttaatttttaaatctctcctctcagtatctgatgttgttcacttcttata

SEQ ID NO: 25496 - DNA, 201 bp, Homo sapiens
ctgctttgttttgaaaaggatttaaaacagtttatataatacatatatattatcacaaaacagtaaaacagaaattaaaagtagaaggaaaagaaaaacgaaaaaaaaaaggtaggagatggataaaaaatggagtcagggaaagcgtagcaatgggaatttgatacttgtctgttgataggctgtacatttggctctgag

SEQ ID NO: 25497 - DNA, 201 bp, Homo sapiens
ggaaaagaaaaacgaaaaaaaaaaggtaggagatggataaaaaatggagtcagggaaagcgtagcaatgggaatttgatacttgtctgttgataggctgtacatttggctctgagctctgttgtcaatgacactaggtgactgggttcataagataaaataaacccattcctcagaatagattttcttggatgctgttaca

SEQ ID NO: 25498 - DNA, 201 bp, Homo sapiens
agaaatgttgcctacatttatgcacatatacaaacactaaattctcctgaatttgtgtatttatagaatcttggacttgttaataccacttactaaccggrcctgtgacactgggctaaacaaagtaagccctgtttactcagcagtgtttgggggacatgaagattgcctagaaatattactccggaatggctacagccc

SEQ ID NO: 25499 - DNA, 201 bp, Homo sapiens
attttcaaccttgtctggatcttgttgagcttccttgcaatccttgctttgaattctttatctgtcatttctgagtttccatttgggtcaggaaccattgygggaacacgactgtgatccttcagtggtgtcactatatttagatttttcacaaatccaaaattcttggggtagttccttttcatctggagatgttcacac

SEQ ID NO: 25500 - DNA, 201 bp, Homo sapiens
tgtaatagagagtatagtcaatattagttttaaggcgtggctcccatatatgtcatatctactgataatttttcataaatcttagcctgaatcaattagtkgcataatttggattttatctttttcagcagttatcagaaatattatccatgtttgatagtttgcatttttctttttaaatgtttacttattgggccccag

SEQ ID NO: 25501 - DNA, 201 bp, Homo sapiens
tggtagaaggtacaccctagacagaaatatttctttaaatgaatcagttggtaattctgaaaaaaattgtgctatagaaatgttgcctacatttatgcacrtatacaaacactaaattctcctgaatttgtgtatttatagaatcttggacttgttaataccacttactaaccgggcctgtgacactgggctaaacaaagt

SEQ ID NO: 25502 - DNA, 201 bp, Homo sapiens
ctgataatttttcataaatcttagcctgaatcaattagtggcataatttggattttatctttttcagcagttatcagaaatattatccatgtttgatagtytgcatttttctttttaaatgtttacttattgggccccagaatgcttgttggaggagggattggaatgaaatgtatccttcattgaataggatttttgttt

SEQ ID NO: 25503 - DNA, 201 bp, Homo sapiens
gagtaaatatatagcatgtaatagtttaatgttgttggtagaaggtacaccctagacagaaatatttctttaaatgaatcagttggtaattctgaaaaaawttgtgctatagaaatgttgcctacatttatgcacatatacaaacactaaattctcctgaatttgtgtatttatagaatcttggacttgttaataccactt

SEQ ID NO: 25504 - DNA, 201 bp, Homo sapiens
catgagaaggaaagttcctactctctctgaggttcctcttgtcatctcttagacagctacatagaaagtcaattcagttaataggaacctgtagatgattsttaatatcctctgatcttgcctctagttacataaatacttaacatgccctggttttctgtctgccctcctcattgagattttgtaagaataggtatgtgg

SEQ ID NO: 25505 - DNA, 201 bp, Homo sapiens
caaatgggaggaaataatggcaaatccactgatgtcattggtgctgtcacccatgagaaggaaagttcctactctctctgaggttcctcttgtcatctctwagacagctacatagaaagtcaattcagttaataggaacctgtagatgattgttaatatcctctgatcttgcctctagttacataaatacttaacatgccc

SEQ ID NO: 25506 - DNA, 201 bp, Homo sapiens
tgtcttatgcctgtcccaccattgaattttggaagtagataacttgtttgatttcacaggctcacagctggcaggaatttaaggtaaattatgccttgagkctcatccccctcagataccaaaatctatgtgttactggaaaggggtcccaatctagacccaagagagggttcttggatctcgtgcaagaaagaattcggg

SEQ ID NO: 25507 - DNA, 201 bp, Homo sapiens
ctcctgggatttttgttgttgttgtttgttttgagacaaagtctcgctctgtcacccaggctggagtgcagaggcataatcttggctcactgcaacctccrcctctggagttcaagggattctcctttttctcagccttccgagtagttgggattacaggcgcgcgccgctacaccctaatttttgtatttttagtagagg

SEQ ID NO: 25508 - DNA, 201 bp, Homo sapiens
ttcaggcaatagttctgcctcagcttcctgagtagctgggcctacaggtgcatgccactacacctggctaatttttaaattttttatagagatggtgctcytctgttgctctggctggtctctagctcctaacctgaagtgatcctcccttcacagcatcccatcacagcactccagagtactatgatgacaggtgtgagc

SEQ ID NO: 25509 - DNA, 201 bp, Homo sapiens
aaagaatacactggtattataaggctaattaaaataggtgaagaaaggttgtgatctaagggagtatctcatatattcttttctgtttgtttttgagatgmagtcttgtctgttgcccaggctgtggtgcagtggcacgatcgtggcctactgcaacctcagcctcccgggttcaagctattctcctgcctcagcctctca

SEQ ID NO: 25510 - DNA, 201 bp, Homo sapiens
aagttggttcatccatttcttaagtgcaggtattaacagatctttagaatttgagcatttagtgtttgcggccctggatactgactttgaatgtgtggccracaaactgaagggagaggagccagttgaaggctgtagaaaagaataaataaggtttattgtggtcatactgactcaaagtagtcttctttcaagcaatat

SEQ ID NO: 25511 - DNA, 201 bp, Homo sapiens
ctgcattgtaacactcagaaccaatttcatttcattgatcgtggaaattcagaccctctttcctgcatacttgtcatcaccaggtataggtccttaaaatrtaaacttctgggtccatagcccatcagaactactaatttgttacctgctggacgggaaaggaaataatctttacattgtttttggtagtggtaggtgttt

SEQ ID NO: 25512 - DNA, 201 bp, Homo sapiens
taaagctgcagttttgtaggatgaggaagttctagagatcatgagaactatagttaaaaatactgtgttgtgtactggtaatttaccaagatagtaaattktaggcacacacatgcacacacacacacacaccagcaaggtaactatatgagatgatgggtatattaatgtttgtttgactgtagtaatcacttcattatg

SEQ ID NO: 25513 - DNA, 201 bp, Homo sapiens
tggtatggaactcctgaccttaggtaatccacccgtctcggcctcccaaagtgctgggattacaggcgtgagccaccgcacccggcctatagttttattargggaaaaaaaatatgacataaagggtgctttcctatatatagggaagtgactttcaaatttagtggatcaaaatgacctagagggcttgacaaagacatt

SEQ ID NO: 25514 - DNA, 201 bp, Homo sapiens
ttagaatatctgtaaatggatggcctgtgtgccttttgagcagttctctctaaatattgtatgtctcaactcagtttttaatttaattaattaattaattwatttatttatttatttggggggacagggtcttgttctgttgaccaggctggagtgcagtggcatgatcatggctcactgcagcctctacctcctgggctc

SEQ ID NO: 25515 - DNA, 201 bp, Homo sapiens
tgtgtgtatgtatacacacacacacacacacacacagttagatcacttctcactaccattaataccttgtctgcgttgctataatagcatcttaacagatmttctctatctgccattgctccttctgcatcctatgacagaccaccctcaatatattagagggatcattttaaaatgcaacagaccaagtcactcttctgc

SEQ ID NO: 25516 - DNA, 201 bp, Homo sapiens
ggaaatatttccaaatgtactgtatgaggccagtattaccctgatacccaaaccagacaaagacacatcaaaaacaaaacaaaacaaaaccaaaaaaaaamcactacaggccagtatccctgatgaatattgatactcaacaaaatactagcaaaccgaattctacaacacatttaaaagatcattcgtcatgaccaagtg

SEQ ID NO: 25517 - DNA, 201 bp, Homo sapiens
ttatgacagacccacagctcatatcatagtgaaagggggaaatacttgaagcttttcctctaagatctggaacatgacaaagatgcccactttcaccactrtgattcaacacagtagtggaagtcctagttagagcagtcagacaagagaaagaaagaaagggcatccaagttggaatggaagaagtcaaaatgtccttgt

SEQ ID NO: 25518 - DNA, 201 bp, Homo sapiens
agatgatatgattttatatttggaaaaacctaaagactccaccaaaaacctattagaactgatgaacagattcaataagttttcaggatacaaaatcaacrtacaaaaattggcgcatttatttatgccagcagtgaacaggctgggcgcagtggctcacacctgtaatcccagcactttgggaggccgaggtgggtggat

SEQ ID NO: 25519 - DNA, 201 bp, Homo sapiens
tcctaataactgtgatgccattatcacatctgagaaaattaacaatagttatgtaatcaaataagtattccatatccaaactgcttcatagagtcactaayaagaaattgtgtcttcgagagagtcacatgagagctatactggactctgactggaggggaacttgaagtgagcattggagggaggtgatgatgtgggcaa

SEQ ID NO: 25520 - DNA, 201 bp, Homo sapiens
tgaaataatatgaggacaaaacaaaatgcattccttattagcaaatgttgttaaaggagcatagaaaacactgctaaagcattaaagcagagttttttttwaaaaaaaacctgcagatagaaagtttggtgtactaagttggaaggagatttgtggtatttataacatgttacaacttagggtatttgttaagattctctt

SEQ ID NO: 25521 - DNA, 201 bp, Homo sapiens
ataatttttcataaatcttagcctgaatcaattagtggcataatttggattttatctttttcagcagttatcagaaatattatccatgtttgatagtttgyatttttctttttaaatgtttacttattgggccccagaatgcttgttggaggagggattggaatgaaatgtatccttcattgaataggatttttgttttag

SEQ ID NO: 25522 - DNA, 201 bp, Homo sapiens
cctgaatcaattagtggcataatttggattttatctttttcagcagttatcagaaatattatccatgtttgatagtttgcatttttctttttaaatgtttwcttattgggccccagaatgcttgttggaggagggattggaatgaaatgtatccttcattgaataggatttttgttttagcttaaaaatgaattctaagat

SEQ ID NO: 25523 - DNA, 200 bp, Homo sapiens
gtccacttggtccagagttgagttcaagtcctggatatccttgttaattttctgtcttgttgatctgtctagtgttgacagtgaagtgttaaagtctcccrttattattgtgtgggagtctaagtctctttataggtctctaagaacttgctttacaatctgggtgctcctttattgggtgcatatatatttaggatagt

SEQ ID NO: 25524 - DNA, 201 bp, Homo sapiens
ctaggctgtttccattttcagagagaataaatgtttgcttcttggttccagttcctctgtgtcttttaacatgctattgaaaatcattttgcatgtgttcmgaaacaattagatatatgttaatggatttgggctaagacaattgtgataactgtttaggaataatcagagcattgtggttctgaggtgagtaagtgatga

SEQ ID NO: 25525 - DNA, 201 bp, Homo sapiens
ccagaggatctaggggtagaaagtgaatatggaactatggaaatctcccaggtgaccggaaaagttgttgacatgagaggtgtgttggatctgattatgaytgaacataaagctaaatggagggactctggaaagtcgactgctccactgtttgtaatgggactatcttctttacacagagctcaccaacattttaataaa

SEQ ID NO: 25526 - DNA, 201 bp, Homo sapiens
catggtttttcccatcagtatgcatctttaagattgttagccactgggcagacatgaagaaatttataaaacagaaatataactttttagtataatttttwaaaaattctgtatatcaataaaatactacatttcagactaaagattttaataattgttctgctgccttgggtataagtaaagtgctggaaaaacataaac

SEQ ID NO: 25527 - DNA, 201 bp, Homo sapiens
ttgctcagtaacgtttcagaattgaacaaattcactaatagagaacatgtataggccgggcgtggtggctcatgtgtgtaatcccagcactttgggaggcygaggcaggctagtcactggaggtcaggagtttaagaccagcctaactaacatggtgaaacaccatctctactaaaagtacaaaaattatctgggcatgga

SEQ ID NO: 25528 - DNA, 201 bp, Homo sapiens
catttaatgggataatagaacataaatgtcatttgtgcatttagttgattaaatgtcactcgtttatgattgtacaactggtctatacaatgtaatggtcwctgtagtaaagtaacaatacatttttagtggcattatcagtgttggtaaaataaactcaccgttatattaactaaactgtgcaaacagatttacttgtca

SEQ ID NO: 25529 - DNA, 201 bp, Homo sapiens
tatgaagtctctgctgagggttgtctgagaagtttgcacataatacaattccttgcattgtggaaattattttatatataaccttttcttataatacctawataaaacatagtaagatgatataaattgtgtaaatggtgtggcgatataatcttgacatttattacacttgtgattggcacatagtaaatttgtcatcaa

SEQ ID NO: 25530 - DNA, 201 bp, Homo sapiens
gttggatctgattatgactgaacataaagctaaatggagggactctggaaagtcgactgctccactgtttgtaatgggactatcttctttacacagagctsaccaacattttaataaagatgagctttaaaagggaactcttcaacttaatggcagtaggaatcaaaatgagaaaacctcacgagaaaggggaaattcagg

SEQ ID NO: 25531 - DNA, 201 bp, Homo sapiens
gtgtcacagacagcctcaggaggtcctgacagcatgtgcccaaagtggtcgggctacacttgggttttacacattttaaggagccacaggacatcaatcartacaagtcttttatgctttatttataggttgattcttaaacattgaaaacttatcaactatttaccatattgtaattatacaatcatcattcgctataaa

SEQ ID NO: 25532 - DNA, 201 bp, Homo sapiens
acaatattaaaattggaagtccatattcatttttaaagtaaaacagaaattctcgatttcagtatttttgtaataatttgaattctagtatatggtagcartgaatagacctagataaaatctccctcaaccccagtccatacaatacaatctctgttctagttaggtaccgtagagcagtgccactcaaaatgtcagtcg

SEQ ID NO: 25533 - DNA, 201 bp, Homo sapiens
gtgagaggataaaaaagaaaaaaaaaacacagtaagaagaaagataccttctattttctttgtttttttcttatttaaaatgtgaatctgtgctttaggawaatgctgagatcataaaattgcttcttagaaaaggagcaaacaaggaatgccaggatgactttggaatcacacctttatttgtggctgctcagtatggca

SEQ ID NO: 25534 - DNA, 201 bp, Homo sapiens
atgagtttcaaggccctggccaaggagccaaggcttggagattgtattgcagagggataagctgggtaaaaatcaggggaggagagcatcttacatgatgrgagagcaatcctcctagccatttacaaacttggggccctggcaagggtggtggggaatgggtcccacataactgcccatgttgagagctgtatatctaaa

SEQ ID NO: 25535 - DNA, 201 bp, Homo sapiens
aaaataccgtgcctggccaatatagtatttaaaaaaaggaaagtagagccttagtgtttgtaaaaacataatgtggaagggccaggtgtggtagctcacayttgtaatctcagcactttgggaggccgaggcgggcggatcacctgaggtcaggggttcgagaccagcctggctaacatggtgaaacctcgtttctactaa

SEQ ID NO: 25536 - DNA, 201 bp, Homo sapiens
caacttccacctccagggttcaagggattcttgtgccttagcctcccgagtagctgagcttacaggtgcctgccaccatgccaggctaatttttgtacatktagtggcgatgaggtttcaccatgttggccaggctggtctcaaaatcctgacctgaagtgatccgcctgcctcggcctcccgaagaactgggattacagg

SEQ ID NO: 25537 - DNA, 201 bp, Homo sapiens
aggctaatttttgtacatttagtggcgatgaggtttcaccatgttggccaggctggtctcaaaatcctgacctgaagtgatccgcctgcctcggcctcccraagaactgggattacaggagtgaggcactgcacctggcttttaattctttaatgtaagcaattatgaaactaggatacttattatctttctggttttacc

SEQ ID NO: 25538 - DNA, 201 bp, Homo sapiens
attagaaaaaatacagtggaaaatttaactttagcaatgaaaatgcttaacatggtcaaatttttgttcactgatcttttttattgaatgggtaaagccartgtttacactgcatatgataaatgttttgctttctttgatcaaatttacattcaaagagctattataagaaacattctataaaaattccaatatgttgtt

SEQ ID NO: 25539 - DNA, 201 bp, Homo sapiens
aagaaggtgtaagtttagggatgtgttatctaaatcaaatgtttcttgactctgctgctggggagacatatggaaaaataaacaatatataataggatagyggaattttagctttttgtcttttaatactttcatttgattgaaggatgtatttttctggatatggtctctgatgtctaattggccattagacttctccct

SEQ ID NO: 25540 - DNA, 201 bp, Homo sapiens
aatattttgttacctaagatatgtttttccagattgcttcatttttcctctaatttaggaaatggaaaaaggtgttttttcaaaaccagaaaatgtctccstagaaattattgcaggatatgttctcatgccatttttgctttcttaagcatttacaattagagatttcttccatactatgttatatgatccattgtggga

SEQ ID NO: 25541 - DNA, 201 bp, Homo sapiens
gcatatatggttataaaattcccttagtatttactggcatattaaacaaaaatggcactgacaggcatattattgtctgtgttaataatctacacatgaarcactccctcagttcagctgaacatagttcttacctctaattgttcattaggccagtgatctgttgtgctcttagaaggaaaaccaaaatggtgcaattaa

SEQ ID NO: 25542 - DNA, 201 bp, Homo sapiens
gcaacatattggtaagaaagaataacttttaaacacacttcactacttttccttctcttgcttctctagctgtgttgtaattttaagtgataagattcatyggtgaacacaaattagacataatttgcattttcttatgtgaggaaaagatggggttgttaggggatggctagtaattcccttcagtaaaaatcatatttg

SEQ ID NO: 25543 - DNA, 201 bp, Homo sapiens
cttcttattccatctcttcttctactgcctttgttgattgcaatgatcatttctgacttacttgacttcagtatactcctgagtgctcagcctctattatkctgaaaatcactgttaaataaaatgtgtttgaatataccatgccccttaaaaaagagaatgtaaaagaactcgatttctcccagagtaaaggacaaactc

SEQ ID NO: 25544 - DNA, 201 bp, Homo sapiens
tgtggaaaacaaacttaccttcactctccttcatatatcactgttgacaacctgataatcttcaagtcatggactggctatagaatgatttttgctaacartcactgataatgatgtatgaatttgatatgaaacagatttttttccttttatgacctccacccaaaattattactattattttcaggcttttttttaata

SEQ ID NO: 25545 - DNA, 201 bp, Homo sapiens
gacatatcaacatccgggggtcgcggagccgtccgcctacgggggccgggacgtcgcctgcgcgtctctcgttttcggacggctgcagcatcgcggtgggratcgaaagcgggggcttctgggacgcagctctggagacgcggcctcggaccagccatttcggtgtagaagtggcagcacggcaggtcggtgagtctcgga

SEQ ID NO: 25546 - DNA, 201 bp, Homo sapiens
tctaggcacgcttcaatgcttgtgttgttcatttttctaaattatttgttactcttacctgccctactgatagagagaggagacagccaaatgctgcccasgtcattgtgcacagggggcttgcctaaacatgcccatgggggcgaaaaattccgtgccttaacacgtgcacagaaagggaaataaatcaatgtggagtgg

SEQ ID NO: 25547 - DNA, 201 bp, Homo sapiens
tgcatttcagtgcgattttgttaggaagcggaggaaaatgtatgtgcttagtttgccttgcatagagtgagtaatccattgtttttttgtttgtttgtttrtttttgagacagggtctcgctttgtcacccgggctagagtgcagttgcatgatcactgctcactgccatcccaacctctggggctcaagcgatcctccca

SEQ ID NO: 25548 - DNA, 201 bp, Homo sapiens
aagacactctaatctacacattcggaacatgagggcaaaccctgtgatttttttttctcaatgttttaagtcctaggatgcccagtgcattattttttacmaaatttactaaacataatgataaaggcttagaactctttttgagttttcttattcaatagcaaaagacaaaaagtcacagaccattggggaaactcatgt

SEQ ID NO: 25549 - DNA, 201 bp, Homo sapiens
cttctgagtgtcttataggggaaataagctttggtataaattcaatatataaaactagtacaatatcaatggcatgttacttgtcttcagtaataagcacrcttatcatttcttgttttacacttttaaggatttttatattcccattgtttcatgtgtattagtgttttctaatgtgactcattatccaaatgtgccttt

SEQ ID NO: 25550 - DNA, 201 bp, Homo sapiens
tcattgagattttgtaagaataggtatgtggtgtttgtttcaagtacgaacccttggcatgttttgtttctaatattatattaacatcttgctaacatagkattgactcagtcagcattgacacccttatcttcactttggagtttactaattggaagacacttgcaccagctgttgaaaggatgctctctgctcgtgcct

SEQ ID NO: 25551 - DNA, 201 bp, Homo sapiens
agttaattctatgtgagttaataacttgtttcctagttgagtagcagcatacacccaattgatactcttctttaggtgacaaaataaagaaaaaagttacstacaaataatcaggtaatgccacttcttaaaaaaatacaatctatgcaggtaacaaaatggcacttgtagcccataaatttgtacaaataaaaaattata

SEQ ID NO: 25552 - DNA, 201 bp, Homo sapiens
gaaagttcagttaggagcaatcattcgcctagagatgaatttgctcagtaacgtttcagaattgaacaaattcactaatagagaacatgtataggccgggygtggtggctcatgtgtgtaatcccagcactttgggaggccgaggcaggctagtcactggaggtcaggagtttaagaccagcctaactaacatggtgaaac

SEQ ID NO: 25553 - DNA, 201 bp, Homo sapiens
tacttgaataacaaggaaattcacaattaaggctgaaatactgttcatattattgtgtatttctaagcatgttattttaagcttgtgtattttaaaccatkgttacagaattgtataggaatatattgaaggcataaccttatatttattggaattttggtttaattgtttagaatttcaaaatagtattgggatgtgaaa

SEQ ID NO: 25554 - DNA, 201 bp, Homo sapiens
tgaggcaggagattcgcttcaacctgggaggtggaggttgtagtgagccaagatcgcaccactgcactccagcctgggcaacagagcaagactccatctcaaaaaaaaaaaaaaaaaaacttgtataaagtaaaggaataaaaaaataaatagagattgaagacagaatcctggtgagtcatcacatttctgaaatagtag

SEQ ID NO: 25555 - DNA, 201 bp, Homo sapiens
aggttagcttttaaaaatctttatacaatggcgtatatataatttaattagatttgtgattttattttattttttataatttcaacttttatttcagattyagagggtatgcatgcaggtttgttacataggtgtattgcatgatgctgaggtttgggatatgaatgacctcatcacttagacagtgggcatagtactcaa

SEQ ID NO: 25556 - DNA, 201 bp, Homo sapiens
aactgtgtccttatttatatagtggtgagtaaaaaatacataaataaactgcaagccatagatgttgcattctagatgtgttcatgtatccattttaaatyagaatgtttaaagtatgtatggttgttgtggtcacctgctttaaggtgagtttctattaactgaccaattattgttcatgatcctactaagagggcttcc

SEQ ID NO: 25557 - DNA, 201 bp, Homo sapiens; identical to SEQ ID NO: 4948

SEQ ID NO: 25558 - DNA, 201 bp, Homo sapiens; identical to SEQ ID NO: 4952

SEQ ID NO: 25559 - DNA, 201 bp, Homo sapiens
ctgataacttttagttgcctttctctatcccaaatcttaagtccgttacagaactgaacatttcttattagaccagaatataatgattttggattgcgcgygcgcgcgcgcctgtgtgtgtgtgtgtgtgtgtgttcaatatgatgatggtcttttttggccttcatcttatcttttggatgaacaatgtttttggtcctt

SEQ ID NO: 25560 - DNA, 201 bp, Homo sapiens
aacaaacaaacaaacaaaaccaaccaacccaattctaatctgcaaaggcaagaacagccctaaactcaaagatgtgctcagctgggaaaaaaaatggtttsagttttgagataaatgggcatgttagcacaattaggattttaatcaggagactgagaggggcatgtctgtggcaccatctttaaagaaagaaaggggccg

SEQ ID NO: 25561 - DNA, 201 bp, Homo sapiens
ggtgggaaagatcttaaataggtttctggattttccaagattagttgaaattttagggggcagacccttttttctcctttgatttctacaaaatcagtcartaacactaattgaccattttgttatgtagagagcactaaatagatcctgttaaacttactgaggaagctgaaacatacacacgatcctttaggaatttaa

SEQ ID NO: 25562 - DNA, 201 bp, Homo sapiens
gttatgtagagagcactaaatagatcctgttaaacttactgaggaagctgaaacatacacacgatcctttaggaatttaaaacctaatgggaaaaacagtrtttagtggcatttacttcactatcttctgctgtctttggcaaagaagcgtttttaatgtatttttttttttttgtatttttttatagagactcatggaag

SEQ ID NO: 25563 - DNA, 201 bp, Homo sapiens
tttttctgtgtaaacttcagtgatgctaagaagttcttaacatgcagtggagtaattccactacagcctctctctttctctctaatgactacaaaaaactrtggtcaaaattcaaaaagaaactacctgaggactctcaaaggaacaaaagcagatagattatgaaagagagtggtaacttggtgaagtgacccacatgaa

SEQ ID NO: 25564 - DNA, 201 bp, Homo sapiens
tgcgccaccatgcctggaattttttttttttgtattttttgtagagacagggtttgccgtgttgcctaggctggtcttgaactccgagctcaggtgatctscctgccttggcctctcaaagtgctgggattacaggcgtgagccacagcacccagccaacccaaaatgttgaaagtaagatttgaactatcatcagagtct

SEQ ID NO: 25565 - DNA, 201 bp, Homo sapiens
aaattggtacagtgaactcccatagacccatcattcatattcagtaatgatcaaggaaatgccatcattttattttgtacaaatatccctgagaaacatgstctttccacctccagccttcatctaaacatcttatactaactttctttagatttcagtgttccaggctctctccttccctcctctttctggtatgtttat

SEQ ID NO: 25566 - DNA, 201 bp, Homo sapiens
gcagtttgttcagcgactgcaactctgtgttaggggaaacctggggtgaggtagcccgccatctccccgtaggtgaataccgcaagcctccgaatttggcrtggtgggcgactctcgtggaatgggcagctagacatcacaaccctacatttttaccctccatctctagattgaagtgttggggtgttgttttatcaagga

SEQ ID NO: 25567 - DNA, 201 bp, Homo sapiens
aactggagatgccttcatgtaacagacatatgaagaggttgagagagtaggctggagattggaagctatccaagtaaaattgaagcctaggatttgatgastttgtgtatttgataaagaatagtgtaagagttgtaactggaaacacaatgaaatgtttttgtctttggctttagtgacatgggatgcttgatcactagt

SEQ ID NO: 25568 - DNA, 201 bp, Homo sapiens
taagattaatacaaagtgaatgacagactacatcattagtgatcatgatttgtataatgtaatttatgctttagtgagttattttccatatagtaaaatgyctttatttaaaaaagaagaggtacagtacattataattccaaggaaattttcgtattttaaaaatgccaatttttggctaaaaactcaaaagatttcatt

SEQ ID NO: 25569 - DNA, 201 bp, Homo sapiens
tataatgtaatttatgctttagtgagttattttccatatagtaaaatgcctttatttaaaaaagaagaggtacagtacattataattccaaggaaattttygtattttaaaaatgccaatttttggctaaaaactcaaaagatttcatttaatacttgaataacaaggaaattcacaattaaggctgaaatactgttcata

SEQ ID NO: 25570 - DNA, 201 bp, Homo sapiens
agtgttttctaatgtgactcattatccaaatgtgcctttctaattttgtgactgagaagtgttgattcccacttcctgcctcctactatagtgggagatayagaataactgtatgattgaaatgaaaaaaaaatcttattcttcaaatcttttttcttactaatcaaaaccacgatgagataccatctcacagcagtaaga

SEQ ID NO: 25571 - DNA, 201 bp, Homo sapiens
tggattagttgttttgtagccagtacaaagctgatttgcataagcagtgagctgctgctaattctctatacatatattgagattaatgtctttgtaggacygactgaaaagtgaatcaatgaacttacatttcatattataattatgagaaccatcaagaaagtaacattaaaataatgctggatatagtaatgagtttgg

SEQ ID NO: 25572 - DNA, 201 bp, Homo sapiens
tcccagctactcatgaggttgaggtgggagcatcgcttgagcccaggaagttgaggctgcagtgagccgtgaatgtgccactgtcctccatcgtgggtaamagagccagaccctatcttaagaacaaaacaaaacaaacaaaaaaatgaaacagtatattttctagctaatagagataaaactcactgtaattttcatttg

SEQ ID NO: 25573 - DNA, 201 bp, Homo sapiens
tttctctatcctgtgccaataccatgctaccttaattattccagctttattagttttgatagctgcttgtatgagtcctctggctttattctacatgattkttttggctttatttggccctttacattcccatctgtatgaatcagtttttgtttttttttttccaactattaagacaatacctgtagcacctttgggtat

SEQ ID NO: 25574 - DNA, 201 bp, Homo sapiens
tttatttggccctttacattcccatctgtatgaatcagtttttgtttttttttttccaactattaagacaatacctgtagcacctttgggtattttgattrggctcacattgaatcgttagattgttttggggagaattgatatttttaaaatagtgaatctttatatctatgaacatggtgtattctacttttttttttt

SEQ ID NO: 25575 - DNA, 201 bp, Homo sapiens
aggagtagcttggtgggcagttcaggcttggaggtttctcttatagttgcattaaatatcagatgaagctacagtcattagcaagcttgacaggagccagrggatcaacttccacagaggctcactgacatggatcactcatatggctgggtgttggcaggaaacctcggtttctctctataaaagcctccccacaggacg

SEQ ID NO: 25576 - DNA, 201 bp, Homo sapiens
tttctttagatttcagtgttccaggctctctccttccctcctctttctggtatgtttatggggtagaggcaagaccaatgcaaagaaagaaggccctttawgctgggcatctaggctttttcagacatcctctgaaacctaggcagagtctcccaaacctcaactcttaaattctgtgcacccacagggttaacaccatga

SEQ ID NO: 25577 - DNA, 201 bp, Homo sapiens
tacacataattagcataaacaaatgatttattaagctttaaagatagacctccagtgatgtagtcacataatctagaaaagctggtcagcactacattaasttttagggtatctggaggaatcttcccagtcagcccatagaattttaagccagtgtagtctgtccactctgagaagctggagcatcattaaggatccctt

SEQ ID NO: 25578 - DNA, 201 bp, Homo sapiens
gatttttagaccagaacaattatttattcacagcaaaagaagagctgggcagggtaaacagcaacaggttacttatagtatttatttcctctttctggaayggacaacccagtgttcctaaagacaatatggaaggttgttttgttagctcaacacttgagcaaaagaggttggatatgtttaccagattgtgagaatgga

SEQ ID NO: 25579 - DNA, 201 bp, Homo sapiens
attcatataaccagaacttcatttaacttcactagtactgaaaaccaaagtgagttccttaataaccagcgaaaattttggaaactcattctgcaatcctrtgtgtcagaaaataaaacttttgaaagatgtaaagaaatcctagaagtaacatgcacgtttaatcgcaagctcatgaaagtcggctagaatgcagaaatg

SEQ ID NO: 25580 - DNA, 201 bp, Homo sapiens
aaggagcaaacaaggaatgccaggatgactttggaatcacacctttatttgtggctgctcagtatggcaagctagaaagcttgagcatacttatttcatcrggtaagattatccattagcctttgtactgttaagatcatgagctttaaactatatttcctagaggaataattcttgtctcaaatataaatcaggttgtga

SEQ ID NO: 25581 - DNA, 201 bp, Homo sapiens
acttatagtatttatttcctctttctggaacggacaacccagtgttcctaaagacaatatggaaggttgttttgttagctcaacacttgagcaaaagaggktggatatgtttaccagattgtgagaatggatgaattgcttttcttcacactagaagtatatttctcttagtaactagtattgggcataagaatcagggct

SEQ ID NO: 25582 - DNA, 201 bp, Homo sapiens
tagtaagtttaatggtataagtttaaaaattttatttttatagcaacaatgtgttatgatagtgttaatttggtatgattgttgtaattaacacctatccracttcaggtgttaatggctaaaagacttcccttttctcatttgtatattttctagtatttctctgaaatctattaatttactatttgtggactttcttgc

SEQ ID NO: 25583 - DNA, 201 bp, Homo sapiens
acttcttttttaaaatttacagttgtagatttagctacaattttcctttggtttgtggtaatatttttcagatgagaggtttttgctttcttttgttgttrgtctattgtttttctataacttttcttcctttattcttgtatctttgtatggatttgtgctggtacctttgtgataattcatcttgggaatatgtgagtt

SEQ ID NO: 25584 - DNA, 201 bp, Homo sapiens
ttagaattctgagtcttaggtgatcagaaagacacctttttttagctctttttttttgagacggaatttcactcttgttgctcaggctggagtgcagtggygcaatctcagctcaccgcaacgtctgcctcccaagcgattctcctgcctcagcctccagagtagctgggactctactggcgtgcgccaccacgcccagct

SEQ ID NO: 25585 - DNA, 201 bp, Homo sapiens
gttaggatttagagttcttttaaaggtttgactaaattttaaagcttctaaaaatataatactgaagttttcaaatcgtttctggtaataccaatttttcrtataatactttatagttttaaaagtatgtttactatgttatctcatattattttcacatatagttccctgaaatgggcagcttatgtattattctcattt

SEQ ID NO: 25586 - DNA, 201 bp, Homo sapiens
aagaatcacggactgttgtgttgactaggcaatttctaatcatcagtctattctgacagcatacatatctcaatgtgttttgtaacacactgtacattttsgtcaagactagtaaagtatgttgttatagccacatacataaatatttaatacttggtcattataattggagcctgggctaaaggttttcttttcggaatg

SEQ ID NO: 25587 - DNA, 201 bp, Homo sapiens
ttactaggttcctgtctaaaataagtattatgaaaaagctagtgttaaatatcatctagcttcttagggaactgaacaagattagaaggaaaggtttcttktagctgcttagatgacagctcccttgaacatgaaaaaattaaaggtgaccaatatataaaaggcacaaaaccgtggctctgaggagggtgttgggggcag

SEQ ID NO: 25588 - DNA, 201 bp, Homo sapiens
gcttccattgacaatacatttttaatgaaatgctctttctcataatcagtgagaaccatgagaatcattatggctgatcctaaaactgttcgtctaaatcraattctggtaatctcctttattcatgaattaggaattatttactatcaggaatagtaaaagcaataataatgaacttggtttgaaatgattaggtagagt

SEQ ID NO: 25589 - DNA, 201 bp, Homo sapiens
cttctgactaacgcagggcagtttgttcagcgactgcaactctgtgttaggggaaacctggggtgaggtagcccgccatctccccgtaggtgaataccgcragcctccgaatttggcgtggtgggcgactctcgtggaatgggcagctagacatcacaaccctacatttttaccctccatctctagattgaagtgttgggg

SEQ ID NO: 25590 - DNA, 201 bp, Homo sapiens
tctaaaaaaaaaaaaattattgagctcttttgtaagtgagcagggtactagctgttgggtctaactttagggtccttgagtgaagtgcaagaaacgagttrcctctttcctcctctccttccaccctgtacccaaataaggaatgctttgttatggaacatgaagatgctcaaaggcttccagggtagactgttaaattaa

SEQ ID NO: 25591 - DNA, 201 bp, Homo sapiens
gtagagacatggtctcactatattgcccaggctggtctcaaactactgacttcaagtgatccccttgctttggcctcccaaattgctgagattacaggcaygagcaccatacccacccctctgcttgtattttatatcacatcttttatattaaataacatagatttgtttgcttgtgtgtttctccaccaaatatgattc

SEQ ID NO: 25592 - DNA, 201 bp, Homo sapiens
agtagtagaattacagtgttatagccctagaagaaggtgtaagtttagggatgtgttatctaaatcaaatgtttcttgactctgctgctggggagacatayggaaaaataaacaatatataataggatagtggaattttagctttttgtcttttaatactttcatttgattgaaggatgtatttttctggatatggtctct

SEQ ID NO: 25593 - DNA, 201 bp, Homo sapiens
tattttaggtaagtaattctgagtgcacagtagagcgtgtattggaaagaggaaaagagattggaaacaagaagaatatgtaagaaactctggctcttgakgtatgataaggctctttagttgagaatctttcagcatgtaaccttttactatcatgtaatcttttaagccttatcacaaaaagccttcagggcttccttg

SEQ ID NO: 25594 - DNA, 201 bp, Homo sapiens
acctttcagtccttttgagattgcttttccagactggtactgttgattctgaattgtccaccttatatcctcccagtttcattttaacaaactagagctakgctgtttccattttcagagagaataaatgtttgcttcttggttccagttcctctgtgtcttttaacatgctattgaaaatcattttgcatgtgttcagaa

SEQ ID NO: 25595 - DNA, 201 bp, Homo sapiens
tagagtgaattcaaggttttattttagttttttgagacagggtcttgctctgttgcccagcctggagtgcagtggtgtgatcatggctcactgcagcctcraactcctgggttcaggcaatagttctgcctcagcttcctgagtagctgggcctacaggtgcatgccactacacctggctaatttttaaattttttataga

SEQ ID NO: 25596 - DNA, 201 bp, Homo sapiens
atacagttttatttttaattttagaagggtagaatagtccttttttctttccagttgactgctagaggtaagtttacaaataacctaagaacttttgtttyaattattttcttagaactttctctacctaggagccagcttctttataaatctgcctccatatttaatgagctcacttttttttcagataatagaatattt

SEQ ID NO: 25597 - DNA, 201 bp, Homo sapiens
aggaggtgcctgttcttggcttctgccagaggttacactttccagcctgtgggatggccagacgcaggctgcaaagaaaaaaaaaattttatatgtatatwtatgtatatacacacacacacacacaaattgagatagtgacagacaaagaattccaaaagctgttttaaaaactaaattttcattatatgtgccattaat

SEQ ID NO: 25598 - DNA, 201 bp, Homo sapiens
acttcctattattggataaagatataaatttacagatttaagaggcctgttaaacccaaacaggataaactcacagaaaggcatggtcagaaaaatcaaamtgctataaaacaaatgtaagggagacctagtctctccccggatcaaagaagaaaaagaaaagtaaaggtgaagcagtatggtgtacagtagtccttggtc

SEQ ID NO: 25599 - DNA, 201 bp, Homo sapiens
ctatgggtattagagtttaaagaaccctatacctggaatcagactagctggtctggtatcagctgtgctcttgatagtacttgtctttgatgctctgatcytggtctgttcatcattgttaaatttcacagggatttataaaagatttcttgaattaacaaaaggctttggtccgattcacataaaagcagacattaactt

SEQ ID NO: 25600 - DNA, 201 bp, Homo sapiens
ggactgagggtttccccctttttatactatagggtaacttcctgaagtttccatggcattggtaaactgtcatggggctggtgggagtgtcttctagcatrctaatgcgttataattagcatataatgaacaatgaggatgaccagaggtcactttcatcaccatcttcgttttgatggggtttggccagcttctttacca

SEQ ID NO: 25601 - DNA, 201 bp, Homo sapiens
ttattaagcatatagctaaaaaatacttttatttggctaataaatgatctagctcatagtattttttattagttcatgttaaataagaaaatacgcactartactgggcacagtaacagatgcagaagttccttagacaaataaatcattgtagcacagcgattaagagttacggtcagatggacctgaattctagtgact

SEQ ID NO: 25602 - DNA, 201 bp, Homo sapiens
taaaagccaagttcttaactgaccaactctagttgagatagaatggtttctaattcaggttcttttcgtgattttaatcccatgtctctcttatgagcagktgcaaactactttagcgccttgatcttttccactttccattgaccaatttccaaattattagttacctcaatcttagttttctttatggattagttgttt

SEQ ID NO: 25603 - DNA, 201 bp, Homo sapiens
taactggctgacaggtgcccggtattttcctccaattctaaggaaggataggacagaatagcaagtgaaagtggtccaatattactcaccgcttttgaggyccctttgtggtcaccaaaatgttactggggggtccttgttcttagagctcctaagatggtggtaggctgcttccaagatggtggcaagcctcttgttctc

SEQ ID NO: 25604 - DNA, 201 bp, Homo sapiens
ggggttccctgccttttttttcttttaggtccttgaaggattacatgatgcctgcccacattggtgagggcaagtcttgtttattcagtctgctgattcaratggtaatgtcttcctgaaacatcttcatggatatacccagaaatgttttagcagctatctgggcatcccttaacccagtcaagttgacatgtaaaatta

SEQ ID NO: 25605 - DNA, 201 bp, Homo sapiens
taatcacacaggagattttatttccttttcccaagatgagtgtgtatgcaagtcactaagggtggcttgcactccagaagtgggaattaaactctacttcyttgatggagtagtctttacataaattatttggaattcttctacatgggagatttatctcttctctcccgttaatttatatatttagtcatttatatctgc

SEQ ID NO: 25606 - DNA, 201 bp, Homo sapiens
gctttctttttctttctaggaacccacagtacttttctagcttctagaattacaccttatctttctgtctttgacacttactccaagacctgcagctgatygcctggctctctgtttccaatgctaaatgggtatcttgaagacaggtatacctagtattctaggttaaatttcaattcaattcaattctaatctctagac

SEQ ID NO: 25607 - DNA, 201 bp, Homo sapiens
cttcatacatccttaactgaacagtagtcctgttttatttttgaaatatttatctcctttgccctaacatgtggtcctagatgggtctcacataaaaaggygaaggagcaaagaaacaccagcttagccaactagttttgcttatcaataggatggtaaaagtcacaactgaatttttctcattatcctccattgattagg

SEQ ID NO: 25608 - DNA, 201 bp, Homo sapiens
tagtacctggaatattacctggtacataataggcactaagtagacatttgttgaatgaatgaatgagtgatttgtgggaaaatgggatcactgaatgtagrctcaagaagagtagtctttgggggtagttcagtggtaaaaaaagaaagtgagagaaaacagtagattggaagatattttgtttgtttgttttatttttag

SEQ ID NO: 25609 - DNA, 201 bp, Homo sapiens
cctgaggtcaggagcttgagaccagcccagccaacatggtgaaaccctgtctctactgaaaatacaaaaattagcccggtgtggtggcacgcacctgtccsagctactggggaggctgaggcaggagaatctcttgaacccatgaggcagaggttgtagtgagctaagatcgcaccaccgcactccagtctgggcaacaag

SEQ ID NO: 25610 - DNA, 201 bp, Homo sapiens
tttcttttggcagaggttgcagagagatggagtccccatctccgcactcagcctggtgcgagctcgtgcgcctgtgcccgcgcttctcgccgtctctagaractaaccaccggcatcttaagcagcttcggaaggagtgcccgggctgggttagagatggcgggcaggtggcagggaaaatctacagaaatgttaccccaa

SEQ ID NO: 25611 - DNA, 201 bp, Homo sapiens
aagagagattgtttgacttcttcttttcctatttggatgccttttatttctttctcttgcctgattgttctggcaaggactttcagtactatgttgaatargagtggtaagagtgggtatccttgtcttcttccatttctctaggagaatgcttccagcttttgcctgttcagtatgatgttggctgtgggttggtcatag

SEQ ID NO: 25612 - DNA, 201 bp, Homo sapiens
aagttatccaagagcaagtttgtttgtttgtttgtttgattttgagacagagtctcactctatcgccaggctggagtgcagtggcaccatctaggctcacygcaacctccgcctcccaggttcaagcaattctcctgcctcagtctcctgagtagctgggactataggcacacaccactatgtctggctaatttttttttt

SEQ ID NO: 25613 - DNA, 201 bp, Homo sapiens
agtcttctattttgattgttctgccagtacatataacaaaatgaacaaaatagaggaattctgtataggaattaaaagttaaatattactcatctgctaayagatctatggataaactaagtttaacatattgaataaaaatgattgggtcagaaaagtgacttagaagtgtagcatggtttcagacgtcattttctaggt

SEQ ID NO: 25614 - DNA, 201 bp, Homo sapiens
tcaggtacttgctttttgtgttttttctagcggttttagttatagtcaatgagagagacaacacaagtaaattaagaaaaactgggaacaaaaggatggawaccaacgagaaagacaatatattaatgatgaaaataaaaatggtagtaggtgtctcagaagtcagataaatgcatttgatgtgcaaaacatttcaaagga

SEQ ID NO: 25615 - DNA, 201 bp, Homo sapiens
ctggtcattcctttatactggccattcctattgttttgacttcatgtcctaatctattacttgtttttcagagttctcaggtacttgctttttgtgttttytctagcggttttagttatagtcaatgagagagacaacacaagtaaattaagaaaaactgggaacaaaaggatggataccaacgagaaagacaatatatta

SEQ ID NO: 25616 - DNA, 201 bp, Homo sapiens
agatggtgcttttccatttaatccattcattgcctctactggtcattcctttatactggccattcctattgttttgacttcatgtcctaatctattacttrtttttcagagttctcaggtacttgctttttgtgttttttctagcggttttagttatagtcaatgagagagacaacacaagtaaattaagaaaaactggga

SEQ ID NO: 25617 - DNA, 201 bp, Homo sapiens
atgcataatggagaacagagtacatgtagaactcaaaaaagtagagataccattaaaaattcatatataattcaaatgtaaaattgaatatatagatgatytctgcatagccagccagcctgctgctataactggaggagatggacagcctgtggttaaacttttcgttacagacttactgaccatgtcattttttagaat

SEQ ID NO: 25618 - DNA, 201 bp, Homo sapiens
tgatgcagggaagtgtcattatgcccattttgtagatgaggcattattctcattttatggaaaggtaactgaaagtcagaatatttagatgacttgcccarggtcacacagctagttaatagtggcacctcagcgccagcacaggtgttactactagatggtgcttttccatttaatccattcattgcctctactggtcat

SEQ ID NO: 25619 - DNA, 201 bp, Homo sapiens
gtttcactttatgaaatgcttttgcaaatgtgttccaacttgaacatcatcaacagccttttgatgcagggaagtgtcattatgcccattttgtagatgargcattattctcattttatggaaaggtaactgaaagtcagaatatttagatgacttgcccagggtcacacagctagttaatagtggcacctcagcgccagc

SEQ ID NO: 25620 - DNA, 201 bp, Homo sapiens
tttaggcacacacatgcacacacacacacacaccagcaaggtaactatatgagatgatgggtatattaatgtttgtttgactgtagtaatcacttcattatggtaggtatatcaacataagcatacaaaacatcacattgtacactttaaatatatacaataaaataataaaaattttaaaaagctaaaaagagctaaaat

SEQ ID NO: 25621 - DNA, 201 bp, Homo sapiens
ttaaatggtgctgggaaaactggatatccatatgcagaagaataaaactagacccctatctctggccatatacaaaaatcaaataaaaatgcattaaagastttaagacctctaactactaaaagaaaacattggggaaactctctagtacattgaactgggcaaaggtttcttgagaaataccccacaagcacaggcaac

SEQ ID NO: 25622 - DNA, 201 bp, Homo sapiens
agactccaccaaaaacctattagaactgatgaacagattcaataagttttcaggatacaaaatcaacatacaaaaattggcgcatttatttatgccagcartgaacaggctgggcgcagtggctcacacctgtaatcccagcactttgggaggccgaggtgggtggatcacctgaggtcaggagttcgagaccagcctggc

SEQ ID NO: 25623 - DNA, 201 bp, Homo sapiens
aaagtcccttcatgtttttagtgggaaccttccaaggaattccaatctgccaaacagagaaacttcctgctttaggcaccagcagagactgtggcatggcmgtcactttctgtattgtgggcccttcttcgtcagtcatgtgagagatactagacaggcccaccgtgatttgctgacctctaggagtgaagtgttgtttta

SEQ ID NO: 25624 - DNA, 201 bp, Homo sapiens
cattgacaatacatttttaatgaaatgctctttctcataatcagtgagaaccatgagaatcattatggctgatcctaaaactgttcgtctaaatcgaattmtggtaatctcctttattcatgaattaggaattatttactatcaggaatagtaaaagcaataataatgaacttggtttgaaatgattaggtagagtggcat

SEQ ID NO: 25625 - DNA, 201 bp, Homo sapiens
aaacagatgaaagataagtgttggcaaggcatgtggagaaaggggaacctctgtacactgttaatggcaatgtaaattagtacaaccgttatggaaaacartggcagttcctcaaaaaactaaaaatagaattaccatatgatccagcaatccaacttctgggtatttacctaaaagattggaaatcagtatgttgaagag

SEQ ID NO: 25626 - DNA, 201 bp, Homo sapiens
aaactctgggccatcattaattcctttctttttctcatatttctcatctagtcagtcagcaaatttgtgtatgtgtatgtctatatttgtgtgtatgtatmcacacacacacacacacacacagttagatcacttctcactaccattaataccttgtctgcgttgctataatagcatcttaacagatcttctctatctgcc

SEQ ID NO: 25627 - DNA, 201 bp, Homo sapiens
aggagagtaagactgagacagctgcgccagtgtccaggagacagttaacctcctggccctcaatgatcaagcatacccggggctctgtgagggtgatggcrtgggctggtgcttgccccggacaccctcagtcctgctgctgtatcatctggttagtggcttctgactcagaggaccttcgtcccctggggcagtgggcct

SEQ ID NO: 25628 - DNA, 201 bp, Homo sapiens
aacctgaatttgtatacaaaatttggggtgtacacttttctagggggaaactacagctttcatgagtttctccaaggggtcaaggatcctaaaattttttkaagatctgctcattagagctcttgctgcaaaatattgtttaggaaattcgcttggactatcatggctgtgtctctgtgtgtgaaaacagaaaccttacca

SEQ ID NO: 25629 - DNA, 201 bp, Homo sapiens
ggccctggcaagggtggtggggaatgggtcccacataactgcccatgttgagagctgtatatctaaactgggacaccagggacaagattccctgggttcayagcctaggtacctaaggacacagcatagaacttccttagatccctttggagatacaacttgctctaatacttgggagaggaaatgaagtctgaaccatta

SEQ ID NO: 25630 - DNA, 201 bp, Homo sapiens
atacctaatttgctaatggtgtgtgtgtgtgtttgtacttattttataaagcactttgtaattctattctggcattctgtttttcattaacttcgtgcttraattcctccataattagtgccaccttcatagcaaagttttgtgcaaaataatctgcatctctttaacaacattttttattttttctggaatccgctttta

SEQ ID NO: 25631 - DNA, 201 bp, Homo sapiens; identical to SEQ ID NO: 4955

SEQ ID NO: 25632 - DNA, 201 bp, Homo sapiens
accaaagtgtccagtcctacaaacatgcctttttgctgacattaatttttctaactgctgtattacagctgttgaaaatggacagatagatgtgttaaggstgttgcttcaacacggagcaaatgttaatggatcccattctatgtgtggatggaactccttgcaccaggcttcttttcaggtaacctctgaatttattat

SEQ ID NO: 25633 - DNA, 201 bp, Homo sapiens
tatccattagcctttgtactgttaagatcatgagctttaaactatatttcctagaggaataattcttgtctcaaatataaatcaggttgtgaaatttatgrttttatgtaagtggtaaataagagtaaatacaaattgatttataaacctggttattaagtatctattactaacaatgcagtgcacagctactaatttatc

SEQ ID NO: 25634 - DNA, 201 bp, Homo sapiens
ggctgctcagtatggcaagctagaaagcttgagcatacttatttcatcgggtaagattatccattagcctttgtactgttaagatcatgagctttaaactrtatttcctagaggaataattcttgtctcaaatataaatcaggttgtgaaatttatggttttatgtaagtggtaaataagagtaaatacaaattgatttat

SEQ ID NO: 25635 - DNA, 201 bp, Homo sapiens
ttttgctctccagtggggcagatcctgatctttactgtaatgaggacagttggcagttacctattcatgcagctgcacaaatgggccatacaaagtaagtrttaaaaacagaaaataaacatggtctcttaatcaaaagctaataaagaataaatctgggctagacccttcacctctaggcaaagtctttgatattctctt

SEQ ID NO: 25636 - DNA, 201 bp, Homo sapiens
gttgcctttctctatcccaaatcttaagtccgttacagaactgaacatttcttattagaccagaatataatgattttggattgcgcgcgcgcgcgcgcctgtgtgtgtgtgtgtgtgtgtgttcaatatgatgatggtcttttttggccttcatcttatcttttggatgaacaatgtttttggtccttctggtcacagcag

SEQ ID NO: 25637 - DNA, 201 bp, Homo sapiens
tgtgcatggctttccaaaaggagtatgtatatttgctatgtttttattttttattcttttttgctgtatggagatgtgttttgaagtgactttctttcacratgaaacttagtatctctgttagtgctaaattgctatcttggaacacaaataggaaaaaaactatgatgtttcagtcaagctgaagcagaaatgaggtga

SEQ ID NO: 25638 - DNA, 201 bp, Homo sapiens
gctgtacatttggctctgagctctgttgtcaatgacactaggtgactgggttcataagataaaataaacccattcctcagaatagattttcttggatgctrttacagcttcctagacaatgtcttggtagctgtggtttcttgggactttcttttacatggactgttgttatcataccaaagtacaattcagtaaaagcag

SEQ ID NO: 25639 - DNA, 201 bp, Homo sapiens
aatatattgtatcatttcatttatcctcagtatttctgataagttgtgatttcactgagatatgctgagaaataaaatgttttcccaagacatctgtgctrccctttaagttcttccttagatgtttgcttattggagaattaagaatttgggaaataattttcataatctttagtccatcatttcaaagatattttgact

SEQ ID NO: 25640 - DNA, 201 bp, Homo sapiens
aacaacgcatttcttgcttctcatcttttaatcattgagtcagatttgtcttcaaaaagtttctagcatcagaaaggaaatgtataccaggtaaaatttastgagtggttgcagtttcagtaacaatcttttaatcaagtgcctcttacatacctcttagaaacatcagcctaaccacatagcaatagatgtcttactcaa

SEQ ID NO: 25641 - DNA, 201 bp, Homo sapiens
tccaaattaccagaagtgtctttgagatggtgagcttagattgttattcagtttatcttctttccttgtatttcctttccttcttcagttgttgttgctcsgtaatacctccaaagaggtgaccttgagaagaatttctgttttggtagtaattactagaagccctagtgacttttttttctccaaccattgtgatggtag

SEQ ID NO: 25642 - DNA, 201 bp, Homo sapiens
gacagctacatagaaagtcaattcagttaataggaacctgtagatgattgttaatatcctctgatcttgcctctagttacataaatacttaacatgccctrgttttctgtctgccctcctcattgagattttgtaagaataggtatgtggtgtttgtttcaagtacgaacccttggcatgttttgtttctaatattatatt

SEQ ID NO: 25643 - DNA, 201 bp, Homo sapiens
catattttctgggtattgcttgtcttaaacagtcttgaaaatgtatctggctgaataattgcctgtcacaatatttaaatgcaagactaagtattcctctscctgcgcaccccacccccatttaatgggataatagaacataaatgtcatttgtgcatttagttgattaaatgtcactcgtttatgattgtacaactggtc

SEQ ID NO: 25644 - DNA, 201 bp, Homo sapiens
gactacttggaggcagaaggatttatttagctttattctcttagaaggctttgtaatttatcccccctttcccaattctgatactgctcccccattttccyccacttgtgaacagttgagaatttttgtcgcaataagccattgggtgtgtgctgtatttatcggatatgtgaaatagaaaagaattaagaactagtaaag

SEQ ID NO: 25645 - DNA, 201 bp, Homo sapiens
cagagcagcagcacaggctgctgagctgcttatacttattgttacttcttgattacatgctaaacaaggggtgaattattcatgaatgaattttccaggaraggggtgggcaagtcccaggactgagggtttccccctttttatactatagggtaacttcctgaagtttccatggcattggtaaactgtcatggggctggt

SEQ ID NO: 25646 - DNA, 201 bp, Homo sapiens
ctcatccccctcagataccaaaatctatgtgttactggaaaggggtcccaatctagacccaagagagggttcttggatctcgtgcaagaaagaattcgggrcaagtccatagagtaaagtgaaatcatgtttattaacaaagtaagggaacaaaagaatggctatttcataggcagagcagcagcacaggctgctgagctg

SEQ ID NO: 25647 - DNA, 201 bp, Homo sapiens
cttacgcggacacgtgctctacagttggacttgctgccagggaaggcaatgttaaagtcttaaggaaactgctcaaaaagggccgaagtgtcgatgttgcwgataacaggggatggatgccaattcatgaagcagcttatcacaactctgtagaatgtttgcaaatgttaattaatgcaggtaaagtaaattcaaggtatg

SEQ ID NO: 25648 - DNA, 201 bp, Homo sapiens
ccccaggtacagagctggggtgatcatgggctcatctcttgtgtttcacttctctcgggaatcacagttgtctgcctgttgattaatacccgagtaagttrccttatatattttgtccactcttatgattgttttggatggatggctagtttagtaccagttatactgtcatatcccaaagtataattctgaagcttattc

SEQ ID NO: 25649 - DNA, 201 bp, Homo sapiens
agttgcctttctctatcccaaatcttaagtccgttacagaactgaacatttcttattagaccagaatataatgattttggattgcgcgcgcgcgcgcgcctgtgtgtgtgtgtgtgtgtgtgttcaatatgatgatggtcttttttggccttcatcttatcttttggatgaacaatgtttttggtccttctggtcacagca

SEQ ID NO: 25650 - DNA, 201 bp, Homo sapiens
gtaatcccagcactttgggaggctgaggcaggcggatcacctgaggttgggaattcaagaccagcctgaccaacctggagaaaccctgtctctcctgaaartagaaaattagacaggcgtggtggctcatgcctgtaatctcagctactctggaggctgaagcaggagaatcacttgaacctgggaggcagacattgtggt

SEQ ID NO: 25651 - DNA, 201 bp, Homo sapiens
gtaaaaatatggaaggattatgcactcaccttgtttcatacatgcctttaaatccatgctgtaactcaaagaaagtgaaactgtgtccttatttatatagyggtgagtaaaaaatacataaataaactgcaagccatagatgttgcattctagatgtgttcatgtatccattttaaattagaatgtttaaagtatgtatgg

SEQ ID NO: 25652 - DNA, 201 bp, Homo sapiens
catgactcactgcagcctcgacttccctgggctcaggcaattatcctgcctcagcctcttgagtagctgggactacggttgtgcgccaccatgcctggaattttttttttttgtattttttgtagagacagggtttgccgtgttgcctaggctggtcttgaactccgagctcaggtgatctccctgccttggcctctcaaa

SEQ ID NO: 25653 - DNA, 201 bp, Homo sapiens; identical to SEQ ID NO: 4973

SEQ ID NO: 25654 - DNA, 201 bp, Homo sapiens
accatttgtggaaaagacttttctttccacttagcgttgctctggtaccttgatcaaaaatcagtcgacgacatgagagtggctctatttctggctgataytgctttctgtgtattctgggcatgaccaagagaatgtctgttggcaaagctccatctcctgatgccattcacccactcttggtaaagcgacttgatgttt

SEQ ID NO: 25655 - DNA, 201 bp, Homo sapiens
gagctcccctgttagcaggggcagttgaaaacacgtatgtgcaaaatgattccaaatctgagcagcaaagaaacagtggcataacctttttttttttttttggacaattgaaactggaatttaggtggtaaaaacagcactagtggagcagggcacaatgacacacgcctgtgatcccagcactttgggagaccaaggcag

SEQ ID NO: 25656 - DNA, 201 bp, Homo sapiens; identical to SEQ ID NO: 4975

SEQ ID NO: 25657 - DNA, 201 bp, Homo sapiens
acttggggaaatctccaccgtgagcaccgggaagtggatggtggggccagcataagcagtatcccgaggactgatcatggaggaccattaggaagggggtyttaaggatgaccttggccagaccgtgggaagcctccagagagtgttacccagatccagggtacagtgttgcatttccaaatgagatggcagttccttcgt

SEQ ID NO: 25658 - DNA, 201 bp, Homo sapiens
gagcaccgggaagtggatggtggggccagcataagcagtatcccgaggactgatcatggaggaccattaggaagggggtcttaaggatgaccttggccagwccgtgggaagcctccagagagtgttacccagatccagggtacagtgttgcatttccaaatgagatggcagttccttcgttccttgatattgtcggagaag

SEQ ID NO: 25659 - DNA, 201 bp, Homo sapiens
ttgcagtttttagatattctcctgtgtttttttctagaagctttaattgtggctttagcttttatgtttaattctatgaaccatctcaaattaatttttaygtataatgtgaattgaggttcaatttttacacacatatctgtaagagagatacatatatataaaatacatacctgtgatattatatagtcagtcgttcca

SEQ ID NO: 25660 - DNA, 201 bp, Homo sapiens; identical to SEQ ID NO: 4990

SEQ ID NO: 25661 - DNA, 201 bp, Homo sapiens
tggaatgaacgatacttgtggagtggaactcatttggagagtgacagatctgaggaagttcctcttctgtgtggacagaggccaccccaggcctttgcttkgctttttcttatccattagggtccgctgattctttcaccagcccctccggctgttctggcttggccttggccaaaagacagagcagtgagaccccaggaa

SEQ ID NO: 25662 - DNA, 201 bp, Homo sapiens
gtagtgtgtatgtccttgtaacactctgttttcagggactacaacctttttccttctgtgaccagccccggattcaggctgtactaataccaggtatattrtggaatttagtataaaggccaatctgtcctgaagtccatctaatgtggtgaatcactgaaagtctcagaaagacctggttagtgtatgttctcatttacc

SEQ ID NO: 25663 - DNA, 201 bp, Homo sapiens
tcacaagaaacacgtggagtccagtgagcaccagcaatgaactttcgcaactgcagaaattagtgattgtagctgagttgacacaacagtagctgaacttrttaattttactggaactttgaacccagtttgtgattatctcttgccgtgtcactgaatacattgagtacattggaattagattgacatattaaagttact

SEQ ID NO: 25664 - DNA, 201 bp, Homo sapiens
ttatggggtggtggggggcggtgagtagtttcatgaacttttaaaaagcacttccattaaaaaattcttcctagatcttctgtaaaccttttttaaagacrgctacaatgaccctggcttatttgctactatttctctgctttgttatattatcacccaagcccaccatggaccccatgctagagagggctaagacttctt

SEQ ID NO: 25665 - DNA, 201 bp, Homo sapiens
attcatttgtttattttgtggctttggtgtacagaagttttttgttttcatgttgtcagatgtatccatctttttctttgtggtttgtgggttttgtgggrgtgggtagtttttggattttgtcttatttaagaaatcttctgtaacccgaggtcatttatgcacacctgtattttcttcagaaagtttgaaagctgctct

SEQ ID NO: 25666 - DNA, 201 bp, Homo sapiens; identical to SEQ ID NO: 4981

SEQ ID NO: 25667 - DNA, 201 bp, Homo sapiens
cccgagggcatatctggaggccatagggaagccctggaaaagactgggcacaagctgaagccaaagttgggtgcctggctggcattggtagatttggggtyctggtttgcattgctcacgatgcagaatggttgctgacctttcctccagcgttggggatgatgtgagagtccagcaggcccccttcatgtgggccctaac

SEQ ID NO: 25668 - DNA, 201 bp, Homo sapiens
ccctgagtgtgccctttggaatcccacaagtcttatcccccattacccctccactcaacctgacatggccctatgggaatggaagcgcttgcctccatctrtcttaatctaattacctagtccttagaggaatgtactccataaaaattcagagatgtttaactggaattggccatttcttctgagctgagaactgtggct

SEQ ID NO: 25669 - DNA, 201 bp, Homo sapiens
ctgttctctcatgtctcctttcgcagcttcaaaagcagctctgttcttggttctgtgccccaccttgttctaatctcaactgtctttgttcactgtgggcrcaaagggctaggaaggggcagtgtcactgctgtcacttctttatggggcaagaagcagtctggatgctttcttttgtgcacagtttagcttctttgttca

SEQ ID NO: 25670 - DNA, 201 bp, Homo sapiens; identical to SEQ ID NO: 4984

SEQ ID NO: 25671 - DNA, 201 bp, Homo sapiens
atggttgctgacctttcctccagcgttggggatgatgtgagagtccagcaggcccccttcatgtgggccctaacttggggaaatctccaccgtgagcaccrggaagtggatggtggggccagcataagcagtatcccgaggactgatcatggaggaccattaggaagggggtcttaaggatgaccttggccagaccgtggg

SEQ ID NO: 25672 - DNA, 201 bp, Homo sapiens
agcagggcacaatgacacacgcctgtgatcccagcactttgggagaccaaggcagtggattgttcaggagttcaccatcctgggtgacatggtgagacatygtctctacaaaaaaatataaaaattagccgggcgtggtggcgtgagcctgtggtcccaactactctctggagcctgaggtgagaagatcacttaagcctg

SEQ ID NO: 25673 - DNA, 201 bp, Homo sapiens
ccttttttaaatctctaaggtgattttattttattttttatttttgagacagtctcgctctgtcacccaggctggagtgcagtggcgcaatcttggctcaytgcatcctctgcctcctgggttcaggtgatcctcatacctcagcctcctgagtagctggaactacaagtgtgtgccaccatgtctggctaattttttttt

SEQ ID NO: 25674 - DNA, 201 bp, Homo sapiens
cgaaatgtaaaggcaaagtgagtgaaatgaaaatgaccagattgttgccactacttttaagtaaagttaacaacaaacttacatgatgctgtgtaggttayacagcgttttcatgttcatcatggtcagaggcagcctggatgcaaagtggatgttatggggtggtggggggcggtgagtagtttcatgaacttttaaaaa

SEQ ID NO: 25675 - DNA, 201 bp, Homo sapiens
cgcgtgcgggcagccctggccggcaggggagggagggtcctgcgaccggaagccggaaaccggaaggggggctgtgaggacgtgttccgaggaagccagasccggagccgtggcctgccgggccggcgacatggatcccctgttccagcaaacgcacaagtgagggccggtcggggagcgggcaggggctagacgaggcga

SEQ ID NO: 25676 - DNA, 201 bp, Homo sapiens
ttgtcaactcggtgctcctggttggtagacctcgagaggagacacggagtaggagacacggcccctggccgtaggagtgtactgtttaattggagagtcarggcacgtacgggaaagtatttgtattcttattcgatttatactaaagaccacatttttatggtacaaagaaattgctgtccacgtagcattcactattat

SEQ ID NO: 25677 - DNA, 201 bp, Homo sapiens
ggttttactatgttgaccagattggtcttaaactcctggcctcaagtgatctgcctgcttcggcctcccaaagttctagggttacaggtgttagccactgkacctggcctctaaggtgattctgatgtgtgtattttggaaccactgtctcctagacagaaagcttctgtctcaaagatgatcacattggtgtaaagagca

SEQ ID NO: 25678 - DNA, 201 bp, Homo sapiens
ctttctgggcagaatgtagattttggattcctgtccatgatgcctaatgttgatctcactttccttgtttctctcagttgctcattaatgtgtatttattwaaaaaaaaaaaaaaggatatggggcatgaggttagatgccatgcatataagttgcagtgggtgatatgtgctgagtgacttggggtctgccccggcattc

SEQ ID NO: 25679 - DNA, 201 bp, Homo sapiens; identical to SEQ ID NO: 4983

SEQ ID NO: 25680 - DNA, 201 bp, Homo sapiens
ttttttgactagatccatagccacctgaagcctaatgttgccatggagttttgttctgctctttggttcctgctgggttcttcttgggttgaaatgaaaartcacttcaatcagtccacccataatgaaatgctgatctaatgtttgatactccagcatgaaattaaaatgaaaccacccttgccacctccacccccagcg

SEQ ID NO: 25681 - DNA, 201 bp, Homo sapiens
ctttaagggaagaaagccttaagggaactcttctctgtatgtttcacatactaatcttccccttcctttatgcttttttttttttaaataaaaaaaaaaaactcattactatagggaattcaattggcagcctttttctaggtatttataatccacgtctgagaatcccaaaggaaaagagacctatatcagaaaatttag

SEQ ID NO: 25682 - DNA, 201 bp, Homo sapiens
ccattcttacagaaagctttaagggaagaaagccttaagggaactcttctctgtatgtttcacatactaatcttccccttcctttatgcttttttttttttaaataaaaaaaaaaaactcattactatagggaattcaattggcagcctttttctaggtatttataatccacgtctgagaatcccaaaggaaaagagacct

SEQ ID NO: 25683 - DNA, 201 bp, Homo sapiens
atgccattcacccactcttggtaaagcgacttgatgtttgtttttttttctgttctcttctgccccaggggactcagaagaagatccttgacattgccaasatgctgggcttgtccaacacagtgatgcggctcatcgagaagcgggctttccaggacaagtactttatgataggtgggatgctgctgacctgtgtggtca

SEQ ID NO: 25684 - DNA, 201 bp, Homo sapiens
ctctctggagcctgaggtgagaagatcacttaagcctggtaggtcaaggctgctctctatcctgggtgacagagtgagagcctgtctcaaaaaaaaaaaaacacgaaacaaaccccagcactacttggcaggagagcttgtgattggcagaaaagagaagggaacgctctcacagctggcgaggacttggctcctgcctat

SEQ ID NO: 25685 - DNA, 201 bp, Homo sapiens
tcagaaacgaacagcaatattaattagtttagttcccacagcatggtttcttttgagaagcatgctggttttttgttttttttcattttttttttttttttctattctgaggaaaggtcctttttctgagttggtcatatggacaccacctgcgggggctgcctacccaccccactgctgggctccctcaggacccattcc

SEQ ID NO: 25686 - DNA, 201 bp, Homo sapiens
actctctggagcctgaggtgagaagatcacttaagcctggtaggtcaaggctgctctctatcctgggtgacagagtgagagcctgtctcaaaaaaaaaaaaacacgaaacaaaccccagcactacttggcaggagagcttgtgattggcagaaaagagaagggaacgctctcacagctggcgaggacttggctcctgccta

SEQ ID NO: 25687 - DNA, 201 bp, Homo sapiens
gttagtagttaagatattagaaaccatgccaaaacgtgggacctaaagtgccacatacaaattttacagttcagtgatgctgtcgatttaaatcagttacrtgttggcatcagaaaaattgtctttcctgactgaagcgctgttgattactcctgtctcactcatttcctccctcttcctttgataggcaggtccacgaga

SEQ ID NO: 25688 - DNA, 201 bp, Homo sapiens
aagcctaggcccttcataaacagcttgcctgtaggcctcacggaggtcagacagggattttcctggctccatccctgccaatctgaaaccctctcacttaygttctccatcatttatcctcattatgcagacaaggggctgagctgtggtgactgtgaaggcctcacaggagtccgagaggagctggcccctcatccagct

SEQ ID NO: 25689 - DNA, 201 bp, Homo sapiens
gagagtgttacccagatccagggtacagtgttgcatttccaaatgagatggcagttccttcgttccttgatattgtcggagaaggatgtttaccaaacagraggtccctgtctcagggtcttcctctgaatggtttcctccagtgagtcacttcagcatcctctcccccaacccgattccctttcaagcagcccaccctac

SEQ ID NO: 25690 - DNA, 201 bp, Homo sapiens
atattgtcggagaaggatgtttaccaaacaggaggtccctgtctcagggtcttcctctgaatggtttcctccagtgagtcacttcagcatcctctcccccracccgattccctttcaagcagcccaccctacttgtaatccacatgtcttgaatgaatttttgcatatcattttcttctatcttccttcaccaaatgatgt

SEQ ID NO: 25691 - DNA, 201 bp, Homo sapiens
agcaaacatttaacactgcattaaggggaagccatggaaaggaacatttggaaccagctaggttagtgagtagtcagagaaagcctttaggagacacccartgaggtcttgaaggaatagcttttcctaagaggagatcatgatacagagacaagtatcgttggaatgaacgatacttgtggagtggaactcatttggaga

SEQ ID NO: 25692 - DNA, 201 bp, Homo sapiens
ttgtcggagaaggatgtttaccaaacaggaggtccctgtctcagggtcttcctctgaatggtttcctccagtgagtcacttcagcatcctctcccccaacscgattccctttcaagcagcccaccctacttgtaatccacatgtcttgaatgaatttttgcatatcattttcttctatcttccttcaccaaatgatgtctc

SEQ ID NO: 25693 - DNA, 201 bp, Homo sapiens; identical to SEQ ID NO: 4972

SEQ ID NO: 25694 - DNA, 201 bp, Homo sapiens
catagctcccctttggtaagttttcttaattgtcatagattaactgagtttcctggatgctaatttcacactttcggttggaggagatctccattgttccyacccctccgggccaaatgggccccaggtttccaaggaaggagcaatctgtgactcctaaaatgggttggggccctgccagagttaaagcagtgactggag

SEQ ID NO: 25695 - DNA, 201 bp, Homo sapiens
gccggcaggggagggagggtcctgcgaccggaagccggaaaccggaaggggggctgtgaggacgtgttccgaggaagccagagccggagccgtggcctgcsgggccggcgacatggatcccctgttccagcaaacgcacaagtgagggccggtcggggagcgggcaggggctagacgaggcgaggccaggtgagcctggct

SEQ ID NO: 25696 - DNA, 201 bp, Homo sapiens
tgactggagggtggactggggggttgcagcatctttagacctagatctgtctaactctggggaggcacattgacatttccattacacacagcactgctgcrgtgccagggacctagcgcagggcttttggtaatccataaaatggattctgagactgcgacggcaaggctgtcctgtcccccaggcacccaaggatcctgc

SEQ ID NO: 25697 - DNA, 201 bp, Homo sapiens
tccagaactttttcatcatcccagtgtgcctgttaatcagtagcacttcatttcttccttccagaacacctagtaacctctgttttacttctctctatgartttacctattctagatacttaatataagtggagtcatacagaatttgtccttttgtatctggcttatttcacttaatgttttcagggttcatctatattg

SEQ ID NO: 25698 - DNA, 201 bp, Homo sapiens
gttgcagcatctttagacctagatctgtctaactctggggaggcacattgacatttccattacacacagcactgctgcggtgccagggacctagcgcaggrcttttggtaatccataaaatggattctgagactgcgacggcaaggctgtcctgtcccccaggcacccaaggatcctgccagacagcacactttggaggaa

SEQ ID NO: 25699 - DNA, 201 bp, Homo sapiens
taatgtagcttgagggtatgattagttctcccaacagaccatgagagatatgggaggttttagggctgtgtcttgcttgtgttcctatctccagtatctgygcatggtacattgtagatgctcaattatagaaaaagtgaaaaaaataattttaggaaaagaatgtacatgggtggacagtctcttgggacacaaaactgg

SEQ ID NO: 25700 - DNA, 201 bp, Homo sapiens
agtcccttctttcaaaagctcccaaataacgtggggctgtgtctaggctgtttctttcctcttgggccagctgtagggtttgcctttccttgtctgtctgyacctgcactgccgccatattgtttccattgttactgctttgtaagtcataatggcaggtgggacaagtcattcctccccctccttcttcagagtggtctt

SEQ ID NO: 25701 - DNA, 201 bp, Homo sapiens
ttgagacagtctcgctctgtcacccaggctggagtgcagtggcgcaatcttggctcactgcatcctctgcctcctgggttcaggtgatcctcatacctcakcctcctgagtagctggaactacaagtgtgtgccaccatgtctggctaattttttttttttttttgtattttttagtagagacagggttttactatgttga

SEQ ID NO: 25702 - DNA, 201 bp, Homo sapiens
gaaaacgaaatccaagcaagcatagaccagatattcagccgtctagaacgtctggagattttgtccagcaaggagccccctaacaaaaggcaaaatgccaractgtaagtgctgacctctgacatggctctgatactccaggcccatcaagacaggcttttctccctgggggaggtgatagaatattctgaaaaccaacgt

SEQ ID NO: 25703 - DNA, 201 bp, Homo sapiens
aggtgatagaatattctgaaaaccaacgtacatgttgaaaaactatgactatgcaaagaaaaagccccctcaaagggcacaattctatctgagtgatgccsctcaaaataaatagcctgtgaggtttgtgactcagaaaccttgtgaccccttacctctttggtgtcattttgaaattttgcctccagttctgttttttga

SEQ ID NO: 25704 - DNA, 201 bp, Homo sapiens
ttgccagatgaaacttcttcctggtcattctaccatatggagctataatacatttttctgagagataatggcccatcagccatactgttttagatgggagrgtaagaaagatttgtatgtgaatggcatttcataagtgctagtcaaattactgaagagaagtctctgagtctttcaaacgccagcatcttctgacacact

SEQ ID NO: 25705 - DNA, 201 bp, Homo sapiens
atggtacattgtagatgctcaattatagaaaaagtgaaaaaaataattttaggaaaagaatgtacatgggtggacagtctcttgggacacaaaactgggtrggatccaggatccaggaaaagagaagtatcaacttgtccaagaaaagaatgtctcctgccttgggaggaatagtagataagcttggaggatggaaacggg

SEQ ID NO: 25706 - DNA, 201 bp, Homo sapiens
gtcctgcgaccggaagccggaaaccggaaggggggctgtgaggacgtgttccgaggaagccagagccggagccgtggcctgccgggccggcgacatggatmccctgttccagcaaacgcacaagtgagggccggtcggggagcgggcaggggctagacgaggcgaggccaggtgagcctggcttctggggctgaggcctcg

SEQ ID NO: 25707 - DNA, 201 bp, Homo sapiens
tttccttctgtgaccagccccggattcaggctgtactaataccaggtatattgtggaatttagtataaaggccaatctgtcctgaagtccatctaatgtgrtgaatcactgaaagtctcagaaagacctggttagtgtatgttctcatttaccacaggcctaccagccctgggcacagcagcttcatggcaagacataaaa

SEQ ID NO: 25708 - DNA, 201 bp, Homo sapiens
gctcaattatagaaaaagtgaaaaaaataattttaggaaaagaatgtacatgggtggacagtctcttgggacacaaaactgggtgggatccaggatccagsaaaagagaagtatcaacttgtccaagaaaagaatgtctcctgccttgggaggaatagtagataagcttggaggatggaaacgggatagcctatgtggaga

SEQ ID NO: 25709 - DNA, 201 bp, Homo sapiens
tttaaccctcaatgctgcatccttgctttgcaataaattttcccaagtgtttcaggctgtgccaacatagtttttgcttccccagactaagcagtcaagtracagtgtttaacagttcaaaaatttaatgaactataagacacactaaaagatgtttggattttagatcgttataatgtagtattcaggccttttttaggc

SEQ ID NO: 25710 - DNA, 201 bp, Homo sapiens
ttccctccctgggaaggccaggccaaatgctctgttctctggcagccagcaacagggataaattaattagtgccgtgattaattagtgatgagtaacctcyaaggctggcttcttcctgataaagcaaaatttatgtagcctccatctctccccgcagatggagacccagacgcagaggcggggctggcccctggggagct

SEQ ID NO: 25711 - DNA, 201 bp, Homo sapiens
aagacgatgaagaggacgaggaggagggcgaggaggacagcagcaactcggagggtgaatggtcttggggtgagagggtgtggccctgtgagcccatctgkcgggagggcagagccacgtgggcggggggcgtggggctctgggccaggcttttccctccctgggaaggccaggccaaatgctctgttctctggcagccag

SEQ ID NO: 25712 - DNA, 201 bp, Homo sapiens
aagggaagaagtaggaaaggcgggaacagggaggagagcaggcaggaacagatgacccctgccaccgtgttaaaataaagctgaaagctgggtaaggtacytgcagccccatagctgggcaaggggtgcaggtccctggggttcagacgtgccttgtcctgctttaggggtctgatgtcggtgagtgggggaggaggtcca

SEQ ID NO: 25713 - DNA, 201 bp, Homo sapiens
tcaaggctgggaagggaggtgggaagtccaagggaagaagtaggaaaggcgggaacagggaggagagcaggcaggaacagatgacccctgccaccgtgttraaataaagctgaaagctgggtaaggtacttgcagccccatagctgggcaaggggtgcaggtccctggggttcagacgtgccttgtcctgctttaggggtc

SEQ ID NO: 25714 - DNA, 201 bp, Homo sapiens
caagtgagttgtggggtgggcagggttgtgcgggagggtcaggagaagcaaatttgctgggactgtgtgggcggtgcctctggcgttcagggccttggggsctgagtctgtgtcctggccgtccctgaggaagggctggggtccctgtacctgctacggggagatgctctggattctggagagctagggctggtgggcacc

SEQ ID NO: 25715 - DNA, 201 bp, Homo sapiens
ggcgtaaaggccgtgcctctgagcacaaagaccagctctctcggctgaaggacagagaccccgagttctacaagttcctgcaggagaatgaccagagcctrctaaacttcagcgactcggacagctctgaggaggaagaggggccgttccactccctgccagatgtgctggaggtgagggcgtgggccaaaccagaagggg

SEQ ID NO: 25716 - DNA, 201 bp, Homo sapiens
ggctgggagcagagtctacggggcaccgagaggcaggtgagggaggcacagggtcgggggacaccgggatccgggtgagggagccctcacctgcacattgscctcgcccaccacaatctcagccgtgtaggcaaactgcaccagctggtccaaggcctgagggtcgatgtcgtgcagcgtcacgtgggtctggcggctctc

SEQ ID NO: 25717 - DNA, 201 bp, Homo sapiens
cgtggccaccacgcgtggttttgcacaggacctgggccagctgtgcacatggagcggtcctgggcttcagtggctgacccctcccttccgcagctgaagtygttcctccgggagtgcaaggtggccaactactgccggcaggtgcagcagctgcttgggaaggttcaggagaactcggcatacatctgcagccgccgccag

SEQ ID NO: 25718 - DNA, 201 bp, Homo sapiens
ctgacgtggttctctctgaccaggaaacataccagtctgtgtacaactggcagtatgtgcactgcctcttcctgtggtgccgggtcctgagcactgcgggycccagcgaagccctccagcccttggtctacccccttgcccaagtcatcattggctgtatcaagtgagttgtggggtgggcagggttgtgcgggagggtca

SEQ ID NO: 25719 - DNA, 201 bp, Homo sapiens
gatgggttgagaccccgtgtgcaagatgaggaaatgattcctgtgccggcccaggaggaacgtgcatcagcctgacttgtcagcctggccagtagctgacrtggttctctctgaccaggaaacataccagtctgtgtacaactggcagtatgtgcactgcctcttcctgtggtgccgggtcctgagcactgcgggccccag

SEQ ID NO: 25720 - DNA, 201 bp, Homo sapiens
ggggtggaggagggggttctccttatcctcagaaggtccttctgggcccccacgggaggtctgtttgctctcagccgtgatgtttccagcctcagggaggsctgtgcctagtggaaggggtgggggccctgctgtctggccctggtggctggaatcagatgtgccgactataggtctgtgcagtgtggggaggagggatct

SEQ ID NO: 25721 - DNA, 201 bp, Homo sapiens
ccaggggagggcctctctggctggaggaggacactgggtgttgggacctgaggccatggccagggtacagtcctactgcccgtccccaagccatgggtggyctgcatgtggggaccctcagcccccagaggggcccagtgtgcagcaggagcttctgccccagcttctcccaggcctgaggctggtgggcacttgggggtg

SEQ ID NO: 25722 - DNA, 201 bp, Homo sapiens
gcctttgcctggctggggagggctgtgctggccctggggcatccctgctgaggaggctggggggccaccagtgacgtctgaccttctgcagagaatggtgrtcgtatggagcactggggaggagtctctgcgggtgctggctttcctggtcctcagcagagtctgccggcacaagaaggacactttccttggccccgtcct

SEQ ID NO: 25723 - DNA, 201 bp, Homo sapiens
ggtcggtccttttttgtatcccagaatacatgggtttggggcttcactgtcccctcctgcccccagctggtgtcctgtctgtcggagacgacggtgttggyggccgtgctgcggcacatcagcgtgctggtgccctgcttcctgaccttccccaagcagtgccgcatgctgctcaaggttcgtggcccagtcccctccctg

SEQ ID NO: 25724 - DNA, 201 bp, Homo sapiens
cttgcagtccgtgccctggagatggcgctgccctgacagcctgaggggaaggggcctgagtgcccagccccagcctctccctgatgcactcggccctctcycctgctcttcaggacggcctggtggagcagctgtacgacctcaccctggagtacctgcacagccaggcacactgcatcggcttcccggagctggtgctgc

SEQ ID NO: 25725 - DNA, 201 bp, Homo sapiens
ccgtggggcctcccagccaggggtgggtggtctctctgcaggatgctgcagccgtccagcagcccgctctgggggaagcttcgtgtggacatcaaggcttwcctgggctcggccatacaggtgctattctggtggggagggcacgggggcctggctgtatctggtggtcggtccttttttgtatcccagaatacatgggtt

SEQ ID NO: 25726 - DNA, 201 bp, Homo sapiens
aaaaagcaaaccctaaaagctaaaacaaagccctcagctgtaggccgtgcctgcccttccccggtgcctggacaggaagccagtcgcctgcccatactttyggcccaggctagagaagggcagtgtcctcccagaggttcatcagtaccagggcgttttcccatctggacctgagctcagctgtctggcagccacccctgc

SEQ ID NO: 25727 - DNA, 201 bp, Homo sapiens
gctgcggcacatcagcgtgctggtgccctgcttcctgaccttccccaagcagtgccgcatgctgctcaaggttcgtggcccagtcccctccctgtgtctgycatggggtcggggggccacacggctacccccaccacatcccactcctggccagggcacaggtggtgcccacactccactggctccgcttggctagagagg

SEQ ID NO: 25728 - DNA, 201 bp, Homo sapiens
agtagtgggcagggttggcccagagggtgggctgattctgcctctgccatcccagctgcaacagctatgcacttgagccctgagatgggatccatgtcccytcctggggtatccccgtggccaccacgcgtggttttgcacaggacctgggccagctgtgcacatggagcggtcctgggcttcagtggctgacccctccct

SEQ ID NO: 25729 - DNA, 201 bp, Homo sapiens
ctttgtgatttgggaacagaggggactagaaattggccacatggggccctggtggtgggtctggcgatgcctggccctgctgtggccgccagcccctgccytctctcacctgagcccctggttctttggccttccagctggaagacctgaacttccctgagatcaaacgaaggaagatggctgacaggaaggatgaggaca

SEQ ID NO: 25730 - DNA, 201 bp, Homo sapiens; identical to SEQ ID NO: 5020

SEQ ID NO: 25731 - DNA, 201 bp, Homo sapiens
tgggcaccaggggcccgtgaggagaagcaggaagggctctgcctttgaccttggacatgggatggacaacttggaggatggctttgtgatttgggaacagrggggactagaaattggccacatggggccctggtggtgggtctggcgatgcctggccctgctgtggccgccagcccctgccctctctcacctgagcccctg

SEQ ID NO: 25732 - DNA, 201 bp, Homo sapiens
ccagggcgagggtttggaaacagtgccaggcggccagggccgtgcccggatgattcgacttggagagggggtaggtgttggagaactggccagaaccaggygtttccagggaggggaagccccaggctgcactaggttggggaggccatgccccctcaggcctgatgggctggaggctccgggcaggtggagtggctggac

SEQ ID NO: 25733 - DNA, 201 bp, Homo sapiens
ccagagcctgctaaacttcagcgactcggacagctctgaggaggaagaggggccgttccactccctgccagatgtgctggaggtgagggcgtgggccaaascagaaggggggcacttgtctctacactctccttcagctcagcctttctgtgcaggaagccagtgaggaggaggatggagcggaggaaggagaagatgggg

SEQ ID NO: 25734 - DNA, 201 bp, Homo sapiens; identical to SEQ ID NO: 5024

SEQ ID NO: 25735 - DNA, 201 bp, Homo sapiens
ggcgtccacgtcgtgtttcacccagctcaggacggctcggtagacctcctcctctgaaggcacgttcaggctgtcgctagagaccagttccagaacctggragtgggggtcctcagacctgagatctggggagggtcctgtggacccagggagccctgaagatgcctaggagggagggttagcaggtgggggctgagtgtt

SEQ ID NO: 25736 - DNA, 201 bp, Homo sapiens
tctgcagccgccgccagagggtttccttcggcgtctctgagcagcaggcagtggttagtgggccctgggggtagtgccacctgagggcacctgccagggtrtagccccagctacatgtgggggtttgcccagggtgaggcatgaccctgaactcccccaaccccccaggaagcctgggagaagctgacccgggaagagggg

SEQ ID NO: 25737 - DNA, 201 bp, Homo sapiens
gccaggcacactgcatcggcttcccggagctggtgctgcctgtggtcctgcaggtgtgtgtcctgcccacaccggctcgtggccgactcagactgtcttawaacgggcttggctgccccaggctggtaggaggtgcccttgtcccgggtacctgggactggggtggaacctgactgctggcaacgcgccccgtgaggcccc

SEQ ID NO: 25738 - DNA, 201 bp, Homo sapiens
tccttgcaggtgggggaagggtggatgggttgagaccccgtgtgcaagatgaggaaatgattcctgtgccggcccaggaggaacgtgcatcagcctgactkgtcagcctggccagtagctgacgtggttctctctgaccaggaaacataccagtctgtgtacaactggcagtatgtgcactgcctcttcctgtggtgccgg

SEQ ID NO: 25739 - DNA, 201 bp, Homo sapiens
ccttgacggagctgctggccctggagccgggtgtggcctaccagcacgccttcctctacatccgccagctcgccatacacctgcgcaacgccatgaccacycgcaagaaggtgtgtggtggggcccttccaggctcatgctgggcatggggtggggcagcccaggtgcccgacccaaggcagggcctggggcctccccgaa

SEQ ID NO: 25740 - DNA, 201 bp, Homo sapiens
cgaggcccagctctgagggaaaggcccaggtgttcacaggggccctggagtgggcggtggaggtgcatggccctgatcccaggtggctctgacccgggtcyctccgcagcaaatgtacatcacgtatgtgaggaactgcaagttcacctcgcctggtgccctccccttcatcagtttcatgcagtggaccttgacggagct

SEQ ID NO: 25741 - DNA, 201 bp, Homo sapiens
agccgcgcggcattctggggccggaagtggggtgcacgcttcgggttggtgtcatggcagctgcggggagccgcaagaggtaagccgcgggtccgagggcygatttggcctcccggtgggtgtctgtatccaagggggcttttcttgctcctctcagcggggctggggcgagctgggcgtgcgggcagctgtgactcctgc

SEQ ID NO: 25742 - DNA, 201 bp, Homo sapiens
cagctacatgtgggggtttgcccagggtgaggcatgaccctgaactcccccaaccccccaggaagcctgggagaagctgacccgggaagaggggacacccytgaccttgtactacagccactggcgcaagctgcgtgaccgggagatccagctggagatcagtggcaaagagcgggtgcggctcggcgaggggacctgggg

SEQ ID NO: 25743 - DNA, 201 bp, Homo sapiens; identical to SEQ ID NO: 5034

SEQ ID NO: 25744 - DNA, 201 bp, Homo sapiens
agcagcctcgcgtccgagccgtggggcctcccagccaggggtgggtggtctctctgcaggatgctgcagccgtccagcagcccgctctgggggaagcttcrtgtggacatcaaggcttacctgggctcggccatacaggtgctattctggtggggagggcacgggggcctggctgtatctggtggtcggtccttttttgta

SEQ ID NO: 25745 - DNA, 201 bp, Homo sapiens
gaagccaccatcaggcaaaagtagcgcagggcacaggcacagcaagtccagggaagaccgcggctgggggcctgtgtagcgcagggcgcaggcacagcaaktccagggaagaccgcggctggggggcctgtgtagtgtgtttgagggtatgttgtagaggttgttgggtaggagacgtgagtctgccaaaaacgtacctcc

SEQ ID NO: 25746 - DNA, 201 bp, Homo sapiens
tgtcggagacgacggtgttggcggccgtgctgcggcacatcagcgtgctggtgccctgcttcctgaccttccccaagcagtgccgcatgctgctcaaggtkcgtggcccagtcccctccctgtgtctgtcatggggtcggggggccacacggctacccccaccacatcccactcctggccagggcacaggtggtgcccaca

SEQ ID NO: 25747 - DNA, 201 bp, Homo sapiens
tcctctggtgccccagcatgtaccctggatctctctggttcacagcctgagggctcctagtggttggggaggggtcacaagactgagaggccaggctgactctttctctgctcctcctggcatgtcctacggaggtgcatggcctgtggcttctgtggagggtgtgggaggggccccccaggcctcccgtgacctccatct

SEQ ID NO: 25748 - DNA, 201 bp, Homo sapiens
cctctggtgccccagcatgtaccctggatctctctggttcacagcctgagggctcctagtggttggggaggggtcacaagactgagaggccaggctgactctttctctgctcctcctggcatgtcctacggaggtgcatggcctgtggcttctgtggagggtgtgggaggggccccccaggcctcccgtgacctccatctg

SEQ ID NO: 25749 - DNA, 201 bp, Homo sapiens
ctctggtgccccagcatgtaccctggatctctctggttcacagcctgagggctcctagtggttggggaggggtcacaagactgagaggccaggctgactctttctctgctcctcctggcatgtcctacggaggtgcatggcctgtggcttctgtggagggtgtgggaggggccccccaggcctcccgtgacctccatctgt

SEQ ID NO: 25750 - DNA, 201 bp, Homo sapiens
tctggtgccccagcatgtaccctggatctctctggttcacagcctgagggctcctagtggttggggaggggtcacaagactgagaggccaggctgactctttctctgctcctcctggcatgtcctacggaggtgcatggcctgtggcttctgtggagggtgtgggaggggccccccaggcctcccgtgacctccatctgtc

SEQ ID NO: 25751 - DNA, 201 bp, Homo sapiens
gaggggccccccaggcctcccgtgacctccatctgtcccgtcctgtgtctggcactcttctttgctgttgctgctgcgtcttctggttgctcgggacggarccccatgtggcattgctgtgctgagggccaggatgggcctcagtgccatgttgtcaggaatgggggctgtcctggtactctgtgtggcagggacctctag

SEQ ID NO: 25752 - DNA, 201 bp, Homo sapiens
gtttcaggggcagcagcataaactcctcggtcttggccacgtccacgaagtgctgcagcacgtacctgtgggcggccttgagcaggtcgctgcaggagtgsgcatcggcaaagccccggatacccaggcagttggaggggtcgagctgactcagtagaaacttgcagcaagcgtctcggacgccattcagctgcaggagac

SEQ ID NO: 25753 - DNA, 201 bp, Homo sapiens
tggcagctgcggggagccgcaagaggtaagccgcgggtccgagggctgatttggcctcccggtgggtgtctgtatccaagggggcttttcttgctcctctyagcggggctggggcgagctgggcgtgcgggcagctgtgactcctgcgtgacccgcaggcgcctggcggagctgacggtggacgagttcctagcttcgggc

SEQ ID NO: 25754 - DNA, 201 bp, Homo sapiens; identical to SEQ ID NO: 5021

SEQ ID NO: 25755 - DNA, 201 bp, Homo sapiens; identical to SEQ ID NO: 5022

SEQ ID NO: 25756 - DNA, 201 bp, Homo sapiens
gggcacttgggggtgggggctgtgcaaggggctacggctcttcctcgaggcccagctctgagggaaaggcccaggtgttcacaggggccctggagtgggcrgtggaggtgcatggccctgatcccaggtggctctgacccgggtctctccgcagcaaatgtacatcacgtatgtgaggaactgcaagttcacctcgcctgg

SEQ ID NO: 25757 - DNA, 201 bp, Homo sapiens
caggagaatgaccagagcctgctaaacttcagcgactcggacagctctgaggaggaagaggggccgttccactccctgccagatgtgctggaggtgagggygtgggccaaaccagaaggggggcacttgtctctacactctccttcagctcagcctttctgtgcaggaagccagtgaggaggaggatggagcggaggaagg

SEQ ID NO: 25758 - DNA, 201 bp, Homo sapiens
acttctgcctcctcagccggcgtaaaggccgtgcctctgagcacaaagaccagctctctcggctgaaggacagagaccccgagttctacaagttcctgcargagaatgaccagagcctgctaaacttcagcgactcggacagctctgaggaggaagaggggccgttccactccctgccagatgtgctggaggtgagggcgt

SEQ ID NO: 25759 - DNA, 201 bp, Homo sapiens
gtatgttgtagaggttgttgggtaggagacgtgagtctgccaaaaacgtacctcctggcaatcctgtcttgctagttggtaatccttgtgaagggagtagrctgaccctgtaggccactccccgccccctctacttccacttcccactggggtcgctgacttctgcctcctcagccggcgtaaaggccgtgcctctgagca

SEQ ID NO: 25760 - DNA, 201 bp, Homo sapiens
cagccgtccagcagcccgctctgggggaagcttcgtgtggacatcaaggcttacctgggctcggccatacaggtgctattctggtggggagggcacggggscctggctgtatctggtggtcggtccttttttgtatcccagaatacatgggtttggggcttcactgtcccctcctgcccccagctggtgtcctgtctgtcg

SEQ ID NO: 25761 - DNA, 201 bp, Homo sapiens
ggtgggggccctgctgtctggccctggtggctggaatcagatgtgccgactataggtctgtgcagtgtggggaggagggatctgctcacatgagccacaaytggtcagaggcttatccagatagaggtgtgtgcatgtgtgtgtactcacacacggccacacatgtcacatgcacagagccgggaccccctttctgggggg

SEQ ID NO: 25762 - DNA, 201 bp, Homo sapiens
tacgagataggatcttgctctgtcgcccaggctggaatgcagtgatcatagctcactgcgacacgtaccttctggattcaagtgattctctcaccttagcytcccaagtaactgggactccgccaccaggcctggataatattttgtatatttttgtagagacggggtctcactgtgttgttcaggctggtctcaaactcc

SEQ ID NO: 25763 - DNA, 201 bp, Homo sapiens
gcggaattaagccactgcaggtcaagactggcctggcgggcacgtgccagacccgacccaagtccagcctccaggcttacccgcccacagcatagagccgrttccccaccgcagccactcccacccgggcccggcgcgtggacatggaggccaccacgtgccagcggtcggtgcgcgtgtcgtaggcctcacagtctccgt

SEQ ID NO: 25764 - DNA, 201 bp, Homo sapiens
tgtggcacctctgcctgctcctgtagggagcatctgctgctccgggcgtctgtgctgagttgtccggcgacttcccggagccctggccgcctccttgtcaygggtgtcacgaggacagtgctcctccgtgtgctgggggcagtgttggggaacgtgggaccactggggatgaaggcggctgctgctagggctgtgcttgag

SEQ ID NO: 25765 - DNA, 201 bp, Homo sapiens
tgttttgttttgtttgtttggtttttggtttttttttttccttacgagataggatcttgctctgtcgcccaggctggaatgcagtgatcatagctcactgygacacgtaccttctggattcaagtgattctctcaccttagcctcccaagtaactgggactccgccaccaggcctggataatattttgtatatttttgtag

SEQ ID NO: 25766 - DNA, 201 bp, Homo sapiens
ctgtgtggggccatggggctgggaccgtgcctagctgcttatctcttgtttcgggttgggtctcctcgtgctgaagcctgaggaccagggtgaccagggtscagccaggtgcagggccaaagggaccagggggaccagggtgcagccagggtgaagccagggtgaccaggcatggggccgagagagcctgacacggccctt

SEQ ID NO: 25767 - DNA, 201 bp, Homo sapiens; identical to SEQ ID NO: 5037

SEQ ID NO: 25768 - DNA, 201 bp, Homo sapiens
acacgccaggctgtgtggggccatggggctgggaccgtgcctagctgcttatctcttgtttcgggttgggtctcctcgtgctgaagcctgaggaccagggkgaccagggtgcagccaggtgcagggccaaagggaccagggggaccagggtgcagccagggtgaagccagggtgaccaggcatggggccgagagagcctga

SEQ ID NO: 25769 - DNA, 201 bp, Homo sapiens; identical to SEQ ID NO: 5019

SEQ ID NO: 25770 - DNA, 201 bp, Homo sapiens
acttgggaggtggaggttgcagtgagccgagatggcaccattgcattccagcctgggtgagagagtgagactccatctcaaaaagaaaaagaaagaaaccmaaagatacaaaaattagcctggcgtggtgacacacacctgtcgtcccagctactcgggaggctgaggcaggagaatcgcttgaacccgggaggcggaggt

SEQ ID NO: 25771 - DNA, 201 bp, Homo sapiens
gtatgcatttgtatgggggatgtgtgtacatctgggtgggtgcgtttgtctgtgcatgcatgcgtgtgtgtgcaccatctgggtgcatgggtctgtaaatbgtgtgtgtgcatatcagttcatgtgtgcatctgtatgtgtgtgtgcacgtgtatccatgaatgcctgtgtgcctgcaggtgtgtgcatctgtgcgtgtgt

SEQ ID NO: 25772 - DNA, 201 bp, Homo sapiens
caccggggctgcccgcaccgagcacgcgaacgcgccctcccgccctgaggccgccggcgttgcggtcggagaaccatagagccactcggctgggcgtggcrcggcggggcggggaaaggggcggggcctgggcggcggaagtgcgcagccgcgcggcattctggggccggaagtggggtgcacgcttcgggttggtgtcat

SEQ ID NO: 25773 - DNA, 201 bp, Homo sapiens
tgtgtgcatatcagttcatgtgtgcatctgtatgtgtgtgtgcacgtgtatccatgaatgcctgtgtgcctgcaggtgtgtgcatctgtgcgtgtgtacasctgtgtgtatgcatgtgtgtacctttgcgtgtacctttgcgtgtgtgcacctgtgcatgtgtctttgtataccagtgtgtacctgtgtgtacctgtatgc

SEQ ID NO: 25774 - DNA, 201 bp, Homo sapiens
ccctgtgatggtgacacaaacttgcctcttgcagatggactgtacaaagccactggggccccaaccccaactacctgttcaggcaggaggccccgtcatarccgccggccgagtacaggagtccatgcaaggcggccacacccaggcagcttcgccttgtgcccatggacacctccggctgccacgtgttagtcacggggt

SEQ ID NO: 25775 - DNA, 201 bp, Homo sapiens; identical to SEQ ID NO: 5025

SEQ ID NO: 25776 - DNA, 201 bp, Homo sapiens
tcgccatacacctgcgcaacgccatgaccacccgcaagaaggtgtgtggtggggcccttccaggctcatgctgggcatggggtggggcagcccaggtgccygacccaaggcagggcctggggcctccccgaagcccctgtctggagacagcccagcaccctggtgcagtcggtccttgcaggtgggggaagggtggatggg

SEQ ID NO: 25777 - DNA, 201 bp, Homo sapiens
cctgcgtctgtgtccctcagcatctgcattggaaatctcggcctaagggcagggcgggctgcctttgtggttggtgcccctcactggaccctcactgcagstctgagcagacctgggcccttggatcacgaatgtctcacagagcacctgggggtggtgggcagggaagagagccctcggccttctcagggccccacctgg

SEQ ID NO: 25778 - DNA, 201 bp, Homo sapiens
tgcctgcgggcgtccacgtcgtgtttcacccagctcaggacggctcggtagacctcctcctctgaaggcacgttcaggctgtcgctagagaccagttccaraacctgggagtgggggtcctcagacctgagatctggggagggtcctgtggacccagggagccctgaagatgcctaggagggagggttagcaggtgggggc

SEQ ID NO: 25779 - DNA, 201 bp, Homo sapiens
ggctgtgctggccctggggcatccctgctgaggaggctggggggccaccagtgacgtctgaccttctgcagagaatggtggtcgtatggagcactggggargagtctctgcgggtgctggctttcctggtcctcagcagagtctgccggcacaagaaggacactttccttggccccgtcctcaaggtagtggtgggccctg

SEQ ID NO: 25780 - DNA, 201 bp, Homo sapiens
gcctgcccttccccggtgcctggacaggaagccagtcgcctgcccatactttcggcccaggctagagaagggcagtgtcctcccagaggttcatcagtacyagggcgttttcccatctggacctgagctcagctgtctggcagccacccctgctgagtggggtgtcttgctggggcctccacccttgggccccccataatc

SEQ ID NO: 25781 - DNA, 201 bp, Homo sapiens
tgtgtagtgtgtttgagggtatgttgtagaggttgttgggtaggagacgtgagtctgccaaaaacgtacctcctggcaatcctgtcttgctagttggtaayccttgtgaagggagtagactgaccctgtaggccactccccgccccctctacttccacttcccactggggtcgctgacttctgcctcctcagccggcgtaa

SEQ ID NO: 25782 - DNA, 201 bp, Homo sapiens
tctgctcctcctggcatgtcctacggaggtgcatggcctgtggcttctgtggagggtgtgggaggggccccccaggcctcccgtgacctccatctgtcccrtcctgtgtctggcactcttctttgctgttgctgctgcgtcttctggttgctcgggacggagccccatgtggcattgctgtgctgagggccaggatgggcc

SEQ ID NO: 25783 - DNA, 201 bp, Homo sapiens
atgtgtagagctagttttgctcatgacgttttgaggtattttgagctttttttttttttttttttttttttgagacggagtctcgctctgtcgcccaggcyggagtgcagtggcgggatctcggctcactgcaagctccgcctcccgggttcacgccattctcttgcctcagcctcccaagtagctgggactacaggcacc

SEQ ID NO: 25784 - DNA, 201 bp, Homo sapiens
cactatgcccggctaattttttgtatttttagtagagacggggtttcaccgttttagccgggatggtctcgatctcctgacctcgtgatccgcccacctcrgcctcccaaagtgctgggattacaggcgtgagccaccgcgcccggcctattttgagattttaaatttgaaatttggccaggtatggtggctcatgcctgt

SEQ ID NO: 25785 - DNA, 201 bp, Homo sapiens
aatcttaacagtagtttattgtgaaagactttatgattatttttacctgtttttatcctgtagtaggaaggtcagcttctcatttagattctgaaggctaytggtattaattgtctggaattgtcttagatcttccttgtgtcgtgttttcccagaaagagctgggaacctttgctcaaagctccatcgcccttcaccatc

SEQ ID NO: 25786 - DNA, 201 bp, Homo sapiens
ctttatgattatttttacctgtttttatcctgtagtaggaaggtcagcttctcatttagattctgaaggctattggtattaattgtctggaattgtcttaratcttccttgtgtcgtgttttcccagaaagagctgggaacctttgctcaaagctccatcgcccttcaccatcagtacaaccccaagtttcagaccctgtt

SEQ ID NO: 25787 - DNA, 201 bp, Homo sapiens
gattatttttacctgtttttatcctgtagtaggaaggtcagcttctcatttagattctgaaggctattggtattaattgtctggaattgtcttagatcttycttgtgtcgtgttttcccagaaagagctgggaacctttgctcaaagctccatcgcccttcaccatcagtacaaccccaagtttcagaccctgttccaacc

SEQ ID NO: 25788 - DNA, 201 bp, Homo sapiens
tacctgtttttatcctgtagtaggaaggtcagcttctcatttagattctgaaggctattggtattaattgtctggaattgtcttagatcttccttgtgtcstgttttcccagaaagagctgggaacctttgctcaaagctccatcgcccttcaccatcagtacaaccccaagtttcagaccctgttccaaccctgtaactt

SEQ ID NO: 25789 - DNA, 201 bp, Homo sapiens
cctaggaatggaggacacaggacatttgtaatttcttccttctctcttttatcctccctttgtactcattatccaagttctagaattacatgataatctcygggcctgggtaaggcatggaggcagtggacagtataggaatatgggaggtagagatctgaggctcagtgctaagaattggactacagcaatatgaggggt

SEQ ID NO: 25790 - DNA, 201 bp, Homo sapiens
aggcagtggacagtataggaatatgggaggtagagatctgaggctcagtgctaagaattggactacagcaatatgaggggtaagtattaggaatcagatcragataaactggggcctggtaaagatgaaagtcaggtggtaaagttcggtcatgtttagctttttattctcttcattaagatcaactaactttatttacca

SEQ ID NO: 25791 - DNA, 201 bp, Homo sapiens
tatgtgacaggtattactaggtactttttaagtgtttgttttactttgtgaataaagtgttacacgtaagaaagagtaagagaggccgggcgccgtggctyacgcctgtaatccaacactttaggaggccgaggctgtcggatgacaaggtcaggagatcaagaccatcctgtctacagtgaaaccccgtctctactaaaa

SEQ ID NO: 25792 - DNA, 201 bp, Homo sapiens
agtagaaacataatttcaccatgttggtcagtctgatcttgaactcctgatctcaggtgatctgcccacctcggcctcccaaagtgctggaattataggcrtgagcctctgtgcctggcaaaaaactttttttttttagggatggggtgtccctatattgcccaggctggtcttcaatttttggccttaggcaattctcct

SEQ ID NO: 25793 - DNA, 201 bp, Homo sapiens
caagtgattctcctgcctcagcctcccaagtagctgggactacaggcgggcaccaccacgggtaattttttttgtatttttagtagagacagggttttgcsatgttggccaggctggtctcgaattcctgacttcaagtgatctgcccacctctacctcccaaagtactgggattacagccatgagccactgcgcctggcc

SEQ ID NO: 25794 - DNA, 201 bp, Homo sapiens
ttctaaatagctttgtgtgtcagagatcagaacgctcattttacatgatatcaagaaccagaatgctagatagctagaatggttgttaacttcctagatawccattgtagaggaacacataaggtaaaacaaatgaataaaaattaaaaaaaaatgagatagccaaagatttgaagctctttacccattaacatgataatc

SEQ ID NO: 25795 - DNA, 201 bp, Homo sapiens
tgttgcccagtttggagcgtggctaaatcatggctcactggtgtctccaacccggtgtgcaccactatgcccagctaattttttttttttttttttttaaracatggtctcgttatgttggccaggctggtctcaaactcctggcctcaagtgctcgtcctgtcttggcctcccaaagtaatgggattataggcatgagcc

SEQ ID NO: 25796 - DNA, 201 bp, Homo sapiens; identical to SEQ ID NO: 5098

SEQ ID NO: 25797 - DNA, 201 bp, Homo sapiens
ttttaaaaaattgaggtgggggggtctcagttttttgcccaggctggtctcagactcctgggttcaagtgatcctcctgcttcagcatcccaaagtgctgrgattataggcatgagccaccctgcatggccccattccagtagcatcctgagggagagtgcttgggaagggaattttcacatttaaaccatctccggggcc

SEQ ID NO: 25798 - DNA, 201 bp, Homo sapiens
gacacaaacaaggatcctggtggtatatagtatcaaaagtgtatctccctcaaacagcccaatggagaattataaaaatcctgcatgactctttccatatrtgaggagatgccactcttgccatgataaacaggctcttcattgggcctgacttaacttccgtggttaagcaggtctgtcaaacctgttcactgtgagcat

SEQ ID NO: 25799 - DNA, 201 bp, Homo sapiens
gtcccgaggagctgggactacaggcgctcaccaccacaccctgctaatttttgtatttttagtagagacggggtttcaccttgttggtcaggctggtctcraactcctgacctcgtgacccacccacctcagcctcccagagtgctgggattacaggtgtgggccaccatgcctggcgtatccatggttttaaggcacacg

SEQ ID NO: 25800 - DNA, 201 bp, Homo sapiens
tctttaaatagagattagtttaatttgaaatgtacaagtattcagcatatgctattcgtatatgtgtgttcatggatgtttgtgtatgtggtcttgtgtgkgtgtgtgtgtgtgtgtgtgtgtgtgtgtgtgtgtttctcttgatccaccaccaccccattcaccagcctgacagaagacagtgtttccagaaggaatgta

SEQ ID NO: 25801 - DNA, 201 bp, Homo sapiens
gagaagaacaccggctcccattctggttaaaggtacagccctcttcctcgaagtctgtaggaggcagaaggtcactgaaagttctgagagaatatcaaggrcttccttaatcgtctaatgctttagttgtagaactaggacttcaggaatcttcctgattcacctttcttcccttacttttctgcccttctccgggtgatt

SEQ ID NO: 25802 - DNA, 201 bp, Homo sapiens; identical to SEQ ID NO: 5092

SEQ ID NO: 25803 - DNA, 201 bp, Homo sapiens; identical to SEQ ID NO: 5093

SEQ ID NO: 25804 - DNA, 201 bp, Homo sapiens; identical to SEQ ID NO: 5097

SEQ ID NO: 25805 - DNA, 201 bp, Homo sapiens; identical to SEQ ID NO: 5096

SEQ ID NO: 25806 - DNA, 201 bp, Homo sapiens
aagaagaagaagcagaaggaatggaaagcctggagaaagaggatgaaatgacggatgaagcagttggagactctgctgagaagcctccttctacttttgcytcacctgagactgctccagaagtggagaccagcagaactccaccaggtgagctaggcaaacctatactgaaggaccattctcacttaacctcattgtcta

SEQ ID NO: 25807 - DNA, 201 bp, Homo sapiens; identical to SEQ ID NO: 5099

SEQ ID NO: 25808 - DNA, 201 bp, Homo sapiens
tgcccagggccagaatggaatagccagccctattttatctttcatgcctaaaatcaacctttttccctgaaattacccataatccacatgacaaaagaaayctaccagcctcctgttcctcttattagggttcacagctatcactctagtggaacaggaagtgtgggaaaccatggccttaccaaattataaggatgctag

SEQ ID NO: 25809 - DNA, 201 bp, Homo sapiens
caaggaatgaatcgggatagcttccctgcccggaagggagaaagactcttttatctttcctggttatagtctctgagttctacacgtgacaccattggcastggtagctcattcagggcgaattcacactcaggcctcttaaaccctcctttcttaggccaaattctcttacagagttagccagtgagggcaaaagatagt

SEQ ID NO: 25810 - DNA, 201 bp, Homo sapiens
tttccgagacagggtcccaccctgttgcccagtttggagcgtggctaaatcatggctcactggtgtctccaacccggtgtgcaccactatgcccagctaattttttttttttttttttttaagacatggtctcgttatgttggccaggctggtctcaaactcctggcctcaagtgctcgtcctgtcttggcctcccaaagt

SEQ ID NO: 25811 - DNA, 201 bp, Homo sapiens
tctaaaattggaaaatggagtgtactctagtatgtacatgaccttcttgtgtgtagcccaacccagggggtgactaaaatactataagaaccttaaatttmtctgcagatgggatataaagtgtccaaaaggaaggctcagattgcccaccaatgggttcaatatttaaggtgtatcttaacacccagagcccagcaaata

SEQ ID NO: 25812 - DNA, 201 bp, Homo sapiens
tagcccaacccagggggtgactaaaatactataagaaccttaaatttctctgcagatgggatataaagtgtccaaaaggaaggctcagattgcccaccaaygggttcaatatttaaggtgtatcttaacacccagagcccagcaaatatccccagaatgagtgcaagccgtatgtggtttggagctcctcccacaccaagc

SEQ ID NO: 25813 - DNA, 201 bp, Homo sapiens; identical to SEQ ID NO: 5094

SEQ ID NO: 25814 - DNA, 201 bp, Homo sapiens
ggacacaactgtatgatgggggaaaggttaaccaaataccaggctatgctcctggaaaatctagatgtgacccttaaaacctgtaacactgtgaatccagyttgattgctgcccacaggcccaataattaatcattcctgcgagcaagttattgcacatacatatgttagccagcctgatttaaaaggttgacctctccca

SEQ ID NO: 25815 - DNA, 201 bp, Homo sapiens
cctgtaatcccagctactcgggaggctgaggcaggagaattgcttgaacctgggaggtggaggttgcagtgagccaagatcacgccattgcactccagccygggcaacaagagcaaaactccatctcaaaaaaaaaaaaaaaaatagtaaatagtccaggcttggtcgctcacacctgtagttccagcactttagaaggcc

SEQ ID NO: 25816 - DNA, 201 bp, Homo sapiens
gagggcctgcgctggagccggcttgacagggtctgagggggagtggagaactgggcgaggaggttcccgtgggtgagcgcgtacgggatggctggctcgcrggacggccgaaggtggtggttggtgggagcagccagcgacgagcccgtagacactcgtacgcgtgcgggctgacgtgcgcgctacatggccggagtcggg

SEQ ID NO: 25817 - DNA, 201 bp, Homo sapiens
ttcattacgttcctctggagtatcttcatcctcttaaaagattccacaaatccatgtttccctgtaataattctctttcttgaactttctagaaatgataygcagtattccacttacatgctttgggtttttgttttgttttgtttttttggtcagacataatcttgcactgtcacccaggctggagtgcaggagtatagt

SEQ ID NO: 25818 - DNA, 201 bp, Homo sapiens
gtcccatggaggaggaggcgagccgcagcgccgcggcgacgaacccagggaggtaggttgtcatgggactcggccggccaccctggcaattccagtcaaayggcaagccagactcgctttgccggtcccttcctctcctgcccctgcagccgccaggaatggaacagtcccgcggtggggactgtgggaggcgcacgcgcg

SEQ ID NO: 25819 - DNA, 201 bp, Homo sapiens
ctaggaatggaggacacaggacatttgtaatttcttccttctctcttttatcctccctttgtactcattatccaagttctagaattacatgataatctccrggcctgggtaaggcatggaggcagtggacagtataggaatatgggaggtagagatctgaggctcagtgctaagaattggactacagcaatatgaggggta

SEQ ID NO: 25820 - DNA, 201 bp, Homo sapiens
attggactgtggtctttgtagaaatttcatatgcagagtcccttggaaagatgccttgagcttgtctcaggtccctaaacttagaaagtcctattcttttycccaaattctgacatgtgctggatcagagtgttctcatttccaataggccagtctgccatccatccaggaagaactgcggcacatggctgatggtgctag

SEQ ID NO: 25821 - DNA, 201 bp, Homo sapiens
ggtggtggttggtgggagcagccagcgacgagcccgtagacactcgtacgcgtgcgggctgacgtgcgcgctacatggccggagtcgggcgaagcgggggrccgtggggaagaacgcgaggagggaggagtgggaggttgggggtgtcgctaggcgcccttagctccctccctctggaggagctgccgcggccactctgct

SEQ ID NO: 25822 - DNA, 201 bp, Homo sapiens
tgtcgctaggcgcccttagctccctccctctggaggagctgccgcggccactctgctgccgccgctgccgccgccattttgggttcgctttgcgaggggaracgatcccagtgtcggttgcgggatccgcctcctctcagtttgcccctttagccctccacctttcccttctcctctctcgcatttccgccagtcggctta

SEQ ID NO: 25823 - DNA, 201 bp, Homo sapiens; identical to SEQ ID NO: 5100

SEQ ID NO: 25824 - DNA, 201 bp, Homo sapiens
tgtttgtgtatgtggtcttgtgtgtgtgtgtgtgtgtgtgtgtgtgtgtgtgtgtgtgtttctcttgatccaccaccaccccattcaccagcctgacagargacagtgtttccagaaggaatgtaattcatgcgcatttttttcatgttaagttttataagaagaccaaacagctgccagtcctaggaaaatgctgtgaag

SEQ ID NO: 25825 - DNA, 201 bp, Homo sapiens
tgtgtgtgtgtgtgtgtgtgtttgtgtgtgtctgtgtctgtatgtatgtatgtatgtatgtatgtattgagatggagtttcgctcttgtcgcccaggcccrgcctatatactttttctcaactctttttacttattgattgattgattgagatggagtctcgctcttgacccccaggctggagtgcaatggtgcgatcttg

SEQ ID NO: 25826 - DNA, 201 bp, Homo sapiens
aattagctggggatggtgccgagtgcctgtagtcccagcaacttgggagactgaggtaggaggatcacttgagcctgggacgttgagactgtagggagccrtgcttatatatcactccagcctgggtgacagagtgagaacctgtctcacaaaaacaaaaccatactttacctcataaaaattgcctcaaacttttggaca

SEQ ID NO: 25827 - DNA, 201 bp, Homo sapiens
ggcttacccgctggccgcctcctgacaagcgggagggatccgcggtggacccagggaagcggaggagcctggcggccaccccctcttcctcacttccctgyactctcatcgctctcggcctccgacacggtgagtagaacgatttgggccggcattcgggcctaagcactctctcagcgattgaatcctgggctttctggg

SEQ ID NO: 25828 - DNA, 201 bp, Homo sapiens
acatttgctagtattctaaaacttccttggtgatcaacaggatgtcttcatctcttactgtattcagaggaggatgaggagtacttggttgtaggcattaytctgagaccaaaagacaaaacaattttaaaagtaatggtcctggtcgggtgaggtgactcatccctgtaatcccagcactatgagaggccgaggcaggcg

SEQ ID NO: 25829 - DNA, 201 bp, Homo sapiens
cggtgagtagaacgatttgggccggcattcgggcctaagcactctctcagcgattgaatcctgggctttctgggagccactgtcatctcccggacctggayctctgggagagcagtggtgaagatgggggaggggagagcagggagggggatcctgagcctaccgggaagtccctccaggcggggtgaaggggtgtccctg

SEQ ID NO: 25830 - DNA, 201 bp, Homo sapiens
gtagaacgatttgggccggcattcgggcctaagcactctctcagcgattgaatcctgggctttctgggagccactgtcatctcccggacctggacctctgrgagagcagtggtgaagatgggggaggggagagcagggagggggatcctgagcctaccgggaagtccctccaggcggggtgaaggggtgtccctgacaggc

SEQ ID NO: 25831 - DNA, 201 bp, Homo sapiens
cgttgaacggtatgtgggaacgacaggatgatctcagtgttgtacgtttaataaatgtcactggttagtttgtacatggaaagagatgtttttggtctagmagacagatggtctgttggtgtgtagcggctgtgttggtgtgtgtatgtgaggatggcaagtgtttccgtaagagtttgcctttatttgtgtaagtgtaat

SEQ ID NO: 25832 - DNA, 201 bp, Homo sapiens
actggttggcttgtatttgggggagaccgattgtgtcagatatgtatgtggaacgtagctgtccttgccgagtctgacctgtatgaaatgcatatccatgrctatattattttggatttatggaggaagcagagcatttctgacacttaaggttgtatgcgtgagggagaaggctttcacagcttaacttgtaccagagca

SEQ ID NO: 25833 - DNA, 201 bp, Homo sapiens
tttgtttttgagagagagtttcgctctcctcgcccaggctggagtacaatggcacaatcttgcctcactgcaacctctgcctcccaggttcaagtgattcyctttcctcagcttcccaaatagctgggattacaggcgcgtgccaacacgccctgctgatttttgtatttttagttgagacagggtttccccacgttggcc

SEQ ID NO: 25834 - DNA, 201 bp, Homo sapiens
cactgtagcctctgccacccggattcaagtgattctcctgcctcaatgtcctgagcagctgggtttacaggcacgcaccactacacctggctaatttttgwattgttagtagagacagggtttcaccatgttagccagtagccaagctgttctcatactcctgacctcaagtgatccacctgcctcagcctcccaaagtgc

SEQ ID NO: 25835 - DNA, 201 bp, Homo sapiens
aatgtcctgagcagctgggtttacaggcacgcaccactacacctggctaatttttgtattgttagtagagacagggtttcaccatgttagccagtagccargctgttctcatactcctgacctcaagtgatccacctgcctcagcctcccaaagtgctgggattacaggtgtgagccaccacgcctagccaaacccatctc

SEQ ID NO: 25836 - DNA, 201 bp, Homo sapiens
gccagcttctgttactgatgtaaggatgcagagtcctgtcaggagttaggtgtcaagtgaagtctccttgttatggggcagtgcagctgtaggccaagctrtatctgtttgggaagggagaaaaaacagtagctggcatccatatccacttctccgggtgagtggtgctggagaggtatgtaggactcaatgtggccagcc

SEQ ID NO: 25837 - DNA, 201 bp, Homo sapiens
cttctgttactgatgtaaggatgcagagtcctgtcaggagttaggtgtcaagtgaagtctccttgttatggggcagtgcagctgtaggccaagctgtatcygtttgggaagggagaaaaaacagtagctggcatccatatccacttctccgggtgagtggtgctggagaggtatgtaggactcaatgtggccagccacaca

SEQ ID NO: 25838 - DNA, 201 bp, Homo sapiens
gcgtgagggagaaggctttcacagcttaacttgtaccagagcagctgcatgggtgctgacagcttaacttgaaatctgtgggaggaaggatcctttttcaytcattcaacaaatataaccattcaatgaatggtccatgccttgaggtgaggatcatcaaggtgtctctgtaaatagcctggatgcaatctgaggggagtt

SEQ ID NO: 25839 - DNA, 201 bp, Homo sapiens
ctcggctcactgcaacctgcaaccttggtcttggtcttgaactcctgacctcaggggatccacccacctcagcctcccagagtgcggggattacaggcgtragacaccacgcctggccttgttttttgttttgttttgcttttttttgagaccgagtctcgctttgttgcccaggctggagtccaaaggcgcgatgatctt

SEQ ID NO: 25840 - DNA, 201 bp, Homo sapiens
tggtcatattaatattgaattataccaaggcctaactctgaggctttggtataatctaaaattagcagctttgtaaatgtcagagatagttaccttactaygtattaaaaccgtagtatcttcacatcagttaggagcttgagaagtcatcatgttcatgtcctgtggctcagggaagacagcacataaggaccctaatgg

SEQ ID NO: 25841 - DNA, 201 bp, Homo sapiens
atggggtgtaatacagaatcatttgatgcatgctaactactttgggaaaagatttgtgtaaggctgggagtttgactgttggctaaagtgaaaaggggggrttagtagggaatgaaaattgttcaggctctttgctcatcattgcaaagaattggatgtgttgtggacctaggaaaacactcaaattcagtcatccccgtt

SEQ ID NO: 25842 - DNA, 201 bp, Homo sapiens
ttctcagtaaagattgtatagacagtcccacggtcttcaggtttttactctgtgctacccaaacctacagtaaatactataaaagaaaacttattcaaacrtaatctttatctgcaaaaactattgaaaaacgttaccatttaactattgctgtaatatagggggttccttgaaatatgataacctgcttgttatagctac

SEQ ID NO: 25843 - DNA, 201 bp, Homo sapiens
agtcacctaggcattagtggagcaaaccctgaagcacctgcagtaaggagtctgaaacatacgtgctgacctttttgcctaaagttggcacttgtgttacrgcatccagaaagtagaggctttaattttttcctcattttgtggtggatttgcatctgcactttattctgttgtagcagcatataatcattaggtcgatgg

SEQ ID NO: 25844 - DNA, 201 bp, Homo sapiens
tgtccttgccgagtctgacctgtatgaaatgcatatccatggctatattattttggatttatggaggaagcagagcatttctgacacttaaggttgtatgygtgagggagaaggctttcacagcttaacttgtaccagagcagctgcatgggtgctgacagcttaacttgaaatctgtgggaggaaggatcctttttcact

SEQ ID NO: 25845 - DNA, 201 bp, Homo sapiens
agcaatatgaggggtaagtattaggaatcagatcaagataaactggggcctggtaaagatgaaagtcaggtggtaaagttcggtcatgtttagctttttaytctcttcattaagatcaactaactttatttaccataatgattgtagcataggtgatatctccattctgaatgaaatgttgacttgcaagttaggcgtaaa

SEQ ID NO: 25846 - DNA, 201 bp, Homo sapiens
agtgctaagaattggactacagcaatatgaggggtaagtattaggaatcagatcaagataaactggggcctggtaaagatgaaagtcaggtggtaaagttyggtcatgtttagctttttattctcttcattaagatcaactaactttatttaccataatgattgtagcataggtgatatctccattctgaatgaaatgttg

SEQ ID NO: 25847 - DNA, 201 bp, Homo sapiens
aggcatggaggcagtggacagtataggaatatgggaggtagagatctgaggctcagtgctaagaattggactacagcaatatgaggggtaagtattaggartcagatcaagataaactggggcctggtaaagatgaaagtcaggtggtaaagttcggtcatgtttagctttttattctcttcattaagatcaactaacttt

SEQ ID NO: 25848 - DNA, 201 bp, Homo sapiens; identical to SEQ ID NO: 5127

SEQ ID NO: 25849 - DNA, 201 bp, Homo sapiens; identical to SEQ ID NO: 5120

SEQ ID NO: 25850 - DNA, 201 bp, Homo sapiens
tgggactacaggcatgcaccaccacccccggctaatttttgtttttgtatttttagtagagacggggttttgccgtgttagccaggcatggttttaacatrttttgccatgttagccaggctggtctcgaacttctgacctcaggggatccatctcccaaagtgctgggattacaggagtgagccaccgcacccggcccta

SEQ ID NO: 25851 - DNA, 201 bp, Homo sapiens; identical to SEQ ID NO: 5132

SEQ ID NO: 25852 - DNA, 201 bp, Homo sapiens
ccaagtttgcatttttgacattaaagtttactttttaattaaaaaaagaaatttaaaaaaaaagagatgtcttctctttcagaatgtgccttgcacacgtkctcttctgaatgcctggctatttggtgaagttgcctggcctgctgattcctagtctatgaaagtggtgaaactgctttttctgcgcggcctacagagggg

SEQ ID NO: 25853 - DNA, 201 bp, Homo sapiens; identical to SEQ ID NO: 5126

SEQ ID NO: 25854 - DNA, 201 bp, Homo sapiens; identical to SEQ ID NO: 5129

SEQ ID NO: 25855 - DNA, 201 bp, Homo sapiens; identical to SEQ ID NO: 5130

SEQ ID NO: 25856 - DNA, 201 bp, Homo sapiens
tgttagctctgttcagaaataactccaagaacagtttcgatattttattttcatattgaaaatcagacagatttgcttcagcctcaaagagcctgtttatrtaaaattaaatgagtgctggcagtgaactgcactttttttttaaatgggaaattaaagaagctctgtgtaacttgattgcctctgtaaagaaaaaagaaa

SEQ ID NO: 25857 - DNA, 201 bp, Homo sapiens; identical to SEQ ID NO: 5125

SEQ ID NO: 25858 - DNA, 201 bp, Homo sapiens; identical to SEQ ID NO: 5123

SEQ ID NO: 25859 - DNA, 201 bp, Homo sapiens
gtttactattttcctagataggagcagttttagttgtttctatttatcctctaccatgacaacagcactcactccataggtcagggaagtgatgtgggaaktctgccagttgctgagtatatctattcaaattatgcactgcagagctgaggaaataatcgcaagatggtttcatggactcactgtacacgctgtgaaatg

SEQ ID NO: 25860 - DNA, 201 bp, Homo sapiens
agaggtgattaccaggacagatggaaggaaacagcttacaaaagtggcctttcactggctttctcccctctccccactttaggtgtctgtactcaaagatytcttggaccatttatatcctgagatgaacagcattggccatacagcattttaaagatctcatctgagaaacccattgatattggtgccaggaatgctaag

SEQ ID NO: 25861 - DNA, 201 bp, Homo sapiens
actttctcagtgttctataatgaacatgtattacttgaataagaaaagataaagaacactaggaattaaaatgaagtttattaccttaacttgatatatgwtatcattctgtaggactggctttgttggaagaaaagctcagatatagcaatgagaaataccaaaagtttaaggcagtggaagaaagcctgcgtaaagagc

SEQ ID NO: 25862 - DNA, 201 bp, Homo sapiens
catcctttaagttcttgatggaactggtctttgcaatccctccaggaaggcagtactgattttggtttactattttcctagataggagcagttttagttgyttctatttatcctctaccatgacaacagcactcactccataggtcagggaagtgatgtgggaattctgccagttgctgagtatatctattcaaattatgc

SEQ ID NO: 25863 - DNA, 201 bp, Homo sapiens
aactattttttaacagggtgacaaattgcaacattgtaaaggaaggcttaatagaaaaaaaaaatagtacatagtaatagaactgcttgctgagttccaaracttttagaacaaggtgaggggggaggacttttccttccaattccttcttcataacattggatggagtccttttggtgggtattttgacagcttcctttt

SEQ ID NO: 25864 - DNA, 201 bp, Homo sapiens
aatttactctgatttttctgaaagtgctatggaaaacaaattagaaataacgtcatgtgaaagaactttaggctattattcacactttctgcattcagatytcaattacagcttttgctagccaagtgatcttggatatgttatctaacttctctattcttcagtcatttcatcagaaaaatagtgataattaatagcttc

SEQ ID NO: 25865 - DNA, 201 bp, Homo sapiens
caggagctcaccaaccagtgttctgcccccaggaagttcccacataaccattgagagtgttactcaggctcatgagggcagaggaactttccaacaatttsttggtcagcattctgtcacatgggtgaggggagcaaagtaataccctacctaacctgtccatggaactccaagctttttgggggccaatctctgccagat

SEQ ID NO: 25866 - DNA, 201 bp, Homo sapiens
gtaaagttccccagtcacaacttagtggctgggagaagtatctagtgactggctgtcctaggaccccttggatagtgacagatctggaggacagttgtccrggacaggagagtaagactgagaaggctctgccaatgttcaggagacagttaacctcctggccctcaatgttcaagcatacccggggctctgtgagggtga

SEQ ID NO: 25867 - DNA, 201 bp, Homo sapiens
aacacttggctaatttttgtatttttagtagagatggggtttcaccatttttggccaggctagtctcaaactcctgacctcaggtgatccaatcatgctgycccctaaagtgctgggattacaggcacgagccaccacacctggaccttaaatggaaatttgtaaagcaatacaaatatattagaatatcaacttaggctg

SEQ ID NO: 25868 - DNA, 201 bp, Homo sapiens
ttcaaagggaatgcttccagtttttgcccattcaatatgacattggctttgggtttggcataaatagttcttattattttgagacacgtgccatcaatacstactttatggagggtttttagcatgaagggctgttgaattttgtcaatggccttttctgcatctattgagataatcatgtgttttttgtctttggttctg

SEQ ID NO: 25869 - DNA, 201 bp, Homo sapiens
tctgcatctattgagataatcatgtgttttttgtctttggttctgtttatatgatgaattacgtttattgatttgcatatgttgaagcagtgttgcatccsagggatgaagcccacttgatcctggtggataagctttttgatgtgctcctggattcagtttgccagtattttattgaggatttttgcatcagcattcatt

SEQ ID NO: 25870 - DNA, 201 bp, Homo sapiens
agcagtgttgcatccgagggatgaagcccacttgatcctggtggataagctttttgatgtgctcctggattcagtttgccagtattttattgaggattttkgcatcagcattcattagagatactggtctaaaattctctttttttgttgttgtgtttctgccaggctttggtatcaggatgatgttggcctcagaaaatg

SEQ ID NO: 25871 - DNA, 201 bp, Homo sapiens
cagctcagtctctgtatctgtcttgaatgcattcacggccactactactggaattccaaacattctggcattttcagtttgtttcttcaagttactgaagmctttttcaaccagctccaggttctcctctatgtaagccttgggaagaggcattccagcagtgaccatagggccacccctgtgcatctttagagcgctgac

SEQ ID NO: 25872 - DNA, 201 bp, Homo sapiens
ccatctacgacaaacccacagccaacgtaatactgaatgagcaaaaactggaacggttccccttgggaactggaacaagacaagtatgcccactttcaccrctcctattcaatatagtactggatgtgctagccagcgcaatgaagaaagggaataaataaaaggcacccaaataaaaagagagaaaatcaaactctctct

SEQ ID NO: 25873 - DNA, 201 bp, Homo sapiens
gggtacactaaatcagatatttaatttttgagccttggctttcttacagctaagatgaggatgctagattgactttgaaggatggttggaaggatataatrtaataatgtgtagagtgctttaaaattattaataatagtgataatgataccatttattggagacatgtatatgtttatattgatattaatgtaggtaata

SEQ ID NO: 25874 - DNA, 201 bp, Homo sapiens
ggcatattaaatcagtatatctaaagtcaacataaaagaaatacttctatgatcagcaagaaaaatgcatctagtcacctatgaaagaaaccccatcagastaagaatgagcttcttagcagaaacttcgcaggtcagaagaaaatggaatgggatttacaaattgctgaaagaaaaaaatacaataaaaatgtttatatc

SEQ ID NO: 25875 - DNA, 201 bp, Homo sapiens
agatacgtcccatcagtacctaattcattgagagtttttagcatgaagggttgttgaattttgtcaaaggccttttctgcatctattgagataattatgtsgtttttgtctttggttttgtttatttttgttcacagtaatcaacctgcattatttccccttcccagtactcttcccagcctctggtaatcaacattctat

SEQ ID NO: 25876 - DNA, 201 bp, Homo sapiens
aagggaaataaattttatacaaaaggatatctacactcatgtgtttataccagcattattcacaatagaaaagatatagaatcaactaaactgtcaatcartggattatcggataaagaaaatgtggtgtatatatacaatggattgtattcagccattaaaaaagagaataaagtcatttttttttttccagcaacatca

SEQ ID NO: 25877 - DNA, 201 bp, Homo sapiens
cctgatatttaagcaaacggttgtctgacagccacaagtcttctttagcaatgagtatgccattcacatcacgagatgtccacacagtaagatctcttccytgtgtcattttaactgcttcagatactgagactgctactgctgccactacccataaataatgaggccaaccctttgccactacatcaatttccttactca

SEQ ID NO: 25878 - DNA, 201 bp, Homo sapiens
ccatgctgaatcttgagctttaataatcaagatttgtacaaggaatcttggcttatagaggtctcaaaaacaagctctccagaggtggttttgctgctgtkgtttttgttgctgatgatgatgatttttgttaccctcaccacataattaagatagactttccaaacaagtttcaatctattattaaataagttgatttgg

SEQ ID NO: 25879 - DNA, 201 bp, Homo sapiens
ttaaggattttacttttcccattgaccttggtgaatctgatggctatgttccttgtggatggtcatcttgtatagtacctagctggagttctctgtatttstttgatttgcctgtcacactctccaataagattaggaaaatttttatggactatattttcaaatatattttccaagttaattattctctctcctctctca

SEQ ID NO: 25880 - DNA, 201 bp, Homo sapiens
caacaagtgtcctgtagtttttttgttgttcttgtgttctttcatgtttttaatatcgtggagatactggatttgtacaatgatttagagaggtattcctmcactttgattttttggaatagcctcagtaggatgacaccagatcttttctgtacatctggcaaaacctgactgtgaatctgtctgttcctgttcttttgt

SEQ ID NO: 25881 - DNA, 201 bp, Homo sapiens
tatctgtctagtgatatcagtggggtgttaaagtcccactattgatatgttgctatcaatctattttcttaggtctagaagtatattttttataaatctgratgttccagtgtctgttgcatatataatttaaataaataaatcttcttttattggagcttttcttaatatataatgaccttatttatattttagtaccat

SEQ ID NO: 25882 - DNA, 201 bp, Homo sapiens
tcagccatcctgctctgcctacacttccctataacaggtttgttgaggtataattcatataccatgcaatgtgcctatttaatgtatacaatgtaatggaytttagtacatttagagttgtgcaacaatcatcacaattttagaatattttcgtcattcctaaaagagacctcgtactcattatcagtcactctacaaccc

SEQ ID NO: 25883 - DNA, 201 bp, Homo sapiens
acgtctgactggtgtacctgaaactgacggggagaatggaaccaagttggaaaacactctacaggatattatccaggagaacttccccaatctagcaaggyaggccaacattcagatccaggaaatacagagaatgctgcaaagatactcctcgagatgagcaactccaagacacataattgtcagattcaccaatgttga

SEQ ID NO: 25884 - DNA, 201 bp, Homo sapiens
tctctcagcagaaactctacaaaccagaagagagtgggggccaattttcaacattcttaaagaaaagaattttcaacccagaatttcatatccagccaaaytaagcttcataagtgaaggagaaattaaatcctttacagacaaacaaatgctgagagattttatcactactaggcctgacctacaagagctcctgaagga

SEQ ID NO: 25885 - DNA, 201 bp, Homo sapiens
gaagagagtgggggccaattttcaacattcttaaagaaaagaattttcaacccagaatttcatatccagccaaactaagcttcataagtgaaggagaaatkaaatcctttacagacaaacaaatgctgagagattttatcactactaggcctgacctacaagagctcctgaaggaagcactaaacatggaaaggaacaact

SEQ ID NO: 25886 - DNA, 201 bp, Homo sapiens
ataaccagctaacatcataatgaaaggatcaaattcacacataccaatattaaccttaaatgtcaatgggctaaacgctcctattaaaagacacagactgrcaaattggatagagagtcaagacccatcagtgtgctgtattcaggagacccatctcacatgcagagacacacattggctcaaaataaagggatggaggaa

SEQ ID NO: 25887 - DNA, 201 bp, Homo sapiens
cttctggcctgaggaagccttaaagagaatattaagtgttagtgggattgtcatacagtcagtggggttgggtggggccagatgctctacagttgcctccmagcctggaaaaggctcaaggagagaaatgacattacataaggaagctggctagggacttcagctaagcaaactcatgcactatggttcctgcagggcagt

SEQ ID NO: 25888 - DNA, 201 bp, Homo sapiens
gaaaggaattacaacatacaattaaaaccttcaacagtagactaggccaggtagaataaagaatctcagaacttgaagataggtctttcaaattaatccastctgacaaaaaaagaaatagtttcaaaaaaagccttcaaaaagtttggaactatgtaaaatctccaaacctatgaatcgtaggtattcccaagagagaat

SEQ ID NO: 25889 - DNA, 201 bp, Homo sapiens
ttctgttttcctagtgttccaggcgccaccgggctttgagaaaaaactcctgcagctagctcagtgtctgcccaaactgctgcccagtgttttgcttgaarcccagggccctggtggtgtaggcacctgagggaatctcctggtctgtgggttttgaagactgtgggaaaagcgtgttatctggggccgtattgcaccatc

SEQ ID NO: 25890 - DNA, 201 bp, Homo sapiens
ggaaggggctcgcattggagaagctgctccaaactcgaatcagaaagacactaatttccttgtctgagaactggcaagtcttatgtttaaatcttcgatcyattttgagatgatttttgtgtatggtttaagataagggattaatttcattcttttgcaaatggatatccagatttcataaaataacttattgaagagatt

SEQ ID NO: 25891 - DNA, 201 bp, Homo sapiens
tgcctccatatctgggtgctttcaatgtgccaagggctctgtatgagttctttggctatatataacttttgtgtcgtggctttctcaaatgctgcttatcrtaatgatgcattggccatatgatctggcacactatcttctgtgagctgggagtgcagagctctcagaaagcttatcttgcacgttagcactatgctgtgt

SEQ ID NO: 25892 - DNA, 201 bp, Homo sapiens
aaacagctcgcacgtttgagcagaccaattattaggcaattttcttaactctgcttctacaagagtttccctcaattattgaatacccattgtgttttttyctcaatcacctgggaggaaccatctattgtcctgtcctgaagggagtccctcctaggtctgttcagacatttgtatggtaattaagatttaaatcccctg

SEQ ID NO: 25893 - DNA, 201 bp, Homo sapiens
tgcctttcttgaccacaaagaaaggggtctgggctgctggattctagtggtcctttaccagcaagcctgacattgcctttgcactcaggggcgagttctaragctgggctgggttcctgagtatttcataataacccatttgccccatcaagatgcattcctacaaacaaccgttcttatgcaaattcatttcagagaggg

SEQ ID NO: 25894 - DNA, 201 bp, Homo sapiens
ggtcttagatttaggtatctgatccatcttgagttgatttttgtgtaaggtgagagatgaggatccagtttcattatcctagatgtggttagccaattatmccagctttatttgttgaatagggtgtccttttcccactttaggtttttgtttgctttgtcaaagatctgttggctgtaaatatttggatttgtgggttct

SEQ ID NO: 25895 - DNA, 201 bp, Homo sapiens
aatggaaacaggccaaatgccccaattaaaagacacagactggcaaattggataaaaagtcaagacacctcagtgtgctgtattcagaagatctacctcawgtgcaaagacacacataggctcaaaataaagggatggagggatacttatcaagtgaatggaaagcaaaaaagaacgtgagttgcagtcctaatctctgat

SEQ ID NO: 25896 - DNA, 201 bp, Homo sapiens
acatggaaattaaacaacatgttcctgcataatctttgagtcaatgaaaaaatgtagacataaattaaataatatttgaaacaaatgaaaatggaaacaamacatacctaaacctttgtaatacagcagaactggtatttacatggaagtttataatgttaaatgcctacatcaaagtaataaaaagactacaaattaaca

SEQ ID NO: 25897 - DNA, 201 bp, Homo sapiens
actgatgctagtcaatccatccacatccttttcaggtgcaatagcattgatcactccttcagtgtattgtctgagtctagagatagctgcactacgaaccygtgtacagtagagtcttcattcaaagatatgatgtacttgatcacctcagattctgtggttgttcttggtaacttaatgtcagtggctttcatcccaatc

SEQ ID NO: 25898 - DNA, 201 bp, Homo sapiens
ccagggatgaaacccacttgatcatggtggataagttttaattgatagaccactagcaagactaataaagaagaaaagagagaagaatcaaatagacgcawtaaaaaatgataaaggagatatcaccaccaatcccacaggaatacaaactaccatcagagaatactacaaacaccgctatgcaaataaactagaaaatct

SEQ ID NO: 25899 - DNA, 201 bp, Homo sapiens
cgcctgagtgagggctattatttctgccagctgagcactagttcctggagtgaggggattactttcaagtattccattatcactgaccactgcataatacrctttttaaagtcctttttctacaaagaaacttccatcagtatacaatttgaggtcggaatcagtcaagggaacctctagaaggtcccctcgagtggtgta

SEQ ID NO: 25900 - DNA, 201 bp, Homo sapiens
aggatttttacgtatgagaacatgtcatctgcaaacacaattttgcattttcctttccaatttgcatgctatttatttatttatttatttatttatttatttatttgcctcattgctctggctaagacttccagtgacatgttgaatagaaatagccaaagtgaacacctttatcttattccttatgaggaaaagctctca

SEQ ID NO: 25901 - DNA, 201 bp, Homo sapiens
ggatttttacgtatgagaacatgtcatctgcaaacacaattttgcattttcctttccaatttgcatgctatttatttatttatttatttatttatttatttatttgcctcattgctctggctaagacttccagtgacatgttgaatagaaatagccaaagtgaacacctttatcttattccttatgaggaaaagctctcag

SEQ ID NO: 25902 - DNA, 201 bp, Homo sapiens
gatttttacgtatgagaacatgtcatctgcaaacacaattttgcattttcctttccaatttgcatgctatttatttatttatttatttatttatttatttatttgcctcattgctctggctaagacttccagtgacatgttgaatagaaatagccaaagtgaacacctttatcttattccttatgaggaaaagctctcagc

SEQ ID NO: 25903 - DNA, 201 bp, Homo sapiens
gtcatcagcaagcagagataacatgactacttctttttaaatttggatccctttcctctggctagaactgccagtactatgttgaataggagtggtgagastggagatccttgtcttttttcagttcttgttttttttgtttgtttgttttttgtttttggcaaaactatttccttttattctgtggaacgtcactaacgt

SEQ ID NO: 25904 - DNA, 201 bp, Homo sapiens
atttttacgtatgagaacatgtcatctgcaaacacaattttgcattttcctttccaatttgcatgctatttatttatttatttatttatttatttatttatttgcctcattgctctggctaagacttccagtgacatgttgaatagaaatagccaaagtgaacacctttatcttattccttatgaggaaaagctctcagct

SEQ ID NO: 25905 - DNA, 201 bp, Homo sapiens
tctactttttattatttctttccttcagataaggttggctttatagtgttcttctttgcctagtcccttgaggtgaaaagttaggtagttagtttgagatcttttttttttttaaattttatttaaaaaattgtattgtattttggtaagaacatttaacatgacatctaccctcttaactgatttttaagtttccaaaca

SEQ ID NO: 25906 - DNA, 201 bp, Homo sapiens
tgatgattagtgttgttgatttttttttttcatatacctaggggccagttgcatgtctcctttgaagaaatgtctattcaggttgtttgccaatttttcarttaagttatttgtttctgataagttctatgaattccttgtatattttgaatattaatcctatatcaaatatatgttttacaaatgttttatcccattcag

SEQ ID NO: 25907 - DNA, 201 bp, Homo sapiens
aaccaaataccgcatgttttcactcataggtgggaattgtacaatgagaatacttggacacaggaaggggaacatcacacaccagggcctgttgtggggtkgggggagtggggaaggatagcattaggagatatacctaatgtgaatgatgagttaatgggtgcagcacaccaacatggcacatgtatacatatgtaacaa

SEQ ID NO: 25908 - DNA, 201 bp, Homo sapiens
aatttgtctttttaaaagcaagagttcatttgggaaagaagaataataaggggaacagacctaccaaattttaaaagtaatttttaaactactattcaatktaataataatacagcttattacgtggaagcaatggaagacaaagaaggcccttacataatggtaaagggatcaattcaacaagaagagctaactacccta

SEQ ID NO: 25909 - DNA, 201 bp, Homo sapiens
aaccattttccatacacagatgatgccaaaatctgcctcttcagctcacttttttcacttaagctagaggactgtctatttactactacaggaagactggscatttcagataactgagactcaatatatctaaaactgatattatttttctttcaagctccagaaacctgatccactactttgattcttacccaatcccag

SEQ ID NO: 25910 - DNA, 201 bp, Homo sapiens
gccatttttacagtattgattcttgctatccatgagcatgaaatgtttttccacttgtttgtgtcctctcttatttccttgagcagtggtttgtacttctycttgaagaggtccttcacatcccgtgtaagttgtattcgtagatattttattttctttttagcaattgtgaatgagcgctcactcatgatttggatatct

SEQ ID NO: 25911 - DNA, 201 bp, Homo sapiens
tagacgtgcaggtgcatgtgtcttttaggtagaacaatatttggctttcaatatatacccagtgatgggatgattgggttggatcacagttctattttttkgggggggggttactttcaacttttacttcagaaacaggggatacatgtgcaaggtttctaaaaaggtatattacatgatgctgaggtttgaggtatgatt

SEQ ID NO: 25912 - DNA, 201 bp, Homo sapiens
tcttgagttaagttttgaatatggtgaaatgtattttgcacatgactagccagttatctaaacaccatttattgataggtacttcattccccattgcttgytattgtcaactttgtggaagaccaggttgttatagatttgaagctttatttctgggttctctatcctgttccattggtctaggtgtctggttttataaca

SEQ ID NO: 25913 - DNA, 201 bp, Homo sapiens
taacaaaggcttaactaaggcattgctggtgatgttgcaagaaagaaattagaataaaatatggaaattaggaaacatcaatttcattaaatgagtatatrtggatgctgaaagagaagaattaagtatgacatctgtatttattgtttacgtgacttggtgtcatcaactgagtcaaataatataggatatgacatttta

SEQ ID NO: 25914 - DNA, 201 bp, Homo sapiens
ctctatctcagggagatgggagtttaatctgtaagctgctgactggggctgttgcctttctttcagagatgcccttccaagtgaggaggaatctagagacrcagtctggctacagtggttttgctgagctgtggtgggctccccccagtttgaacttcctgaaggctttgtttacactgaggggaaaaccacttactcaag

SEQ ID NO: 25915 - DNA, 201 bp, Homo sapiens
tctagtatttattcatcttgcataaccaaaactttatatcacatgaatagcaattccccatttctccctttctccatctcctgacaatcatcatttcactstctgcctctatgagtttgacaaatttagataactcatataagtggaatcacacagtatttgtccttctgttttatttagcataatgtcctcaagatgcat

SEQ ID NO: 25916 - DNA, 201 bp, Homo sapiens
tttgcagggacatggatgaatctgctctactttttattatttctttccttcagataaggttggctttatagtgttcttctttgcctagtcccttgaggtgraaagttaggtagttagtttgagatcttttttttttttaaattttatttaaaaaattgtattgtattttggtaagaacatttaacatgacatctaccctct

SEQ ID NO: 25917 - DNA, 201 bp, Homo sapiens
tccatattttattctacgttcagggggcacatatgcgggcttattacatgggtaaattgtgtgtccatgtggtttggtgtacaaatgatttcatcattcasgtagtgaacacagtccctgataggtagttttttgatccttgccctcctcccatcctccacctttaagtaggctctggtttctcttgttttcttctttctg

SEQ ID NO: 25918 - DNA, 201 bp, Homo sapiens
acaggaataaacatttttttgaattcgaattgtaactatgcctgttactaaatatgcacttttgttattttaaataacctccagagtctcagtttccccayctttgaaaatgagataatacttacctcttaggttagttctgaatacaaaaacatgtgttggttaaacatgtgccaaaattgtttgtttctaaaatttaaa

SEQ ID NO: 25919 - DNA, 201 bp, Homo sapiens
acaaaccactgctcaaggaagtaaaaccggagcaaaacaaatggaagaacattccgtgctcatggataggaagcatcaatatcgtgaaaatggccatactrcacaagatgatttatagatttaatgccatccctatcaagctcccaatgactttcttcacagaattggaaaaaaactacttagtttcctatggaaccaaaa

SEQ ID NO: 25920 - DNA, 201 bp, Homo sapiens
ttactagtagtttgttgaatatatttgcatccatgtttatcagggatattggtctatagttttcttgtagtaacagtatatggtttggtatcagggtaacrctggctttgtaaaatgagtttggaaatattatattcaatttttggatgaatttgaagatgattagtattatttaaaaaaaaagttagatagaattcttct

SEQ ID NO: 25921 - DNA, 201 bp, Homo sapiens
agcaccctctttttatagtccctttgaaatcatatatggccaaacttttgtcttggggtctccacccttaccagactctgagccactcagatattacctcycctccttaatccagacatggtctttcattcgtgaagcagcaaataaggccatgcctctccctgttaacacctttttgtcctctgaacgtaactgtcttac

SEQ ID NO: 25922 - DNA, 201 bp, Homo sapiens
gtaatcccatctgtctatttttgttttattgactgtgcttttcatgtaccaccaaaaaaaattattgatcagactaatgttatgaactgttttccttgtgkttttttctgatagttttatagttttgagtattatacttaagtctataatctattttgaaatgatgtttgtatgcagttaaagataagggtctagtttcat

SEQ ID NO: 25923 - DNA, 201 bp, Homo sapiens
taggtcaagatcaaaactacccactcttggtagactgaggactatgaattttatcttcctagcacaatgaagtcaccaaaagtacagatcttcctctcacscattactttagactcagcaaatattcctttcccccagagaaaaataggttccatgttctggactcaacactagattccttttctgttatagacctctgtc

SEQ ID NO: 25924 - DNA, 201 bp, Homo sapiens
catgtttttgtcctttaatctccataccagaattagaagtgatttataaaccaatattatagtatcacaggatttaatatctgtctgcgtatttacctctrccagagatctttgttatttatggttttatgttgctaacaagtgtcttttgatttcaacttgaaggactccttttggcaattcttgatggcaggtgtaaag

SEQ ID NO: 25925 - DNA, 201 bp, Homo sapiens
ggcagagtgcagtggggtctgcacatgtgtgcacaccaccagcagcagcatggcagtgttcacatgtgcatgtgccagcacatctgtaggggagactgtgrgtgagtgcacatcagcagaagctgcgggtggtgcttatcagcagaagctctctgatggttaagcaagatctgtcagtgtaggagctatgaagttggctgc

SEQ ID NO: 25926 - DNA, 201 bp, Homo sapiens
tcataatgaaataaagcgtgaagacaagattagagaaaaaagaataaaaagaaacgaacaaagtttccaaagtatatgggaccatgtgaaaagaccaaacytatgtttgattggtgtacctgaaagtgatggggagaatggaaccaagttggaaaacactcttcaggatattatccaggagaacttccccaacctagaaag

SEQ ID NO: 25927 - DNA, 201 bp, Homo sapiens
agccactgcaaaaacataccaaattgtaaagaccatggacactatgaagaaattgcatcaattaacggacaaaacagtgagcaagcatcataatgacaggwtcaaattgacccataacaatattaaccttaaatgtaaatgggttaaatgccccagttaaaagacacacactggcaaattggataaagagtcaaaacccat

SEQ ID NO: 25928 - DNA, 201 bp, Homo sapiens
tattgaaatatgagtttggagccaaagaatgttttttaaataagattgttatcatagtgctattgtggcaggccaggtctccattagcaaccagaacagtsagtttccactaaccctttactatagttctgatgaatgtataagttaaacattaaagaattggagaaactagtgctttagtacaagggctgggatgtgaaa

SEQ ID NO: 25929 - DNA, 201 bp, Homo sapiens
cttccaaaaaattcattaggagataacacttccaaactcattttgcaaggccagtattagtccaaagcctgacaaggatactacaagaaaagaaaatatargtgaatatccctgatgaacaaaacacaaaaattctcaacaaaacgctggccaactgaattcaaatgcatattaaaaggatcatacaacataatcaagtgg

SEQ ID NO: 25930 - DNA, 201 bp, Homo sapiens
tcccattaaaaagtgggcaaaagacatgaacagacacttttcaaaagaagacgcatatgcggccaacaagcatattaaaaaaagctcaatatcattgatcwttagagaaatgcaaatcaaaaccacaatgagataccatgttgcatcagtcaaactggctataattataaagtcaaaaaataacagatgatggtgagtttg

SEQ ID NO: 25931 - DNA, 201 bp, Homo sapiens
ttagaggttgtaggttaaaacaaaacaagcccctgggatcccaccaagcatgcttttggtgggctaggaagataaattttgtgaccaggatctacttttcyaacaaaggagactttcattctatcaataaatttccatatgcatgatatgcttggaagattcaagccagcctaggggccctcttggaatataaagatacta

SEQ ID NO: 25932 - DNA, 201 bp, Homo sapiens
actgttataactggtctataaatgtcttgttttcttctaactcttagaacagtgataaaaattcattggcatgcatgtagtccgtgttacagcctagatgraacaagcacatatgctcatgtgtcatttctgactcagtggtatctctacaaactctcaaacttcttgtagaaattttttatgttggcctaccagggagat

SEQ ID NO: 25933 - DNA, 201 bp, Homo sapiens
cctgatgcatttataactgaccagaaaagctggcagatttgtaaagagattcctcctctgctcatgagatataggaatgcctacaaccaggtctatggtaytatgtagatcaataactgtcttatgaggagtagctagccaggggctttttcttctacttctgttatgactagtagagatatgtcattttgtgtcattgtt

SEQ ID NO: 25934 - DNA, 201 bp, Homo sapiens
aatactatcatcaaaactgattacacaagttcatctgttaatgttcatttttattgagattttatatatttacacttcaaaaatttcttttcacacatatrgaaacatatatgaattttaaaatatgcatcttcatgaaagtccaaataacactatttggactatagtttgagttcagaaattatatctgctgaaaatttg

SEQ ID NO: 25935 - DNA, 201 bp, Homo sapiens
ctctttatctgtgatttttgactgcttgattataatttgtcttggtatgagtctgcttgggtttatcttagagtttcattttttagcttttcccatttttrtgtaactttcctcaaaattgagaagtttttggccttctttcttcaaataattcctcttcccttttacttttttatgggtatttcatatgcatacatttgt

SEQ ID NO: 25936 - DNA, 201 bp, Homo sapiens
tttccttaatattgtgtcctttaggttgatcccttctgccattaatgacaggatttttccatttttatagcagaatagcataccactgtgtatgtataccrcattttctttgttaattcatctgctaaaggacacttaggttgattccttttattggcaattgtgaatgatgctttataaacacaggagtgcagatatgtt

SEQ ID NO: 25937 - DNA, 201 bp, Homo sapiens
tgatagaattcagcagtgaaaccatcaggttactgcttctatctcattactcataattagtttgctcagattttttatttttccatggctcaccatcttargttatatatgtaaatacttttttttagtttttcaaaattactggcatatagttattcataataacttctttctttctttctattaatttaaggtttggca

SEQ ID NO: 25938 - DNA, 201 bp, Homo sapiens
gctttgtcaaaaaatatgtgaccataagtgtgtagaattaattttgggttctcaattttgtcgcattgatctttgtttttatttttatacaagtaccatgycgttttggttattattgctttatacagtatttggaagtcaggtaaggtgatgcctccagctttgctccttttttatttgttttattttttattctgatat

SEQ ID NO: 25939 - DNA, 201 bp, Homo sapiens
ctctttcaggaatgccaattctttgtaggtctggtctctacataattctatatttcttggaggtattgtttattttaaaaagaattaaaatttctttctgrtagagttgatttgaagaactggccttaaaatcttattctattttgctcatcttagtctgtcttcctgttaataatttctgattgtattacagaattcttg

SEQ ID NO: 25940 - DNA, 201 bp, Homo sapiens
gtttggggataagaagacattctggcttttagagtttcagagttcttgcactggttgttttgtatgtgtgtgggctgatgttcatttaatctttgaagtcrctcttctttgtatggtgctttttgcttgtattttctttggtgtccttgaaggtttgactggtataagttgggtttagttgatggccttcatttctagatg

SEQ ID NO: 25941 - DNA, 201 bp, Homo sapiens
cctgactgtctatcctttcaggtgtggttcccaacaaaggtcagtttcccttggctgtgggagcccaggagttgtttctgtgcactggtcctatgtgccgytatgctgaagacctggcccccatgttgaaggtcatggcaggacctgggatcaaaaggtatgttcatttatttttatttccttggactcttatcctgacat

SEQ ID NO: 25942 - DNA, 201 bp, Homo sapiens
aaacaacttgatccatggagaacagagaaaagcaaggcaggacgatggcccactcgggagtgacacagagccaagggaacctctctcacccagggaagtgrtgagtgaacatgtgaccacaggaaaccacacttcttctatggagctttgcaaactttgggtcaggtggtccccttgtgaacccactccacgtgggccttc

SEQ ID NO: 25943 - DNA, 201 bp, Homo sapiens
cactccacgtgggccttcagtctgacacagagagctacatggagtcttggcaaagcatccactcaggcatgcacgagactcaggagctttagatactccasctttctgggcttcctggcagaagtaactgcaaccccaggtggttagacccctgtacatacccctaagaaagaagttgaatccagggggccaagctgcaat

SEQ ID NO: 25944 - DNA, 201 bp, Homo sapiens
gactgttagaaggaaaataaacaaacagaaaggaatagcacatccactcaaatgccccatctgaagttcaccaacatcaaagaccaaaggtagataaatcyacaaagataggaaagaaaaaaaaaagtgctaaaaggatataaataccaaaatccagaatgcctctcttcctctgaaggatcacaactcttcaccagcaag

SEQ ID NO: 25945 - DNA, 201 bp, Homo sapiens
aaggagtccagtttctgttttctgcatatggctagccagttttcacagcactatttatttaatagggaatcctttccccattgcttgtgtcaggtttgtcraagatcagatggttgtagatgtgtggcgttatttctgagacctctgttctgttccatttatctatatgtctgttttggtaccatgctgttttggttactg

SEQ ID NO: 25946 - DNA, 201 bp, Homo sapiens
acatcaaagaccaaaggtagataaatccacaaagataggaaagaaaaaaaaaagtgctaaaaggatataaataccaaaatccagaatgcctctcttcctcygaaggatcacaactcttcaccagcaagggaacaaaactggacagagaatgcatttgatgaactgacagaagtagccttcagaaggtgggtaataacaaac

SEQ ID NO: 25947 - DNA, 201 bp, Homo sapiens
gctattcagtaaagcaatatttcatatcctttcttcactgtttatttttgtcaactttgtcaaagttcagttttttataggtatgtggctttatttcttgrttctctatttggttccattctatgtctccatttttttaccattaccatacagtctttgttactatagttttttagtatattttgaagtcagataatgtgg

SEQ ID NO: 25948 - DNA, 201 bp, Homo sapiens
gtatctcagaccagagtgcaatcaaattagaactcaggataaagaaactcactgaaaacctcacaactacatggaaactgaacaacctgcttctgaatgaytactgggtaaataatgaaataaaggtaggaataaagacgttctttgaaaccagtaagaataaagacacaacgtaccagaatctctggacacatttaaggc

SEQ ID NO: 25949 - DNA, 201 bp, Homo sapiens
ttgtaatgataggagttatgtttagtctgtagattgctcttggcagtatggtcgttttaactagtgatacttccagtccatgagcataagatctttttctrtttctggcatctatgatttattatatcagtgttttgtatttctccttatagtgatctttaacctccttggttaaacatatttctagtattttatttttgt

SEQ ID NO: 25950 - DNA, 201 bp, Homo sapiens
gtagatagtattttatataggtatcatatacgttacttctgtgtctctattgctaagtaaacacttctcagcagctctgaggtattagagggccaaaaacytggattattttctttgtaatattctgtttaatgggtagtacagttcttcttagcacaccatgacatagggtgccatcgtgtagctctcagccattcatgt

SEQ ID NO: 25951 - DNA, 201 bp, Homo sapiens
cttctgtgcaataaaataaattaccaatagaatcaacaaacagtaacagaatgggagaaaatatttgcaaactatacatccaacaaaggcctactatccaraacctacaaaaaacttaacaaatcaacgtgcaaaaaagaaaccacctgaacaaccacatgttgggtactatgtttatgacctggaagataggatcactag

SEQ ID NO: 25952 - DNA, 201 bp, Homo sapiens
gtataaggtgtaaggaagggatccagtttcagctttctccatatggctagccagttttcccagcagcatttattaaatagagaatcctttccccatttctkgtttttctcaggtttgtcaaagatcagatagttgtagatatgtggcattctttctgagggctctgttcttttccattgatatatatctctgttttggtac

SEQ ID NO: 25953 - DNA, 201 bp, Homo sapiens
gacttcaaactatactacaaggctacagtaatcaaaacagtatggtactggtaccaaaacagacatatagaccaatggaacaaaacagagccctcagaaamaatgccgcatatctacaactatctgatctttgacaaacctgacaaaaacaagcaatgcggaaaggattccctatttaataaatggttctgtgaaaaccgg

SEQ ID NO: 25954 - DNA, 201 bp, Homo sapiens
aagaaaacctaggcaataccattcaggacataggcatgggaaaagacttcatgtctaaaacaccaaaagctatggcaacaaaagccaaaattgacaaatargagctaattaaactaaagagcttctgcacagcaaaagaaactatcatcagagtgaacaggcaacctacagaatgggagaaaatttttgccgtctatccat

SEQ ID NO: 25955 - DNA, 201 bp, Homo sapiens
agtaccatgctgttttggttactgtagccttgtagtgtagtttgaagtcaggtagcatgatgcctccagctttgttcttttggcttaggattgacttggcsatgtgggctcttttttggttccatatgaactttaaagtagtttttttccaattctgtgaagacagtcattggtagcttgatggggatggcatcgaatcta

SEQ ID NO: 25956 - DNA, 201 bp, Homo sapiens
tttcttctgaaactattccaaacaatagaaaaagagtaactcctccctaatccattttatggggccagcatcgtcctgataacaaaccctggcagagacamaacaaaaaaagaaaatttcaagccaatatccttgatgaacatctatgcaaaaatcctcaataaatactggcaaactgaatccagcagtacatcagaaagt

SEQ ID NO: 25957 - DNA, 201 bp, Homo sapiens
tacacattaagtagaagctatcaaaaaaataaattaagaaaaccatatcatttgtaatggcatcagtaagaataaaatagataggaataaatttaaccaargaggtgaaacattatggcattcaacactttaaatgtgtgaattgtatgatatatgaattgtatctcaataaagctgtttaaataacaatgtactatattc

SEQ ID NO: 25958 - DNA, 201 bp, Homo sapiens
ttgaagtcaggtagcatgatgcctccagctttgttcttttggcttaggattgacttggcgatgtgggctcttttttggttccatatgaactttaaagtagtttttttccaattctgtgaagacagtcattggtagcttgatggggatggcatcgaatctataatttaccttgggcagtatggccattttcatgatattgat

SEQ ID NO: 25959 - DNA, 201 bp, Homo sapiens
aaaaggccctccataaaattcaacaccctttcatgctaaaaactctcaataaagtaggtattaatggaacatatctcaaaataataagagctatttatgasaaacccacagccaatatcatactaaatgggcaaaaactggaagcattccctttgaaaactggcacaagacaaggatgccctctctcaccactcctattca

SEQ ID NO: 25960 - DNA, 201 bp, Homo sapiens
ctgtttcagggtccaaatcagtatcataaaaacagggctgggtggggagtccattgtgctcatcgttcctactaaagggtacagaaaaccagccccgatgytggcatggatgttgcgaatgggcagaatgaatcctgtagggacaccttttcgctctgggttgtgagacaaggacaagtgtgttttggccatgcagatggg

SEQ ID NO: 25961 - DNA, 201 bp, Homo sapiens
caatgaaatcaaagagaaagctgaaaagcaatacaaagaaataaaaaatcaattaaggatataagtgagaaatttaccaaaaagatagatattaaaaaacaaaaaaaatctgaaaataaaaaattagaaaggaattacaacatacaattaaaaccttcaacagtagactaggccaggtagaataaagaatctcagaacttg

SEQ ID NO: 25962 - DNA, 201 bp, Homo sapiens
tacccttgcccccttctgccagtgagtgcacttcacggcatcaaaagccctctgttctctggaaaggcagccgatgaggtccagctcagtctctgtatctrtcttgaatgcattcacggccactactactggaattccaaacattctggcattttcagtttgtttcttcaagttactgaagcctttttcaaccagctccag

SEQ ID NO: 25963 - DNA, 201 bp, Homo sapiens
gggcatctctgaaagaaaggcaacagccccagtcagaggcttatagataaaattcccatctccctgggacagaacacctgggggaaggggaggctgtgggygcagcttcagcagacttaaatgttcctgccagacggctctgcagagagcagcgtatcctgacaaggaggattctcccagcacagaacgggagctccacta

SEQ ID NO: 25964 - DNA, 201 bp, Homo sapiens
atgaagcatctataaggagcttaaacaaaactacaagaaaaaaaaacagacctattaaaaagtgggcaaaagacataaacaggcacttttcttcttttctktaaatagctacctttatttgtaaagttcatttttaaaaattttgtatttcaatagttttggcggtacaggtggtttctggttacatgtatgtgttcttta

SEQ ID NO: 25965 - DNA, 201 bp, Homo sapiens
tattttacttcttaataaatttattagaagtgttttacagaaattttcagatcatttatttatttaatgagtcaaacacgcatgaacaggcactcttccarataatccaaataaagtatctagctagatgacatatttactcacatggagctaacattctagagaagaacatatagaataaacaaagattcaatttaataa

SEQ ID NO: 25966 - DNA, 201 bp, Homo sapiens
taaagcaaattgtaatatcatcttgaataatagactgttttatcattatataataacctcctttgtctcttgtgggccttattttttacttcaactatatyttgcctaagtatagccacctctgttactttttgatgctgcaatttgcatggaatatatttttctatctctttattgtattctgcacctctagaatttctt

SEQ ID NO: 25967 - DNA, 201 bp, Homo sapiens
agtataattaaaaaaagaaaataaaatcataccatttgtaatggcaccaataagaataaaatatatagaaacaaatttaaccaaggatgtgaaaaatctgraccccaaaatctataggagagtgattaaggaaactgaaaaaaagaaataattgaaaatatatcttgtggttcatggattagtaaaatcaatattgccaaa

SEQ ID NO: 25968 - DNA, 201 bp, Homo sapiens
atttactcttggagttttttgttccaccagggtgctacacctagaatcgaaagctcccacaacattattatttttaatgaataaattaaattatttttcayctgcaactattcctatgggagtattactcttttaaaattttctttatcttaacagatacatactagttgtacatatttatggggtacatgtaatatttcg

SEQ ID NO: 25969 - DNA, 201 bp, Homo sapiens
tgttatttgcttgtggtaaaaaatttatttttacaaattttaataatagtgactgaaatatcacacttaaaatctaataatatttaccatttggaattacwaatttgtttatattagtatttgcagagtaaacacatgaataatataaatatatgtagtgtaatataacttcaaacaatcattgatatgtttaaggatttt

SEQ ID NO: 25970 - DNA, 201 bp, Homo sapiens
ccacagctgatgttgtactaggttgggtgcatccaaaatcaattgcctctgagagaacagtgcagctccagggtttttccaaggcctgtagtccttgaggyctgatggccactcaaatttacttcaggcctcgggccatgttagtcagctagtggtggagccagccaggactggagttcctcccactggagctgagaattt

SEQ ID NO: 25971 - DNA, 201 bp, Homo sapiens
cactagggatcaaaggatatgtgtgtgtgtgtgtgtatatatatatgaatggtaaataagtgtataaaatatgtttagtatcattagtcatcagaaaagtkcaaattaaaattttaatatgataatatatcacactcacaaggcggctaaaaagtaaaaaatgacaaccacaagtgttggtgagaatgtagtgcaactaga

SEQ ID NO: 25972 - DNA, 201 bp, Homo sapiens
gcggctaaaaagtaaaaaatgacaaccacaagtgttggtgagaatgtagtgcaactagaaatttcatacactgctgttgggaatataaattgctaaaacasttttaaaactattttagtagctatgtacaaaattaaacatacatctaccataaaacccaatcttctagatgtttttctaaaatataataaagcttttgtt

SEQ ID NO: 25973 - DNA, 201 bp, Homo sapiens
taccaaaggtttaaaaaagaaataacaccaaattcaagtctctttcagaaaatggaagagaacactttctaactaattgtatgaaggtagtattactctgwtaacaaatctaaataaagatagtctaatgaggaaatctcagactaatagctctaattaatttggatttaaaacttctaacacaatattagtaaatacaat

SEQ ID NO: 25974 - DNA, 201 bp, Homo sapiens
agtctgtgtcccaaaacctcaaaagtaggaaagctgacaatgcagcctttaatctgtggccaaaggcccaagagcccccggcaaaccacttgtgtgagtcygagcgtccaaaagctgaagaacttggggtccgatgtttgaggacaggaagcatgcagcatggaggaaagatgaatgctggaagacacagcaactctgctc

SEQ ID NO: 25975 - DNA, 201 bp, Homo sapiens
gtcagtcctctgtgggagttgatcaaatggtgcctgggtctgtcagtgtacaccatcccttccattggtatgtaaatcatattctacctagaccagtttgwtgtcctgtaatatttcttaatatctaaatataaattttggactaaaggccccatgcaagtccaaaatccagtggggtactgaaatcttaacgctccaaaa

SEQ ID NO: 25976 - DNA, 201 bp, Homo sapiens
aagaccttaaaaacaaatgcacaataccaaaaatagacaaatgggacttaaactaaagtgcttctttacaacaaaagaaattatcaacaaaataaacagamaacgtgcagaatggaataaactatttacaaacaatacatccaataaaatattaataactaggttccacaaagaactcagacatctcaacaacaacaaata

SEQ ID NO: 25977 - DNA, 201 bp, Homo sapiens
acaaagaactcagacatctcaacaacaacaaataattctgccaaggccaggtgcagtggctcacgcctgtaatcccagcactttgggaggccgaggtgggyggatcacgaggtcaggagatcgagaccaccgtggccaacacggtgaaaccccatctctactaaaaatacaaaaaaaaaattagctgggcgtggtggcggg

SEQ ID NO: 25978 - DNA, 201 bp, Homo sapiens
tgaggcaggagaatggcgtgaacctgggaggtggagcttgcagtgagcccagatgacgccactacactccagcctgggccatagagtgagattccatctcaaaaaaaaaaaaaaaaaattctgctaaaatgtaggcaaatggcataaacagactttttcaaaagaagacatacaaatggccaacaaacacataaaaaactg

SEQ ID NO: 25979 - DNA, 201 bp, Homo sapiens
agcttgtttcaagagttctcacaaaactactttgctctatatattttggggtgttttgttttgtttttgtttttttgtttttttgtttttttgtttttttkttttttttggtgtttccatggggcaatgagggcctggcgctttctgctctgccatcttgctgatgtcactcttcagtagtatctcctcttctcatcatgt

SEQ ID NO: 25980 - DNA, 201 bp, Homo sapiens
gcttgtttcaagagttctcacaaaactactttgctctatatattttggggtgttttgttttgtttttgtttttttgtttttttgtttttttgttttttttttttttttggtgtttccatggggcaatgagggcctggcgctttctgctctgccatcttgctgatgtcactcttcagtagtatctcctcttctcatcatgtt

SEQ ID NO: 25981 - DNA, 201 bp, Homo sapiens
tcttgcagtttcttgtgcatttgcactataacatttatttctttttatactatctcttaaaaaatggttgtagttattatcatagtcatatcttcaagaayaaaattccacattcaatgaaagtaaattcaaaaataagaacaatcccctattcccctggttgctcagaaatcaacgtatagatgcagaaagcctgaaaaa

SEQ ID NO: 25982 - DNA, 201 bp, Homo sapiens
aaagagagattacaacaaaatcagaaatgaaaaaagagagattacaacaaaatcggaaaagcaaaagaagaaattataaatcacatcacagaaatacaaayattcttaaaaattattattaagaactctacttccacaaacaagaaaacctagaggaaataaattaatttctggaaacatgcaacctcccgtttgaatcag

SEQ ID NO: 25983 - DNA, 201 bp, Homo sapiens
tataatagttacaaaaaataaagtagaactccttgttaattaataagatgaaatatatataatgtatatattacatataaatatataacatatttatatattatatattatatatattatttatatttatatttatattgaaatataattatatattatatattaaatatgttataatcagatttatatttttaaattata

SEQ ID NO: 25984 - DNA, 201 bp, Homo sapiens
taattatatgtacttttactgatatatatctgtatacatatatacatacgtatatgtatacacatatatacatacgtacatgtatacacatatatacatasgtacatgtatacacatatatacatacgtatatgtatacacatatgtacatatatacatacgtatatgtatacacatatgtacatatatacatatgtatat

SEQ ID NO: 25985 - DNA, 201 bp, Homo sapiens
taatcctttgggtatatacccagtaatgggatggctgggtcaaatggtatttctagttctagatccctgaggaatcaccacactgacttccacaatggttsaactagtttacggtcccaccaacagtgtaaaagtgttcctatttctccacatcctctccagcacctgttgtttcctgactttttaatgatcgccattcta

SEQ ID NO: 25986 - DNA, 201 bp, Homo sapiens
tgatgttgcaagaaagaaattagaataaaatatggaaattaggaaacatcaatttcattaaatgagtatatgtggatgctgaaagagaagaattaagtatsacatctgtatttattgtttacgtgacttggtgtcatcaactgagtcaaataatataggatatgacattttaacttattggaaatggaatatatatatata

SEQ ID NO: 25987 - DNA, 201 bp, Homo sapiens
tagagtcactcaaaaattaaaatacttagttgtaaatataacaaaacatgcactggacctgtttactgaaaactacacaatgctgatgaaataaatcaagsgttatctaaataaataaagagatatgccacattcacgattggaagattgaacatagtaaagatgttaattcctccaaattaatatacaaatttaacacaa

SEQ ID NO: 25988 - DNA, 201 bp, Homo sapiens
tgcgtaaagagctggtggatatgctaggtgatgatggtgtgttcttatatccctcacatcccacagtggcacctaagcatcatgtccctctaacacggccyttcaactttgcttacacaggtacctaattgtattccttacattctgtaatcttaaagaaatagagatgtatgtttccaaggaaagcataattttcttttg

SEQ ID NO: 25989 - DNA, 201 bp, Homo sapiens
atagtgataatgataccatttattggagacatgtatatgtttatattgatattaatgtaggtaatatcaatatctctgctttacttcgtagtattagttayatgtgttttccttgttttatctattcctagaattgttctgagttttacatgtttcatctcattttatcttacagcagccctataaaaaggagaaattatt

SEQ ID NO: 25990 - DNA, 201 bp, Homo sapiens
aaaccaaacgggggcagaagagatcccccagcacagcacagctgctttaccaaaacatggccagattgcttctttaattgggtctcaaatcccctttctcmtcacttggggggtaactcccaaccaaggcctgcagccccctctgccagtgttctctggccagtagagattttaaaattccatgggaaagagctcccagag

SEQ ID NO: 25991 - DNA, 201 bp, Homo sapiens
aggggcaactgaaagcctctctgccactgcctttgcagtaggcctctccttgttactcttgaactataaaaagagcaaagaccttaagtgcctatccacamctttaacaactggtagttgacccaaggagagtaggcctgtctatccccatgggttccacataccccacattgctcatcactagacagggaatccctggct

SEQ ID NO: 25992 - DNA, 201 bp, Homo sapiens
gatattgtattgcttgctttgttagctgaaacaaactgcttccggctgtctttactaacagacataggaaaaaaaaaacattcttttagtcaatagctctmtaccagataccaggggatgtgttaatttgctctagcagtgaacccacatttggcacaacagctgtttggagttatcatctcatcaagctcacaataatcc

SEQ ID NO: 25993 - DNA, 201 bp, Homo sapiens
agcagttcctcttctttctgaactctgccagtggacacagcctcctgttatccagggaaacagaaaaactgcaggataggtgattccacaacccccaccascactcatagccaggcagctagaacttccagcccagcagtcccacttctgtctgaactctgatggcaggaacagcctctagaatataacccaacagcaggt

SEQ ID NO: 25994 - DNA, 201 bp, Homo sapiens
caaaaagccagtgtttgcccttacctataaacgtacacattagcctcccagaaatggttcttaaccagagtgagctgactgtggacatagaattcagaagytggatgacaaggaagctcagtgagaatgaggagaaagttgaaacataatccaaggaatccaataaaacaattcagtagctgaaagataaaatatccattt

SEQ ID NO: 25995 - DNA, 201 bp, Homo sapiens
actaggctccctggcttcagacccctttccaggagagtgaacagttgtgtctcactcaggttccaggtgtcactggggttccaggtgccactgggatatgrcaaaaatatgcctgcagctatctcagtgtcaaaacagccacccagttttgtgcttgaaactcagggccccggtggtgtaggtacacaagggaatcttctg

SEQ ID NO: 25996 - DNA, 201 bp, Homo sapiens
gatccctgaggaatcaccacactgacttccacaatggttgaactagtttacggtcccaccaacagtgtaaaagtgttcctatttctccacatcctctccarcacctgttgtttcctgactttttaatgatcgccattctaagtggtgtgagatggtatctcattgtggttttgatttgcatttctctgatggccagtgatg

SEQ ID NO: 25997 - DNA, 201 bp, Homo sapiens
gcaaccaccaggatgtcgcctttatttacctcctcatccagattggcagtcttggagtggcaggtggtcactgtggcattgttccacagaagcaagtcacrcatcagggccctgactattttactgcacccaaccaccacagcatgccttctggcaatctgcacccctgtctctttcatgagttccaagcatcctttaggc

SEQ ID NO: 25998 - DNA, 201 bp, Homo sapiens
acacaaaccccctgtagatactacacaagatgacaaaccggaaggtacatagtcatcagattcaccaagatcaactcaaaagaaaaactcttaaaagtagytaaagagaaaaatcaggttacctacaaagtaaaccccaccagactctctgtaagaactctctgtaagaaacctacaagtgagaagagattgggggcctat

SEQ ID NO: 25999 - DNA, 201 bp, Homo sapiens
tctgtaagaaacctacaagtgagaagagattgggggcctattttcaatattgttacagtgaagaattttcaaccaagaatatcatattccatgaaactaarcttcataagcaaacgagaaataaaattcttcccagacaagcaagtactaaaggaatttattattaccagaccacccttacccgagttctttaagagagtg

SEQ ID NO: 26000 - DNA, 201 bp, Homo sapiens
cagaaatagaatagttccttagagactatacagaacacctttgtgaacacaagttagaaaatatagatacaatggataaattcctagaaacacacaacctyccaagatagaatcagggataaaagtgaagacatgaacagataaataacaagttcagaaattgaatcactaataaaaaaacttaccaacaaaaaagagccc

SEQ ID NO: 26001 - DNA, 201 bp, Homo sapiens
ctctgctaagtctcctggaactgataaatgaattcactaaaattttaatatactaaaccaatgtacaaaaatcctaacatttttatacaccaatattgttytaggtgagaatcaaatgaagaacagaattccatttacaatagccacaaaaaaaaaaaaaaggaatacctaggaacccatctaaccaatgaggtaaagatc

SEQ ID NO: 26002 - DNA, 201 bp, Homo sapiens
ggagaatcgcttgaacccaggaggcagaggttgcagtgaatcgagatggcaccactgcactccaacctgggtgacagagcaagactccatccaaaaaaaamcaaaaaaatcctagaagaaaacctaggaagatggatgtcgagatggctgaataggaatagcagcttcagtctgcagttcccagtgagatcaacgcagaag

SEQ ID NO: 26003 - DNA, 201 bp, Homo sapiens
ttacgtgacttggtgtcatcaactgagtcaaataatataggatatgacattttaacttattggaaatggaatatatatatatatacttttctttactcctsctactaaatgcaactaaaaatctcaggcattgtatctaaaacaaacataaaaagactcctaaaggtgaagagaaggtggcagaccagctcggactctcag

SEQ ID NO: 26004 - DNA, 201 bp, Homo sapiens
gactgcaaaccaacaatgaccaaaaaagacaagaagggcattacataatggtaaaatgatcaatgtaaaaagaagagctaactatcctaaacatacatgcrcccaatacaggagcaccagattaataaaaaaaaaaaagttctcagagttctacaaaaagacttagactcccacacaataatagtgggagactttaacacc

SEQ ID NO: 26005 - DNA, 201 bp, Homo sapiens
ttctgaattatgttacgtggtaaaaatataaggtactgaacaatgaatataatatgattccttttgtgtgaagaagggagagagagctgaagagaggggaraagggaataagggagagagggagggaaagagagagagagtgagaagctttcacttttcatttgtacttttctgtagtgaatggattttctaacgatgtac

SEQ ID NO: 26006 - DNA, 201 bp, Homo sapiens
gatatctccaaactcctttccaaagggctgaactaatttacattcttaccaacagtatataagcattctcttttctctgcagcctcatcagtgtcagttayttttggattttttcaatgattgccattctgacttgtgtgagacagtatctcattgtggtctttatatgcatttctctgatgattagtgatgttgatcatt

SEQ ID NO: 26007 - DNA, 201 bp, Homo sapiens
agacaagaagggcattacataatggtaaaatgatcaatgtaaaaagaagagctaactatcctaaacatacatgcacccaatacaggagcaccagattaataaaaaaaaaaaagttctcagagttctacaaaaagacttagactcccacacaataatagtgggagactttaacacccaactgtcaatattagatggatcaat

SEQ ID NO: 26008 - DNA, 201 bp, Homo sapiens
tagacaactcagaaataagactgcacaactacaaccatctgatcttctacaaacctaacaaaaacaagcaatggggaacggattctctatttaataattcrtgctgggagaactagctagacatatgcagaaagttgaaactggaccctttctttacaccttgtacaaaaattaactcaagatggattaaagacttaaacc

SEQ ID NO: 26009 - DNA, 201 bp, Homo sapiens
aaataaaaataattttaaaaagaaagaaaacctagtaaatacttttcttgacatgggttttggcaaataatttatggccaagttcctaatagcaattgcaaaaaaaaaaaaaaaaaaaaaattgacaaatgagtcctaattaaagtaaagggcttctgtgcaataaaataaattaccaatagaatcaacaaacagtaacag

SEQ ID NO: 26010 - DNA, 201 bp, Homo sapiens
gcagaaggcaagaaataactaagatcagagaagaactgaaggagatagagacataaaaaacccttcataaaatcaatgaatccagatgctggttttttgamaagatcaacaaaattgagagaccgctggcaagactaataaagaaggaaagagagaagaatcaaatagacgcaataaaaaattatgaaggggatatcacca

SEQ ID NO: 26011 - DNA, 201 bp, Homo sapiens
tctcatgccagttagagtggcgataattaaaaagtcaggaaacaacagatgctggagaggatgtggagaaataggaatgcttttacactgttggttagagwgtaaattagttcaaccattgtgaagacagtgtggtgattgctcaagggtatagaaccagaaataccatttgacccagcaatccttttactgggtatacac

SEQ ID NO: 26012 - DNA, 201 bp, Homo sapiens
tgcctctgggagcccctcccccagggaaatacaaagccactagcagagggaatgctctgccaagggtgggacgtctgtgtagatccaggcttggggccctrcttggtgaagagtgtggggtgggagcctacatggaagagagactgggctcctctctgtatggtggctgcagcgtgctggaggctccagtgtagcaactcg

SEQ ID NO: 26013 - DNA, 201 bp, Homo sapiens
aaatcctaaataaaatactgccaaaccgaatcaagcaacacatcaaaaagcttatccaccatgatcaagtgggcttcatccctgggatgcaaggctggttyaacatacgcaaatcaataaacgtaatccagcatataaacagaaccaaagacaaaaaccacatgattatctcaatagatgcagaaaaggcctttgacaaaa

SEQ ID NO: 26014 - DNA, 201 bp, Homo sapiens
ataggtacgctcttgcttagccatgtggctcgcctgtatttcctcatgattgccatcaaattttctgttactgttctgaaagtgtaggctcctctcccacwgaagtgctgtctgtagacctctgtttggcacttgcgagctgtacagcacaaccttgtggtgagctcatctttattttccttccccacttttgaggcagca

SEQ ID NO: 26015 - DNA, 201 bp, Homo sapiens
acacaagccttctccaggtaatgttaatatgatcagaagggtggttctacttttataattcagagcaattcagaaattttgttctagcaggattatcttgyttatcagggtgattattatatatttctcaatgttcttaaataaaactagctactgtttattgagcaccaactctgggattggtgcacaaaattgtgcaag

SEQ ID NO: 26016 - DNA, 201 bp, Homo sapiens
attgtttggaactttcttatactggtatattcctgacttcttaccttcaaagtagacatcttatacctccttagcttcatattttgcctcatgggggactrcactgtgtaattcactgaaagtgtctcaaaaaatgattaatgtacataggagtctttcaggaaatacttgttgaatgaattgtttagtgaataaatggct

SEQ ID NO: 26017 - DNA, 201 bp, Homo sapiens
ctgtgtaattcactgaaagtgtctcaaaaaatgattaatgtacataggagtctttcaggaaatacttgttgaatgaattgtttagtgaataaatggctgcwgactaaagtattgtattttgcaggtgaaatgtatagatgttgttcaggcttatatcaacagaatcaaggacgtgaacccaatgatcaatggaattgtcaa

SEQ ID NO: 26018 - DNA, 201 bp, Homo sapiens
ctgaagcctttttcaaccagctccaggttctcctctatgtaagccttgggaagaggcattccagcagtgaccatagggccacccctgtgcatctttagagygctgacagtggcaacaagcaccaccacgtgagggtggagaccggaatactgggatttgatgttaagaaacttttctattccaatgtctgctccaaatccc

SEQ ID NO: 26019 - DNA, 201 bp, Homo sapiens
tacatagtaggtgtatatatttatggggtacatgagatattttgatacaggcataaaatgcatagtaatcatatcagggtgaatgggattttcatcacctrtagcatttatcctcttcttgtgttacaaacaatccaattatactctttcggttatgtttaaatgtacaatatattactgttgactgactgtagtcacact

SEQ ID NO: 26020 - DNA, 201 bp, Homo sapiens
aggttaatgcaaaagactctacaaatgtactttcctcttttttcttgtcttctttcatacacacgcacacataaaaacacatacatacattatataaagcraaagctatagcactgtattgttggattatctctctctctctctctctctctctctatatatatatatatatatatatatacccacacacacatagtatac

SEQ ID NO: 26021 - DNA, 201 bp, Homo sapiens
ctttcctcttttttcttgtcttctttcatacacacgcacacataaaaacacatacatacattatataaagcgaaagctatagcactgtattgttggattayctctctctctctctctctctctctctatatatatatatatatatatatatacccacacacacatagtatacataactataataacacagaaaaggattag

SEQ ID NO: 26022 - DNA, 201 bp, Homo sapiens
tcatacacacgcacacataaaaacacatacatacattatataaagcgaaagctatagcactgtattgttggattatctctctctctctctctctctctctmtatatatatatatatatatatatatacccacacacacatagtatacataactataataacacagaaaaggattagagaatgcagctattttgctgcaaac

SEQ ID NO: 26023 - DNA, 201 bp, Homo sapiens
aatataggggagctttctttatttgaaaaatagctctaagaatactacagctcacatcacacataatggtaaaagtgtgagagcttttcccctaaaattargaaacaggcaaaaatttttattctcaccactcttaattacaatgctggaagttccagacaatgcagttagacaagaaaagtaaataaaattctgatcaga

SEQ ID NO: 26024 - DNA, 201 bp, Homo sapiens
agaagtatattttttataaatctggatgttccagtgtctgttgcatatataatttaaataaataaatcttcttttattggagcttttcttaatatataatkaccttatttatattttagtaccattgttgatctaaagtctgttttatctgatatgaaagtggttattcctgcttgcttttgtttttcatttgcatggtgt

SEQ ID NO: 26025 - DNA, 201 bp, Homo sapiens
ggtgagagagggcatccttgtcttctgctgggtttcaaagggaatgcttccagcttttacccattcagtatgatatcggctataagtttgtcataaatagytcttattattttgagatgtgttccatcaatacctagtttattgagagcttttagcatgaaagggtgttgaattttatcaaaggccctttctgcatctatc

SEQ ID NO: 26026 - DNA, 201 bp, Homo sapiens
tttctttttcaggtaaatcagagatttcttcttggtttggatccattgctggtgaactcgggtcggggggtgttgaggagccttgttttgtcatattaccrgggttggttttctgcttccttctcatttgggtagactctgtcagagggaaggtctagggctgaaggctgttgttcatattatattttcccacaggctgtt

SEQ ID NO: 26027 - DNA, 201 bp, Homo sapiens
attgttcaattcccacctatgagtgagaacatgcggtgtttggttttctctttgcaatagtttgctgagaataatggtttccagctttatccatgtccctrcaaaggacatgaactcatcttttttatggctgcatagtattccatggtgtatatgtgccatatgttcttaatccagtctatcaaaaggatctagaactag

SEQ ID NO: 26028 - DNA, 201 bp, Homo sapiens
taactcattttatggggccagcatcatcttgataccaaagccgggcaaagacacaaccaaaaaatagaattttagaccaatatcctcgatgaacattgatrcaaaaatccttaataaaacactggcaaaccgaatccagcagcacgtcgaaaaccttcaggtgctcttttaaggctggtttggtggtgacaaagtttctca

SEQ ID NO: 26029 - DNA, 201 bp, Homo sapiens
ttctcctcctttgttccccttccagttctgctatggaagaagcaacatctaagatgacggaaattatttcagagcccacagttacactggaaaatgaggtaaaaaaaaaatagaattctgctcactaccttacagaaaaacaagccagacaaaagggtggaatggttaagagacagtgttgacaatgagcacttggactat

SEQ ID NO: 26030 - DNA, 201 bp, Homo sapiens
gttactgtgtagtattctgggtagagtccttggctctgctcctatttcctgtgcactgggggcaacttttttttttttttttttttttttttttttttgaracggagtttcgctcttatttcccaggccagaatgcaatggcgcacaataaatctcagctcaccacaagctccacctcccgagttcaagcgattctcctgc

SEQ ID NO: 26031 - DNA, 201 bp, Homo sapiens
gtggggttgctaggtaaatacaaaacatgcatttaaatttgaactttggataatgaataatgtttacttcatgcatatttaaaagatatttgtgaaaaaawttattgttcatctgaagttcaaattcaactgggcatcttttttaagtttttgtattatttatttatttttttaaatgatgtgctaagtttggcaacacac

SEQ ID NO: 26032 - DNA, 201 bp, Homo sapiens
tgtgtagtattctgggtagagtccttggctctgctcctatttcctgtgcactgggggcaacttttttttttttttttttttttttttttttttgagacggrgtttcgctcttatttcccaggccagaatgcaatggcgcacaataaatctcagctcaccacaagctccacctcccgagttcaagcgattctcctgcctcag

SEQ ID NO: 26033 - DNA, 201 bp, Homo sapiens
gctctgttcattgtatcttttcttgtacagaagctttttagttcagtgtaatcccatctgtctatttttgttttattgactgtgcttttcatgtaccaccaaaaaaaattattgatcagactaatgttatgaactgttttccttgtggttttttctgatagttttatagttttgagtattatacttaagtctataatctat

SEQ ID NO: 26034 - DNA, 201 bp, Homo sapiens
agactgttgtcacattggtgcagactctttggaaaacaatttggcattttcttaaaatgttaaatgtaaatttgtcataagactcaactatttcattcatytttatatgtatatatatgctcaagaaatgaaaataaatattcatacaaagacataaacaaatgtgtaattatattgctgatttttgcagcataattagta

SEQ ID NO: 26035 - DNA, 201 bp, Homo sapiens
agaggggaacaacagacagtggaagggaggagggggagaggatcaggaaaaataactaatggacactagacttaacatgtgggtgatggaacaatttgtamaacaaacccccatgacatgagattacctgtataacaaacctgcacaggtacccctgaacgtaaaatgaaagttaaaaaaacttccttttaaaaattttat

SEQ ID NO: 26036 - DNA, 201 bp, Homo sapiens
taaacaaacagcctatggaaaggaaaataaattttgcaatctatgcatctgacaaagtctaatatgaagcatctataaggagcttaaacaaaactacaagaaaaaaaaacagacctattaaaaagtgggcaaaagacataaacaggcacttttcttcttttctttaaatagctacctttatttgtaaagttcatttttaaa

SEQ ID NO: 26037 - DNA, 201 bp, Homo sapiens
caggttggtggggggaggggtgtccactattactaaggcttgagtaggcggttttccaatcacagcataaacaaagctgccaggaagttcaaactgggtgragcccaccacagcttggcaaagccactgtagccagactgcctctagattcctccattctgggcagggcatctttgaaagaaacacagcagccccagtcag

SEQ ID NO: 26038 - DNA, 201 bp, Homo sapiens
cagataaagttcctaaatattattaagtcctaagtagatagtaaattataattatatattttcacctatttattattggtaaaataattgaaaaaatacgktttcaggaacaggtcttgatttctcacttattttgtttgttttcttcaggtgtcttcagtgccctgggtttgcctgtgacccaatgcccactgggactga

SEQ ID NO: 26039 - DNA, 201 bp, Homo sapiens; identical to SEQ ID NO: 5137

SEQ ID NO: 26040 - DNA, 201 bp, Homo sapiens
tctccggacctcgtgatccacccacctcggcctcccaaagtgctggaattacaggtgtgagccactgcgcccggccttaaaagcatttcttaactttttgkgtctctgatgtcctttaagaaaaatggatttgataatagaatctaccttttagagttattgtgatgaattaaatgaattcatatatgtaaaacttataga

SEQ ID NO: 26041 - DNA, 201 bp, Homo sapiens
cacaaaactgggaggctgtttgggcagtcactgtgctagctgcaagagttgttttcttgttgtttcccagtggcgcctggaactccaccaagacagaaccrttcactcccctggaaagagggaaagggggctgaagccagagagccaagtggtctcgctcagtggttcccactcccatggagacaagcaagctaagaacca

SEQ ID NO: 26042 - DNA, 201 bp, Homo sapiens
tcatctcgctgggactggttaggcagtgggtgcagaccatggagggcgagcagaagcagtgttgggcattgccttacccgggaagtgcaaggagtgggggyctccgttccctagccaagggaagccctgagagactgggctatccagcccatttactatgctttccccacaggtttgcaatccaaagaacaggagattccc

SEQ ID NO: 26043 - DNA, 201 bp, Homo sapiens
gtctactaaatgtggtccctgcctgagggagcccatggaccagaacacctaacaaaagaagtgagggcatggaaccagtgatcgaagggggctcctccaargcccaggagccatctaggtgagcgagtcacctctctcccccacaccacagaggactactgtcatcttggccagaacaccgaagagccctgaaagagagta

SEQ ID NO: 26044 - DNA, 201 bp, Homo sapiens
caccatggaatgctatgtagccatgaaaaagaacaagatcatttcctttgcagggacatagatggaactggaggccattatccttagcaaactaacgcagraacagaaaaccaaatgtgacatattttcactcataagtgggagctaaatgttgagaacatgtgagcacatagaggggaacaacaaacactggggaccttt

SEQ ID NO: 26045 - DNA, 201 bp, Homo sapiens
acttaaagaaaggtcttttgaaataattcttttggacaaaaataagagaacaaagaattaaaaaaaaccaaggcctccaagatctttgggacaacataaawcaactgaatatgaaagttattaatattcctaaatgtgaggatagatcaaagcttagaaaatgtaatttaatgaaataacagatgaaaacttcccaagtct

SEQ ID NO: 26046 - DNA, 201 bp, Homo sapiens
ttgatgtacaaattgttcacccaactattgagtatagtacctgatatgcatttttttaatcctcatcctccttccacccctcaccctcacgtaaactatgrtgtctattgtttccttttttgtgtacacgtgtattcaatatttagttcccatttatatgcagtgttaggttttctgtttctgtgttaatttgtttaagat

SEQ ID NO: 26047 - DNA, 201 bp, Homo sapiens
ggaatagtttcagtggcaatggtaccaggtcttctttatattttggtagaattcggatgtgaatccatctgcaggaaagtctggtccagggctctttctgrttggtaggtttttcattattgatttattactgatgttcattattgatcatatttctcatttgtttatgaagattagtttggccggatataaaattcttgg

SEQ ID NO: 26048 - DNA, 201 bp, Homo sapiens
ctgatttctatgtgtcttggaaatggtcatcttgcaggggttctttgtattttctcaatttgaatgtgaacttttctagtatgcttcagaaaattttcatrgacaatatgcttaaatatgttttccaagttgctttttgtctctgtgtctctttcaggaatgccaattctttgtaggtctggtctctacataattctatat

SEQ ID NO: 26049 - DNA, 201 bp, Homo sapiens
taactaggataaccagtttagagaacataaatgacctgatggagctgaaaaacatagcatgagaacttcgtgaagcatacgcaagtatcaatagctgaatyaatcaagcagaagaaaggacatcgaggttgaagatcatcataatgaaataaagcgtgaagacaagattagagaaaaaagaataaaaagaaacgaacaaag

SEQ ID NO: 26050 - DNA, 201 bp, Homo sapiens
atgacctgatggagctgaaaaacatagcatgagaacttcgtgaagcatacgcaagtatcaatagctgaatcaatcaagcagaagaaaggacatcgaggttraagatcatcataatgaaataaagcgtgaagacaagattagagaaaaaagaataaaaagaaacgaacaaagtttccaaagtatatgggaccatgtgaaaag

SEQ ID NO: 26051 - DNA, 201 bp, Homo sapiens
aataaaattctttacagagaaactaatggtgagagattttgtcaccacaaggcctgcctcacaggagctcctgaaggaaatactaaacatggaaaggaaargagcaacccataccagccactgtaaaaacatgccaaattgtaaagaccatcaacactatgaagaaattgcattaattaatggacacaataacgagctaac

SEQ ID NO: 26052 - DNA, 201 bp, Homo sapiens
tttgaaaagttcaacaaaattgatagaccactagcctagcaagactaataaagaagaaaagagggaataatcaaataaatgtaataaaaatgataaagggstatcaccaccgatcccacagaaatacaaactaccataagagaatactataagctcctctaaacaaataaactagagaatctagaagaaatggatcaattt

SEQ ID NO: 26053 - DNA, 201 bp, Homo sapiens
tgaaggcaccacgctacctgacttcaaattgtattacaaggctaaaaatcaactcaagatggaccaaagacttaaacataaaacctaggaccataaaaatyctagaagaaaacctaggcaataccattcaggacataggcatgggaaaagacttcatgtctaaaacaccaaaagctatggcaacaaaagccaaaattgaca

SEQ ID NO: 26054 - DNA, 201 bp, Homo sapiens
tgagatcaacgcagaaggggagtgacttctgcatttgcaattgaggtaacctaatcatctcgctgggactggttaggcagtgggtgcagaccatggagggygagcagaagcagtgttgggcattgccttacccgggaagtgcaaggagtgggggcctccgttccctagccaagggaagccctgagagactgggctatccag

SEQ ID NO: 26055 - DNA, 201 bp, Homo sapiens
atatggaaattaggaaacatcaatttcattaaatgagtatatgtggatgctgaaagagaagaattaagtatgacatctgtatttattgtttacgtgacttkgtgtcatcaactgagtcaaataatataggatatgacattttaacttattggaaatggaatatatatatatatacttttctttactcctgctactaaatgc

SEQ ID NO: 26056 - DNA, 201 bp, Homo sapiens
agaattaagtatgacatctgtatttattgtttacgtgacttggtgtcatcaactgagtcaaataatataggatatgacattttaacttattggaaatggaatatatatatatatacttttctttactcctgctactaaatgcaactaaaaatctcaggcattgtatctaaaacaaacataaaaagactcctaaaggtgaag

SEQ ID NO: 26057 - DNA, 201 bp, Homo sapiens
aacccagaaataaacctgccacctacaaccatctgatcttcaacaaaatgagcaaaagtaagcaatggaggaaaggactctctattcaataaatggtactrtaatagtttgcctgccgtatgcagaagaatgaaactggatctctacctgtcaccatatatgaaaactaagttaaagtagattaaatatttaaatgtaaga

SEQ ID NO: 26058 - DNA, 201 bp, Homo sapiens
gaattaagtatgacatctgtatttattgtttacgtgacttggtgtcatcaactgagtcaaataatataggatatgacattttaacttattggaaatggaatatatatatatatacttttctttactcctgctactaaatgcaactaaaaatctcaggcattgtatctaaaacaaacataaaaagactcctaaaggtgaaga

SEQ ID NO: 26059 - DNA, 201 bp, Homo sapiens
tgagaacccagaaataaacctgccacctacaaccatctgatcttcaacaaaatgagcaaaagtaagcaatggaggaaaggactctctattcaataaatggyactataatagtttgcctgccgtatgcagaagaatgaaactggatctctacctgtcaccatatatgaaaactaagttaaagtagattaaatatttaaatgt

SEQ ID NO: 26060 - DNA, 201 bp, Homo sapiens
attatatacagaaatcttaaaataaacaatcccattaaaaagtgggcaaaagacatgaacagacacttttcaaaagaagacgcatatgcggccaacaagcrtattaaaaaaagctcaatatcattgatcattagagaaatgcaaatcaaaaccacaatgagataccatgttgcatcagtcaaactggctataattataaag

SEQ ID NO: 26061 - DNA, 201 bp, Homo sapiens
tacctaattgtattccttacattctgtaatcttaaagaaatagagatgtatgtttccaaggaaagcataattttcttttgcagttggacaagttttaaacmtgcaggtataaaagtgctgtgtgattgaaaactccagaaaacagttgctaatgtcatatgttgaagatactttgccaatatctggtttctccacaataat

SEQ ID NO: 26062 - DNA, 201 bp, Homo sapiens
accaggaagaagttgactctctgaatagaccaataacaggctctgaaattgtggcaataatcaatagcttaccaaccaaaaagagtcctggaccagatggwttcacagccgaattctaccagaggtacagggaggaactggtaccattccttctgaaactattcctatcaatagaaaaagagagaatccttcctaactcat

SEQ ID NO: 26063 - DNA, 201 bp, Homo sapiens
catggtgataccccgtctcttctaaaaatacgaaaattatccaggtgtggtggtgtgcgcctgtaatcccagctactcagctactcaggtgggtgagaccrgagagttgcttgaacccaagaggtggcggttgcagtgacccataacataataccatagactgggttatttaagcaacagaaatttattttttcatagttt

SEQ ID NO: 26064 - DNA, 201 bp, Homo sapiens
aacagtaacagaatgggagaaaatatttgcaaactatacatccaacaaaggcctactatccagaacctacaaaaaacttaacaaatcaacgtgcaaaaaaraaaccacctgaacaaccacatgttgggtactatgtttatgacctggaagataggatcactagaacctcaagccacagcatcatacaatttactcaagtaa

SEQ ID NO: 26065 - DNA, 201 bp, Homo sapiens
aaaaaaaaaaaaattgacaaatgagtcctaattaaagtaaagggcttctgtgcaataaaataaattaccaatagaatcaacaaacagtaacagaatgggaraaaatatttgcaaactatacatccaacaaaggcctactatccagaacctacaaaaaacttaacaaatcaacgtgcaaaaaagaaaccacctgaacaacca

SEQ ID NO: 26066 - DNA, 201 bp, Homo sapiens
gaggtattgtttattttaaaaagaattaaaatttctttctgatagagttgatttgaagaactggccttaaaatcttattctattttgctcatcttagtctrtcttcctgttaataatttctgattgtattacagaattcttgtagtgagtatttcagctcttatgatcagttttgttctttcttaaaatggctattttgtc

SEQ ID NO: 26067 - DNA, 201 bp, Homo sapiens
tgagtagtggcagtgggttccatgcatgcatgcatgcttgtgtcagcaggatcggtgtgcaagtgtgtatccaagcagtggcatggcattgacatggtcgkgtctgcaagtgcacacagtctccactggcagagtgcagtggggtctgcacatgtgtgcacaccaccagcagcagcatggcagtgttcacatgtgcatgtg

SEQ ID NO: 26068 - DNA, 201 bp, Homo sapiens
ctatggaaaggaaaataaattttgcaatctatgcatctgacaaagtctaatatgaagcatctataaggagcttaaacaaaactacaagaaaaaaaaacagmcctattaaaaagtgggcaaaagacataaacaggcacttttcttcttttctttaaatagctacctttatttgtaaagttcatttttaaaaattttgtattt

SEQ ID NO: 26069 - DNA, 201 bp, Homo sapiens
accaaaaaagaaatttcaggccaatatccctgaggaatatgtgaaaattctcaataaaatactagcaagccaaatccagcagcacatcaaaaagcttatcraccatgatcaattcggcttcatccctgggatgcaaggctggtacaacatacctgaatcaattttaatgcaatccatcacataaactgaatcaatgacaaa

SEQ ID NO: 26070 - DNA, 201 bp, Homo sapiens
aataatactgggtatatatacagcattgcataataaaaatcatgctttgttattattcaataacaaagtaagtcttgtggcactgtgccttaaaagtgtgkcattaaaagtccacttaattcttcctttcttttcttgacatggtgagtatgcagtaaaaataattgtgggttggtgatatatgggacactcaaaacactt

SEQ ID NO: 26071 - DNA, 201 bp, Homo sapiens
tgtcattttacaaaatactatgtgaatttccaaactttggaagtaaaatttgtctagatattgaaatatgagtttggagccaaagaatgttttttaaatargattgttatcatagtgctattgtggcaggccaggtctccattagcaaccagaacagtcagtttccactaaccctttactatagttctgatgaatgtataa

SEQ ID NO: 26072 - DNA, 201 bp, Homo sapiens
atgttttttaaataagattgttatcatagtgctattgtggcaggccaggtctccattagcaaccagaacagtcagtttccactaaccctttactatagttytgatgaatgtataagttaaacattaaagaattggagaaactagtgctttagtacaagggctgggatgtgaaaacaaaaccattaagaccttgcctgggtt

SEQ ID NO: 26073 - DNA, 201 bp, Homo sapiens
aggccccagaccctagttaaagattagattgagtgaaacactcctgtttatagttgcacacgtgcatgcaggcatatagcttgaatgtattaatgtataarcaagtgctgaaaaaaatcttgtaactttgggttggtctggtgaactaccctgaccttctccttatggccagttacagaaataaactctcttctttcccag

SEQ ID NO: 26074 - DNA, 201 bp, Homo sapiens
tcctgtaatcccagctactcaggagtctgaggcaggagaaccacttgaacccaggaggcggaggttgcagtgagcagagactgtgccattgcactctagcmtgggcaacagagcgagactctgtctcaaaaaaaaaaaaaaaaaaaaaaagaaaaaaataagaaaaaatctatatttatacagaattccagaaaatcaaaa

SEQ ID NO: 26075 - DNA, 201 bp, Homo sapiens
ataggacacaaacaaatggaaaaaaaaaatccatgctcatggataggaagaatcattatcgtgaaaatagccatactgcccaaagtaatttatagattcamtgctattcctattaaactaccattgacatttttcagagaattaggaaaaaaaaacctattttaaaattcacgtggagacaaaaaagagcccgagtagcca

SEQ ID NO: 26076 - DNA, 201 bp, Homo sapiens
gggtttgtcataattagctcttattattttgatgtatgctcttttgatgactattcttctaaggtttttatcatgaaggaatgtttgattttattgaagtmtctttctgaatctattgagatgattatatctttttttgttttaaattctgtgtatgtggtaaatcacttttttttatttgcttatgttgaattaacattg

SEQ ID NO: 26077 - DNA, 201 bp, Homo sapiens
ggataaagaaaatgtggaattaggagtggccaagatggccatctagaagttgctaatgtgtgtgcctctcacggagaggaaccaaaggggcaggtaaatayagcaccttcaattaaaatattcaggtactcgcattgggactattcaaacaacttgatccatggagaacagagaaaagcaaggcaggacgatggcccactc

SEQ ID NO: 26078 - DNA, 201 bp, Homo sapiens
gtactcgcattgggactattcaaacaacttgatccatggagaacagagaaaagcaaggcaggacgatggcccactcgggagtgacacagagccaagggaamctctctcacccagggaagtggtgagtgaacatgtgaccacaggaaaccacacttcttctatggagctttgcaaactttgggtcaggtggtccccttgtga

SEQ ID NO: 26079 - DNA, 201 bp, Homo sapiens
gtggagaaaaaaatcttagagcatgaagactggctttctaaaataaggcaggcagacaagaatagataaaaaaagaattaaaaggagtatataaccccccmaaaaaaatgagattatgtaaagagaccaaatctatgactgattggtgtacctgaaagagataaggagaatgggaccaacttggaaaacatatttcaggat

SEQ ID NO: 26080 - DNA, 201 bp, Homo sapiens
gaattctaccaaatgtacaaagaagagctggtaccattcctattgaaattactttaaaaaattgaggagaatggacgcctccttaattcattctatgaggycagcatcatcctgatagcaaaacctggcagcaatgcaacaaaaaaagaaaacttcaggccaatatccttgatgaacactgatgcaaaaatcctcatcaaa

SEQ ID NO: 26081 - DNA, 201 bp, Homo sapiens
agtcaggggcttatagcagacataaaagttcctgcctgatggctctgaagagtacagtggacctcccagcacagtgttcgtgctttgctaagggtcagacrgcctccacaagtgagtccctgacccccgtgtgtactgactaggagacacctccaagtaggggccaacagacatctcttacaggagagctctggctggcat

SEQ ID NO: 26082 - DNA, 201 bp, Homo sapiens
gaatatacaagtatcaatagctgaatagatcaagcagaagaaaggatatcagtgattgaagaccaacttaatgaaataaagagagaagacaagatcagagaaaaaaaaaaagtataaaaagaaagaacaaacactccaagaaatctgggactatgtgaaaagaccaaacctgtgtttgattggtgtatctgaaagtgatgg

SEQ ID NO: 26083 - DNA, 201 bp, Homo sapiens
cgatggcaccttcatttaccgcccgcattcagttgttcctcttgcgggcgctaggctttctcataggcttagtaggccgagcagctttagtcttagggggyccaaagtttgcctcaaagacccctcggccggtgactgaaccattgcttctgctttcggggatgcagctggccaagctgatccgacagagaaaggtgagaa

SEQ ID NO: 26084 - DNA, 201 bp, Homo sapiens
ctattccaatcaatagaaaaagagggcatcctccctcatttcatgaggccagaatcattctgatatcaaaacctggcagagacacaacaaaaagagaaaamttcagaccaatattcctgataaatatcgatgtgacaatgctcaataaaatactagcaaactgaatccagcagcacatcaaaaagattatccactatgatc

SEQ ID NO: 26085 - DNA, 201 bp, Homo sapiens
aggcaaaggttgcaatgagccaagatggtgccactgcactccagtggcgctccagcctgggcgacagaatgagacaccatatcataacaaaacaaaacaacaacaacaacaacaacaacaacaaaacctggaatattactcagcttttaaaaagcaggaaatttaacatctattttaaagataaatcttaatggtcttatg

SEQ ID NO: 26086 - DNA, 201 bp, Homo sapiens
tgagacaccatatcataacaaaacaaaacaacaacaacaacaacaacaacaacaaaacctggaatattactcagcttttaaaaagcaggaaatttaacatytattttaaagataaatcttaatggtcttatgataagtgtaataagtccatcataaaaagtatgaatccacttatacgagttagctaaagtagttgcactt

SEQ ID NO: 26087 - DNA, 201 bp, Homo sapiens
ggcaaaggttgcaatgagccaagatggtgccactgcactccagtggcgctccagcctgggcgacagaatgagacaccatatcataacaaaacaaaacaacaacaacaacaacaacaacaacaaaacctggaatattactcagcttttaaaaagcaggaaatttaacatctattttaaagataaatcttaatggtcttatga

SEQ ID NO: 26088 - DNA, 201 bp, Homo sapiens
ctccagtggcgctccagcctgggcgacagaatgagacaccatatcataacaaaacaaaacaacaacaacaacaacaacaacaacaaaacctggaatattaytcagcttttaaaaagcaggaaatttaacatctattttaaagataaatcttaatggtcttatgataagtgtaataagtccatcataaaaagtatgaatcca

SEQ ID NO: 26089 - DNA, 201 bp, Homo sapiens
ggggaagaaccactgcaatggcagtggcagaggggctgtcagttgcctctgggagcccctcccccagggaaatacaaagccactagcagagggaatgctcwgccaagggtgggacgtctgtgtagatccaggcttggggccctgcttggtgaagagtgtggggtgggagcctacatggaagagagactgggctcctctctg

SEQ ID NO: 26090 - DNA, 201 bp, Homo sapiens
cagggaagtgatgtgggaattctgccagttgctgagtatatctattcaaattatgcactgcagagctgaggaaataatcgcaagatggtttcatggactcwctgtacacgctgtgaaatgaatgtcagctaaacctatgatctgatggtctgacagagattttgtctcttctgcctgtccactgagctcaggttcactcca

SEQ ID NO: 26091 - DNA, 201 bp, Homo sapiens
gcacatcagatggggctagtcccacctgagcactccttggtctgctggcctcctggggccccatcctggccatgcctgcttataagacagtctcaggtgcsctgcgagcccacaccatagcttctgcaccagtggaccatgcctgtcccatggaaagctccagcaaggtggcccctacaggtgtgcaccagcctgcacatt

SEQ ID NO: 26092 - DNA, 201 bp, Homo sapiens
tggcctcctggggccccatcctggccatgcctgcttataagacagtctcaggtgccctgcgagcccacaccatagcttctgcaccagtggaccatgcctgycccatggaaagctccagcaaggtggcccctacaggtgtgcaccagcctgcacattcccttgccatagtgcagcttctcatgagcccatggcaaatcccca

SEQ ID NO: 26093 - DNA, 201 bp, Homo sapiens
agttcttagatcattttaatggattccctggattccttggattgggtttcaactttctcctgaatctcgatgagttttctttccattcagataatgagttycatatctgtcaaaaaggctagtttgtttatttggaggtaaggggatgctaagtttttttttttttttttttttttttttttttttgctgttgttgttgtt

SEQ ID NO: 26094 - DNA, 201 bp, Homo sapiens
aaatgcaagtcaaaaccaatgtgagattatatcttactccagtcagaatgggcattattacaaatacagaaagtaacagatgttggcgaggatttggagamaaggaaatcttacacattgtgccaatataaacaagtgtagtctgtgaaaaacagtatggaggtttttcaaaggggtaataatagaactactatttcatct

SEQ ID NO: 26095 - DNA, 201 bp, Homo sapiens
cactgcaaaaacacgccaaattgtaaagaccatcgatgctaggaagaaactgaatcaattaacagttaaaataaccagctgacatcataacgagaggatcraattcacacataacaatattgaccttaaatgtaaatgggcttaaagccccaattaaaagacaaagactggcaaattggatagagtcgagacctgctagtg

SEQ ID NO: 26096 - DNA, 201 bp, Homo sapiens
gtagtctgtgaaaaacagtatggaggtttttcaaaggggtaataatagaactactatttcatctagcaatctctctactggatagctacccaaagggaaakcaattatattaaaagctacctgcacttgtatgtttatacagcattattcacaatagcagagatatggaatcaacctaagtgttcatcaacatatgattgg

SEQ ID NO: 26097 - DNA, 201 bp, Homo sapiens
atcaagtaggctttaatgctgggatgagagtttggttcaacatatgcaaatcaataaatatgattcatcacataaacagaactaaagacaaaaaacacgtwattatctcaatagatggagaacaggctttcagtacaattaaacattccttcatgttaaaagttctcaacaaacaagattttgaaggaacatacttcaaaa

SEQ ID NO: 26098 - DNA, 201 bp, Homo sapiens
gtgtaaattagttcaaccattgtgaagacagtgtggtgattgctcaagggtatagaaccagaaataccatttgacccagcaatccttttactgggtatacmcccaaaggattataaatcattctactataaagacacatgttcatgtatgtttattgaagcactgttcacaatagcaaagacttggaaccagcccaaatgc

SEQ ID NO: 26099 - DNA, 201 bp, Homo sapiens
aagaaagcctgcaatctgggcatggtggtgggtgcttataataccagctacttggaaggctgaggcaggagaatcacttgaacccgggaggcaaaggttgyaatgagccaagatggtgccactgcactccagtggcgctccagcctgggcgacagaatgagacaccatatcataacaaaacaaaacaacaacaacaacaac

SEQ ID NO: 26100 - DNA, 201 bp, Homo sapiens
acaagatcgtgatatatcaatgtcacttggaacaggtgtcttgaggttaaggttgttatactgaatcatccactttcctggcttaaatttctccaggaaaygcttggcactctctacagtgctctgcatgagcattgcaaccgtcatgagccctaagccaccaggaacgggcctcgtcgtatgccacatcacccacaactt

SEQ ID NO: 26101 - DNA, 201 bp, Homo sapiens
tctcagccctttgaatatatcattccagtcctttctgtactgtaaggtttctgctgggaaatatggtgatagtcttatggaaacttctttctgcacagtgwgtagctattctcctgctacctataagattctctctttatctgtgatttttgactgcttgattataatttgtcttggtatgagtctgcttgggtttatctt

SEQ ID NO: 26102 - DNA, 201 bp, Homo sapiens
gaaagcctgcaatctgggcatggtggtgggtgcttataataccagctacttggaaggctgaggcaggagaatcacttgaacccgggaggcaaaggttgcartgagccaagatggtgccactgcactccagtggcgctccagcctgggcgacagaatgagacaccatatcataacaaaacaaaacaacaacaacaacaacaa

SEQ ID NO: 26103 - DNA, 201 bp, Homo sapiens
cagatgcccagctttaaaatttctttcttttgtactctgttcctttatttctcaaactggctgatgcttagggaaaatagaaaagaacctatgtgactatyggggcaggttccccaataggagggtatgggctagctgggcttgtcttctgtggcaggtctgttccaggactttgcaggtcaggtgctatccacctgacag

SEQ ID NO: 26104 - DNA, 201 bp, Homo sapiens
gcttgtgcttatttggatcttctccttttttttttttttttttgctaatagatcccctagtgttttggtcttgtcaattcttccaatgattcaacttttgrttttgttgatcttttgtatggattttgctatctagattttgctcagctcttaattttagttatttctttttaaatagtaactttagagtctctcttgctt

SEQ ID NO: 26105 - DNA, 201 bp, Homo sapiens
tctgaaaaagattttatttctctttcacttatgaagttagtttggtagaatatgacattcatggttggaatttcttttgtatagggatgctgattataggyctccactctcttctggtttctaagatttctgctgaaagttctgctattagcctgatggggttccatttgtaggtgacatgctccttctctctagctgcca

SEQ ID NO: 26106 - DNA, 201 bp, Homo sapiens
gatgagatgatctagatatagtttatctagatttataaaaatgttctgaaggggagaagtggagtggatacaaagttttatttatcccttagtttctgacwtttttaaacatggaaatattgttactgcaaaacaactaaatttcttaaacacctaccatgtgccacttgataaggcaaacattttacttagatttttgta

SEQ ID NO: 26107 - DNA, 201 bp, Homo sapiens
tgtaatttcagccattacagtctgcttaagaaccattggtgagtttgtttggaggtaagaagacactctaacttctaatgttgccagagttcttgcactatttctttctttctttctttcttttttccatctgtgtgggctgatgttcctttagtttttggagttgctgccttttggatgaggcttttgcttttttctttc

SEQ ID NO: 26108 - DNA, 201 bp, Homo sapiens
agaaacatcagaaaattgtcaagtcacatataaaaggatctccatctgactgacagcagatttatcagctgaaaccttgcaggcctaaggagaatgggatrgtatatcaaagtgctggggaataaattgaggtaaaaatgccatacccaacaaaactattcttccaaaatgaaagagaaataaagtctttacctgacaaac

SEQ ID NO: 26109 - DNA, 201 bp, Homo sapiens
tcagaaaaaaacacagagtcactgctactggggatgttcagccagggggtgaggcaactgtgctgttggcctgaggtggggaccccgcttggggaagagtsggggttcgagggataacagggaggagagagtgggctcttctttgtatggtgactgtgtcttgctagaaatgtgagtaaagccctcaggatcttcatttct

SEQ ID NO: 26110 - DNA, 201 bp, Homo sapiens
cttattaagacacacccacttttgcctactttaagcacaagtttatagttactaagacatacatttgtttttatattagttagtatttgggaatgggtaayaagaaatttgatttacatagttgtatatgtgcatgtgtgcatcctcagatataagttcatgttttcattatgagtatatgtatttttatgtgttttttaa

SEQ ID NO: 26111 - DNA, 201 bp, Homo sapiens
tccagtctacagttcccagcgtaagcgacgcagaagatgggtgatttctgcatttccaacggaggtactgggttcatctcactggggagtgctggacagtkggtgcaggacagtgggtgcagtgcaccgtgcatgagcagcagcagggcgaggcatcacctcacccaggaagtgcaagggatcagggaattccctttccta

SEQ ID NO: 26112 - DNA, 201 bp, Homo sapiens
ccggttcatctcaatgggactggttgcacagtgggtgcagcccacggagggtgagctgaagtcaggtgggttgttgcctcacctgggaagtgcaaggggtyggggaattttctcccctacacaagagaacccatgagggtctaagcctgaggaactccagcacagatactgagcttgtccctcagtcttcacaacctgcaa

SEQ ID NO: 26113 - DNA, 201 bp, Homo sapiens
aaaggcctttgacaaaattcaacaacacttcatgctaaaaactctcaataaattaggtattgatgggatgtatctcaaaataataagagctatctatgacraacccacagccaatatcatactgaatggacaaaaactggaagcattccctttgaaaactggcacaagacagggatgccctctctcaccactcctattcaa

SEQ ID NO: 26114 - DNA, 201 bp, Homo sapiens
cacagccaatatcatactgaatggacaaaaactggaagcattccctttgaaaactggcacaagacagggatgccctctctcaccactcctattcaacataktgttggaagttctgtccagggacatcagacaagagaaggaaataaaggacattcaattaggaaaagaggaagtcaaattgtccctgtttgcagatgacat

SEQ ID NO: 26115 - DNA, 201 bp, Homo sapiens
ttcaatgccatccccattaagctacaaatgactttcttcacagaattggaaaaaactactttaaagttcatatagaaccaaaaaagagcccgcattgccawgtcaatcctaagccaaaagaacaaagctggaggcatcacgctacctgacttcaaactatactacaaggctacagtaatcaaaacagtatggtactggtac

SEQ ID NO: 26116 - DNA, 201 bp, Homo sapiens
ttcttttacaacctgggcaatcacgcatgcttgtggggcacagaataagcacccaggcctgcactggccagcattccaccacaaaccaggaccatctccastgcaacagtgcacacagtctctagcagggtactaccataaccccaacccttggctgccttgcctccaccactatggtgaatgcccacagggaggcaggta

SEQ ID NO: 26117 - DNA, 201 bp, Homo sapiens
gccactgaggccacatgtaagggtatccaatttcctttatgcctttatcaaccttcccttggaagttctctgcttgtgctgattgtatgtggctgaagttkgggcaatgctaatgaaggggatttcaagaccttaggaaagtgtacatacttaaggcactaccttttctccatccttggaaagaacaggactgggaagcct

SEQ ID NO: 26118 - DNA, 201 bp, Homo sapiens
tagatcttctcattgtcataagatggctgctatgccttatgtctcaagagacaaaattgtgaccagataccactggtaaaccaatttttggcaaggtgaawaacattactgtgattgcactaaacaaataagaaatcacacacttaaggttagagattgggcctattccctgtaaggcatatggcagtacaataaagagag

SEQ ID NO: 26119 - DNA, 201 bp, Homo sapiens
tcataaagatcctcacaatttgacaaattatgagacatttgaacaactagaccctgggaagttcagggactgatgtagctctggactctcaaacgtaggasatttgtgggccttcatttaagagccctgccattaatgtgttctaaccaaccccagtccttctttcttttagttgaacctctagggaaagagataatttta

SEQ ID NO: 26120 - DNA, 201 bp, Homo sapiens
ttactccttggtctgtgagtctctgagggagctatattgtttactactgtacttatacatctggtcaacttctctttgtatttgtagtatatgcttcatgyatttgccagctttattaaaacagaaaagtatatgactgttacagcatcctcatgtatcataccattttaggtttcagttttaaaatttgctttctctaat

SEQ ID NO: 26121 - DNA, 201 bp, Homo sapiens
agtaaatacttttcttgacatgggttttggcaaataatttatggccaagttcctaatagcaattgcaaaaaaaaaaaaaaaaaaaaaattgacaaatgagwcctaattaaagtaaagggcttctgtgcaataaaataaattaccaatagaatcaacaaacagtaacagaatgggagaaaatatttgcaaactatacatcca

SEQ ID NO: 26122 - DNA, 201 bp, Homo sapiens
cttgaggtgaaaagttaggtagttagtttgagatcttttttttttttaaattttatttaaaaaattgtattgtattttggtaagaacatttaacatgacayctaccctcttaactgatttttaagtttccaaacagtagtcttcatttgggcacaatactttacagcagatctctagtatttattcatcttgcataaccaa

SEQ ID NO: 26123 - DNA, 201 bp, Homo sapiens
cctcatgcaattattgggacatacttatattaaaaattactctctattcatttgaaattcaaatttaacttgatttcctgtattttatctggaaaccctamctttatgcccttttatgtctccactctccaactcttggttttgcagagttgatgtatactgttaagtttcagtgtattactgaaacaatatctatttttt

SEQ ID NO: 26124 - DNA, 201 bp, Homo sapiens
ttagttttattgtgataaaatatactcgccataaaacttactgtgttagccacttttaatttttttaattattttttattacaataggtttttggggaacmggtggtgtttggttacataaataagttttttagtggtgatttctgagattttggtgcacccatcacccgagcagtatacactgtacccagtatatagatt

SEQ ID NO: 26125 - DNA, 201 bp, Homo sapiens
gtggtgatttctgagattttggtgcacccatcacccgagcagtatacactgtacccagtatatagatttttatccctcaccctcctctcaccctttccctygagtcccgagagtccattatatcattcttatgcctttacatcctcatagcttagcttccacgtatgagtgaaaacctacaatgtttggtttttcattcct

SEQ ID NO: 26126 - DNA, 201 bp, Homo sapiens
ttctgagattttggtgcacccatcacccgagcagtatacactgtacccagtatatagatttttatccctcaccctcctctcaccctttccctcgagtcccragagtccattatatcattcttatgcctttacatcctcatagcttagcttccacgtatgagtgaaaacctacaatgtttggtttttcattcctgagttact

SEQ ID NO: 26127 - DNA, 201 bp, Homo sapiens
gtacccagtatatagatttttatccctcaccctcctctcaccctttccctcgagtcccgagagtccattatatcattcttatgcctttacatcctcatagyttagcttccacgtatgagtgaaaacctacaatgtttggtttttcattcctgagttacttcacttagaataatggtctctaattccatccaggttgctgca

SEQ ID NO: 26128 - DNA, 201 bp, Homo sapiens
caattcacacaataagaacaaaagctgaacaaactaaaagttaatgacaattcttaaatttatcaatatgctgaggtaacgggaaaaccactcttcccaaractgaatgaaaagacaggcagatacaaagaagtgaaacttgctagaacaaaagcctaggagcagaaaatttcaggggaaccagcacagctttagagaaac

SEQ ID NO: 26129 - DNA, 201 bp, Homo sapiens
gagacacaaccaagaaagagaattttaggccaataaccctgatgaacatcgatgcaaaaatcctaaataaaatactgccaaaccgaatcaagcaacacatmaaaaagcttatccaccatgatcaagtgggcttcatccctgggatgcaaggctggtttaacatacgcaaatcaataaacgtaatccagcatataaacagaa

SEQ ID NO: 26130 - DNA, 201 bp, Homo sapiens
accataaaaaccctagaagaaaacctaggcaataccattcaggacataggcatgggcaagaacttcatgtctaaaacaccaaaagcaatggcaacaaaagycaaaattgacaaatgggatctaattaaactcaagagcttctgcacagcaaaagaaactaccatcagagtgaacaggcaacctacagaatgggagaaaatt

SEQ ID NO: 26131 - DNA, 201 bp, Homo sapiens
ataccattcaggacataggcatgggcaagaacttcatgtctaaaacaccaaaagcaatggcaacaaaagccaaaattgacaaatgggatctaattaaactmaagagcttctgcacagcaaaagaaactaccatcagagtgaacaggcaacctacagaatgggagaaaatttttgcaatctactcatctgacaaagagctaa

SEQ ID NO: 26132 - DNA, 201 bp, Homo sapiens
aaattatcagactgagaattgaaaccatttgtgattaatatagtaagggctataatggaaaaactggtcaacatgcaagtacagatctgtaatgtaagaaracagatgggaacttcaagaatcaaaagcaaatgctagaaataaaaaaaaaaaatataacagaaatgaagaacatctttgatgggctcatcaatatattgt

SEQ ID NO: 26133 - DNA, 201 bp, Homo sapiens
tctctaaatagaacaataatgagttctaaaattgaggcagtaataaatagcctaccaatcgaaaaaaaaaaaaaaaagcccaggaccagatggatttacakctgaattctaccacaggtacaaagaggagctgataccatttctactgaaattattccaaaaaattgaaaaagagggatttttttctaactcattttatga

SEQ ID NO: 26134 - DNA, 201 bp, Homo sapiens
gggccttcagagggcttggagcctggaagcttttggtgctctgggcagctccagctgagagtagccataggcaccaatccccaagtcttcccattcctccraggaggtgcaggccgggatgacctctgacccaggagagagcagagccagcttcttcatgggactgaggtgcatctgctctgcaagctttcctgcctttca

SEQ ID NO: 26135 - DNA, 201 bp, Homo sapiens
tgcctttcagctactcccagcatccatgcctagctactctgcaggagcaggtgcacataacagcccctgcagcccaacctcagtgtattgatgcacgtgagtactttcctagctagcctggagcatattggatcccctagcacaggcagaactgagtcccagctaagagacagtcaggtgcacccagggctacagcgtgct

SEQ ID NO: 26136 - DNA, 201 bp, Homo sapiens
ctacttgagagtaaggagcagagatctgtggacagtaatgaagctggggaggagctcccaaccccagaacactgagaagggagagatgcatgggtttctgrgcaaggtgagatggggcatgcctccctccacagggtgggtccatagagtgtggcatatctctgctgcagcccctgcccaagagggctggtggtacagaat

SEQ ID NO: 26137 - DNA, 201 bp, Homo sapiens
gggaggctgaggtaggagaatcgcttgaacctaggaggtggaagttgcagtaatccgtgccattgcactccagcctgggcaacaagcacaaaactccatcaaaaaaaaaaaaatcctatacagaacactagccttctgaaaggatccacaaatatagccaactaactatactgaacttacaccacagttacagaaatacca

SEQ ID NO: 26138 - DNA, 201 bp, Homo sapiens
aacgctattcctaccaaactaccaaagacatttttcaaagaattggaaaaaacctattttaaaattcatatggaatctaaaaagagcctgaatagccaaarcaatcctaagcaaatagaagcagagatatcacactaccccacttaaaactatattataaagctacagtcaccaaaacagcatggtgctggtacataaaca

SEQ ID NO: 26139 - DNA, 201 bp, Homo sapiens
aagccaacattgacaaatgggatctaattaaactaaagagcttctgaacagcaaaagaaactatcatcatagtgaacaggcaacctatagaatgggagaayatttttgtgatctatccatctgacaaagggtaatatccagaatctacaagaaacttaaacaaatttacaagaaaaagacaaacatccccatcaaaaagtg

SEQ ID NO: 26140 - DNA, 201 bp, Homo sapiens
tgaggcaggagaatggcgtgaatctaggaggcggagtttgcagtgagcccagatggtgccactgcactccagcctgggtgacagagcgagactccatctcaaaaaaaaaaaagaaaaccggatgaatgcatgtcctttgcagggacatggatgaagctggaaaccatcgttcttagcaaactaacacaaatcggaaaacac

SEQ ID NO: 26141 - DNA, 201 bp, Homo sapiens
ttctttctcttgcccgattgccctggccagaaattctgatactattttacacaggagtggtgagagagggcatctttgtcttgtgccagttttcaaataartgcttccagcttttgcttttgcctcgtcagtatgatattggctgtgggtttgtcataaatagctcttattattttgagatatgtttaatcaatatatagt

SEQ ID NO: 26142 - DNA, 201 bp, Homo sapiens
ttggtctttgatgctggtgacctttggatggggtttctgtgtggatgttctttttgttgatgttgatgctatcccttttggtttgttagtctattttctarcagtcaggcccctctgctgcaggtctgctggcatttgctggaagtccactccagaccctgtttgcctggttattgccagtggaggctgcagaatagcaaa

SEQ ID NO: 26143 - DNA, 201 bp, Homo sapiens
aaataaacttcagaaactttaaaaattttagccagcagcagcccatgctatgggtgggtccaatggaaatttgtgagtgagtcaccagtgtgtaagagggrgagagaatttctctctgatacatattttcattggggaactgggaaatccaggccacgagggagctccttgatcctaccaagcacaggatctgacttggtg

SEQ ID NO: 26144 - DNA, 201 bp, Homo sapiens
aactatgctatcattccagttagtattccaagtcagaaaagacacaacagtccctcagactgtccccagagaagctagaactttacaagcaagttccattyatattctttcattccaatggaggaaccaataatttgatggattctttcagacactcagtgctgtgttagagagggagtgggacaagggcaagcagaaatg

SEQ ID NO: 26145 - DNA, 201 bp, Homo sapiens
gtctgctccaaatcccgcctccgtcactacaaacccttctgggccaacaagctagagtgtgatccggtctgcaatgatagaggaattgccgtgtgcgatgwtggcaaatgggcctgcatggacaaacactggagtgccctccaatctctgcatgagattgggcttgattgtgtccttcataagcactatcaatgcaccact

SEQ ID NO: 26146 - DNA, 201 bp, Homo sapiens
agatattcatggatcagcacttgccttctggcctgaggaagccttaaagagaatattaagtgttagtgggattgtcatacagtcagtggggttgggtgggrccagatgctctacagttgcctcccagcctggaaaaggctcaaggagagaaatgacattacataaggaagctggctagggacttcagctaagcaaactcat

SEQ ID NO: 26147 - DNA, 201 bp, Homo sapiens
ctcaccagtctccaggcccctagatggccaattggatgacatttacgagtcctgaaggggctggacctgggttgagccagcccagagttcagtgctgtctrtgtaatggggagagttgggttggtccctgggtcactggctgaactctcaggcaggtcaggcagaccagtcaggtggtgggaacctgagggtggataactg

SEQ ID NO: 26148 - DNA, 201 bp, Homo sapiens
tgtgaattatttatactcattaactctaaattctcacattgccatctcataaatgaattcactacaaagtggtttttaccaccaaaattattcttgccaargtccctgaatttttttttttttttgcatttttgctaaaaataatgactgcttctcaatacttaccattcattacctcattataactggtggcaatattga

SEQ ID NO: 26149 - DNA, 201 bp, Homo sapiens
ttgctgcctgatccttcctctggaagcttcatctcaggggcatccagctctgtaagatgtcagtcagcccctactgggagctgtctcccagttaggctacytgggggtcagggacccacttgaggaggcagtctgtccgttctcagatctcaaactgcatgctgggagaaccagtactctcttcaaagctgtcagacagga

SEQ ID NO: 26150 - DNA, 201 bp, Homo sapiens
atgtcagtcagcccctactgggagctgtctcccagttaggctacctgggggtcagggacccacttgaggaggcagtctgtccgttctcagatctcaaactscatgctgggagaaccagtactctcttcaaagctgtcagacaggacgtttaattctgcagaaatttctgctgccttttgttcagctctgccctgccccaga

SEQ ID NO: 26151 - DNA, 201 bp, Homo sapiens
tatttccccttcccagtactcttcccagcctctggtaatcaacattctattcattaccttcataagattaacattttagctccaacacatgagtgaaaacyattatcaagaagccacaaaggtgtttttggccgggtgaagtggcccacacctttaatcccagcactttgggaggccaaggcaggcggatcacaagatcag

SEQ ID NO: 26152 - DNA, 201 bp, Homo sapiens
ttgcccccgttcttatttgacctaagctgctgctgcacagtgctatcttataactggagccactgctatattgtgtcttgctcatgagggcaataaccacktcatgcctccatccctgaggttttgccatcattacaccatgctcatacctagtagtacaccattactcagccaaactattatgggtcactcccctttgga

SEQ ID NO: 26153 - DNA, 201 bp, Homo sapiens
gtactacctgttagtgatcttataaggattaaataatatgcatatggaaaatatatatatacttgccatttagttgtttgttgagcatactgaatatttgyatacaaaggtatacttacaacacttttttcacaagcacagctgaaataaactataacaactaccacttatactatttaccataaattgtgctaaatgttt

SEQ ID NO: 26154 - DNA, 201 bp, Homo sapiens
gtgtttttgaagcagaatatatttactcactcaacccaaatacagacagctttatggctcacatcttctttgacatattagtgttgctgcttcgtggaagkgagaggtctgcctttcagcccatgtggtgagtgtcatttgtggtggtgtaagctagttaggttagtctgacctcaggtgccaggaggactggataggtac

SEQ ID NO: 26155 - DNA, 201 bp, Homo sapiens
ccttgttgtagggctcatcatgtacacttcagatgcacgttgttgtctctccaggccacagtgtgtctgagagccagggagaatgcctctcttgcaactcyccatggaggtgtttttgaagcagaatatatttactcactcaacccaaatacagacagctttatggctcacatcttctttgacatattagtgttgctgctt

SEQ ID NO: 26156 - DNA, 201 bp, Homo sapiens
cagcaaatattgctgcctgctccttcctctggaagctttgtcccagaggggcaccaacctgatgccagctggagctgtcttgtatgaagtgtccttcgacycctgttgggaggtctctcccagtcggatgcacaaggtcagggacccagctgaggtggcattcggtcccttggcagagctggtgcactgtgctgggagaat

SEQ ID NO: 26157 - DNA, 201 bp, Homo sapiens
gcaaaggacatgatctcattcctttttatggttgcatagtattccatggtgtatatgtaccacattttctttatccagtctctccctcccttctccataawtttttggataatttgagtagaattataattagttctttcttaaatatttgatagaattcagcagtgaaaccatcaggttactgcttctatctcattactc

SEQ ID NO: 26158 - DNA, 201 bp, Homo sapiens
ttttctcccatttgttttttttatcatctgggacataattgattccacagttgatgactattgctaggtttgatccattcccctttaaccatttcaggccraccagttgcaaccaccaggatgtcgcctttatttacctcctcatccagattggcagtcttggagtggcaggtggtcactgtggcattgttccacagaagc

SEQ ID NO: 26159 - DNA, 201 bp, Homo sapiens
ggagctttctttatttgaaaaatagctctaagaatactacagctcacatcacacataatggtaaaagtgtgagagcttttcccctaaaattaggaaacagrcaaaaatttttattctcaccactcttaattacaatgctggaagttccagacaatgcagttagacaagaaaagtaaataaaattctgatcagaaaggaaga

SEQ ID NO: 26160 - DNA, 201 bp, Homo sapiens
gaaaaatgttaagggcagccagagaaaaaagtcaggttacccacaaagggaagccaatcagactaacagcagatgtctctgcagaaaccctacaagtcagragagagtgggtgccaatatttggtgttctcaaagaaaagaattttcaaaccagaatttcatatctagccaaactaagcttcataagtgaagaagaaataa

SEQ ID NO: 26161 - DNA, 201 bp, Homo sapiens
ctgacaaagggctaatatgcagaatctacaaagagctcaaacaaatttacaagaaagaaacaactccatcaacaagtgtcctgtagtttttttgttgttcktgtgttctttcatgtttttaatatcgtggagatactggatttgtacaatgatttagagaggtattcctccactttgattttttggaatagcctcagtagg

SEQ ID NO: 26162 - DNA, 201 bp, Homo sapiens
gtgccagtatttctgagggtgtgtgatgagactagttctagagtgtgggaagaaataggaaactggaatcaactactgttgcctggatgaaaggctattgytgaaacaatggtgtcaggaacagcaggcaaactggaagaaacaaaccccttcacctcttttctttcctcctagtctttctctggcacccatatttgaagg

SEQ ID NO: 26163 - DNA, 201 bp, Homo sapiens
atgtaagggtatccaatttcctttatgcctttatcaaccttcccttggaagttctctgcttgtgctgattgtatgtggctgaagtttgggcaatgctaatsaaggggatttcaagaccttaggaaagtgtacatacttaaggcactaccttttctccatccttggaaagaacaggactgggaagcctgattgccctgcccc

SEQ ID NO: 26164 - DNA, 201 bp, Homo sapiens
atgctcacaaaggcattgctggtgttgactacagctgaaggaactgcatagagactatgctattgcactcactggaatcaaagccagcatgctctacccartcaagccctaggaaacatcagcaggtaaaagtatctccacatgaaagacacttgataatattggaaaagataaccattccaccttatgcatgggtattaa

SEQ ID NO: 26165 - DNA, 201 bp, Homo sapiens
tctgtgtagagagaggaagatgaaccccagtcattgtttgagcccaggtggtgggcacacattcagtgtggatggagccactattaaaagtgctagacgarcaaccacaaagtgcacttgcaccagcccccagtgggaaaagccttggctgcatctgtggcaatagatggggtggcaggaggtgatctctctacatttgtt

SEQ ID NO: 26166 - DNA, 201 bp, Homo sapiens
aatgcacattcactaaaatagttataaaccaaaaggataagggttaatgagcatgtggagtaactgggaccctcatacatttctggtaagactgttgtcamattggtgcagactctttggaaaacaatttggcattttcttaaaatgttaaatgtaaatttgtcataagactcaactatttcattcatctttatatgtata

SEQ ID NO: 26167 - DNA, 201 bp, Homo sapiens
tcctcaagatgcatttatagtgctgcattttgcaaggtttccttgtttatgaaggctcaacaatttccattatatatgtatgtgtgtgtgtgtatatatakagagagagagtttctcaacctgttcatctgttgatggacatttaggttattcccacctcttggttattgtaagtagtgctgcattgatattcagaatgct

SEQ ID NO: 26168 - DNA, 201 bp, Homo sapiens
ccaaacagtagtcttcatttgggcacaatactttacagcagatctctagtatttattcatcttgcataaccaaaactttatatcacatgaatagcaattcyccatttctccctttctccatctcctgacaatcatcatttcactctctgcctctatgagtttgacaaatttagataactcatataagtggaatcacacagt

SEQ ID NO: 26169 - DNA, 201 bp, Homo sapiens
acgcaagttagcaaatgtctgtggcaccaatctccatgttctgattctgcatccctctgagggtctacactgggaactgcctggtggcagaattgttctgwggggaactattctctttcctctgttgtcatcctatcattgacctgactgagataccagagattgacaaactctcgggctgcagttatggtggcacttctc

SEQ ID NO: 26170 - DNA, 201 bp, Homo sapiens
gatggagctggaagccattattctcagtaaacgaatgcagggatagaaaagcaaacacagcatgttctcacttataagtgggatgggagctgaatgattakaacacatagacacatggtggggaacaacacacacttgggcctgttgggggatgttgggagaaaggagagcatcaagaagaatagctaatggctgctgggc

SEQ ID NO: 26171 - DNA, 201 bp, Homo sapiens
ctaacggtcaggaccttcagctgcaggtctgttggagtttgctggaggtcccctgcagaccctgtttgcctgggtatcagcagcagaggctgcaaaacagsgaatattggtgaacagcaaatgttgctgcctgatcgttcctccggaagttttgtctcagaggagtacctggccgtgtgaggtgtcagtctgcccctactt

SEQ ID NO: 26172 - DNA, 201 bp, Homo sapiens
acctgatggtcctggctgatgagctcagccccataaagaatgtcgaggaggctttgcgcctctgcaggtgactctcgggcccaagcaaccttctggaaaaygggttaataaataaatcaataaagaaccttcaagtttctactacttccgtgtgcctctgtgtcttgcatgatggatcttggctaggtcagctcctgatcc

SEQ ID NO: 26173 - DNA, 201 bp, Homo sapiens
ctgtgctgagggtccttggacctcatgctaggattaccagcccagagggacgcttcataccgctacacctgggatcggagtctgtttctgatctaccgacrcaaggagctgcagagaatcatggaagagctggatttcagccagcaggttggtatggcctccatgccccagtcagaagccccttggggcgatgcctgtctt

SEQ ID NO: 26174 - DNA, 201 bp, Homo sapiens
gtgggttctggagtcgactggaatacttgggagatgagatgacaggtctggtcatgaccaagacaaaaactcagcgtggcctcatggagcccatcactcayatcaggaagccccactccatccgggtggagacaggtgaggcgcagggctgtaagccagctagcatcttgtgcctggcccggaggcagggtagtgtggaag

SEQ ID NO: 26175 - DNA, 201 bp, Homo sapiens
aagaccctacccctgacatcatcctctcttctcaagaacccatagaccccctggtcatggggaaatacacccagaggctgcacagtgaggtgaagggaagygcccagcagccattcccctgcctcccacctgccttattcattccattcagtctgcagacaataagtgcccactccatcatggtggaagcagagctgcttc

SEQ ID NO: 26176 - DNA, 201 bp, Homo sapiens
gggctccgagcgggtggcccaccagtgccgcgagaacctctacaccatccagacactcaaggacttccagtacatcgaccgcgacggcaaggaccagggcrtcaacgtgcgcgagaaggtcaagcaggtgatggccctgctcaaggatgaggagcggctgcggcaggagcgaacccacgccctcaagaccaaggagcgcat

SEQ ID NO: 26177 - DNA, 201 bp, Homo sapiens
tgccacccaaggcaagccagaaccccctccaagcacttgccctggcggggaacagtgaggatgctggctgttcaggggtgtggcatttccacagcagctcrtggcaccagggtctttgaagggagggacccaagcctctgcaggttcaaggacaaatgaggagtgatggcatttctccactgtgtcttgccctctagtttg

SEQ ID NO: 26178 - DNA, 201 bp, Homo sapiens
ggttgggggcagggcctgaggcagctcctgctctcatacattctgagagccagtttgacaataggcaactacacaaaaaaccgaaataatcccagaatgcstcagggctccaggggaaggcgaaaaaagcgggtgcgtttataaacttaaaataatcagaggcagcatctccaaggactgtgagaatgccccaagtcaggg

SEQ ID NO: 26179 - DNA, 201 bp, Homo sapiens
caagtcaggacaggttttctttggaagaccctacccctgacatcatcctctcttctcaagaacccatagaccccctggtcatggggaaatacacccagagsctgcacagtgaggtgaagggaagcgcccagcagccattcccctgcctcccacctgccttattcattccattcagtctgcagacaataagtgcccactcca

SEQ ID NO: 26180 - DNA, 201 bp, Homo sapiens
cacagcatagttcatatataggtgcttcccacagagtaaactctgcctgtgatgttgtcccgttcttccaggtccgtgggctgctggacaccctggtgacygacctgatggtcctggctgatgagctcagccccataaagaatgtcgaggaggctttgcgcctctgcaggtgactctcgggcccaagcaaccttctggaaa

SEQ ID NO: 26181 - DNA, 201 bp, Homo sapiens
tgaggtaggcctctgcccctgagttcctggccctctcttcctcagccccatgtggaacccaaggatgcagctgctctgctaacacggcagcccatccttcragactgtgacctcgccacagtggccctcagccctccacctccggcgggggcgagggccacccacctccaagtctccagccatgacgacctccgcactccg

SEQ ID NO: 26182 - DNA, 201 bp, Homo sapiens
cgtggtctgggccaggtggggctggggaggggattggaggggctgcggaggtgggggctgtggaggtgggcatgtgcccaggctctcccagtgagctactrttgaggacatccttggcctacctctggagctcctgaaggctatgtgtgtctccctcccccagcaggaccgtcccaacagcaagaagcacaaggcaaagga

SEQ ID NO: 26183 - DNA, 201 bp, Homo sapiens
gtggggaaagctgggaaggaggagcggaaaggagcagcccaggaaaagaagcaactggggatcaaagacaaagaagacaagaaaggagccaagctgctcgrgaaagaggcatgctggggcgtggtctgggccaggtggggctggggaggggattggaggggctgcggaggtgggggctgtggaggtgggcatgtgcccagg

SEQ ID NO: 26184 - DNA, 201 bp, Homo sapiens
aggcatcaggactcagggcccacatgcctcatttccctctgctctgtgcactgtcttgattttcccttctctggagactggcctgccctcctcagtccacrtggtggaggaaggtggcttcccactgcttcctgggccacgggaagattctgtatctttccagccttcccatcatgcagtgcttcacctgtctcttcccct

SEQ ID NO: 26185 - DNA, 201 bp, Homo sapiens
accccctggtcatggggaaatacacccagaggctgcacagtgaggtgaagggaagcgcccagcagccattcccctgcctcccacctgccttattcattccrttcagtctgcagacaataagtgcccactccatcatggtggaagcagagctgcttcaggaagggcatcctcgtgtgtgagacaggcctcatgaataaggaa

SEQ ID NO: 26186 - DNA, 201 bp, Homo sapiens
actgtgagtggctctggcaagagggcttaaagagtctgtgtgtttctaagaatctcccatctacagcaatgggtcaggaggaagctgcgcgggagtggagytgatcatactccattgcagggtagagctggttgtgtttctaggcttcctggtgaccgtttctgtggggttccacatggcatgactgtggcagcctaagag

SEQ ID NO: 26187 - DNA, 201 bp, Homo sapiens
tggcctggaggtggtgggcaaagggtggcccttctcggctgttactgtggaagactacacagtgtttgaaagaagtcagggaagctcctctgaagacacarcatacttgtgagtgcagcctgaaccctggggagagaggctgaagagttctccagcacctaccagtattaaagagcgggcttccctccctgagatcagggt

SEQ ID NO: 26188 - DNA, 201 bp, Homo sapiens
tggatccttttcatccatttttagggaacaaggatgtctggagagactcagaggttttcaggtcttagaacaggcgtgtgtgtgtgtgtgtgtgtgtgtgwgtgagagagagagagagagagagagagagacaatggcaggaactcagaccctaggaaggcacaaagtcctgggggctccaacttcctgaaggatgcattg

SEQ ID NO: 26189 - DNA, 201 bp, Homo sapiens
gaggagcggctgcggcaggagcgaacccacgccctcaagaccaaggagcgcatggcactggagggcatcggcattggcagtgggcagctgggcttcagccrccgctacggcgaggactacagccgctcccggggctccccgtcctcctacaactgtgagtaagccccggtgtgtggctgggatggggaggtggcccgactt

SEQ ID NO: 26190 - DNA, 201 bp, Homo sapiens
cttggccacccttcccctcccttcaaatctttgtgggttgtcacctcctcactgaggcctctgtgcctccattccctgcctggtctatcttctctcccatygtactcatcacctaacatgctaggcgcattccttattcatgaggcctgtctcacacacgaggatgcccttcctgaagcagctctgcttccaccatgatgg

SEQ ID NO: 26191 - DNA, 201 bp, Homo sapiens
ctggtaatctgactcacctttccttccttgccagagctgggagaacagtgggttctggagtcgactggaatacttgggagatgagatgacaggtctggtcrtgaccaagacaaaaactcagcgtggcctcatggagcccatcactcacatcaggaagccccactccatccgggtggagacaggtgaggcgcagggctgtaa

SEQ ID NO: 26192 - DNA, 201 bp, Homo sapiens
ggcgtgagccaccacgccaggccaattttgtatttttagtagagacggggtttcaccatgttggtcaagctggtctcgaacacctgacctcaggtgatccrcccgcctcagcctcccaaagtgctgggattataggcgtgagccactgtgcccagctgggttacctgtttttgtctggggtgcccaagctgctatattcca

SEQ ID NO: 26193 - DNA, 201 bp, Homo sapiens
taattaatacatagcagcatgagtctgcccaccgtcccactcaatcagctgacaactcgagtgagtgtgaggtgggagcttggaatctgtcgtccgcagtsagtttcacagtgtggccatttgagccgtgcatcctgggatttggtggaaagctgtgcttttttattcattgtggcccccaatcacaaggccggctccttc

SEQ ID NO: 26194 - DNA, 201 bp, Homo sapiens
gtggaagctctgctaggttgagcccatggagtaggccccttacccctttctgtcggctgccaggatgtggtacccagaagctaccttagtgaccaccttgstttagtaatcccagcaaagttaaatgacttatccatggccattcatggcatggcagagctgggaccagaacataggcaccacagtcctgtttcatgaagc

SEQ ID NO: 26195 - DNA, 201 bp, Homo sapiens
ttgctccacaaacacttcccagggcttgtgatttaaaagatgggtgcactggctaggcaggcatggagcagcttgcagcaatgccatgcatggccccactsagttagaaagaaattagactgagccttaagaggcagactgtaaagtacaatgtgtggccctatgtactggtctgtgttttgttcatcgctgtctggtact

SEQ ID NO: 26196 - DNA, 201 bp, Homo sapiens
ctctgaatggacaagcagcagtgcctgggccagtcatactcctttggtggaagctctgctaggttgagcccatggagtaggccccttacccctttctgtcsgctgccaggatgtggtacccagaagctaccttagtgaccaccttgctttagtaatcccagcaaagttaaatgacttatccatggccattcatggcatggc

SEQ ID NO: 26197 - DNA, 201 bp, Homo sapiens
atttctcccagcctaagaggagaattggatttttagcaaacaggtaactactcttgctccacaaacacttcccagggcttgtgatttaaaagatgggtgcrctggctaggcaggcatggagcagcttgcagcaatgccatgcatggccccactcagttagaaagaaattagactgagccttaagaggcagactgtaaagta

SEQ ID NO: 26198 - DNA, 201 bp, Homo sapiens
agagactgatggaacttgagaacctggggaggtgagccaccagggagcagaagcgttctaggggctcagttatctaggtgcacaggcctggggctaggatrgccagctgtctctgtttgcctgggactttagcactcaaattcccacattccaggaaacctctcagccctgggcaaactgggatggttggccagccacctg

SEQ ID NO: 26199 - DNA, 201 bp, Homo sapiens
gacccccattattaaaaaaataaaagtccaatgctgttttatgacatactatatatatatatgtatgtattttatatatattatgtatatgtgtatatatrtgtgtgtgtgtgtgtgtgtgtgtgtatatatatatatatatatatatatatatatatatatatgtattttgagacagggcctcgctctgtcacccgggat

SEQ ID NO: 26200 - DNA, 201 bp, Homo sapiens
agactgagtggagcctacaccctaaagagagaggttgaagagtcccccacctttttttctggtagaccagtgcagtacctgtaccaacccacaccatctgkctgggggcaggtaaagatgacaacagggtgtccagaaaacacggcagtggatgcttctgttatgcaatcacggcagcaatgaattccccagaggaagcat

SEQ ID NO: 26201 - DNA, 201 bp, Homo sapiens
gttgtacttttcagctggctgagcggatacctacctcaccctgtctgatgaccctcatctctgctgaaggagagtcaaagcaaaaagccccaaaagaagasaagagacctccctgggccccacctcctcagcacaactttctgaaaaactggcagcgtaacacagccctgcggaagaagcagcaggaagccctcagcggtg

SEQ ID NO: 26202 - DNA, 201 bp, Homo sapiens
agaggctcacgcctgtaatcccagcactttgggaggctgacgtgggtggatcacctgacatcaggagttcaagaccagccctggccagcatggtgaaaccycatctctactaaaaatacaaaatagcagggcgtggtggtgggcacctgtaatccctgctacttggaaagctgaggcaggagaatcgcttgaacccgggag

SEQ ID NO: 26203 - DNA, 201 bp, Homo sapiens
ggatattactaagtcacatatctgttacacaggcatttccttgacagaacatatggacagagctgaagaaacagatctgtcagccttcaggaactccaccyagaactagaacagaagagatgggtggtgctcttcctcctgccaccacaggtggaattctcctttgttttatttctttttagcaacacattcctcgcctta

SEQ ID NO: 26204 - DNA, 201 bp, Homo sapiens
ctggcatgtatccctagaacctagcacagtgcctggcatgtagaagctgcttaaacaatctttattaaatgaatatgcaataaatggccagtggtgaatgytctgcttcccccacagagattctgcactttaaccagtgtcttgtgaaaccctgtgccttcacccagaagcatggatcagtgccagcactggaggaggctg

SEQ ID NO: 26205 - DNA, 201 bp, Homo sapiens
cgtgcattcagcacgtctgaaaatggtgacagcaacactgacttgagcaagaataaaatcacaaggctgcgagtgtcataagccacttggggcttataccyagcccccaagcatgtaaacaagcaaactcaagtaggtatggctctaagaaggttccaaaatattcttcagatgctaaggaatagaagtgttcattggata

SEQ ID NO: 26206 - DNA, 201 bp, Homo sapiens
atcacctgagccagggaagtcaaggctgcagtgagccatgatcacaccactggactccagcctgggtgacagagtgagatcctgtcaaaaaaaaaaaaaaatctgcaaaaccaaaaattatttcacaagaactttgaacttgtgaaattctttcacaaacaactggtttctttcccctctccagctattctctcacagcat

SEQ ID NO: 26207 - DNA, 201 bp, Homo sapiens
cttttcatccatttttagggaacaaggatgtctggagagactcagaggttttcaggtcttagaacaggcgtgtgtgtgtgtgtgtgtgtgtgtgtgtgagwgagagagagagagagagagagagacaatggcaggaactcagaccctaggaaggcacaaagtcctgggggctccaacttcctgaaggatgcattggttttg

SEQ ID NO: 26208 - DNA, 201 bp, Homo sapiens
ggccacctccccagactggtttgaaaagtaaaactgcaaaagcaggtggattgcttgagcccaggagttcgagactagcctgggcaatgtggtgaaacccyatctctacaaaaaatagaaaaaagtagccaggtctggtggtgcacgcctgtagtcccagctacttgggaggctgagatgggagaatcacctgagccaggg

SEQ ID NO: 26209 - DNA, 201 bp, Homo sapiens
gctcaggtgatcctcccacctcagcctcctaagtagctaggactacaggcatacatcaccatgctcagctaatttctctctttttttttttttttttttttggtagagataggatcactctatgtcatacaggccggtcttgaactcctgagttcaagtgatcttcctaccgtggcttcccaaagcactgggattgcaggc

SEQ ID NO: 26210 - DNA, 201 bp, Homo sapiens
acccatgggggtcaacgtcaacccttccatggctctttgatattaagaatcaacttgcagaccaggtgcggtggctcgtgcctgtaatcccagcactttgrgaggccaaggtgggcagattgcctgagctcaggagttcaagaccagcctgggcaacatggtaagatcccgtttctactaaaaattcaaaaaattagccag

SEQ ID NO: 26211 - DNA, 201 bp, Homo sapiens
ctgtgccgtccccctgctgcacaggtcggagggtcaccgcagaggctactcgggctggggctggggccgagggagcccgcactggaggtaagcttcctccytggccccctccctggcagtggcggcatggaaggcgggggttggtggggagcaaacagtggttctggggcttagtctcttttccaggtgcgagggagaagg

SEQ ID NO: 26212 - DNA, 201 bp, Homo sapiens
tacttggccacccttcccctcccttcaaatctttgtgggttgtcacctcctcactgaggcctctgtgcctccattccctgcctggtctatcttctctcccrttgtactcatcacctaacatgctaggcgcattccttattcatgaggcctgtctcacacacgaggatgcccttcctgaagcagctctgcttccaccatgat

SEQ ID NO: 26213 - DNA, 201 bp, Homo sapiens
gtatgtattttatatatattatgtatatgtgtatatatgtgtgtgtgtgtgtgtgtgtgtgtgtatatatatatatatatatatatatatatatatatatatgtattttgagacagggcctcgctctgtcacccgggatggagtgccgtggtacagtcataggtcactatagtcttgaacttctgggctcaagtgaacctc

SEQ ID NO: 26214 - DNA, 201 bp, Homo sapiens
tgtcacatttttcagtacctcaagagaaggagccatatcttaaccttttataccatctttgtagtttatagcacatagaaggggcttggtaagcactctckaggagcaatttaactttaagatacatatatatccctgggcgcactggctcatgcctctaatcccagcactttgggaggccgaggtgggcagatcacctga

SEQ ID NO: 26215 - DNA, 201 bp, Homo sapiens
gatccttttcatccatttttagggaacaaggatgtctggagagactcagaggttttcaggtcttagaacaggcgtgtgtgtgtgtgtgtgtgtgtgtgtgwgagagagagagagagagagagagagagacaatggcaggaactcagaccctaggaaggcacaaagtcctgggggctccaacttcctgaaggatgcattggt

SEQ ID NO: 26216 - DNA, 201 bp, Homo sapiens
attgtgacctcaaactccccggctcaggtgatcctcccacctcagcctcctaagtagctaggactacaggcatacatcaccatgctcagctaatttctctctttttttttttttttttttttggtagagataggatcactctatgtcatacaggccggtcttgaactcctgagttcaagtgatcttcctaccgtggcttcc

SEQ ID NO: 26217 - DNA, 201 bp, Homo sapiens
tgacagtaatagcaaactcttttatgtgccaagctctgttctgcgcatcttccatgagtaactcacctctcttcacagcagtcctatgagatgggtactayttatttttgtttatttttttaagaaatagcgtgtcatactgtcacactccaggccagagtacagtgtcccactcatagctcattgtgacctcaaactccc

SEQ ID NO: 26218 - DNA, 201 bp, Homo sapiens
attagattctcataggagcacgaatcccattgtgaactgcgcatgcgagggatggaaattgtacactccttatgagaatctaactaatgcctgatgatctraggtggaagtttcatcctgaaaccattccccaactccctgccatccgtggaaaaattgtcttccacgaaaccagtccctggtgccaaaaaggttggggac

SEQ ID NO: 26219 - DNA, 201 bp, Homo sapiens
cattgcactccaacctaggtgacaagagcgaaactctgtctcaaaaaaaaaaaaaaaaaaaaaaaaaaaaaatatatatatatatatatatatatatatawgttttatcttctcttcttgctattgagggtaacctcagagacaaccacgctggagtaggataccactctgtgtgacagtggccaagccctggaggcctgg

SEQ ID NO: 26220 - DNA, 201 bp, Homo sapiens
ccagggcgtcaacgtgcgcgagaaggtcaagcaggtgatggccctgctcaaggatgaggagcggctgcggcaggagcgaacccacgccctcaagaccaagragcgcatggcactggagggcatcggcattggcagtgggcagctgggcttcagccgccgctacggcgaggactacagccgctcccggggctccccgtcctc

SEQ ID NO: 26221 - DNA, 201 bp, Homo sapiens
ggcgggggttgcagtgagctgagatcacgccattgcactccaacctaggtgacaagagcgaaactctgtctcaaaaaaaaaaaaaaaaaaaaaaaaaaaawatatatatatatatatatatatatatatatgttttatcttctcttcttgctattgagggtaacctcagagacaaccacgctggagtaggataccactctg

SEQ ID NO: 26222 - DNA, 201 bp, Homo sapiens
aagtacagataataccaaaatatttacaaaaacagaccttcagctgatctcagttctcataggctgccacccactttggtgagtttgtgtagaagggagargggaggtagaaatcaaagcccaaggctgcatccccacacatggcggcagatgagactggaactcggggttcagccggcagccctgcatgtgtgtttgtgt

SEQ ID NO: 26223 - DNA, 201 bp, Homo sapiens
tgagccatgctttacaaagctgtcatgccctggtttccctctcatccccaacatcaccacctctccacctccccagcaagttttcttttttttttttttttgagacggagtcttgctctgtcgcccaggctctggagtgcagtggtgcaaactcggctcactgcaagctctgcctcccgtgttcacgccattctcctgcct

SEQ ID NO: 26224 - DNA, 201 bp, Homo sapiens
tatgtattttatatatattatgtatatgtgtatatatgtgtgtgtgtgtgtgtgtgtgtgtgtatatatatatatatatatatatatatatatatatatatgtattttgagacagggcctcgctctgtcacccgggatggagtgccgtggtacagtcataggtcactatagtcttgaacttctgggctcaagtgaacctcc

SEQ ID NO: 26225 - DNA, 201 bp, Homo sapiens
agtccaatgctgttttatgacatactatatatatatatgtatgtattttatatatattatgtatatgtgtatatatgtgtgtgtgtgtgtgtgtgtgtgtrtatatatatatatatatatatatatatatatatatatatgtattttgagacagggcctcgctctgtcacccgggatggagtgccgtggtacagtcatagg

SEQ ID NO: 26226 - DNA, 201 bp, Homo sapiens
ggtctgagtcactagcaagggggagggcaggagttaaacaagttgtggccgtggcattcccacagaaggcccacgacccgctggaaggaaagagatagcaracaaaaggtaggctgcgctgtgggccaggcactctccacctcgcccactcccacggtatcttattctctgggcccccaacaaaacctgccaaggcatgtt

SEQ ID NO: 26227 - DNA, 201 bp, Homo sapiens
atgtaggtgcccatcgggcttaagggggctcagagcacctgagccagaccagggatggttgtaggggtacgtcttctgaagaaggtgacatctatggcagrcaagaaaaaaaaggagaggtttgcttctctaggtctaggaagcagcatgagtttatggaactgtaaatgtgggaaccagaagaggctgcacaggtgggta

SEQ ID NO: 26228 - DNA, 201 bp, Homo sapiens
gcccctctgaggggtctgcacctcctgggagcaggtgggtctctgggacgagggtccatggtggatggctctggagacgctcccgaggctgtgccgtcccsctgctgcacaggtcggagggtcaccgcagaggctactcgggctggggctggggccgagggagcccgcactggaggtaagcttcctccctggccccctccc

SEQ ID NO: 26229 - DNA, 201 bp, Homo sapiens
cctgggaggcagagattgcagtgagccgagatcacgccattatactctagcctgggcaacaagagtgaaactccatctcaaaaaaaaaaaaaaaaaaaaaagctgggcatggtggcgcatgcctgtattcccagctactcgggaggccgaggcaggagaatcacttgagcccgggaggcggaggttgcagtgagctgagat

SEQ ID NO: 26230 - DNA, 201 bp, Homo sapiens
gaggtgctatactgcaggtcaatctccacgcggtctccctgacccaggacgtttttgaggatgagaggaaagtactggaggtaagggacccaggaccatgkcccctgtggacatcaggtagggtatcctggtgttcttcctggcagtgactgaagggatcatatttctcccagcctaagaggagaattggatttttagcaa

SEQ ID NO: 26231 - DNA, 201 bp, Homo sapiens
agatttttcactgcatatttatttttaataagcagaaaatttagtttgttaattaacccttgagttaagaacatgcaccagagtgaggagggaaaaaaaaatgaagtgtttagcatgcaagatatctttttaaaaatatctcaggggagcctctaatgttgtagagcagtactctcccccagcccccatacaaggcagcta

SEQ ID NO: 26232 - DNA, 201 bp, Homo sapiens
acccatagaccccctggtcatggggaaatacacccagaggctgcacagtgaggtgaagggaagcgcccagcagccattcccctgcctcccacctgccttaytcattccattcagtctgcagacaataagtgcccactccatcatggtggaagcagagctgcttcaggaagggcatcctcgtgtgtgagacaggcctcatga

SEQ ID NO: 26233 - DNA, 201 bp, Homo sapiens
tccttttcatccatttttagggaacaaggatgtctggagagactcagaggttttcaggtcttagaacaggcgtgtgtgtgtgtgtgtgtgtgtgtgtgtgwgagagagagagagagagagagagagacaatggcaggaactcagaccctaggaaggcacaaagtcctgggggctccaacttcctgaaggatgcattggttt

SEQ ID NO: 26234 - DNA, 201 bp, Homo sapiens
cccggagcgcacaccatcacctgtggatgcctatctcaccgaggaagacttgttccggcacagaaatcctccggtgaggcccagcgccagcccctgccccmtcatgtgtgccctgcgtcaagggtccccaacccgcaggccgcacagcggcaggtgagcagtgggtgagccagcattactgcctgagctctgcctcctgtc

SEQ ID NO: 26235 - DNA, 201 bp, Homo sapiens
tcctctgatgtctccatgcctattctcggcccttctctgctgttctgtgggaagccagcttgctggatcagaggcagtaatccacaggacaaggtaaaacwgcctccaccacacctgctgggagagcctccctcaggggtgcagccctgaggtgactggcagttaccagcagcctgcacagtctcctgtttgggtttttat

SEQ ID NO: 26236 - DNA, 201 bp, Homo sapiens
attaagaggttctggctcattgttaagcactcaataaaaggtagctgctgttattatttttattataatccaaagatttggctatttggaagctaattttkcaggagtcttgtgtagggctgctgaggaggtataggacaggagaacgggagtctagctgccacagggaagctgtatttttagtccttcctagaaatggtg

SEQ ID NO: 26237 - DNA, 201 bp, Homo sapiens
agatcaaacaccttatcttttttttcttcccctttttgccttgttccttctcagtgagcaggggaatggaaaaaggagaagccagagggcaggaagaagasggggggcagattccaataaaagcttcatttctctgttgtcaccctcccctgtacctgtttggaacttgcttgtataggcgtggggtccttttcaaggccc

SEQ ID NO: 26238 - DNA, 201 bp, Homo sapiens
tcgtgttagtgaaccccagagtggttgaacccctctggcctgtagtttcctcatctgtaaaatatgcacagggttgtgatagggctaaatgagatatgaartgtattaagaggttctggctcattgttaagcactcaataaaaggtagctgctgttattatttttattataatccaaagatttggctatttggaagctaat

SEQ ID NO: 26239 - DNA, 201 bp, Homo sapiens
tggaagtctcatgcaaggttcagcccctccagtgcgactggacccaagtctggccctggcctcaagccctctgaagtaggactgaattcatgcaggcctcstaaccctagtcctgggccatttttttcttggttgccacccaaggcaagccagaaccccctccaagcacttgccctggcggggaacagtgaggatgctggc

SEQ ID NO: 26240 - DNA, 201 bp, Homo sapiens
agtctcactctgttgcccaggttagagtgcagtcacacgatctcagctcactgcaacctctacctcccgggctcaagtgattctcctgcctcagccgcccragtagctgggactgcaggcatgggccaccacacctggctaatttttgtatttttagtagggacggggtttcaccatgttggccaggttggtcttgaactc

SEQ ID NO: 26241 - DNA, 201 bp, Homo sapiens
atagaaaaacaaaaattatttttaaggataggttctcctgtgttgcccaggctggttttgaactcctggcctcaagcaatcctcccatctcggcctctcamagtgttgggattacaagcgtaagccactgcacctggccaacaggctgaatttagaactatgtttggaatgattttggtgtgagtttttttggccaccaac

SEQ ID NO: 26242 - DNA, 201 bp, Homo sapiens
gtccagttagctgagtcatgaatgtaaaggagaagttcttgaagaaaattaagtgctactccagtgaacacatgaatgataagaaagcaaagcagccttaktgctgatatatagaaagttgagtggtctgggaaggtcaaactagccacaacagtcacttaagccaaagcctaatccaaagcaagatcctaactctcttca

SEQ ID NO: 26243 - DNA, 201 bp, Homo sapiens
aaagaatttagaatattccataaacttagacgataaagcaatgtcaggatttgaggattgactctaattttgaaagaagtttttctgtgggtaaagtgtgrtacaaaagatgctcaacagcattaatcattagatattcaaccgtgggtaaaattgcatgctacagagaaatattttgtaaaatgaagagtcaattgatgt

SEQ ID NO: 26244 - DNA, 201 bp, Homo sapiens
ggttcctggcaatccttagcattgcatggcttcttgacacttgatactaatctctaactttgtcttcacatggtcttctttctccctcatgtttctgtttytgtatctaggtatcttaaatactcctctcctttctcttataagattaccagtcattgaattttggccccaccataaaaaacaggatgatctcatttagac

SEQ ID NO: 26245 - DNA, 201 bp, Homo sapiens
ttagctgtcatacctagaatgactgttccagataaccagagttttactatgccttaatagtctcagtaataaaactcaaataattgttgaaggatgaattwttgttaaggaaaaaaatcccaatagattttagttgtacaatttattcagagataggaggtccttctgagttcaagtctacgttccagaagttttatgtct

SEQ ID NO: 26246 - DNA, 201 bp, Homo sapiens
tggcaatccttagcattgcatggcttcttgacacttgatactaatctctaactttgtcttcacatggtcttctttctccctcatgtttctgtttctgtatmtaggtatcttaaatactcctctcctttctcttataagattaccagtcattgaattttggccccaccataaaaaacaggatgatctcatttagacatcctt

SEQ ID NO: 26247 - DNA, 201 bp, Homo sapiens
ccccgcgcccgcccaggggtcgctgtcgcctgctgctggctcctcactggtgagcgactcgcttttctctgagcatctcctgctcgcgggcttggggcttrgagcggggagggaggtcctcagagccatgggccagataggaagagagagcgcccatccactttccggcattccaggtactcaggccaggctacggggcag

SEQ ID NO: 26248 - DNA, 201 bp, Homo sapiens
gtgacagagggagaacaagactctgtctcaaaaaattattattattattattattataaatacaaatgtacaaagtaatcttggggaaaatattaccacaraatttttctctagtaaaaattattgcctgtatcctcctatgctgacttaatggcctggcagagaggcatagctaaaaaatctgacagtgcatctcttctg

SEQ ID NO: 26249 - DNA, 201 bp, Homo sapiens
gataattgcttttattagattgattttgaaagaatagaaggaattttttacattagtcctcaccaatggtgaaagtattaagctttttaaaaaagttttgytttatttattcaaatatgtatgtcttttcttagattctgtgtgagaaaaggatagctcatgtataaaaactgtatgtttcataaaatccttaaaccactg

SEQ ID NO: 26250 - DNA, 201 bp, Homo sapiens
tacctcatttgaatttaggaccaatggaaagaaatctcccccattattctaataagcactggattgcagtgtatggtttaggtataaagggtgtcctcacrctgaagcatggacttagaccaccagtaaccacctaggtcatcagcagtgctgatccatctctgtccttcttcatggagcccaccttgtaaaacttgtcaa

SEQ ID NO: 26251 - DNA, 201 bp, Homo sapiens
atgataattttgaaaaatatataataaatttcattaagaaatataaaggaagggtttcataaataaaatctatttatgccaggtgactttatgggaagtcygcatgttgattctcctaaattaatgcattggtttactgtaattcgggtggaaacatacatcaatgctctttttcccaaaaatctacctagaagagtaata

SEQ ID NO: 26252 - DNA, 201 bp, Homo sapiens
ttttctgttattttttgacttcttaataatagccattctgactggagtgagatggtacctacctcattttggcttttatttgcatttctgtaatgattagygataatgagagttttttcatatgtttgttggtcacctgtatgtcatgttttaaggagtctattcatgtcctttgcccattatttaatgtggttatttgtt

SEQ ID NO: 26253 - DNA, 201 bp, Homo sapiens
aagttctttagcctcttaatcaaataaaaacaaaggggaagaaaaacaaagcaaactgtaagatgtccttaattgatgagcaattaacttccacaacagtrtttgttcactttgatacctagaattagccataatgattatccaagtaacaaaaccattttgcttttatttacactgaacatttatatacccaaagacatg

SEQ ID NO: 26254 - DNA, 201 bp, Homo sapiens
cctgtcctgcatgagtaggaatgcagggacacagttgacagctgccttagatccagctcccagaagcaaaccctgagaggacgattcacatgatagtgatwtatttgtgaggaagcatttccaacagaaagcagatgaattggggaagcaaaacaaggtatcaacagaggacaaaggaaagtgtaatttcaagtggaatcc

SEQ ID NO: 26255 - DNA, 201 bp, Homo sapiens
gactacatcaactgaccatctcaaacgaggcacaattctggtaaattaagacaagtgctatttttaccttttgctttccaaatgaataaaattgatatcawtctagaaataaccatctgaagaatttaaatatagatatttgataaaacggcaagaatactgatatgtatctctggacatttaaacaggactgcaatacat

SEQ ID NO: 26256 - DNA, 201 bp, Homo sapiens
aggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacagaaagaaagaaaaagaaagagaaagaaagaaa

SEQ ID NO: 26257 - DNA, 201 bp, Homo sapiens
gtctagaaccagctatcttataaatatagcattttaacataatatattaacatctatagggctgtctgcttacgtctacctcccatgtagactgagtgtcytatccttggtgtgtagggaatcaaaagtattactggatgaatacataaatacagatgaaggtctctcgcttttcaattgtttcatgagccataatattga

SEQ ID NO: 26258 - DNA, 201 bp, Homo sapiens
gaaggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacagaaagaaagaaaaagaaagagaaagaaaga

SEQ ID NO: 26259 - DNA, 201 bp, Homo sapiens
aaaaagaaggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacagaaagaaagaaaaagaaagagaaag

SEQ ID NO: 26260 - DNA, 201 bp, Homo sapiens
caagtacttttgggtagaggacaatatatttgctctagcatgatgaagtccagtaggatattgtattttccccacatggtgagctgcacgtcatatttgcmccagtgaagatgcagaaccttgaaaaaaaattctgttgcaaaaggaataggttatggaacccagtcaattctggagcagaaattacatgtttgtatgcag

SEQ ID NO: 26261 - DNA, 201 bp, Homo sapiens
gaaaaagaaggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacagaaagaaagaaaaagaaagagaaa

SEQ ID NO: 26262 - DNA, 201 bp, Homo sapiens
atatattcattcattcaacaaattttattaaacacatcatctaccaatgaatctatgaagatcaggtactttagcaatatagaacaatgtacaataacacrtaacataagacagtccatgtgaaggcagttcattcctggtgtggtggctctattgtcagcataaccctgtgttactttcatctttctgcttcagcaccta

SEQ ID NO: 26263 - DNA, 201 bp, Homo sapiens
tgcactcactttgcactcccaagttgatgacattcattaaatgtaaaaatgtgtgagtaatcccattgtttttgtttgtaggtcccgagatgtggccgtarttaaagtgaccatgaattttgagccaaataaagtgaatattcaaaagaaaaactgccatatggagggaaaggaaacagtatgcataaatgctacagtgtg

SEQ ID NO: 26264 - DNA, 201 bp, Homo sapiens
atattataggtatcgaaaagaccctttttattctggcagaaatatataaatctgtgtgtgtgtgtgtgtgtgtctgtgtgtgtgtgtgtgtgtgtgtgtgkgtgtgtcttctggtgctatttctcaaaagagtttttttttttggtagattttttttggttacttttttatttcattttgttaagccatcaaaagctttga

SEQ ID NO: 26265 - DNA, 201 bp, Homo sapiens
cagatttaaatactgaaaaatattataggtatcgaaaagaccctttttattctggcagaaatatataaatctgtgtgtgtgtgtgtgtgtgtctgtgtgtstgtgtgtgtgtgtgtgtgtgtgtgtcttctggtgctatttctcaaaagagtttttttttttggtagattttttttggttacttttttatttcattttgtt

SEQ ID NO: 26266 - DNA, 201 bp, Homo sapiens
ttggaagcagatttaaatactgaaaaatattataggtatcgaaaagaccctttttattctggcagaaatatataaatctgtgtgtgtgtgtgtgtgtgtctgtgtgtgtgtgtgtgtgtgtgtgtgtgtgtgtcttctggtgctatttctcaaaagagtttttttttttggtagattttttttggttacttttttatttca

SEQ ID NO: 26267 - DNA, 201 bp, Homo sapiens
cataggtaggactgtaagaatgttttaaataaatcctaatcattttaccagagagtataccttaaaacaaatttttctggctttatttgacaggttttttwaaaaaaataacttagtcatttttaagttgattgtagttcatccagaaagttactccatgttggtaaaaggttaaaaattaagagagtccaatttttgaaa

SEQ ID NO: 26268 - DNA, 201 bp, Homo sapiens
tgtatctaggtatcttaaatactcctctcctttctcttataagattaccagtcattgaattttggccccaccataaaaaacaggatgatctcatttagacmtccttaacttaaatacttctgtaaagaacctatttccaaataaggtcacatttacagataccgataccggggattaggacttagacaaatttgtgtgggg

SEQ ID NO: 26269 - DNA, 201 bp, Homo sapiens
caaacttcatggttttattctattctgagaaattgccagagccactgcagccttcagcaaccaccaccctgcccagtcagcaaccatcaccattgaggcaraccctccacctgcaaaaagattatgactcactgaaggctcagatgattgttagcgtttttaatcaataaattattttaagactaaggtatgcatattgtt

SEQ ID NO: 26270 - DNA, 201 bp, Homo sapiens
attcagcccactataatgaacatatattaggcttcagtttttaaaagatggctttaaaaaacaaaatggaaaacaattttactggtcagatgtggtggctyatgcctataatcccagcactttgggaggccgaggtgggtagatcacttcaggccaggagttcaagatgagtttggtcaacatagtgaaacctgtctttac

SEQ ID NO: 26271 - DNA, 201 bp, Homo sapiens
atattactgctcattggtgatatacccagtcacccaagagctccagtggagatgtacagagataaatgttgtttcaatgacttctgatacaagattcattstgtacccatctatcaaaaagtaattttgactttcacgtctcattatttaagaaatacatttcataagactatagctgtcatagatagtgattcctctgat

SEQ ID NO: 26272 - DNA, 201 bp, Homo sapiens
gtttggtcaacatagtgaaacctgtctttaccaaaaaaaagtaataatgataataaacatttaacaaaaaggaaaaagaaaactactttagaaaaatgtgrtagtctaggtttctgagtcaaaatatctgtaggttaaggaggaaaaaaaattcacgggatgctcaccaccataaaagttagaaattcttaatttttgaaa

SEQ ID NO: 26273 - DNA, 201 bp, Homo sapiens
agattcctttcaaaatattactgctcattggtgatatacccagtcacccaagagctccagtggagatgtacagagataaatgttgtttcaatgacttctgwtacaagattcattctgtacccatctatcaaaaagtaattttgactttcacgtctcattatttaagaaatacatttcataagactatagctgtcatagata

SEQ ID NO: 26274 - DNA, 201 bp, Homo sapiens
actattgagcctcagcacctttgtattttaatatgacatgtggctgatgatcaaccttgctgggtctcatttcatatatcagttaaataaatatatgaatraagtaatattttcttcccaagagtgatatttgattcaatagattaaaagttatttgagtccctaaacataaaaaagccagtagggtatagtagctctgtg

SEQ ID NO: 26275 - DNA, 201 bp, Homo sapiens
tacagggtttggctttgaaataactgacatacagcagaggcactcaccctaacatactttccatctatacgccaggcagggctgtcagtttgtggaaaggmaaactgggacctccctcagctctgccctcctaataagaccatcctgacacaaagcagcaattattctttgatgacatcaccaccgtcttgcccttatttt

SEQ ID NO: 26276 - DNA, 201 bp, Homo sapiens
cacataatgaagatggttcatcactgctttttatgtgcttcatagtgtgagatagtggactgggaacttgaatcagagcaagaaaattgttttctgctctrggtttggtcacttaaactagccacagtatattaggcaaaatatttcaactgcttgggcatcagtgttctcatcatttgaggacactgtctcattagatgg

SEQ ID NO: 26277 - DNA, 201 bp, Homo sapiens
ataataacagacaaaaacttccaattctggtcttctgttaatcctaggtctattaagagaatgggggatggaggaacaatatgattatagctgatacatayggctactgaccattaagtgtccatattttctgctggctgaattatgccaattctctgtacagcaccataaaggatctacatttgtttggggattcaaaat

SEQ ID NO: 26278 - DNA, 201 bp, Homo sapiens
aagagattcctttcaaaatattactgctcattggtgatatacccagtcacccaagagctccagtggagatgtacagagataaatgttgtttcaatgacttstgatacaagattcattctgtacccatctatcaaaaagtaattttgactttcacgtctcattatttaagaaatacatttcataagactatagctgtcatag

SEQ ID NO: 26279 - DNA, 201 bp, Homo sapiens
aatgggactatttgagaatttgccatgtggaggccgtttcctgaccttttatcctttatatgctagagtgctttagagtttccaaatggtgttcatatgtrgaattttatgtcaatccttgaacaatactacaaggatcattattaacatttctacttgatagacttggaaatcaaggctcagaggagacaaatgttttgc

SEQ ID NO: 26280 - DNA, 201 bp, Homo sapiens
ggcctctgttctgttccattggtctatatctctgttttggtaccagtaccatgctgttttggttactgtagccttgtagtataatttgaagtcaggtagtwtgatgcctccagctttgttcttttggcttaggattgacttggcaatgcaggctcttttttggttccatatgaactttaatgtggcacatatacaccatgg

SEQ ID NO: 26281 - DNA, 201 bp, Homo sapiens
aggcctctgttctgttccattggtctatatctctgttttggtaccagtaccatgctgttttggttactgtagccttgtagtataatttgaagtcaggtagyttgatgcctccagctttgttcttttggcttaggattgacttggcaatgcaggctcttttttggttccatatgaactttaatgtggcacatatacaccatg

SEQ ID NO: 26282 - DNA, 201 bp, Homo sapiens
attatggcaaactgggtaaaggcaaccaaaaatctaaattgttccgtggtctcccttctttccagtttcaaaaagactggtatgttaaaaaaaaaaaaaaraaagaaaaagaaaagaatgagcatggcaagaacataataacagacaaaaacttccaattctggtcttctgttaatcctaggtctattaagagaatggggg

SEQ ID NO: 26283 - DNA, 201 bp, Homo sapiens
gcctaggttttcttctagggtttttatggttttagatctgacatttaagtctttaatccatcttgaattaatttttgtataaggtgtaaggaagggatccrgtttcagctttctacatatggctagccagttttcccagcaccatttattaaatagggaatcctttccccattgcttgtttttctcaggtttgtcaaagat

SEQ ID NO: 26284 - DNA, 201 bp, Homo sapiens
tagtttaattagatcccatttgtcaatgttggcttttgttgccattgctttcggtgttttagacatgaagtccttgcccatgcctatgtcctgaatggtawtgcctaggttttcttctagggtttttatggttttagatctgacatttaagtctttaatccatcttgaattaatttttgtataaggtgtaaggaagggatc

SEQ ID NO: 26285 - DNA, 201 bp, Homo sapiens
ttactgttcctcatcagagatgccaatttgttaggaaaacaaagtgcatccctttcaggcttcatatctgcttagaaaaaagcacaatcctataaattacstaatcatataaattagttgagtaatacaaaattatttttccttttatctgacttttttttctgaataaattaccttaaacctggcttcagtttgctcata

SEQ ID NO: 26286 - DNA, 201 bp, Homo sapiens
caggcatgcaacccctcacccagctaatttttgtataggcgggttttcgccatgttgaccaggctggtctcaaacttctaacctcaggtgatctgcctacyccaggctcccaaagtgctgggattacaggtgtgagcactgtgcgagcccacaatgagtttttaacacttactgttcctcatcagagatgccaatttgtta

SEQ ID NO: 26287 - DNA, 201 bp, Homo sapiens
aactgctctcatagagttgcaaggaataaatgatatgatgtaagcaaaatacctgaaaattcctaagagcgcaatttaagttcattttgttccttcttatsgcttttttttttttttttttttttttttttgccaaatacaccacttgggcaacagatcagccatggaaatatgatgcagaagatctgcctcatgcctgtt

SEQ ID NO: 26288 - DNA, 201 bp, Homo sapiens
ctaccctcataagaaaatgaaaatcaaatacagaccagggaccatgactgaaaggactctgaaagattgtggaacctttgtataatagtatccatgtttttgttgtctcctctgcatttcttacatgactaagcactgactggttaaaccagaaaaggaagcttagcttctttcgtttttaggacagcaaagatggggatg

SEQ ID NO: 26289 - DNA, 201 bp, Homo sapiens
tgctgatatatagaaagttgagtggtctgggaaggtcaaactagccacaacagtcacttaagccaaagcctaatccaaagcaagatcctaactctcttcarttctatgaaggctgagagaggggtggaagctgcagaagaaaagttggaagctagcagaggttggttcatgaggtttaaggaaataaaccatctgcataac

SEQ ID NO: 26290 - DNA, 201 bp, Homo sapiens
cttgtccccacaactattcagccttaacattttcttacttcattccactgtaatcatttatttagtatagaatttattaggaatctaaatgcctttaaaawtacgctagtatttttatttgagttgtttcgactttatgttttagctaaaaaggtgtatggactttgagttgactgccccaactctgtttttatcataagc

SEQ ID NO: 26291 - DNA, 201 bp, Homo sapiens
gtatatttatgtctctcttaatattttgatatctatgtatatataattttctaaaaggatggtggttgaaaatttcaaagttgaactcaaacttcaaagtraaatgtattgctgcattccaaggctgaataggtctctgtagagagtgagtggaagggtaaggttataaatatcctgctggacaatagagaacttgttgaa

SEQ ID NO: 26292 - DNA, 201 bp, Homo sapiens
tttagttgctgtgatcctctatctggcagtgtatccagtgaaccctgtgggcttcttccttcctgtccctcgtgttacctgttctgtgctacctgtgttgygttctgctcaacgaaccctcctttgggtggcactcttgtcctgcctagccctagttctgctagagatgctcaattagttgttgagttgaagaattgaatt

SEQ ID NO: 26293 - DNA, 201 bp, Homo sapiens
ttaaacagattaaagtttgagaaacactggactaaggcataattattatattagtgtgcgtgagtgtgtgtctgtctatctgtgtttgctgcatactgtarataataggcacctcaagagcaaagtctgcatcatcttcttatcttcgtcagtggccagcccagtggtttactgtggcacagtaagtcctcaatgagcact

SEQ ID NO: 26294 - DNA, 201 bp, Homo sapiens
taaatttaatggggtagcatttgaagtagaaaaggaaagctaaatcattgtcagatgaaatagatttgtcataaacaacttgttttctaaatggtggtaartcaagatgcaactttaaacaaaaacaacaaaaagaatattagagttggatttgtttaattactggcaaaatgtttttccaaggaataggtgaagatgtgc

SEQ ID NO: 26295 - DNA, 201 bp, Homo sapiens
aatagataaaggcacgtttatatataccagcaaatacgaagacttggattcagtaaagtttgataccattcaatagcattaagattaaggatgactgtgayggcctttagtttgcatttttagactgcttaatttgggtcaatgtttctcaaagttatctccagtggtctaaactgttaaatctgttccgaagtctaggaa

SEQ ID NO: 26296 - DNA, 201 bp, Homo sapiens
gggcaggggaacaatcagatatgcatttgtgtcaggagggcagaggggtgactgtacctgaaaacagaagctatctatttacattgccatggtaaattttmatagaaacactttatggtaaagatcttggcgctcactgagaatttccttgtgggcaaaatatgagcgaggtgtgtagcttttcatctggtagccatctca

SEQ ID NO: 26297 - DNA, 201 bp, Homo sapiens
acacttccctatactttaaaactcacatatttatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattatat

SEQ ID NO: 26298 - DNA, 201 bp, Homo sapiens
gacacttccctatactttaaaactcacatatttatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattata

SEQ ID NO: 26299 - DNA, 201 bp, Homo sapiens
tgacacttccctatactttaaaactcacatatttatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattat

SEQ ID NO: 26300 - DNA, 201 bp, Homo sapiens
ctgacacttccctatactttaaaactcacatatttatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttatta

SEQ ID NO: 26301 - DNA, 201 bp, Homo sapiens
ctccgagtttaaaatattatttttattatttttggtgcacattcctaaaagttaaggaaggagcctcagtaatggaattgcttcttgaccttttgcaaacytcaatttagcaaaataattaggaacgatctaatagtgatgatacagtttttaactgctggatcagcgacgcctatttcaagtagtgatactaactaaact

SEQ ID NO: 26302 - DNA, 201 bp, Homo sapiens
cacgcctatgccaaactcagattccttcctttcatccctgtttcatctgttcaggctggttagttcccctttccaatccacacagagaaagacagaaaagmcagtgagaagctatgtgtgcaggacttctctgccctccactccatctaagctctcaagaaacttttagattcttttgttttttctattcatcggtctctt

SEQ ID NO: 26303 - DNA, 201 bp, Homo sapiens
attttacttataatatttttggtgaaatgatcttatgccgtataagaatacatgcaaatagaaatacacacacacacacacacacacacacacacacacamttctgttcataggattttgtttatttggtaggaggttttgtattattttgtgacaactgcaagtaagcactttccatcatgagaaatttagatagtgagt

SEQ ID NO: 26304 - DNA, 201 bp, Homo sapiens
tggggatccgagatttattttccttccacacgcctatgccaaactcagattccttcctttcatccctgtttcatctgttcaggctggttagttcccctttycaatccacacagagaaagacagaaaagacagtgagaagctatgtgtgcaggacttctctgccctccactccatctaagctctcaagaaacttttagattc

SEQ ID NO: 26305 - DNA, 201 bp, Homo sapiens
tgttaagttttatgaagatgatttagaagttgattatcagcaagcagagcttttttcagaagggaggtaatgtaaagagagttaataattagctactggcytttcatccaaacatttcccactactcaggaaatgtccaataatccaaacagtggtaactgctgaacagcattatagccggtgagtggtttaacttaccag

SEQ ID NO: 26306 - DNA, 201 bp, Homo sapiens
cctaattaagataactattctagaggaaaaagaatgtatatgcttagattaactcagcaattacataaacacaactgtagtacatacatctattcttttarcatcaaggcttgctgagttgaaaaaaaaatggtatggttctctaactatattctgttgagttgctggtgtgtaaatcacattgtaactggccactattac

SEQ ID NO: 26307 - DNA, 201 bp, Homo sapiens
taaagaagacacgatttatgaagctggtaagcaaaataattatagcaagtacttttgggtagaggacaatatatttgctctagcatgatgaagtccagtargatattgtattttccccacatggtgagctgcacgtcatatttgccccagtgaagatgcagaaccttgaaaaaaaattctgttgcaaaaggaataggttat

SEQ ID NO: 26308 - DNA, 201 bp, Homo sapiens
ccattaatccttaaaatctgtttttcttgatttgttccatatgtgcatgtatatgctctgaaatagcctcctgactagaaagatcaatgaggtataagaayataaaataatgattttgagttttatatgtaactttatttcagtcttatttaatttttgcaaagtaattaagtgatcaaataaggaatattgtagccttca

SEQ ID NO: 26309 - DNA, 201 bp, Homo sapiens
taatacgaggaagtatgtatatgtgtgtatgcacatatatacatgtgtttacataatatataatttaaatgataaccaaaatcaagagaataaatcagtgyttaacaaacaatatgatcatcaagtacttagtatggaaagactattaaagaagaaaacaaaagattttagatttactctcagctgtgtgaccctaatcac

SEQ ID NO: 26310 - DNA, 201 bp, Homo sapiens
tttattctttcacggttctggagtccagaagtccaaaatcaaggtgttgacagtgttaattccctctggaggctccaagagagactctttctcatgctgtyttcctagcttctggtgacaactggcaaccctagtcgttccttggcttgcggcagcatagctcctatctctgcctctgtcttcacctggccttctctgtgt

SEQ ID NO: 26311 - DNA, 201 bp, Homo sapiens
gggtctggcaggcgggagaggctgcagaacagacatgccccagtcccatggggaatgcctgctttctcctggcttgtggtcacctggggctagagcctctstgaaggagatggggagtccgaggggatgggcacctatgtctgtgctctgctcacaaaagctcctgggctccatgctagctgaagccctgtctctacctgc

SEQ ID NO: 26312 - DNA, 201 bp, Homo sapiens
ggagtttgggtttgaccattaggagaaacaattacaaagctgaagcagcatgctaaactgcatttcacaaataccactttggcagcatcaaggatcgattkgaggaggcaagactggaggcaggaagactggttaaaaaaatgcatattaggaagatacgagagaaaaatgataatggccttatcaaaggcagcaataatg

SEQ ID NO: 26313 - DNA, 201 bp, Homo sapiens
ggctgcagaacagacatgccccagtcccatggggaatgcctgctttctcctggcttgtggtcacctggggctagagcctctctgaaggagatggggagtcygaggggatgggcacctatgtctgtgctctgctcacaaaagctcctgggctccatgctagctgaagccctgtctctacctgctccctgggaaaatccacct

SEQ ID NO: 26314 - DNA, 201 bp, Homo sapiens
gcaacaccttattctgtaaaataaaatgaatggtggatgagctgaggagaggaagttgactttatagagagaaaagggctgaagaaagcagaaacagaacraaaagttgattggtcatttcaaagttattttccttgtaaaagtgaaagcagaggggattttcttatcatgctgtttgaaactggcttgattggggatttg

SEQ ID NO: 26315 - DNA, 201 bp, Homo sapiens
agttatttgtaagctcatttcaaatgtgataaactgaggttcatagaggtgaaatcacttgcttttttttttcaggagcatcatcttttttttttttttttgagatgaagtctcactctgtcacccaggctggagtgcagtggcacgatctcggcttactgcaacttctgcctcccaggttcaagcaattctcctgcctca

SEQ ID NO: 26316 - DNA, 201 bp, Homo sapiens
caaagcattttcttaacgtaggcaggctcagttctaaaagaaaatgagaaagagaggatggggctggccacacagtgtctccttccagactcaccaatcarttagtgtgaaggaagggcaggttgagaaatagccgagaagtattacaaccggtgaggcactcaccccatggaaggaaacgtcagaagtggaaagttagca

SEQ ID NO: 26317 - DNA, 201 bp, Homo sapiens
aaaagaaaaaaaaaactctagaatttttaggattcataaaattggcatcacaataacagtaatcacttatggctcctaagaattttttctttttttttttwaaccttaaagattagttaatttaattacatcttaaatacatctcgcaagtgactacaaattctttgagggcagagacaatatattttttttaccttttaa

SEQ ID NO: 26318 - DNA, 201 bp, Homo sapiens; identical to SEQ ID NO: 5178

SEQ ID NO: 26319 - DNA, 201 bp, Homo sapiens; identical to SEQ ID NO: 5180

SEQ ID NO: 26320 - DNA, 201 bp, Homo sapiens
gatatattcattcattcaacaaattttattaaacacatcatctaccaatgaatctatgaagatcaggtactttagcaatatagaacaatgtacaataacayataacataagacagtccatgtgaaggcagttcattcctggtgtggtggctctattgtcagcataaccctgtgttactttcatctttctgcttcagcacct

SEQ ID NO: 26321 - DNA, 201 bp, Homo sapiens
ctatgtgcagggagctattttaaacatttctgctttaagcattcccacttaatactcatatcaaccttatgaggtcgtatgaacctcctcttttaagtgargaacataaaatttaagtatatttcccaaagacacatagtgagattcagagtaaggatctgaattctgtgccaaaaccactgactattatcactctgtgtt

SEQ ID NO: 26322 - DNA, 201 bp, Homo sapiens; identical to SEQ ID NO: 5162

SEQ ID NO: 26323 - DNA, 201 bp, Homo sapiens
catctcaaacgaggcacaattctggtaaattaagacaagtgctatttttaccttttgctttccaaatgaataaaattgatatcaatctagaaataaccatytgaagaatttaaatatagatatttgataaaacggcaagaatactgatatgtatctctggacatttaaacaggactgcaatacatgtaaatttgctaccat

SEQ ID NO: 26324 - DNA, 201 bp, Homo sapiens
actcccaagtagctgggactacaggcgcctgccaccacacccaactaatttttgtatttctagtagagatggggcctcaccatgttggccaggctggtctygaactcctgacctcaggtgatccacccacctcggcctcccagagtgctagaattacaggtgtgagccactgtggctggccgttgtttttgtttttatcag

SEQ ID NO: 26325 - DNA, 201 bp, Homo sapiens
ctgggaagtggaggttgcagtgagccgagatcgtgccgctgtactccagcctgggtgacagagagagactctgtctcaaacaaacaaacaaacaaacaaamaaaaacttatagctgtaggtatatattatattaatgaaatgtaactcattttatagaaagtttgcccttctgaagttgggaaatgttcccggaagtgtta

SEQ ID NO: 26326 - DNA, 201 bp, Homo sapiens
aataaagtataaaagaaaggtgaagatagagaggtgaaaatagatgactttgctataatttaagataatgcttaagaactaatggtcaaattaaaatggtrcagtaaattgtgcacatacaataatcactatttaaaaaaaaaacctttacaatagaggggaaagaagactgaagggtgatacctaagaaaagggaatatt

SEQ ID NO: 26327 - DNA, 201 bp, Homo sapiens
acaggggagaattagagcataggaaagaacttgataaacattcaatacgtgatagctcttcaataaaaaccttttgttaagatcccactgtgtgcttaccmctgtgattctgtggcttttaatctttggcagactatgggaaagataaattgtacttagaaagatgatcaaggagcacttcaaagccccagttcaaaatta

SEQ ID NO: 26328 - DNA, 201 bp, Homo sapiens
agccatcttgtccccctagatcatcaatttcatttttaatcctaaataagtgcctagataaacttcatcaccagaatgtagttgtttcatgtcttgctacrttaaaggtaggcagagtttgaggtttgttttttctaatgataaatcaatacaaaatatttttaaaattttttttcattccataacgaggatctaagtaag

SEQ ID NO: 26329 - DNA, 201 bp, Homo sapiens
ctagatcatcaatttcatttttaatcctaaataagtgcctagataaacttcatcaccagaatgtagttgtttcatgtcttgctacattaaaggtaggcagwgtttgaggtttgttttttctaatgataaatcaatacaaaatatttttaaaattttttttcattccataacgaggatctaagtaaggattttcagtggcaa

SEQ ID NO: 26330 - DNA, 201 bp, Homo sapiens
acatgactagctctcattttgattagcatcatatattaagaacaaatcctatttgcttttcagtcatatttttccagcttaaatcttactataaggggagracttcggagtgaaaatgcatctctggttttaagtagcagcaatcaaaaaagagaggtaagtgcaacatgagttttgaaaacattatgcatttcactctga

SEQ ID NO: 26331 - DNA, 201 bp, Homo sapiens
acaggtggtccaggctatccagcgccacatacactttgatgttgtaaagtgcatcctggtggccagcccaggatttgtgagggagcagttctgcgactacmtgtttcaacaagcagtgaagaccgacaacaaactgctcctggaaaaccggtccaaatttcttcaggtaaaacaatcttacccagggataattaagaatgg

SEQ ID NO: 26332 - DNA, 201 bp, Homo sapiens
gtgacagacttggggatttcttgtaaacttcctaactagtctgaacctttttatttcttattgggaactgacacttccctatactttaaaactcacatatktatatttttgtacatctatctcctaattcaaaagtaattgagattgtcatttcattataattccgtgagtatctttaaattactatcaaatatgttacta

SEQ ID NO: 26333 - DNA, 201 bp, Homo sapiens
tcccatttatatccctctttataatgacaaaatgttaaacctagcctctgctaacatagcttcagaatggtttgtgctaacagttaactgggattgtatcmtgtattatcactacatttatatcctgacttagtcacactggaagcatgttgtagggtagggctttgtaccatagtttgataaaaggaaatatacattggc

SEQ ID NO: 26334 - DNA, 201 bp, Homo sapiens
agccagaacttagatatggggtgtaaatatttatattacactaatcattaagagtaatatatttaattttatccatttttttagtgccttttttgaaccartcactgggctagatgtggggaggacaaacatgtaagcaaatcactgttagaagtaacttgtacaaagtgtgtaaaaggacacagtggtgaaaggggtgac

SEQ ID NO: 26335 - DNA, 201 bp, Homo sapiens; identical to SEQ ID NO: 5160

SEQ ID NO: 26336 - DNA, 201 bp, Homo sapiens
tgttttcattatcttgaacatttttatattaaaaacagttttaacataaaaaatttttacattaaaaactaatttttttaggcagaaaaagtacaaacctyaacaaagctaattagttggacttcatcaaaatgtaaaacttctactcttcagatgacactgttgagaatatgaaaagacaatctacagacgggaagaaaa

SEQ ID NO: 26337 - DNA, 201 bp, Homo sapiens
tttttttatttattacagaagtgattttttattataaagttttaaaaaaaatattgaagcaaatataaggaaacacctagtgtcctaatatacagaaatamaaaataatatattatgatacacattttttcacattttttatgcccatgtacttatgtgatttaaaaaatagaattaggtcatatctacatattggggatt

SEQ ID NO: 26338 - DNA, 201 bp, Homo sapiens
ttcctttttcagcttccctgactaattctcttaacctccaattatctttaacagaagttactaattctgcaattcatatattctggaactggaattatctktgttcctaagcaaccaagtatacatatgaaacggtctgtacattaatgcctcataatagcagctcttatttgggaaagggttatagtacatttaaaccat

SEQ ID NO: 26339 - DNA, 201 bp, Homo sapiens
gagggaggacaagtgcacggttattatttgatactaccagttccatttggaagttaacaaaactggaatttttaatctctcagaaaaatcttagcttttayaaatgtcctactcaaacatgactagctctcattttgattagcatcatatattaagaacaaatcctatttgcttttcagtcatatttttccagcttaaatc

SEQ ID NO: 26340 - DNA, 201 bp, Homo sapiens
ctgagtcaaaatatctgtaggttaaggaggaaaaaaaattcacgggatgctcaccaccataaaagttagaaattcttaatttttgaaaaatgatctcactrtttaaaaagcacagttagatggaaaaggggacttatataaaaaagactttcaaaggatatttatctgttgtgggtttttttttcattttttggagaggaa

SEQ ID NO: 26341 - DNA, 201 bp, Homo sapiens
gtggaaaccaacttttataaaagtaagtaaatacatagttctatgcactgattgaataatatcaataaatattcatttaccacttagaatatgcaaggcaytgtgctgcttttggaaagaatgtgcgactggaagtataagaggatgtgaccaagccccagctctacttaaccagctatgtgtgtctcatcttccttgtct

SEQ ID NO: 26342 - DNA, 201 bp, Homo sapiens
aggaaaaattatatctatattgataaaattactaaaagtgatcattttgtaattgtgtgatctgaggaaagtcactgatcttatctagattccggtttccrtatctgtaagttcagggaattgttttacatatgtttaaaatctgccttgctgggcttagtggctcatgtctgtcatcccagcctactcgggagactgaga

SEQ ID NO: 26343 - DNA, 201 bp, Homo sapiens
tacatcaactgaccatctcaaacgaggcacaattctggtaaattaagacaagtgctatttttaccttttgctttccaaatgaataaaattgatatcaatcyagaaataaccatctgaagaatttaaatatagatatttgataaaacggcaagaatactgatatgtatctctggacatttaaacaggactgcaatacatgta

SEQ ID NO: 26344 - DNA, 201 bp, Homo sapiens
tgcatttcacaaataccactttggcagcatcaaggatcgattggaggaggcaagactggaggcaggaagactggttaaaaaaatgcatattaggaagataygagagaaaaatgataatggccttatcaaaggcagcaataatgttccttgcaataggaatgaacagaagtcaacaggaaatattaagagatgggatcaaaa

SEQ ID NO: 26345 - DNA, 201 bp, Homo sapiens; identical to SEQ ID NO: 5207

SEQ ID NO: 26346 - DNA, 201 bp, Homo sapiens
ttctatcccggtaaaatatgaagttggactacagttttacaggtaggagaaaactacatttttatgtggatgcctttctattaacccagtggttctgaaartgtggtccctgcctggccaagggcatcagcatcacctggaaacttgttaggcaaattctctggccccaccagaaacctaccaaatcagaaactcggagga

SEQ ID NO: 26347 - DNA, 201 bp, Homo sapiens
gatcgattggaggaggcaagactggaggcaggaagactggttaaaaaaatgcatattaggaagatacgagagaaaaatgataatggccttatcaaaggcarcaataatgttccttgcaataggaatgaacagaagtcaacaggaaatattaagagatgggatcaaaaggacatgactgcagattgctgtttagagttatgg

SEQ ID NO: 26348 - DNA, 201 bp, Homo sapiens; identical to SEQ ID NO: 5210

SEQ ID NO: 26349 - DNA, 201 bp, Homo sapiens
ggtcttttctatttttatattcaacattttatctttcgttgtaaaactcaggaaaacacctttaacaaacaaaaataacttctctcttaagttgttcattktactaaatggccaacatggattggatatggtagaaggaaagaacattttctgcagaagggagaaaaaaaccacaatctattttatgaggaggaatgaact

SEQ ID NO: 26350 - DNA, 201 bp, Homo sapiens
ggcaggagtttcgcgttctggttttgatatgaattagttttagtgtctctccaaagtccttcaccctaggagtaggagtgaggcagcactgaaaaccttasaaggtagaattcacttttaaaattaaagttgtttttacaatacacattgtatattaggactttgctgaatatttcctcccctccacccttttttatggca

SEQ ID NO: 26351 - DNA, 201 bp, Homo sapiens
tttgttcactttgatacctagaattagccataatgattatccaagtaacaaaaccattttgcttttatttacactgaacatttatatacccaaagacatgygtatccatggatatgtcccttaataattattcagtgtttccaaggattactaatcaaaaactttagggtcattgaagaaaagaattttaaatttatgcag

SEQ ID NO: 26352 - DNA, 201 bp, Homo sapiens
actctaattttgttcctcttcaatttacttatgacacttcaagcaaataagctttgtaaatcaaaaaggtgatcatgttacacccctctttaatagcttcrttggttcccaacttccccctacatagaataaagccaaagttcttaaagctgactatgagaacattcatgatctggactctttttacctctctagcctcaa

SEQ ID NO: 26353 - DNA, 201 bp, Homo sapiens
cagttggagaaaagtgaggcttccttaggattcaagtggtaagatacacgtactttcaagcttgttattaaaagtttcatgtttgttttcaaagaaaacasatactaggaaaatacagaaaattagcagtcctatgatctgctaacctggtctttactattggtcccaactcccaaactccctgtctcaatcctgggctcc

SEQ ID NO: 26354 - DNA, 201 bp, Homo sapiens
tgttttgatcttctcagtctgcatacaggtcattacaaaaatgccatataaaaagcaagatctaataggaataaaacgtaataagttaaaactaacttgcrttaaattttaaaataatgattctcacagtttataaaacaatgtgcctgggccttcaccttgaccctgtgggtttgggcggatatcattgttatcatctgt

SEQ ID NO: 26355 - DNA, 201 bp, Homo sapiens
ttaagacttaaaccacctacttaaaatgaagtatctcttttaaggatggttaaatattgctaaaatattttatgaaattctcattttcaatttctgatatsagaaaaacctgtatgttttctttcttatccagtcctgtctctgtgattttagaaaaatctgatgtcagaagtccttaattatatgaatgaaccttagtag

SEQ ID NO: 26356 - DNA, 201 bp, Homo sapiens
caaatttgcctctcaggagatgcagttatgcagactaatatgtggctgtcttctaagctcatcctcatatcactttgtactagccctttctagttttaggmctaagatgtaaaaattgaattaatatgaatagtggttactactttggatttggaagcctgtggaaatgtgggcacatttctctgccttcccaagctttct

SEQ ID NO: 26357 - DNA, 201 bp, Homo sapiens
aaccacaatctattttatgaggaggaatgaactctgggaatagttctctgaccctttgtgtgtcagtgtgttctcagcctgaactggaagaaaatgggatrgcatgtggaatgtgggaaagtgcgaagactgatgcaaaattcactatctgcctcattaaatacactagtaggttttcaagagaatgagtctgttatcacc

SEQ ID NO: 26358 - DNA, 201 bp, Homo sapiens
aaagggcttccaactttcacaaactcttattactaaaatgtttttcttccaacctcctgtattgcctcaaaatggaatatatttcatctgaatttagtagrtaaaagtaaatttggagttatagaaaatacttaatatatcaccttttagttacagtgagaatatatgactttaggagtttataccatgtgaatggggtga

SEQ ID NO: 26359 - DNA, 201 bp, Homo sapiens
aaagttgttatacattaaggaaaagggcttccaactttcacaaactcttattactaaaatgtttttcttccaacctcctgtattgcctcaaaatggaatayatttcatctgaatttagtaggtaaaagtaaatttggagttatagaaaatacttaatatatcaccttttagttacagtgagaatatatgactttaggagtt

SEQ ID NO: 26360 - DNA, 201 bp, Homo sapiens
atcatataaattagttgagtaatacaaaattatttttccttttatctgacttttttttctgaataaattaccttaaacctggcttcagtttgctcataagytcctgatatttgaacaggtatctgcccaacaatcagagagaattagtcctctgcaccttctgagaggtattaaaaaaaaagggggggaaagaaaaagaat

SEQ ID NO: 26361 - DNA, 201 bp, Homo sapiens
cgaaagatgatgctgatgtggtgaagggggttggtttctgaaactgtttaagaattttagagatcaagagtaggtctgagaggagctggcaaagcaggcawttatttgtggtgggaggatatggggaaagagcagatgtctgtagatactacaaaggaaaataaacaccatgaaagaacaaacttatgtagaaaaatttta

SEQ ID NO: 26362 - DNA, 201 bp, Homo sapiens
tcttttaaatgaattttattaattaacatataatttcttctcagtaagatatgtgagctggcaacacattgccaatcctatggttatttttgttagtatgmacaataggtagtttcatgggtcaggaaagcagaaatagtatacaaggttaaagaaatgattttcagttctctaatttccactggaattattaaacatata

SEQ ID NO: 26363 - DNA, 201 bp, Homo sapiens
ttttcaagattcaaatcacaacttaaaagcaaggagttgcaagaatatatggaatggtgagaaatgattgatgttagaaagctttcgaaaattgcaatacrtaaggaaaattgtccaatgcacattcttatttatctgcatttatctttctatatcctgttgaactttgccgataattgtagaaacaccttggcatttctt

SEQ ID NO: 26364 - DNA, 201 bp, Homo sapiens
tcaatgggtggaaaaacagattctacctcatgaaataataaaagtcaaagtcgtgttgcaaaagtgtacacaattccaaaccatcgaccacccttgcaaaytgctcaatactgggctgctcagcgtgctgcctagggaatggtcgctcttcctcatttttaagacaaacctctccttctggatccaccctgtctacctgct

SEQ ID NO: 26365 - DNA, 201 bp, Homo sapiens
tctctgagcatctcctgctcgcgggcttggggcttggagcggggagggaggtcctcagagccatgggccagataggaagagagagcgcccatccactttcsggcattccaggtactcaggccaggctacggggcaggcaggagtttcgcgttctggttttgatatgaattagttttagtgtctctccaaagtccttcaccc

SEQ ID NO: 26366 - DNA, 201 bp, Homo sapiens
ctttgagggcctaactcccatccactataaaaacaccttccgaaacatccctggccagctgcaacccacctcatcttgaccagaggagctgcctgacagayctacgtatgccttatcagtttaaatcttcatcgctctctacaagcccaccacccttctacctcctctgtaaatctcactagacaactgcagctattattt

SEQ ID NO: 26367 - DNA, 201 bp, Homo sapiens
ggggaaagaaaaagaatcagtccaattggtagattttaaatggctcatttaaatactacaagtttatcagtctctaaattttcagcctaggaaaatttcarccaggaatttgatattagtcctgatgcatcacgaaagtacggaaactcagtttctacagacccagggcttcctggggttacctcaggccacttatatctc

SEQ ID NO: 26368 - DNA, 201 bp, Homo sapiens
aagaaaatatcctgaattgcagtcatagatgtgtctttatccactttattatttttgtgtaattagttggctgtatcctatcttgttcccaaagggtcttytggtcacctttattccaaatatagtagctctctcagaataggtggtaaaggatattgggtgaaagataaactcacagaacaaggctaacctggacatgaa

SEQ ID NO: 26369 - DNA, 201 bp, Homo sapiens
aagataaactcacagaacaaggctaacctggacatgaattgagcagagtgcatgttcattcagctgatgatgtaacctcatcttacaattacatatattcyctagttatttcttatttatcttatacctaactaagcaactttaggagagaattcatatgttctattattttttacaaaatatgatatatgtatttatgtg

SEQ ID NO: 26370 - DNA, 201 bp, Homo sapiens
tttaaatggctcatttaaatactacaagtttatcagtctctaaattttcagcctaggaaaatttcagccaggaatttgatattagtcctgatgcatcacgraagtacggaaactcagtttctacagacccagggcttcctggggttacctcaggccacttatatctcttatctgtgcttttccttagctgacatttggttc

SEQ ID NO: 26371 - DNA, 201 bp, Homo sapiens
gcaaattcattgagtagccatgaagtggcagtggcactcagcagaagctagcaggttgaggtgactaaagaatggaggattttagatagatgcctttttastgagaggaaatagggtgattgaaagagcccttggataagggatacacatcttagactagaccccccttccaccacttcactatagggattgggtgttttc

SEQ ID NO: 26372 - DNA, 201 bp, Homo sapiens
ttggagcaggtctcagggcccattgcctggcacacctcctcccagaattcctgaggtataaccttctcaggaagatagcagagctcttttctaacactccrctatttctggagagtagtgagtatattcccctccaggccttttcacttttattcagaaacacagggaaaataataaaagtctgtctgtattatgactagc

SEQ ID NO: 26373 - DNA, 201 bp, Homo sapiens
gtaatgtgaaagaacttctccaaataaacctgcccaccacattccctccacaaaatttaacttagtgcctggttttcaagaggaaatagaatcagaggaaytgtaatagataaatttaattttaaaaatagaatcacacaagataaatttatattgaaatagatgtatttgacataaatagtaggaatgtgaccggaaaat

SEQ ID NO: 26374 - DNA, 201 bp, Homo sapiens
agtcatgtctttgtagccatctagatttcttagctctgttgcctcattcttcctcctcattcttcccccagccacggtggagaaataaagttgtctggggkctcattactggactacccaatctcagttcccttctgtactttagaactctctccttccctcatcttgatttcactaggccacactataaccctgcttcct

SEQ ID NO: 26375 - DNA, 201 bp, Homo sapiens
ggtatttttgtataattctgtcttatctggtgcatcagctgtgtattttacgtcaaggtaaatgagcatcctgttttatatgttaaattttaaaaatgackttttcaaagaagaatgtgattgctgtgatttttaagtgtgtatattttttccaaaattaatgtgacttcttctgaagctccgaccttttttttttttttt

SEQ ID NO: 26376 - DNA, 201 bp, Homo sapiens; identical to SEQ ID NO: 5202

SEQ ID NO: 26377 - DNA, 201 bp, Homo sapiens; identical to SEQ ID NO: 5204

SEQ ID NO: 26378 - DNA, 201 bp, Homo sapiens; identical to SEQ ID NO: 5206

SEQ ID NO: 26379 - DNA, 201 bp, Homo sapiens
gccaacttaatcagtgccctgacaaagcatccagcaccaacacatacattagaaaggtatctaattcctcaccattttggtattctaattttataaatttyaattctattccattttgagagtatctagggatcagaacctttatggaagactaataactaggtaaacactattacctagcttaagagaccctaaaatgtc

SEQ ID NO: 26380 - DNA, 201 bp, Homo sapiens; identical to SEQ ID NO: 5209

SEQ ID NO: 26381 - DNA, 201 bp, Homo sapiens
aatgctaatttctttttttgtcatagtaacagagcaagccaacttaatcagtgccctgacaaagcatccagcaccaacacatacattagaaaggtatctarttcctcaccattttggtattctaattttataaattttaattctattccattttgagagtatctagggatcagaacctttatggaagactaataactaggt

SEQ ID NO: 26382 - DNA, 201 bp, Homo sapiens; identical to SEQ ID NO: 5212

SEQ ID NO: 26383 - DNA, 201 bp, Homo sapiens
cttgaatatcaatgaatgtctacttagcaatcatcttttccagatgattcttatgtcttaaaataatgttacttcaagaaggtgcctaattgtaagacatmcttacagtaatagtagttgggttgtgatgcaatttgataatgtgagattctcttagaaaataaaattagtaataaataactacagctgagtttataatct

SEQ ID NO: 26384 - DNA, 201 bp, Homo sapiens
aggctttcaacaatagccttgaatatcaatgaatgtctacttagcaatcatcttttccagatgattcttatgtcttaaaataatgttacttcaagaaggtrcctaattgtaagacatccttacagtaatagtagttgggttgtgatgcaatttgataatgtgagattctcttagaaaataaaattagtaataaataactac

SEQ ID NO: 26385 - DNA, 201 bp, Homo sapiens
tacttattctaaaaatttacttgctgtttatctgaaattcaaatgtaactgagtatctagcaaccctacatcctgatattcaactttcctactcccctggycatgactggcttgggcaggagagatctttgcctgggtagatgttgggaggagcctggtgaatgtattccttcccaggattggtcttggctctagttctgg

SEQ ID NO: 26386 - DNA, 201 bp, Homo sapiens
aaatataaatttggaggtgagccaaagttaaaaatataaaaatatagccagtgtttctctcctactttcctagggttgctaggttttgggagcctgggatrggggaaaacagtagaggagacatacttattataaaacattcaaaatagtgaatgggacatacttattctaaaaatttacttgctgtttatctgaaattca

SEQ ID NO: 26387 - DNA, 201 bp, Homo sapiens
ggtcacatgcccacattctatgaaccaggagcaggataacggactattctatatgcctacatctcctcctctcattcacatctcctatgtaccttccccarccaggaggaatttgtggattctaggtagccaaaacaaaagaaaatattcactaaccattttaaagaagttgaagtaagagaactaacatttaccaaatac

SEQ ID NO: 26388 - DNA, 201 bp, Homo sapiens
aggaaaggctagaagtctgcaaaattatacaattgtactttagtgcaccaaagattaaaaataatgcagtcagaataacatttatttcatctaccagaatsttaccctatttcttgcctttgattagtttaagaataggaaactaagatagtacagacttataaagatataacgtatttataaatatgtatctttgcatat

SEQ ID NO: 26389 - DNA, 201 bp, Homo sapiens
gacaaccatcaccaatacactggggcttctgagagactcaaccagagcttctgagaataatctctgagtgtgaaaatcagattggctattgaaaggtcacrtgcccacattctatgaaccaggagcaggataacggactattctatatgcctacatctcctcctctcattcacatctcctatgtaccttccccaaccagga

SEQ ID NO: 26390 - DNA, 201 bp, Homo sapiens
gaatgctttgccaaacactcccctatttttaaagttgttgggggactttaaacttgaatatagggtggtaggacaattgtttgaaccactctgtaaatacrtgcatgaaaatcttgaggtttacaaatattttttaatagtttgccacatttcaatggcatgtcaagttgcagggtcctgccacttttcttcttgttattt

SEQ ID NO: 26391 - DNA, 201 bp, Homo sapiens
aatcatatataactcctgcttctctctcctcttcataaaaaagaatgcccctgtctccagcatttggtttcaaacaagaatatctcaattgtttattttcyagattgccaatttagattaccacttagtccagtatgtgtttaaaatatatatgtgctggactgtgccttggtaatagtttcaggaagaattgctcattca

SEQ ID NO: 26392 - DNA, 201 bp, Homo sapiens
ggtttggctgactactaaggagagcagcctgctagaaggagcaaattccagagctgagggtcatttatttggaatgctttgccaaacactcccctattttyaaagttgttgggggactttaaacttgaatatagggtggtaggacaattgtttgaaccactctgtaaatacgtgcatgaaaatcttgaggtttacaaatat

SEQ ID NO: 26393 - DNA, 201 bp, Homo sapiens
caatttaaaaggccatctttgaaaagacagtaaaacagacttttactatgaaaagctaccatctggaacccttagtaaactgactgttgtctcataaagartacaaccaagcctaatgcaacttaattgttcacacagttttgtaagatgtacttcttctataactctacaggacttaaaagaactcataatactatatga

SEQ ID NO: 26394 - DNA, 201 bp, Homo sapiens
tgtctccagcatttggtttcaaacaagaatatctcaattgtttattttccagattgccaatttagattaccacttagtccagtatgtgtttaaaatatatrtgtgctggactgtgccttggtaatagtttcaggaagaattgctcattcaaaagcaggcaactcacttgctgattgcctttgccagcagataatgacatca

SEQ ID NO: 26395 - DNA, 201 bp, Homo sapiens; identical to SEQ ID NO: 5166

SEQ ID NO: 26396 - DNA, 201 bp, Homo sapiens; identical to SEQ ID NO: 5183

SEQ ID NO: 26397 - DNA, 201 bp, Homo sapiens; identical to SEQ ID NO: 5184

SEQ ID NO: 26398 - DNA, 201 bp, Homo sapiens; identical to SEQ ID NO: 5185

SEQ ID NO: 26399 - DNA, 201 bp, Homo sapiens; identical to SEQ ID NO: 5186

SEQ ID NO: 26400 - DNA, 201 bp, Homo sapiens; identical to SEQ ID NO: 5188

SEQ ID NO: 26401 - DNA, 201 bp, Homo sapiens; identical to SEQ ID NO: 5189

SEQ ID NO: 26402 - DNA, 201 bp, Homo sapiens
aaaagctgccagatttggggtttggctgactactaaggagagcagcctgctagaaggagcaaattccagagctgagggtcatttatttggaatgctttgcyaaacactcccctatttttaaagttgttgggggactttaaacttgaatatagggtggtaggacaattgtttgaaccactctgtaaatacgtgcatgaaaat

SEQ ID NO: 26403 - DNA, 201 bp, Homo sapiens
taagtaaatgtttactcttctcccctataaattacagggataaatataaaatcccttaagatttttgcagggaaattctccttatgagttgcttaacttaytttggctgtatgccatttttgttacacaaattgatgggtaattttcaacaatgcgtagctaaattttgaaaaattctttcctgtcatcatttcagattcc

SEQ ID NO: 26404 - DNA, 201 bp, Homo sapiens
ttaagatttttgcagggaaattctccttatgagttgcttaacttactttggctgtatgccatttttgttacacaaattgatgggtaattttcaacaatgcrtagctaaattttgaaaaattctttcctgtcatcatttcagattccctttgccaaagattgtggaaataaggaaaaatgtatctcagacctcagcctgcat

SEQ ID NO: 26405 - DNA, 201 bp, Homo sapiens; identical to SEQ ID NO: 5190

SEQ ID NO: 26406 - DNA, 201 bp, Homo sapiens
tcagtgtgttctcagcctgaactggaagaaaatgggatagcatgtggaatgtgggaaagtgcgaagactgatgcaaaattcactatctgcctcattaaatrcactagtaggttttcaagagaatgagtctgttatcaccacagtaaatttctcactctgggcctaactccttatctaaaacttaatagagcttaataagtg

SEQ ID NO: 26407 - DNA, 201 bp, Homo sapiens
aaaattccaagacaacttagtataacaaaattcacattgaactaaaagttatgaaaagctgcttttactgtttactcactcctttaaatcaaaagaactgratgtaaactatttttttatgtcatctcctgttcttcaggctcttcggtgcctcagaaaacataaaagagtctgatttacaatcattttgggcaaattgcc

SEQ ID NO: 26408 - DNA, 201 bp, Homo sapiens
ataaatataaaatcccttaagatttttgcagggaaattctccttatgagttgcttaacttactttggctgtatgccatttttgttacacaaattgatgggyaattttcaacaatgcgtagctaaattttgaaaaattctttcctgtcatcatttcagattccctttgccaaagattgtggaaataaggaaaaatgtatctc

SEQ ID NO: 26409 - DNA, 201 bp, Homo sapiens
tttcaccctctaggacaagcatgactttcaggactctgtgagaataacgttggactttaatcttaccgatccagaaaatgggcctgttcttgatgattctytaccaaactcagtacatgaatatgtaagtcagatttctttaaaatacaaaataccaacttgtgaacattttaatgtcactagtaaactgtgttttttcac

SEQ ID NO: 26410 - DNA, 201 bp, Homo sapiens; identical to SEQ ID NO: 5193

SEQ ID NO: 26411 - DNA, 201 bp, Homo sapiens
ggaatgaactctgggaatagttctctgaccctttgtgtgtcagtgtgttctcagcctgaactggaagaaaatgggatagcatgtggaatgtgggaaagtgygaagactgatgcaaaattcactatctgcctcattaaatacactagtaggttttcaagagaatgagtctgttatcaccacagtaaatttctcactctgggc

SEQ ID NO: 26412 - DNA, 201 bp, Homo sapiens; identical to SEQ ID NO: 5195

SEQ ID NO: 26413 - DNA, 201 bp, Homo sapiens; identical to SEQ ID NO: 5194

SEQ ID NO: 26414 - DNA, 201 bp, Homo sapiens
gcaacaatgctaattggcttgtgatcacttaaatgttttcctaagggcaaggaaaaaataagcctttggaatttccctctaatccaaaaaagcaggtttgygaaaatccagaagagaaaaaaaaattgtacttttcatactgcttaggaaactttaatcttattaacttttgtcaaggatattgacagtactggggaagca

SEQ ID NO: 26415 - DNA, 201 bp, Homo sapiens
ctgaagtcaggaataaagaagtgacaaggagctagctggggcctggggaaggccctggggctggacactagaaagacccaccggggtcttttctatttttwtattcaacattttatctttcgttgtaaaactcaggaaaacacctttaacaaacaaaaataacttctctcttaagttgttcattttactaaatggccaaca

SEQ ID NO: 26416 - DNA, 201 bp, Homo sapiens
tgtgcatgatgtcagaatttggaaatctgtcttttcatgcattttttaaagtgttcccagaaatcaagaaatagcaacaatgctaattggcttgtgatcayttaaatgttttcctaagggcaaggaaaaaataagcctttggaatttccctctaatccaaaaaagcaggtttgcgaaaatccagaagagaaaaaaaaattg

SEQ ID NO: 26417 - DNA, 201 bp, Homo sapiens
cagcaaagatggggatggtgacaggggagtttgagacattctgtccctttccatagccattcctggaagaaagaatgtccaggattaactggttggtggcrcagccacctcagggaaagggaaactgacccctggggactgaagtcaggaataaagaagtgacaaggagctagctggggcctggggaaggccctggggctg

SEQ ID NO: 26418 - DNA, 201 bp, Homo sapiens
acagcaaagatggggatggtgacaggggagtttgagacattctgtccctttccatagccattcctggaagaaagaatgtccaggattaactggttggtggyacagccacctcagggaaagggaaactgacccctggggactgaagtcaggaataaagaagtgacaaggagctagctggggcctggggaaggccctggggct

SEQ ID NO: 26419 - DNA, 201 bp, Homo sapiens
ttggtactttaagagcaacagtgttaaatctatacattgctttgggcagtatggccatttaatgatattaaatgaaaggttttttcttttatttgtctcawctctgatttctttcagcagtgttttttaggtctccttttagagatctcttacctccttggttagctgtattcctggatatttcagtgttttttgtagctt

SEQ ID NO: 26420 - DNA, 201 bp, Homo sapiens
actcaattctgtggtcctctaatctacctggatcatagtggagaattagaaagcagagaaaatgtggcaaatctatgtattaaagcaatcccctcaagcaytatccagcattcatttattgttatttcacacctagtttcagcaagctttttttgttgcttaattttaaacctacaattaagtcatgcactattacaataa

SEQ ID NO: 26421 - DNA, 201 bp, Homo sapiens
taaaaataaaaataaattatttgatgacactaaattttatataatcagccaaagtttatgcaatcatttttaatgtttttattctattattttgtcatctyatgaaaaatcaggaactcaattctgtggtcctctaatctacctggatcatagtggagaattagaaagcagagaaaatgtggcaaatctatgtattaaagc

SEQ ID NO: 26422 - DNA, 201 bp, Homo sapiens
ttttactatgaaaagctaccatctggaacccttagtaaactgactgttgtctcataaagagtacaaccaagcctaatgcaacttaattgttcacacagttwtgtaagatgtacttcttctataactctacaggacttaaaagaactcataatactatatgattgtattatgggttccataaaacattatgacaatgtattt

SEQ ID NO: 26423 - DNA, 201 bp, Homo sapiens
gggtgtgatgaggtgctccctcagctatcaccctaaaaaatctaagaatgccagttcttctcagctttcagtttggagtaggcaaacatgtatctaaaaawaaaaataaattatttgatgacactaaattttatataatcagccaaagtttatgcaatcatttttaatgtttttattctattattttgtcatcttatgaaa

SEQ ID NO: 26424 - DNA, 201 bp, Homo sapiens
aaaatgttttggcagtcatattgcctggctttgcccagggttggtaccactgtccccactccaggaatggacaacctgttataacaaaagtaactgtgtgyttattaagtgtcaggtcttatggtaagtgctttaaaatgcattagtctttcaagaacccagtcagaagggttttgtcattactattttctgatgcaaaaa

SEQ ID NO: 26425 - DNA, 201 bp, Homo sapiens
cctagtgaacatgcataccccagacattttacctttctcttaaattattccatctgattttactaccttgctcttgctagagttaagagttttctgaaagyttattcagtgttaactaatgttacttttcctgggccatttttgttggtattgagttttttctttatgtgatcataaagttatagtttagaacaaggttat

SEQ ID NO: 26426 - DNA, 201 bp, Homo sapiens
ttgttgtgtggtttggaggctgtagagagcataggagactttaagattatagtactgcaatcaatacagtgatcttccttttttttttttttttctgaggrctttactttgggagaagtttctgaggcactgaaaaagcagactgactgcgttaatgtttgccacacctacattaaatttggaacataatatgtgcacata

SEQ ID NO: 26427 - DNA, 201 bp, Homo sapiens
tacaaaatatgatatatgtatttatgtgtttgtttcatcatatactctaacatatctcagttaactagctagttaagcaaattcattgagtagccatgaartggcagtggcactcagcagaagctagcaggttgaggtgactaaagaatggaggattttagatagatgcctttttactgagaggaaatagggtgattgaaa

SEQ ID NO: 26428 - DNA, 201 bp, Homo sapiens
actcagcagaagctagcaggttgaggtgactaaagaatggaggattttagatagatgcctttttactgagaggaaatagggtgattgaaagagcccttggrtaagggatacacatcttagactagaccccccttccaccacttcactatagggattgggtgttttcaactcagtttcctcacttatgaaacattatcatgt

SEQ ID NO: 26429 - DNA, 201 bp, Homo sapiens
aggtcaagaggagaaaactggattttaacatatggacctagtatttcaaggagtagcttgaagttttatctatttttaaaaaattagaataaaaatctatmttttaaagtatatttcgaagtcattgatacaggcaatggagagttattggaggtttttgaacaagtatgttataggatgaaagcagagtttcaggacagt

SEQ ID NO: 26430 - DNA, 201 bp, Homo sapiens
gcttagtaggagggacaaagaagtgcatttggtaggagtggagttcatattggggagtcctgaagatgggggtgaatggagaatttagcattggaatattragggactgaaggtcaagaggagaaaactggattttaacatatggacctagtatttcaaggagtagcttgaagttttatctatttttaaaaaattagaata

SEQ ID NO: 26431 - DNA, 201 bp, Homo sapiens
ttgagaataaatctgccactgccttctctctagtaaggaacattcaaaagccactgcactgccttcaagactcactttctcacattaacattgagtgtacrttatagtatttcagttgctgctctaaactactatccatttttttttttaaatggagtctcgctctgtcacccaggctggagtgaagtggcacgatctcgg

SEQ ID NO: 26432 - DNA, 201 bp, Homo sapiens
cccagaggacaggggcaaagtggcttaaagtcctctgatgagacgtgtggtatttcctctgggatggtcactgatactccccagggaaaaggatgagggcyttactgaagcaaaagaaaagaattgagaataaatctgccactgccttctctctagtaaggaacattcaaaagccactgcactgccttcaagactcacttt

SEQ ID NO: 26433 - DNA, 201 bp, Homo sapiens
tacttcagagctagctctagttttaacagtgtgcttcttcaaaacagcttgcagttcttctcagacattagtgcattactcctgtaacctcattattcctrtagcttcatggaacagcaggtgagggagctgagaaagaggcaagggcacccagtgacttgggtggtcccagaggacaggggcaaagtggcttaaagtcct

SEQ ID NO: 26434 - DNA, 201 bp, Homo sapiens; identical to SEQ ID NO: 5201

SEQ ID NO: 26435 - DNA, 201 bp, Homo sapiens
agtggggaacaagttctgaaataaaaagttacccaaatggtatgccaattacttcagagctagctctagttttaacagtgtgcttcttcaaaacagcttgmagttcttctcagacattagtgcattactcctgtaacctcattattcctatagcttcatggaacagcaggtgagggagctgagaaagaggcaagggcaccc

SEQ ID NO: 26436 - DNA, 201 bp, Homo sapiens; identical to SEQ ID NO: 5203

SEQ ID NO: 26437 - DNA, 201 bp, Homo sapiens
gacattctagtggggaacaagttctgaaataaaaagttacccaaatggtatgccaattacttcagagctagctctagttttaacagtgtgcttcttcaaarcagcttgcagttcttctcagacattagtgcattactcctgtaacctcattattcctatagcttcatggaacagcaggtgagggagctgagaaagaggcaa

SEQ ID NO: 26438 - DNA, 201 bp, Homo sapiens; identical to SEQ ID NO: 5205

SEQ ID NO: 26439 - DNA, 201 bp, Homo sapiens; identical to SEQ ID NO: 5208

SEQ ID NO: 26440 - DNA, 201 bp, Homo sapiens
ggaaaaatgcctttgcctttaaataagagagaggatttgttcagtataacaagagcagtggccattgggcttcccttccccgtctgagcaattttcgactmtctttttcattaattatcttcccccatcacttagctaaagtgggggaaagtgccagttgtctctgtttaaatattaacaacttctgacgtttgacacttg

SEQ ID NO: 26441 - DNA, 201 bp, Homo sapiens; identical to SEQ ID NO: 5211

SEQ ID NO: 26442 - DNA, 201 bp, Homo sapiens
taaattaaaatagttaattgtgttatgttttgtgttttctcaacagattggattcttcaaaagaccactgaaaaagaaaatggagaaatgaaatattttaygaaagaaaataataacaattattcaataatctatcctcaggtttgcctcaaatatgtgacaagaaatgtataattcatgacatagtcatgtaactatgta

SEQ ID NO: 26443 - DNA, 201 bp, Homo sapiens
ttggtttgattatataggaacatacggcactggagctgtctcagcctaattgcctataaattcaattcttttaaaagataatatcatggaacagcgtaatmagatttagagggtggggaatgaggaatgtgatcagataccaaggatgagggatttccactaaattgattaagccagattcttgcttaaactggactaagt

SEQ ID NO: 26444 - DNA, 201 bp, Homo sapiens
cattgatcacaaagaacgaacaactaactggaagaaagaaaaaaaaggcaagcagattttattcctggtcaggaatggagaaagagggagctcttgctctraagaccttctcttcaagctgtgaaaacctggggaattttaaggagttagatgtggggcagggaggtatatgtaagcatgtccagagaggaactccagatg

SEQ ID NO: 26445 - DNA, 201 bp, Homo sapiens; identical to SEQ ID NO: 5214

SEQ ID NO: 26446 - DNA, 201 bp, Homo sapiens
caaaatattttcccagaagcttttaattagttcaatgtgtatactatattttactaggggtcatggtgtatttaaccaatgaaaatattaaaaatgaaacmgcggcccggcgcgatggctcacgcctgtaatcccagcactttgggaggccgaggcaggcagatcatgaggtcaagagatagagaccatcctggccaacat

SEQ ID NO: 26447 - DNA, 201 bp, Homo sapiens
agagatttaaggaatttaaagcttatttctatttgggtgccacatttgttttcaaaacacccaatactgaggcaagagcagtatttgccaagtagcaaatwcaagagcaaaatgttttggcagtcatattgcctggctttgcccagggttggtaccactgtccccactccaggaatggacaacctgttataacaaaagtaa

SEQ ID NO: 26448 - DNA, 201 bp, Homo sapiens
caattattttttaaaatttttgtagatttgcagtaccgtgtcaccctagattcactaagacaaatatcacgaagttttttctctggaactcaagagagaarggttcaaaggaacatcacagttcgaaaatcagaatgcactaagcactccttctacatgttggcaagtaaatcatatatcgttgctgccttattccaaatc

SEQ ID NO: 26449 - DNA, 201 bp, Homo sapiens
aatacagacaactcagaaatctccctaacgccctagccataatatacctgtcagattccctaccatctctaatgacctcaacttatggtcatcaatcattygatggaaatttctctgccacatccctgaaaaaaaagatgatggcaaagaagagacaatgctagctaattgcagtttgtctcccaaaatattttcccagaa

SEQ ID NO: 26450 - DNA, 201 bp, Homo sapiens
aaggtaacaaggggttgctggttcttgtttgctccgttttctcaatggctttatcttcctctggtaattggcaaagggtcctgaagcttccaggccgtctrtagttgtttttcagcaagcttacctacagataaatagactagaaaaaaaaaaactgtttaagaaaaaataatgcactttctcagctatctactgtttaac

SEQ ID NO: 26451 - DNA, 201 bp, Homo sapiens
tgaaacggtctgtacattaatgcctcataatagcagctcttatttgggaaagggttatagtacatttaaaccatgtggttttccaagcaagttaagactgsctatttgtgtttagtgtcagaatatgttgaattagaagttgaagagtttctaaagtgattttaagggcttgaggagagatgaacccttttgcttagagcc

SEQ ID NO: 26452 - DNA, 201 bp, Homo sapiens
tctggagatgtgctctatattgctggacagcctcggtacaatcatacaggccaggtcattatctacaggatggaagatggaaacatcaaaattctccagaygctcagtggagaacaggtaaacttgaaaaatattcttttatttaaattaatctattcatactctatgtatatttactgtctattgtcctaaacttaaaaa

SEQ ID NO: 26453 - DNA, 201 bp, Homo sapiens
taaagttaatacagacaactcagaaatctccctaacgccctagccataatatacctgtcagattccctaccatctctaatgacctcaacttatggtcatcratcattcgatggaaatttctctgccacatccctgaaaaaaaagatgatggcaaagaagagacaatgctagctaattgcagtttgtctcccaaaatatttt

SEQ ID NO: 26454 - DNA, 201 bp, Homo sapiens
actagtatgtggcagttgacttaaactccaatactctttactatcattgacttaaactctgatactctttactataattatggaattgtgcaaatacctcygagtttaaaatattatttttattatttttggtgcacattcctaaaagttaaggaaggagcctcagtaatggaattgcttcttgaccttttgcaaacttca

SEQ ID NO: 26455 - DNA, 201 bp, Homo sapiens
aaaaataagcattttaggttagataattgcaaagatcccttctatcccccatacttagttttgttattctataggatgggaaacaattgcagcacttatarctttttatgatgccccaaattgcaaagcataatgaaatatggctcaccatccaccacgatgtgaaatttttcttatggtcaacaacttcattttttattt

SEQ ID NO: 26456 - DNA, 201 bp, Homo sapiens
aaatcagttatttttagctttttagaactttgatctgctagggattgtcaaaataatctccttgaggcatctttatttttaaaatgagattaaagtatgtkatttgcttgttatgtggctaattagtggcaaagctggaagtcattcccagtctggactttagttctttgcgccaaaacatgctatattatttatttattt

SEQ ID NO: 26457 - DNA, 201 bp, Homo sapiens; identical to SEQ ID NO: 5164

SEQ ID NO: 26458 - DNA, 201 bp, Homo sapiens
ggggaaaagtgggaagtaaatttgtaaggccagtgcaaattgggattgtagacgttaattcatagggaatgggaatccaaaatgaatcaaaataaaaatayaatgattggtctagaaatactaagccataaacaaaatctgggtgaaaacatctaatagtcaactacaggcttaaattactaaggaaaaaaaaaagttccc

SEQ ID NO: 26459 - DNA, 201 bp, Homo sapiens
cctgtctttccagcttgctgtatgctctgtgagggtaggatctttaaccataacacctagaaataataggcactttttaattgaatgaatcgcaaaagaaytgactattgacaaactcagaaaatacttaagggatcagattgtccctttattatatacctctgccttattttattatacctctgcctgaaatatttctgt

SEQ ID NO: 26460 - DNA, 201 bp, Homo sapiens
tctggaggttctaggggaaaatcagtttccctgttttcaccagcctctggccaccacctgcattcttggcctgtggcccctttctccatcttcaaccgagsagggtagaatcttcagatcttcccccatgactctgctttatcatcacatctccttctcagactctgaccctactaccttcctaaggatccttgtaattac

SEQ ID NO: 26461 - DNA, 201 bp, Homo sapiens
ttctggaggttctaggggaaaatcagtttccctgttttcaccagcctctggccaccacctgcattcttggcctgtggcccctttctccatcttcaaccgarcagggtagaatcttcagatcttcccccatgactctgctttatcatcacatctccttctcagactctgaccctactaccttcctaaggatccttgtaatta

SEQ ID NO: 26462 - DNA, 201 bp, Homo sapiens
agtcattatattctgtaggctcttctttagcaatctctttcagatttggaaacttctcatcaattcagagtccgtttgtaacctggggactcatcaccatwcttatccatgcacactactgtagagcttatctttctgtcttcaatttgaacccaacttccagtctaccctcctaatacatcatttttactatatctgttt

SEQ ID NO: 26463 - DNA, 201 bp, Homo sapiens; identical to SEQ ID NO: 5219

SEQ ID NO: 26464 - DNA, 201 bp, Homo sapiens; identical to SEQ ID NO: 5220

SEQ ID NO: 26465 - DNA, 201 bp, Homo sapiens
ggagaagtgtgtgtatatatttatatagaatacatacaaaacaaaaattttccatttccctgtcttctgtttctttccataagtgctgttcaattaaattsaaattcggttttttgttttgttttgtttttgagacgggaaggtgtctcgctctgtcgcccaggctggaatgcagtggcgcgatcttggctcactgcaagc

SEQ ID NO: 26466 - DNA, 201 bp, Homo sapiens
gtgggaaggagaaaaagtcttagaatccaccacctgcttttgtgaaagccttgtctgtttatttttgactcaggacatgcaggcacaagttaagaagcctmatggtttgtgaatctggaacttttatacttggctcatatgaaaaagcctgagacgtgtaggagagctggcatttggggaagaaaaacttattgttttcat

SEQ ID NO: 26467 - DNA, 201 bp, Homo sapiens
aaattagtacaactatatcctgtatatccaccactcagaactgacagttgtcaacatcttgtcatatttgctttaagtccttcgaaaggaaaagtcatcayatagaatccttttccccatttcaccagaatcctctcttcctgcttaaagatatcagttatggtatatttagtgtgtatctgttgtgcaaactctttggaa

SEQ ID NO: 26468 - DNA, 201 bp, Homo sapiens
ttttcccacatcgaccagttatctgacatcagctgcatgttctagaattcaattcagttctgacaccaactagagtttatgcaaacctcccacagattaasggctcagtccttcaagaattcattccaatttagagccagtaggtttccaggtacccacgatttgtccaacgtggctacaaattagaccccttacttgggt

SEQ ID NO: 26469 - DNA, 201 bp, Homo sapiens
gctctgtggatagaaaacattttaatcttgtgtttcagctcatttgatctgatgaccataatttatagtttatttttcctccccaagtgtgttgttgactrtggtataattctttttttctttttctttctttctttctttttttttttttttttttttttgtttgatgagtttgaagaggaagcttaaaatacatttcag

SEQ ID NO: 26470 - DNA, 201 bp, Homo sapiens
ttcgcatacaaagatctgttaaagactaacatgtaacatctgttttcacctttgtttgtatactttaaaaagtcagaaaatcggctgggtgcagtggctcrtgcctgtaatcccagcactttgggagtctgaggcggctggatcacctgaggtcaggagttcgagagcagcctggccaacatggtgaaaccccatctctac

SEQ ID NO: 26471 - DNA, 201 bp, Homo sapiens
attcgcatacaaagatctgttaaagactaacatgtaacatctgttttcacctttgtttgtatactttaaaaagtcagaaaatcggctgggtgcagtggctygtgcctgtaatcccagcactttgggagtctgaggcggctggatcacctgaggtcaggagttcgagagcagcctggccaacatggtgaaaccccatctcta

SEQ ID NO: 26472 - DNA, 201 bp, Homo sapiens
aattaggaagttttagtgacctaaggaatttgaatttcaaaagtgattgaatctcatatgatattcgcatacaaagatctgttaaagactaacatgtaacrtctgttttcacctttgtttgtatactttaaaaagtcagaaaatcggctgggtgcagtggctcgtgcctgtaatcccagcactttgggagtctgaggcggc

SEQ ID NO: 26473 - DNA, 201 bp, Homo sapiens
tctcagttcccttctgtactttagaactctctccttccctcatcttgatttcactaggccacactataaccctgcttcctggagagaatcagacccatgtragctcttgagcctcctgttccatggatctctccaccaagacaagagcctactccaggctgccaacctgagattagagagttcatactctgattggtcccc

SEQ ID NO: 26474 - DNA, 201 bp, Homo sapiens
gatcacttcaggccaggagttcaagatgagtttggtcaacatagtgaaacctgtctttaccaaaaaaaagtaataatgataataaacatttaacaaaaagraaaaagaaaactactttagaaaaatgtgatagtctaggtttctgagtcaaaatatctgtaggttaaggaggaaaaaaaattcacgggatgctcaccacca

SEQ ID NO: 26475 - DNA, 201 bp, Homo sapiens
atttgaaaaatcacttacctatgacccttaattttctttttttaaaaataagcattttaggttagataattgcaaagatcccttctatcccccatacttarttttgttattctataggatgggaaacaattgcagcacttataactttttatgatgccccaaattgcaaagcataatgaaatatggctcaccatccaccac

SEQ ID NO: 26476 - DNA, 201 bp, Homo sapiens
tctaaataccatgtccctatgtgttttttgcctctgtgtttcacaaagggtatagctgtgggacacagagtttattgaattttgattatacattaaaattmtgtagtgatagtaccaagtatttttctcctacattaattaccttttcatgtttaagcacattttaattgttttttattcctttcaggcagaagttgcaaa

SEQ ID NO: 26477 - DNA, 201 bp, Homo sapiens
atttatttattaatcctaaagctttattcttcatccaatatacatgttctgggtgggtgtggatggggactggtgtctcaccactttttagtcttttatayattagtatgaatttattcattcagcaattattccatgttatattcattaagcacttacttttctgacagttatcacctcattagagcctttgccataggg

SEQ ID NO: 26478 - DNA, 201 bp, Homo sapiens
ccacaaacagatggaggtaattggacatttacctacctattggatcacctattggatcaccaatttgtatacacaaagagtgcacatgtttaggtgtaccraatgcacccccattcaataatcaattaaatgtgactgcacattcgaagtaagtcaaagtgttctttgaaacctctgagcctgtagggagctgtacgtttt

SEQ ID NO: 26479 - DNA, 201 bp, Homo sapiens
agagaaagagagaagaaagaaagaaagagagaagaaagaaagaaagagagagagagaagaaagagagagaaagaagaaagaaagggagagaaagaaagacrgaaagaaagaaaaagaaagagaaagaaagaaagaaagagaaagaaagaaggggaaggaaggaaggggaaggaaggaaggagagaaagagagagagagatc

SEQ ID NO: 26480 - DNA, 201 bp, Homo sapiens
agcacaccaggagccatgagagactcagaacattcctctctcctaacttgatgtcataatgatgcctgaagttcctcaactgatgatttatttattaatcytaaagctttattcttcatccaatatacatgttctgggtgggtgtggatggggactggtgtctcaccactttttagtcttttatacattagtatgaattta

SEQ ID NO: 26481 - DNA, 201 bp, Homo sapiens
tgcatgaaggctctgcagttagctgcctgcgttatccaatctgtggactaaagggaatgaaaggaggaaggcagtaggaaaggaagacaaaacaaggaaasaaggtggagttgggaagggctgatttgggagaaatgaggctgcagcaaggttagacaaagctcactgctcaagtgtgtaaccctgcaggctacataacct

SEQ ID NO: 26482 - DNA, 201 bp, Homo sapiens
acacatagtgagattcagagtaaggatctgaattctgtgccaaaaccactgactattatcactctgtgttctctcttgcttccattcactctggtgtcctygcaacaatcttttcgaccaagtattttaactacattttacacctgaggacattaaagcaaagggaggtaaagtgactctcccatgattactagctagtaa

SEQ ID NO: 26483 - DNA, 201 bp, Homo sapiens
tctcaagcgctgtattctaggagaatttcaaatgtcactttctctgtaattttctatgattatcctacccactgttcttgagaaaaatgccttcctctccyatgttcccatagcagctgcaaccgtgagagcacatttccttactgctcttatcactcagtagcattgctctttgttttttgggtctgtctcttctagtag

SEQ ID NO: 26484 - DNA, 201 bp, Homo sapiens
cgttgaaatgatgactaagggaaagaaaaaagaaaaatgcgtatttcaaacactgcacacaacttgacccaatttttgtaaaggaaaaaaaacttattttragttagaaatagtcaaaaattcacaaaagtatctttctagagtttagtatgataggggactttcacatgtgtaacaattaaaattttataataagtatgt

SEQ ID NO: 26485 - DNA, 201 bp, Homo sapiens
cactgcaacctccgcctcccgggttcaagctattctcctgcctcaggctcccgagtagcttacccttcagccattcctgggcccttgccttccttgttcawgaagtgctgtgctcttgttacttgcttttcctgtgattccctgctccatctcaagcgctgtattctaggagaatttcaaatgtcactttctctgtaattt

SEQ ID NO: 26486 - DNA, 201 bp, Homo sapiens
gttaatgctgctcattttagcactgtggaaggtaaacaccaaaattcctttgactctctacttcaatcatcaacagcaaactggagaaataagctctgatmtattcagactatgtaatatagtattattacagcaatgaaacaaacgttgaaatgatgactaagggaaagaaaaaagaaaaatgcgtatttcaaacactgc

SEQ ID NO: 26487 - DNA, 201 bp, Homo sapiens
gagaatgcagaagatctctgtaattcttaggaactgaggcagtgggatgcattcactcagggcaagggtgtaggtgagatatctcaatgaagggagttctmcaaagaacccttgaaaaacttgtacatacctattaggacctgattcatcttaggataataccaatgcagtaataatttctctatccttatttatcttccc

SEQ ID NO: 26488 - DNA, 201 bp, Homo sapiens
caagggtcttattagaattccatgttcaagacctaggatgctgggcacccagaataaagtagaaagacaagattagaaaatatatcatttgcagttaatgraagaaaaggcataatggtccttgcaaaagaatattgacatttccatgtgcaattttactgtataacttgggtaagttatttgtgccttgatttccttttc

SEQ ID NO: 26489 - DNA, 201 bp, Homo sapiens
ggataatattataaataccttttggtaataataaatttgacatagttagagatttagactagatgaagagcattttctaatgtaaatctaatgttttctcrttatatagtaacgagattaatgcactggtagagaattgtagcctgcaagaactcaatgttccaggagttctaataggtgtttattatgttaacaatcttg

SEQ ID NO: 26490 - DNA, 201 bp, Homo sapiens
gatgcaagacgaaactgccacttgttccaaaatgatgtttctatgtcagcacccaagaggagggatattttgaaacgtagaaaggaatggtgaacattttytctgtaaatatcacagggcagtctacttttaagatgcaaaatatagtattgttatttgtacataaatgtgtatttttaaggaggggacttaaaaacatag

SEQ ID NO: 26491 - DNA, 201 bp, Homo sapiens
gctgaccagtcagcagcttcatttgaaatggaaatgtctcagactggcttcagtgctcattattcacaggtatgttgaccagttggtgaaaaatgaaatayatgtttgcaagacttcccttcccaaaaccaacatctagccatcagtatgtaagtgcaacgtgcagttcatagcttgaacaattatgcaggctatgatgat

SEQ ID NO: 26492 - DNA, 201 bp, Homo sapiens
agtgatttgagaggttttgattagtatcatgcatatacaaatctctcccctgttagtttctttttctaccctaatcttccctctaggtaaagaaattgagrtgttactgttaaaggcaaatacagggcttgaactattactagccattgatatctaccctaaattaatttttttcaaatcccccagggatgagacacagag

SEQ ID NO: 26493 - DNA, 201 bp, Homo sapiens
ggacagggctgctaatgaacaagaatttgagacatgagccctttgactatttttctctgtcttctacccaggcctacctagaaattttgggttgagaaatrtatggctgaaaatgccctaagatgtttgaagttctggttggtaagaccacaagctctaccaggtatctgtattctgcaagtcagtagtgcatgaaaaggc

SEQ ID NO: 26494 - DNA, 201 bp, Homo sapiens
ggtatttcctaatacaaattcagacttgagtcctcagtaaaaatagaaaggtttgagtttttaactcttgtcctttttataaattaataagccaaggtgayggagtaagaccccatctctaaaaaaataaaataaaataagtacttgttacacatgcaggcacttcagcatgatctccccccttctcatgggagactttaa

SEQ ID NO: 26495 - DNA, 201 bp, Homo sapiens
aaacaacttctttataaaaagtgcctttatactgtacaggaaaacatgtacattttttaaagttttctttcaaatttcattgagaaatttgaaacaaaaawgtgatggtatttcctaatacaaattcagacttgagtcctcagtaaaaatagaaaggtttgagtttttaactcttgtcctttttataaattaataagccaa

SEQ ID NO: 26496 - DNA, 201 bp, Homo sapiens
tcagttcagtctctaatctttcagtgcagccatccccaaccgttttggcagagagaccggtttcatagaaggcattttttccacagaccaggggtaggggraacggtttcaagatgattcaaacacattacattcattgtgcactttattcccattataattatgttataatatataatgaagtaattataaaactcacca

SEQ ID NO: 26497 - DNA, 201 bp, Homo sapiens
gcccacgaatccatgtttgttacccatctcagtgctctgagatgggggctcctcccctacttgagtgccagccatagatctcagcttggtactcctgagayggacatgccatctctgggtctccaggacaccccgcagctcagagtcaggctctggttgctttggaggatccaaagtcctcccaggtcacagggaaagtac

SEQ ID NO: 26498 - DNA, 201 bp, Homo sapiens
gttaatgatctaaaggtaacaaggggttgctggttcttgtttgctccgttttctcaatggctttatcttcctctggtaattggcaaagggtcctgaagctyccaggccgtctgtagttgtttttcagcaagcttacctacagataaatagactagaaaaaaaaaaactgtttaagaaaaaataatgcactttctcagctat

SEQ ID NO: 26499 - DNA, 201 bp, Homo sapiens
gctttatcaaagatcagacggctgtaggtatgtggctttatttctgaattctctattctgtttcactggtccatgtggctcttctgtaccagtatcatacygttttgattaccgtagccttatagtagagttcgaagtcaggcagtgtgatgggtctggctttgttctttttacttaggattgctttggctacctgagctc

SEQ ID NO: 26500 - DNA, 201 bp, Homo sapiens
tacttaaaatcaaattttggcaaacacttataaatattttttgtcttcccttgactgaagtgctgcttaaaaacatactattttactctaccaagttcatscaaagaacatgatgaagctgtgtagagaagattgaacttttaagtttagcagtaaatataggactttaaattatgaaatggtaaaaatttttaatctatt

SEQ ID NO: 26501 - DNA, 201 bp, Homo sapiens
atctatggcactctctctttactaaatggagactacaaaaatggcatgattataggacatacatgtagattgtgctaatatttctcagcctttaaattctrtctccacttttctgtatttttctgtatccacttctattggtgcactgacttttccccaagagttttccatttacttaaaatcaaattttggcaaacactt

SEQ ID NO: 26502 - DNA, 201 bp, Homo sapiens
actttgtaagtgtttcagtgcattacatgagcacagatgctgcagagaacaaacattagtaattactatcattgtatagattatgatctaggagagaagayaaaaaatggtcacattattgtaaaataagctatgtaagtgttattatctcagagccaaataatagactcccttcccttgatgcacttattttgtattaaa

SEQ ID NO: 26503 - DNA, 201 bp, Homo sapiens
tcaaccataccaatcatctctgatctccttcttcaccccaattaaaaaaatgattaaaaattatactcttacatgcttttatttagttgccaggataagcktctctttcaaacacttagaaatgtctttaaatagtcaagattttaatggtttgtctgaatgtgccgtgtattttctagtgacagcgaagaacctcctgaa

SEQ ID NO: 26504 - DNA, 201 bp, Homo sapiens
atttctcaacccctctggcgaggacagggctgctaatgaacaagaatttgagacatgagccctttgactatttttctctgtcttctacccaggcctacctrgaaattttgggttgagaaatgtatggctgaaaatgccctaagatgtttgaagttctggttggtaagaccacaagctctaccaggtatctgtattctgcaa

SEQ ID NO: 26505 - DNA, 201 bp, Homo sapiens
gaagtatgtatatgtgtgtatgcacatatatacatgtgtttacataatatataatttaaatgataaccaaaatcaagagaataaatcagtgcttaacaaayaatatgatcatcaagtacttagtatggaaagactattaaagaagaaaacaaaagattttagatttactctcagctgtgtgaccctaatcacttatcttta

SEQ ID NO: 26506 - DNA, 201 bp, Homo sapiens
tggggccaaatctgcacttctgagagctacttttactgctaagctttgaaattggatttacccagagggaagcgttgcagtggcagccgcaggcaggtaaractagtatttgcactcacacactccccggattcttcacagacagggatggaagagaaaacttaggaagttgaagtttggcattaaaataaaggactcgcc

SEQ ID NO: 26507 - DNA, 201 bp, Homo sapiens
taaactggaaaaaatagagtatatgactaaaccacttgatagaaaatcagtcccagagaggtgaggaatcttaacaaggataaagctaacagtggtgcagycagggtttaaattctggtggtcacgggtcagagcctatgctcttatccactgcactaaactcctccaatgactagcattcactgaagactgctctgcacc

SEQ ID NO: 26508 - DNA, 201 bp, Homo sapiens
gtttaggccctgtactaaggatttcacttatttcattttcattaattcttttgtaagtaggtatgactgtactgcagagatgcgaagataaaacctttttwtcatgtttcaacattcttgtaattgcattttacaattgataacatgtttatttacgtggcagtgttatttttacttcttatgggtatgtaaaaataatgg

SEQ ID NO: 26509 - DNA, 201 bp, Homo sapiens
tcttgagtcacatcatggtttaggccctgtactaaggatttcacttatttcattttcattaattcttttgtaagtaggtatgactgtactgcagagatgcraagataaaacctttttttcatgtttcaacattcttgtaattgcattttacaattgataacatgtttatttacgtggcagtgttatttttacttcttatgg

SEQ ID NO: 26510 - DNA, 201 bp, Homo sapiens
ttagttcagggaggaaatgagaatgcttgggtgtgaggtggtggtgggactgcagaagcaagaaaggattggagagatatttagaagaggagtagaatggrcagggcttggtgagttacatatggtggtggtggagaggcggtcaatgaagaagaatcaagcaaaactcctagatttgtggcttgaccgttttccaccctc

SEQ ID NO: 26511 - DNA, 201 bp, Homo sapiens
cattttatttatgaaaggccttttaatcatctccttcagctgatgttcattcaattcttttgtaaccctgatatttaagagaattaggaagttttagtgayctaaggaatttgaatttcaaaagtgattgaatctcatatgatattcgcatacaaagatctgttaaagactaacatgtaacatctgttttcacctttgttt

SEQ ID NO: 26512 - DNA, 201 bp, Homo sapiens
cttccaatattacataaagccagccctgagtttagaacagtcacattttatttatgaaaggccttttaatcatctccttcagctgatgttcattcaattcwtttgtaaccctgatatttaagagaattaggaagttttagtgacctaaggaatttgaatttcaaaagtgattgaatctcatatgatattcgcatacaaaga

SEQ ID NO: 26513 - DNA, 201 bp, Homo sapiens
attttaattgttttttattcctttcaggcagaagttgcaaacaatatttttaatatttttagaattctttaccttcattttcagtaaatcccagttcaaakttttgtgtgtgtgtgttcccttcttcctatcccaaatttttacttttgtcaataaacttacagtatttaatcatgaggcctggattctcctgtcttgaag

SEQ ID NO: 26514 - DNA, 201 bp, Homo sapiens
tagtttctgtctctaactttagtttcctttttcagcttccctgactaattctcttaacctccaattatctttaacagaagttactaattctgcaattcatrtattctggaactggaattatctttgttcctaagcaaccaagtatacatatgaaacggtctgtacattaatgcctcataatagcagctcttatttgggaaa

SEQ ID NO: 26515 - DNA, 201 bp, Homo sapiens
gggaattctttttccccatacacctatcttccattctcccttccttcctaccagatatattgattgtcttatacataccaggcattggagcttacagtcttaacactggaaacaggtattaagtagtaattagagcatatgctatggaggaggatttcagagctctctaggaacttccacctaggctgagaagtcaggaca

SEQ ID NO: 26516 - DNA, 201 bp, Homo sapiens
tcgaagtaagtcaaagtgttctttgaaacctctgagcctgtagggagctgtacgttttccaaaggcaaccatttaagaatgaatattcatctctgaaaacwaactgaagaaatattctggctgcttttgcttctgcataaatacggctctaaataccatgtccctatgtgttttttgcctctgtgtttcacaaagggtata

SEQ ID NO: 26517 - DNA, 201 bp, Homo sapiens
aagctggtaagcaaaataattatagcaagtacttttgggtagaggacaatatatttgctctagcatgatgaagtccagtaggatattgtattttccccacwtggtgagctgcacgtcatatttgccccagtgaagatgcagaaccttgaaaaaaaattctgttgcaaaaggaataggttatggaacccagtcaattctgga

SEQ ID NO: 26518 - DNA, 201 bp, Homo sapiens
atctggctctagttatatggggcccaagagaaaataaccacaaacagatggaggtaattggacatttacctacctattggatcacctattggatcaccaayttgtatacacaaagagtgcacatgtttaggtgtaccgaatgcacccccattcaataatcaattaaatgtgactgcacattcgaagtaagtcaaagtgttc

SEQ ID NO: 26519 - DNA, 201 bp, Homo sapiens
ttttataagacagtgctctttggaaataattttgtttgtttgtttgtttggtttgtttgagacagtctttctctgttgcccaggctggagtgcagtggcamaatcttggctcactgcaacctctgtctcccaggttcaagcggtgcccctgcctcagcctcccgattagctgggactacaggggcatgccaccacacctgg

SEQ ID NO: 26520 - DNA, 201 bp, Homo sapiens
tccctccaatttacaacccttcctttcttccatctgcagttttccttatggtgaacacataactcagtctgtggttgaatttcattttataagaacgaacrgaattgtcctctcttacaaatgtagaacactttatttcctgtgtgttctcttatctcattcattaaactagcaaacttctgaacaaattcaaaacaatac

SEQ ID NO: 26521 - DNA, 201 bp, Homo sapiens
ataattataaaagagttgttttacttttccattttttacctttagcattatttgcttatgtttctataggcttgcaaccatatagcaggattatttcaacragttgggtattttccagaacccatgcaaagttttaggcctctgagcagctttagttagtcaaaatgacatacatgggggtccttttttgttagtagggct

SEQ ID NO: 26522 - DNA, 201 bp, Homo sapiens
tatgcagaagatggtaaccagctgttctctatcacgctggaagaatgaacaggaaatgtacataaaaggacccgtgcaattcacccattctttttctgctwccttcatgccagctagacaaatctcttcatgatcttgcaaccatatttgtcctggcctgtgtcttaatacttgcagagaccctcccaaatcctgggtaca

SEQ ID NO: 26523 - DNA, 201 bp, Homo sapiens
agaagggatagtggcacaaattaaggatataatattatttggcctgaaaaagatgctctgaattgtatactcaattgcattaaaaagagattccattaaartatgtctcccacacttctaccatctgctctttggaatccctaactttactctcagataggcacactttttaagaaattttaccaactttaccactaatgt

SEQ ID NO: 26524 - DNA, 201 bp, Homo sapiens
tagatggtagagctacacatctaggctgtatatcgcctatgtcttctaggctacagacctctacaagtggttactatactgtatactgtaggtcacggaarcacaatggcggccgggcgcagtgactcacacctgtaatcccagcacttctggaggccaaggcaggtagatcatttaaggccagcagtttgagaccagcct

SEQ ID NO: 26525 - DNA, 201 bp, Homo sapiens
tgtaatttaaatccatttgatttgtttgtttgtttgtttttagttttatttgtttcttttaatgaaagcattcaattccaccctatgattggcagaattarcttctggaatttattctcccctttatgtattctatctctgtttctgaaaggaacagatgtaaaaatgaattgtgagaaagattacccagaggagggtgca

SEQ ID NO: 26526 - DNA, 201 bp, Homo sapiens
cccaagaagtgaattatgagagctgacagaattcattcttcataaatccatgcaaagggctatgccatccattttagcctttttttcctctttttttttttctctttatttgagacagagtttctctcttattgcccaggctggagtgcagtggcatgatctctgctcactgcaacctccacctcctgggttcaagtgatt

SEQ ID NO: 26527 - DNA, 201 bp, Homo sapiens
tctgccttcccaagctttcttctccttattttcagaatgatgatagtaatggtatttaattatagagttgctggcaaattaaatgagagtaacacatggtyagtacacaatatagttattatttataaggggaaaaattactggttttcaattgctggtacatgtgaaatcagaatttcttttgacatctgtcttatctat

SEQ ID NO: 26528 - DNA, 201 bp, Homo sapiens
tatgaaggagacacgagaggctaactgatttgtttaaggtctttctgcttgctgatggcagattagaacacacacagctctctaattgtagcccagtttgytgttgttttttttctttctgagggctctacttctagagaagcttcagagccagtaccatctaatgcccctgaatagtagatttcaatccttttctatttc

SEQ ID NO: 26529 - DNA, 201 bp, Homo sapiens
cttctgcctcccaggttcaagcaattctcctgcctcagcctcctgagtagctgggactacaggtgtgcacctctatgcccagctaattttttttaatgtayttttagtagagatggggtttcaccatattggccaggctgctcttgaactcctgaattgaggtgatccgcctgacttggcctcccaaagtgctgggatttc

SEQ ID NO: 26530 - DNA, 201 bp, Homo sapiens
gtgaaattactagtggatggtaggggacctttttatcccgtcttgctacagggtacagggcagcctgcatcttaacagaccaactccaggatgtgacttgytcttccttctggcacctgttcctcatggacctccttttttcccttctgagaccactcttccttcctcctttcctcgcttcccctatcccttctctccttg

SEQ ID NO: 26531 - DNA, 201 bp, Homo sapiens
gccagtatataacaaaatctgactgctatttttggaattgatattagtgtaaataactttacaaagtcatttttaaacatcatagataaagctgtcatgckgcttatatttaaagaatgagtctctttgaagaaagaagtaacttcatttgagatatgctcaaaaactgttttataaaaacttatataaaattcatattga

SEQ ID NO: 26532 - DNA, 201 bp, Homo sapiens
agaacagacatgccccagtcccatggggaatgcctgctttctcctggcttgtggtcacctggggctagagcctctctgaaggagatggggagtccgagggratgggcacctatgtctgtgctctgctcacaaaagctcctgggctccatgctagctgaagccctgtctctacctgctccctgggaaaatccacctgccagc

SEQ ID NO: 26533 - DNA, 201 bp, Homo sapiens
ttttcttttttagtgtgagaaagtgaaacttcttgccaatattgttaggctggcatgcttcatgcttcaggacccaacattcccttcagaatgtcaaatgyagtctctttactgtgtttcctttatcaaaactttctggacactgctctaatattcctctagtttcctttgtcacccaaaggatgtcctcatgattttgga

SEQ ID NO: 26534 - DNA, 201 bp, Homo sapiens
ttttatttgcatttctgtaatgattagtgataatgagagttttttcatatgtttgttggtcacctgtatgtcatgttttaaggagtctattcatgtccttygcccattatttaatgtggttatttgttgattgattgcttgctgagttgttcaagttccttattctggatattagacctttgtcagatgcatagtttgcaa

SEQ ID NO: 26535 - DNA, 201 bp, Homo sapiens
gactgttattatatgtataattttataatatataggtatatatgaagccttttttcttttttttttttttgagacggagtgtctctctgtcgcccaggctrgagtgcagtggcacgatctcggctcactgcaagctccacctcccgggttcacgccattctcctgcctcagcctcccgagtagctgggactacaggcgccc

SEQ ID NO: 26536 - DNA, 201 bp, Homo sapiens
gctacttgggaggctgaggcaggagaatcgcttggacccaggaggcggaggttgcagtgggccaaggtcatgccactgcactccagtctggcaacagagcragactccgtctcaaaaaataaaaataaaaaaataaaataaaaaaataaagttgtaatctaacacaatcccaagtacaaaatctcatactatgtaattaag

SEQ ID NO: 26537 - DNA, 201 bp, Homo sapiens
tggaaaccaacttttataaaagtaagtaaatacatagttctatgcactgattgaataatatcaataaatattcatttaccacttagaatatgcaaggcacwgtgctgcttttggaaagaatgtgcgactggaagtataagaggatgtgaccaagccccagctctacttaaccagctatgtgtgtctcatcttccttgtctg

SEQ ID NO: 26538 - DNA, 201 bp, Homo sapiens
atgtaatctcacttcttctgacatcagccaagtcaatgtttcgcttatcttgtggaaaccaacttttataaaagtaagtaaatacatagttctatgcactkattgaataatatcaataaatattcatttaccacttagaatatgcaaggcactgtgctgcttttggaaagaatgtgcgactggaagtataagaggatgtga

SEQ ID NO: 26539 - DNA, 201 bp, Homo sapiens
ctgaagaaatctgaacaggaaatttggattgacgtataactcacagtggcttggtatttcaggttggaattgtacagtatggagaaaacgtgacccatgarttcaacctcaataagtattcttccaccgaagaggtacttgttgcagcaaagaaaatagtccagagaggtggccgccagactatgacagctcttggaatag

SEQ ID NO: 26540 - DNA, 201 bp, Homo sapiens
aagagagagcgcccatccactttccggcattccaggtactcaggccaggctacggggcaggcaggagtttcgcgttctggttttgatatgaattagttttmgtgtctctccaaagtccttcaccctaggagtaggagtgaggcagcactgaaaaccttacaaggtagaattcacttttaaaattaaagttgtttttacaat

SEQ ID NO: 26541 - DNA, 201 bp, Homo sapiens
aaccaaaaatctaaattgttccgtggtctcccttctttccagtttcaaaaagactggtatgttaaaaaaaaaaaaaagaaagaaaaagaaaagaatgagcmtggcaagaacataataacagacaaaaacttccaattctggtcttctgttaatcctaggtctattaagagaatgggggatggaggaacaatatgattatag

SEQ ID NO: 26542 - DNA, 201 bp, Homo sapiens
aactctataccactatagcaaacaatcacggaattttattttaggtaatgcctagttactgacacagactcaagttaaaatcactcaaggaaaaaagagarcacaattcaaataatggatttaaatatgtattcaaaaatatgagataatgcaacaaaattataaatgaagacagcctcaatccttttgggaattgccaac

SEQ ID NO: 26543 - DNA, 201 bp, Homo sapiens
gatgtgggagccccgtgggaagctattactttagttcagggaggaaatgagaatgcttgggtgtgaggtggtggtgggactgcagaagcaagaaaggattrgagagatatttagaagaggagtagaatggacagggcttggtgagttacatatggtggtggtggagaggcggtcaatgaagaagaatcaagcaaaactcct

SEQ ID NO: 26544 - DNA, 201 bp, Homo sapiens
gacgtctttgatccattatcactccattaattgtatacaagacaagaagtgtcaaattttatgaaaatttgcatatgaaagttgaggagagtatcatgaawgatttaaatcgtgaatgatttcagtttcaagcctgggaatctgaaagaaaggtggctccatgattagaatgtcaacacctcaagcaatttagatattttt

SEQ ID NO: 26545 - DNA, 201 bp, Homo sapiens
atacccacatattcagtaacaactgggaacagggccctgtgttaggttctttggaaggatgtatagtgtctgtatctttgtcttcatgttggatgggtgtrgaggtaagatatacaatagatgtggatacagatgtacaaatatatacacaagaaaagagatccaaaacattaagaggcatgaaattaccagtggcccaga

SEQ ID NO: 26546 - DNA, 201 bp, Homo sapiens
tggacccatactttgcatggcaaaagggacttttcagatatgatgaaattaaggatcccgagttggaagattatcctcagatatctggctggacctgatayaatcaagcattctaaaaatcagagaacctctcctggatgtggccagagggagacagaactatggaaaaatggtcagagagatgcagtgttgttggcttta

SEQ ID NO: 26547 - DNA, 201 bp, Homo sapiens
tttagactagatgaagagcattttctaatgtaaatctaatgttttctcattatatagtaacgagattaatgcactggtagagaattgtagcctgcaagaaytcaatgttccaggagttctaataggtgtttattatgttaacaatcttgtttaataattttcagcttgctattcaaatatccaaagatgggctaccgggca

SEQ ID NO: 26548 - DNA, 201 bp, Homo sapiens
cttaatgaatattacacacccataaaaataaaaattataaagctgctgattctatgatactaaagacttgaagcagttatggtacaaggtgtacaattagygatagcgatgaggtcatagagacttgagcttgttttctgattctgcccctggctatggctttaggcaaattactctccccctcaaagcctcaattttcct

SEQ ID NO: 26549 - DNA, 201 bp, Homo sapiens
aaatttcagaaggataatattataaataccttttggtaataataaatttgacatagttagagatttagactagatgaagagcattttctaatgtaaatctratgttttctcattatatagtaacgagattaatgcactggtagagaattgtagcctgcaagaactcaatgttccaggagttctaataggtgtttattatgt

SEQ ID NO: 26550 - DNA, 201 bp, Homo sapiens
gcagggaatggtttaggttgatatgtgccctttctgatatgttcagtttctctgtgtctggtatcaactttaacttcaaggagaactttgaacctggtggwcaagaaatgagagtagaaaaggaaacctcgacttctcctatatcctgaaaaccaaactcatattgtcttaaatgtcttctatcattaatttctctctatg

SEQ ID NO: 26551 - DNA, 201 bp, Homo sapiens
atataattataaaagagttgttttacttttccattttttacctttagcattatttgcttatgtttctataggcttgcaaccatatagcaggattatttcawcgagttgggtattttccagaacccatgcaaagttttaggcctctgagcagctttagttagtcaaaatgacatacatgggggtccttttttgttagtaggg

SEQ ID NO: 26552 - DNA, 201 bp, Homo sapiens
caagaagcccaggagaatatagtggtctattaccatgatgccactgcagcaggaagaacatcacatagcgtccttctgtctgttctcagctgaaggcagartagcggcagggcaggtgctgaaaataatgcaggtttccgttgctgcattcttattgatcttgcagataagtgagaaaacacctgaaagcattgtggactg

SEQ ID NO: 26553 - DNA, 201 bp, Homo sapiens
agtacatcagaaaatagtctactgtctccatttcccgttgagcactgggagaaaatgccaacatttctaaccagaggctgcacagtggttagagtggctgrcccaaacacccatgaacagtccagggagaagtttgaagcaagaagcccaggagaatatagtggtctattaccatgatgccactgcagcaggaagaacatc

SEQ ID NO: 26554 - DNA, 201 bp, Homo sapiens
aaatgacttgattggctatagctaggcatttaccttatttgggtatgatctggtggaaagttagaggttacttgccaggttctgattggtaaagtctctasttagaagttagttgcagtttctaattggtaatgtttaagttttgttttactgtttacattgaattggactttggtttgattatataggaacatacggcac

SEQ ID NO: 26555 - DNA, 201 bp, Homo sapiens; identical to SEQ ID NO: 5165

SEQ ID NO: 26556 - DNA, 201 bp, Homo sapiens
tgtgtgtatatattttgatacaagaaacccttctgaagaaattagttattagattccattgatgtcacaaggtgttctttttgttgttgttattggttcgkttgttctaatttctgcccttttcaagattcaaatcacaacttaaaagcaaggagttgcaagaatatatggaatggtgagaaatgattgatgttagaaagc

SEQ ID NO: 26557 - DNA, 201 bp, Homo sapiens
ggaagaatgattatcaacgggggagttggggagagttcaccaggctaagaattgaagaaaggaatttccagaagtggggaaaactttagcagaagttcgaytgagaatacaagatgtttcagggaactgcgcatattgaagggtggccattacttgacattctgagccagagtagtaatgagattggaaaggtcaaatgag

SEQ ID NO: 26558 - DNA, 201 bp, Homo sapiens
atcattcacttattgtatgacccagcactttcatttctagttatttactcaagagaaaagaaaatatatgtctattacagagacctacatgtgaatatttrcagcagcattattcataatatgttgaagctgcaaacaactcaaatgttctcattaagtaaattgtggtgcatccatacaatggaatgctactctgcaata

SEQ ID NO: 26559 - DNA, 201 bp, Homo sapiens
ttatattctagaatgtccatgtattttcagtacttgatttaccgttatcgaagctactagataagaggtgttaaggcgccaaattaaatattgtctatttraaatcatttttagtgcaaagtttgaaagaaatggaaaggatattatcatttgtaatcctctctccttttttactttctttagattccctccaatttacaa

SEQ ID NO: 26560 - DNA, 201 bp, Homo sapiens
gaacggattaaaaataggtctacctctactcaatatatatttatattctagaatgtccatgtattttcagtacttgatttaccgttatcgaagctactagrtaagaggtgttaaggcgccaaattaaatattgtctatttaaaatcatttttagtgcaaagtttgaaagaaatggaaaggatattatcatttgtaatcctc

SEQ ID NO: 26561 - DNA, 201 bp, Homo sapiens
aaagccattttgtttaaaatgagattcagaagattaaataatggttacaagatcagatgtttgtatgacacaatctcaccatccttcttatccttctcttrttacaagggtttaattgatagagaatccattttaaaatatcactgcatctatattttcatgttcttgggtactaagacaatattagttaatatttgtttc

SEQ ID NO: 26562 - DNA, 201 bp, Homo sapiens
atacccagcaatgttttttttttcttttttttttttcattttaaatacacacctcctgtagtaaccactgatgtgacataccaccatagctcacttagatwgccaattcttgaatttcaaataaataaaactgtatagtatgtactgtgtgtttagcttttcactcaacataattattgcttgtgatattttgtgtactgg

SEQ ID NO: 26563 - DNA, 201 bp, Homo sapiens
tatacccagcaatgttttttttttcttttttttttttcattttaaatacacacctcctgtagtaaccactgatgtgacataccaccatagctcacttagattgccaattcttgaatttcaaataaataaaactgtatagtatgtactgtgtgtttagcttttcactcaacataattattgcttgtgatattttgtgtactg

SEQ ID NO: 26564 - DNA, 201 bp, Homo sapiens
tatggagaaagaaaataatgaggccaaataaaagttaaactttgttatgttttatttttcttctaattaattttttaagctctgcaagtgaataccacatktcaattgctgccaatgagacagtccctgaagttattaattctactgaggacattggaaatgaaattaatatcttctacttggtaagaaattacctctaaa

SEQ ID NO: 26565 - DNA, 201 bp, Homo sapiens
agtgctgcaataaacaggggagtgcagatatttcttcaatatactatttcctttctttgggatatatacccagcaatgttttttttttcttttttttttttcattttaaatacacacctcctgtagtaaccactgatgtgacataccaccatagctcacttagattgccaattcttgaatttcaaataaataaaactgtat

SEQ ID NO: 26566 - DNA, 201 bp, Homo sapiens
taaatgataaccaaaatcaagagaataaatcagtgcttaacaaacaatatgatcatcaagtacttagtatggaaagactattaaagaagaaaacaaaagaktttagatttactctcagctgtgtgaccctaatcacttatctttactaagtcctcatctgtgataaataagcatcacctgggggcagatatgtggttaaaa

SEQ ID NO: 26567 - DNA, 201 bp, Homo sapiens
ttgagaaatgtatggctgaaaatgccctaagatgtttgaagttctggttggtaagaccacaagctctaccaggtatctgtattctgcaagtcagtagtgcrtgaaaaggcattgttacttatttacagtgatattttcctatgttatagctacagctgaccagtcagcagcttcatttgaaatggaaatgtctcagactgg

SEQ ID NO: 26568 - DNA, 201 bp, Homo sapiens
ggtagtaggtgtctctggccttcaagaaaaagaatgcttcaaatagattggtttagaacttaatcagaaattctccttccatctctctctttctaaaaaamaattgccttattgagatataattcacgtagcatggagttcactcgttgaaagtgtgtatttcagtgggttttagtatattcaccaaattataaattgtac

SEQ ID NO: 26569 - DNA, 201 bp, Homo sapiens
gtaagaccacaagctctaccaggtatctgtattctgcaagtcagtagtgcatgaaaaggcattgttacttatttacagtgatattttcctatgttatagcyacagctgaccagtcagcagcttcatttgaaatggaaatgtctcagactggcttcagtgctcattattcacaggtatgttgaccagttggtgaaaaatgaa

SEQ ID NO: 26570 - DNA, 201 bp, Homo sapiens
gaaaaatgttcagttcaaaattgtgacagattggaatatgctatggtcagaatgtttgtgccccaccaaaattcatatgttaatacttaatccccaatgtkatcgtagtaaaagatgaggcctttaggaggtcagtaggtccagagggtggagcccccatgagggattagtgtcctcataagagaggcttgagggagactg

SEQ ID NO: 26571 - DNA, 201 bp, Homo sapiens
agtgtagaacagctggtcccagaattctgtgcctcttccagctaaatcgagacaaaaatagtggcaaggcagtcaccaagacacatctgggaaaattctgraagaacacgtatcaatatttcacctgcttgtccactctgattctgtttgctttctcttcctaggctatccaaaaagacagttgtgaatctaatcataata

SEQ ID NO: 26572 - DNA, 201 bp, Homo sapiens
ttctaggtataggatcatattaccagtggaaaaaagatagcttgacttcttctattcctatttggatgtctttatttctttatcttgccttattgctctgrctaggacttagagtactaggttgaataggagtggtaagagtgggcatccttgtcttattccagttccccaggggaatggttccagcttttgcccattcag

SEQ ID NO: 26573 - DNA, 201 bp, Homo sapiens
ggcaacgtgacgagcacttttctatacaaaaaatacaaaaattaaccaggcatggtggcatgtgcctctggtcttagctacttgggaggctgaggtggaasaatcacttgagctggcgaggccgaggctgcagtgagccatgattgcaccactgcatcctaggctgggtgactgagtgagaccctgcctcaaaacaaaaac

SEQ ID NO: 26574 - DNA, 201 bp, Homo sapiens
gtattaagctttttaaaaaagttttgttttatttattcaaatatgtatgtcttttcttagattctgtgtgagaaaaggatagctcatgtataaaaactgtrtgtttcataaaatccttaaaccactgaaactgaaacagagtcaaggaaaataataacaatcaaagccaaaacagttaacagacgtacagagaggtacctc

SEQ ID NO: 26575 - DNA, 201 bp, Homo sapiens
gtcttgaaaaccttgtatacaagttaaaacatttgtaaaagtctaggcatgcttcatttttgaaataatgtggtagataacttaaaatgccagtaattatwttccagtctaaataatcacaacattgagtcaggtgtggtgactcacgcctgtaatcccagcacttcaggaggccgaggcaggcggatcactcgagcccag

SEQ ID NO: 26576 - DNA, 201 bp, Homo sapiens
ggatgctaagtgtgaaagtcctgagcatgaaggaaacaacgacattcgctagtgtggctgacgctaaagagcaagaaaggaggtgacgtgaggtgaggccrgaggtaaaggcaggggccgggtcattcgggacttggtgccactgcacaaattctaaacttttgaaagagcagtgcagtgcttttgaaggtttttatttgg

SEQ ID NO: 26577 - DNA, 201 bp, Homo sapiens
gttgggaaatgttcccggaagtgttacataatgatctttggcttgaggtctcaagaaaaactatattgtgatgcaggtagctcctatgttgacacagccargtgtgatgttgccatcactccagcagggccctctgaggaactggaagtgagtcaacaggtcatactctgaaacctccacattcccctatgccccttgtca

SEQ ID NO: 26578 - DNA, 201 bp, Homo sapiens
aatcaaattaaagaaatgacttgattggctatagctaggcatttaccttatttgggtatgatctggtggaaagttagaggttacttgccaggttctgattrgtaaagtctctagttagaagttagttgcagtttctaattggtaatgtttaagttttgttttactgtttacattgaattggactttggtttgattatatag

SEQ ID NO: 26579 - DNA, 201 bp, Homo sapiens
aaactaactgaagaaatattctggctgcttttgcttctgcataaatacggctctaaataccatgtccctatgtgttttttgcctctgtgtttcacaaaggktatagctgtgggacacagagtttattgaattttgattatacattaaaattctgtagtgatagtaccaagtatttttctcctacattaattaccttttcat

SEQ ID NO: 26580 - DNA, 201 bp, Homo sapiens
ttcacatacacagtttcccctgtatggacgctctgcccttctagcactcactcttgaagtctcagcttctgagaagccttccctggacccccattttcagkctggcctctagattatattggctgattagggattttcccatacagtcctttccacagtttgcaattgttcatgtatttgaatgatcacgtgtttaatctc

SEQ ID NO: 26581 - DNA, 201 bp, Homo sapiens
tccaaaggattgttattttatgtatgtcaaagtctcagcataaactgatgtcacatataaaggatttaactgaagacagtttcataaagtgacagtttagrgaggccttaaaggaacaagaaaagagggtggagcatctagcgcaagcaacagtagggaaaaaagaacctgaagcaaggtgagaagaaaaaccatgaccat

SEQ ID NO: 26582 - DNA, 201 bp, Homo sapiens
agggctgatttgggagaaatgaggctgcagcaaggttagacaaagctcactgctcaagtgtgtaaccctgcaggctacataacctgattattcctccagcytcatggtgccctcttctttcctcacagccctggccatggctcactgcctttctttccattcttagggtagatctatctctttcccatcctggtcttcttc

SEQ ID NO: 26583 - DNA, 201 bp, Homo sapiens
aaactgatgtcacatataaaggatttaactgaagacagtttcataaagtgacagtttagagaggccttaaaggaacaagaaaagagggtggagcatctagygcaagcaacagtagggaaaaaagaacctgaagcaaggtgagaagaaaaaccatgaccattcctaggcctgaggaggtggcagtgttagtttgattatgaa

SEQ ID NO: 26584 - DNA, 201 bp, Homo sapiens
ttggaggtggatagatggatgatagagatgtaaaatttaaagcactgatttctgacttaccaacattttgagttttttactattcctagtgtgaagataakttttccggacaatccaatggttcatagtaggttctttaagatatgtaaagtgtgttgtaaatgtaaagtattaacacacatgtggcaaaaagcagtcttg

SEQ ID NO: 26585 - DNA, 201 bp, Homo sapiens
agggataggagtaagagaaaaccttactcttttgcaccatttgcaatttgtgacagttttcatagtgataggagaaaggtagagatggggaggagtctgcygtaaagatatatatttaactttattttactcattgttttccaagattatttgaccatagaattcttttttaaatcaaacttagtaacatacaaagggatg

SEQ ID NO: 26586 - DNA, 201 bp, Homo sapiens
tggtggagaggcggtcaatgaagaagaatcaagcaaaactcctagatttgtggcttgaccgttttccaccctctcaactgagctttatgatattcctaagyatttgattaattttaagagaaaaatctcatgattagagttgagtagatttagatcttgcagtacttgactttgtatttcaaaactgtccttccctggcag

SEQ ID NO: 26587 - DNA, 201 bp, Homo sapiens
aaatgtaattttccctggaagtgacttatttgcaattgaccttctcaagtgaaattactagtggatggtaggggacctttttatcccgtcttgctacaggstacagggcagcctgcatcttaacagaccaactccaggatgtgacttgctcttccttctggcacctgttcctcatggacctccttttttcccttctgagac

SEQ ID NO: 26588 - DNA, 201 bp, Homo sapiens
atgcctcaaatgttattttgcttttccttcctagaaatagaggaagagctgaactcacaaggacagacaatattacagtccagacaagagatagcaggggyctacgggctgttcagggacctttagacttctttcaaatttggaacaaactcgtaaatccccaaaatacagttgattctggggtttcacctggacacttga

SEQ ID NO: 26589 - DNA, 201 bp, Homo sapiens
aaagcacttagaacagggcctagcacatggtataaattcaataaagcctagctgccattatcagtggtagtataatgaacatagtaatttggtgtctttcmtgttaaattagggcacagattttcactaaattagataaattttcactttgagttcgatcataaataatttttcatcctaccatacaatgaatgtacaata

SEQ ID NO: 26590 - DNA, 201 bp, Homo sapiens
gagctacttggcatttatcaaaggagtggtattcttacttctaagactttgctgaagttgcatcaagttcagacctattcaatattgcaatagtacatgtmtagttgtgcttctctctctaagttataagcaaactaaaaattgtgttttattcacttttgtatcattttatatcctcaggacctggcataaatgcccagc

SEQ ID NO: 26591 - DNA, 201 bp, Homo sapiens
catttctacttgatagacttggaaatcaaggctcagaggagacaaatgttttgcctacagtagattggtgacaacattctggctataattagttactctaytcaaataaacatatttgagcttcgattttacttagggcactggggatacaaagataattaaaatgaaactcagtcctcatccaaccagttgcctctcttc

SEQ ID NO: 26592 - DNA, 201 bp, Homo sapiens; identical to SEQ ID NO: 5163

SEQ ID NO: 26593 - DNA, 201 bp, Homo sapiens
ccagatgccactagagtagctttgtaaagctcatttttcttatctttacttagtttctgtctctaactttagtttcctttttcagcttccctgactaattstcttaacctccaattatctttaacagaagttactaattctgcaattcatatattctggaactggaattatctttgttcctaagcaaccaagtatacatat

SEQ ID NO: 26594 - DNA, 201 bp, Homo sapiens
cctttcaggcagaagttgcaaacaatatttttaatatttttagaattctttaccttcattttcagtaaatcccagttcaaagttttgtgtgtgtgtgttcycttcttcctatcccaaatttttacttttgtcaataaacttacagtatttaatcatgaggcctggattctcctgtcttgaagaaagggacactcttgatat

SEQ ID NO: 26595 - DNA, 201 bp, Homo sapiens
agggttacccaaactaagtctcaagatacctgtttctaatgacttttagatagcatagacctctttattgattaaataggaaagagaaaagaaaaaaaaaactctagaatttttaggattcataaaattggcatcacaataacagtaatcacttatggctcctaagaattttttctttttttttttaaaccttaaagatta

SEQ ID NO: 26596 - DNA, 201 bp, Homo sapiens
cattcaataatcaattaaatgtgactgcacattcgaagtaagtcaaagtgttctttgaaacctctgagcctgtagggagctgtacgttttccaaaggcaaycatttaagaatgaatattcatctctgaaaactaactgaagaaatattctggctgcttttgcttctgcataaatacggctctaaataccatgtccctatgt

SEQ ID NO: 26597 - DNA, 201 bp, Homo sapiens
ggacccccattttcagtctggcctctagattatattggctgattagggattttcccatacagtcctttccacagtttgcaattgttcatgtatttgaatgwtcacgtgtttaatctctctctccttctagctttagagaagctccatgaaggcagagaccatatcagtgtgtttcatattctacccaccaaggcctaccag

SEQ ID NO: 26598 - DNA, 201 bp, Homo sapiens
atatctctattttcagtaacatgttattatattgtgttgagataaataacactgattaataaattggaatattatgaatgttttaatttaaattgagaaaygaatgagtttctgtaaggacaaacacctttgtgtgtagtattatagttgcatacaaatttgaggctacagtgtttgctttttacaatgaatattttaact

SEQ ID NO: 26599 - DNA, 201 bp, Homo sapiens
cttcatgtgtctgtgtatatttatgtctctcttaatattttgatatctatgtatatataattttctaaaaggatggtggttgaaaatttcaaagttgaackcaaacttcaaagtgaaatgtattgctgcattccaaggctgaataggtctctgtagagagtgagtggaagggtaaggttataaatatcctgctggacaata

SEQ ID NO: 26600 - DNA, 201 bp, Homo sapiens
cagatcaggaagtctaactgaccattccagaatctctgcttccattccccactttaaatccacatacagtcttaacatgaaaacaacctctggaacaaacrgtgagacaaatctttctcaacctgaattttgcctctttctaatattccactctactaagcagatttagaagttcttgtttttcctgtccagtcttttttt

SEQ ID NO: 26601 - DNA, 201 bp, Homo sapiens
tgttgcctgctaaataatatccaagctctctagtggactaactggcatctgaccacctggcccagccatttctcatgcatcctgcttccccttacacccgyctcagtcaattttttttttttttttttgtgggtggaggagatggagttttgctccgatctcagctcactgcaacctccgcctcccgggttcaagctattc

SEQ ID NO: 26602 - DNA, 201 bp, Homo sapiens
gaatcaacttaatgagaaatccacatgataattttgaaaaatatataataaatttcattaagaaatataaaggaagggtttcataaataaaatctatttatgccaggtgactttatgggaagtccgcatgttgattctcctaaattaatgcattggtttactgtaattcgggtggaaacatacatcaatgctctttttccc

SEQ ID NO: 26603 - DNA, 201 bp, Homo sapiens
agaatcaacttaatgagaaatccacatgataattttgaaaaatatataataaatttcattaagaaatataaaggaagggtttcataaataaaatctatttatgccaggtgactttatgggaagtccgcatgttgattctcctaaattaatgcattggtttactgtaattcgggtggaaacatacatcaatgctctttttcc

SEQ ID NO: 26604 - DNA, 201 bp, Homo sapiens
aagaatcaacttaatgagaaatccacatgataattttgaaaaatatataataaatttcattaagaaatataaaggaagggtttcataaataaaatctatttatgccaggtgactttatgggaagtccgcatgttgattctcctaaattaatgcattggtttactgtaattcgggtggaaacatacatcaatgctctttttc

SEQ ID NO: 26605 - DNA, 201 bp, Homo sapiens
tactcactcaacaaatatttgggggatcctcttttgccccaggcattgatcttagtgctgggaataaagtgataaagaaaacacataccttggcctggaarcattcacagcttcacgtgttagccttcctctctgggatctttctgtcccggagacaagtctttttctctctgtcccagttgctttctattttatcaggaa

SEQ ID NO: 26606 - DNA, 201 bp, Homo sapiens
caagaatcaacttaatgagaaatccacatgataattttgaaaaatatataataaatttcattaagaaatataaaggaagggtttcataaataaaatctatttatgccaggtgactttatgggaagtccgcatgttgattctcctaaattaatgcattggtttactgtaattcgggtggaaacatacatcaatgctcttttt

SEQ ID NO: 26607 - DNA, 201 bp, Homo sapiens
gctggtaaatctctggcaggggtccccagtcaggaaaaagatttgagtattaaggtctttcaaaaaagttaactggccatactcaactgtctataaaacckctataaatttctgtttttatgtctatgaattattaaataaaatttaactcatttttaagaaattacattttctgttatcaagaatacaattcttactaga

SEQ ID NO: 26608 - DNA, 201 bp, Homo sapiens
ctggaagcattcacagcttcacgtgttagccttcctctctgggatctttctgtcccggagacaagtctttttctctctgtcccagttgctttctattttaycaggaaggtggcaggtctttactgcggtgtttatacatctccttattgaaggacacctattaaagctgtaggagcagcaggacttaagaagaataaaagg

SEQ ID NO: 26609 - DNA, 201 bp, Homo sapiens
tttttgattgattgccaaagagatttttctataatgctaatttaataatctgtacaatatgagaatcacttcaaataaacatttccatcaattattttttraaatttttgtagatttgcagtaccgtgtcaccctagattcactaagacaaatatcacgaagttttttctctggaactcaagagagaaaggttcaaaggaa

SEQ ID NO: 26610 - DNA, 201 bp, Homo sapiens
tatatatactatatgtatagtgtgtatctactatatatactatatatggtgtacctatatacacacactatatatagtatatagatacactatatatagcrtatctagtatatagatacactatatatagcgtatctagtatatagatatgctatatatagcgtatctagtatatagatacgctatatatagtgtatctag

SEQ ID NO: 26611 - DNA, 201 bp, Homo sapiens
acgtaaaataagatgtcagcagtaaaaatggaaaaggaagggccatgacagatatcaataataggaagttgacaatagtaaaatgaagcattttagatgaygtctttgatccattatcactccattaattgtatacaagacaagaagtgtcaaattttatgaaaatttgcatatgaaagttgaggagagtatcatgaatga

SEQ ID NO: 26612 - DNA, 201 bp, Homo sapiens
gaaattaaagtctaaagaagacacgatttatgaagctggtaagcaaaataattatagcaagtacttttgggtagaggacaatatatttgctctagcatgaygaagtccagtaggatattgtattttccccacatggtgagctgcacgtcatatttgccccagtgaagatgcagaaccttgaaaaaaaattctgttgcaaaa

SEQ ID NO: 26613 - DNA, 201 bp, Homo sapiens
tagtttatatattgtatatagtgtatatatagtgtatatagagtacatattgtatatatagtgtacatatagtatatataatatatagtgtatatatagtrtatgtagtgtatatatagtatatacagtgtatatatagtatatgtagtgtatatatagtatatacagtgtatatatagtatatagtgtatatatagtgta

SEQ ID NO: 26614 - DNA, 201 bp, Homo sapiens
aacatacacagttataaggggctagctctggccacaaggcagaaaccaggtaaaaatgtgcagtaattgttccggcttggatctaagacaatgacctcagwatccatatattctccatgtctgagatcttactctgatctcattttggattagtagacattactgggctttcgagttaaaacgactgagtttaaaatccca

SEQ ID NO: 26615 - DNA, 201 bp, Homo sapiens
tttatggcctctcctgccccaaatcaaggcattgatggcccaaaatgatagtcatttccctatcatagtccaggctccactgacagcagaatggaccaaaycgatatactgggacacgaagactaagattcacaatgcctaacaagaagtgagagtggatacaagtgacagatgataggaaaaacgtttggaagcaaatag

SEQ ID NO: 26616 - DNA, 201 bp, Homo sapiens
tactgtatatactatatatactatacatagtgtatatagtgtatatatagtatatatagtgtatatatagtgtatatatagtatatagtgtatatatagtktatatattgtatatagtgtatatatagtgtatatagagtacatattgtatatatagtgtacatatagtatatataatatatagtgtatatatagtatatg

SEQ ID NO: 26617 - DNA, 201 bp, Homo sapiens
agaaggagtaaggaaaataaatatacctcctttcctcccaccctctgatgtcttgctcagccttcccattggccatccccaaatggcaagatccaaccttycagagaacaaagggcaagacaatcaataacagaatagctagcacaacttaaccccgaaatgtattatgtgcaaggcactgtgccaagggctttgcatgta

SEQ ID NO: 26618 - DNA, 201 bp, Homo sapiens
taattcaaatatgcaaaggagtggatacacatactctttttgtatgaattatatgagatctcctaaaataaatgcaaattcttaaatttaaatatagcacytaagtcactttaaaacatcaatagttaagatggtttatatattttgttacaaatcatatatccttactacaaattaaatgtactttcaaaattattttat

SEQ ID NO: 26619 - DNA, 201 bp, Homo sapiens
agtaatgactatatttagtactgtgcctgacacacagttaacactcaatgggtgttgtctattattttattatgtaaatgttattatgtatttttttattrtgtaatgttatataataaacattcctcttattagtattgtggtaggcagaataatgatccccaaagatgtccatgtcctaatccctggacccatactttg

SEQ ID NO: 26620 - DNA, 201 bp, Homo sapiens
gtattcatttacctgatacatagaaacagataatcgcgtagcactctctgactctgtttatattgttggtcaagcctagaggcatcttaagtaatatcttygctcagcctttaaaatgcctaaatccccaaattggcccagttctttcagatacatacattcataatgctttattaattatgaataaataataatttagta

SEQ ID NO: 26621 - DNA, 201 bp, Homo sapiens
tgtctgctctcaagtaatcatagttggttagatattgaacaactacttacaaataaaacagaattcactaccttctagcttatataatttgaaaagaaatyagaatattaattatttcattttctatttgagtgttctctttggttctgtagtcaacagagctctcaaaatctattcatgtaatgcaaacatgagtgattt

SEQ ID NO: 26622 - DNA, 201 bp, Homo sapiens
agttttctagcttcaagccaggcatttttagagctctataatttattaatatcaagtatcataatatcactaggacctcataaggatggtcaaatgagagrgcaggacaaataatcttatttatcatttagaatgaaaaataattagctttattgcggtctgggacttatttcaagttggtagaatccatccaggaaagac

SEQ ID NO: 26623 - DNA, 201 bp, Homo sapiens
tattttttgtattttttctatattgtctctgaagccacctctgtgttttgcttttctgggagtggaagtggaggctcggttgtgaataagtacaattttgytttacttctggtacataaaattccaagacaacttagtataacaaaattcacattgaactaaaagttatgaaaagctgcttttactgtttactcactcctt

SEQ ID NO: 26624 - DNA, 201 bp, Homo sapiens
aattagcaagctatatctcattcaggccaatcagttactgctagcggaccccatggccttgtgctccccatcttaacatagtatctctgatttgtctcacyagacaaatcagagatacacttccccttttattccgtgaggaaccacaagagtctgaactgtggcatcaattttgcagttggatttacatctttcttaatg

SEQ ID NO: 26625 - DNA, 201 bp, Homo sapiens
gttatctgtcagtctgaaaatatgttactgcccatctgtgtacaaggagttgtgctagattttgataaaggattaaaaaaaggtaagtaagagagtcattrtttttaggaattttccaatttggggggaaaaatctgacacagataactatatagtatttaataattatctccatgagaggtttcttaaaaaataagaaag

SEQ ID NO: 26626 - DNA, 201 bp, Homo sapiens
ctttagtgaggaggtattcccagagtttaaactggcaagttccagaagcccacactgatcttccattagtttctagagagatcaggtgaagggacctgagmgcattcctcttttaaggcctctcaactttactttttttttttttttttttggagacaagagtcttgctctataccccaggctggagtgcagtggcctgat

SEQ ID NO: 26627 - DNA, 201 bp, Homo sapiens
cttggctcactgcccctctgcctcctgggttcaagcaattctcgtgcctcaccctccccagtagctggggattacaggtgcgtgccaccacacccagctarttgtcatatttttagtagagacggggtttcaccatgttggccaggttggtctcaaactcctgacctcaagtgatctgcccatcttgtcctccccaagtgg

SEQ ID NO: 26628 - DNA, 201 bp, Homo sapiens
tcctgggttcaagcaattctcgtgcctcaccctccccagtagctggggattacaggtgcgtgccaccacacccagctaattgtcatatttttagtagagayggggtttcaccatgttggccaggttggtctcaaactcctgacctcaagtgatctgcccatcttgtcctccccaagtgggattacaggcgtgagtcactgc

SEQ ID NO: 26629 - DNA, 201 bp, Homo sapiens
gtagctggggattacaggtgcgtgccaccacacccagctaattgtcatatttttagtagagacggggtttcaccatgttggccaggttggtctcaaactcytgacctcaagtgatctgcccatcttgtcctccccaagtgggattacaggcgtgagtcactgcacctggcctcaacttcactttggtaatatttttcttct

SEQ ID NO: 26630 - DNA, 201 bp, Homo sapiens
ttttagtagagacggggtttcaccatgttggccaggttggtctcaaactcctgacctcaagtgatctgcccatcttgtcctccccaagtgggattacaggmgtgagtcactgcacctggcctcaacttcactttggtaatatttttcttctacagagtggtctctgtaatccctgatctctctaaatgttaaatatttact

SEQ ID NO: 26631 - DNA, 201 bp, Homo sapiens; identical to SEQ ID NO: 5179

SEQ ID NO: 26632 - DNA, 201 bp, Homo sapiens
tcaatttccaagcattgactttcttgcaatgacaagtagttaaaatctctattcaggttttatttcagctgggctatttgaaatatactctgcgcatttaytattcaagtcatctagttatttggataaaatatatatgcatattatagaactgttgttttgtggctctttttctaagatatactactctcctcctcattt

SEQ ID NO: 26633 - DNA, 201 bp, Homo sapiens
cttccagggtgcttattggttctccgttagttggccaacccaaaaacagaactggagatgtctataagtgtccagttgggagaggtgaatcattaccttgygtaaagttggatctaccaggtatgtaaaattaaaaaaatctggttttaggccaggtgcggtgagtcacgcctgtaatccccacactttaagaggtcaaga

SEQ ID NO: 26634 - DNA, 201 bp, Homo sapiens
tatctcttttaaggatggttaaatattgctaaaatattttatgaaattctcattttcaatttctgatatcagaaaaacctgtatgttttctttcttatccwgtcctgtctctgtgattttagaaaaatctgatgtcagaagtccttaattatatgaatgaaccttagtagagtgaaaaggggttcatatttctttttagaa

SEQ ID NO: 26635 - DNA, 201 bp, Homo sapiens
cttggaagcagatttaaatactgaaaaatattataggtatcgaaaagaccctttttattctggcagaaatatataaatctgtgtgtgtgtgtgtgtgtgtctgtgtgtgtgtgtgtgtgtgtgtgtgtgtgtgtcttctggtgctatttctcaaaagagtttttttttttggtagattttttttggttacttttttatttc

SEQ ID NO: 26636 - DNA, 201 bp, Homo sapiens
tcttagatatgtatttcatacagattcacatatgttcttctggatgaattagaaattttaattgtgaggatcaataaagtagcgcaaccagctttcacatytgtatgaaatttaggactttgcaaaggatgttgcacaccaaaaattacaaaataattcaacgattatttgctacagttaccaaagattataatattaaca

SEQ ID NO: 26637 - DNA, 201 bp, Homo sapiens
ttatttacataagcaggtagtgggcaggatttggtctgtaggacacagtttgttgaaccctggcctagagcatgatatagagtatgcttacaaactgggcmtaattaagataactattctagaggaaaaagaatgtatatgcttagattaactcagcaattacataaacacaactgtagtacatacatctattcttttagc

SEQ ID NO: 26638 - DNA, 201 bp, Homo sapiens
aaatttcacttctgtggacctaacctagggaaaaaaatccaatatttaagaatgccaagtgaacaatgatttccattgtattattatttatgttattgggrgaaatgccattatcctaaatgcccgaaaatatgcaggtagttaagtaaatagtaaatccacttaatgaatattacacacccataaaaataaaaattataa

SEQ ID NO: 26639 - DNA, 201 bp, Homo sapiens
gaaaggtgtactcaggagttctgtcaatgtctaatcttccaatattacataaagccagccctgagtttagaacagtcacattttatttatgaaaggccttytaatcatctccttcagctgatgttcattcaattcttttgtaaccctgatatttaagagaattaggaagttttagtgacctaaggaatttgaatttcaaaa

SEQ ID NO: 26640 - DNA, 201 bp, Homo sapiens
tttactgtttttctgtgatagacaaatactgaaatttgattcagatccattacacaaatggccaagacaggatattctgtgaatttcctgggaagtatatwcaagtatcacttacctgacagcatctgagccattgtgttataaggaatttcctgcagggattgaattagttaggcttagccctcagtggttttgtaacta

SEQ ID NO: 26641 - DNA, 201 bp, Homo sapiens
cctaaacattgttttccaatccagctgtcaaacttcaagtatggaagaggaggagaaaaatcagctagcaaatatatccagatttcctgctgggcaccaartgctaagcagggtaggccaaaaacatttaatcaaaaaaacaagatccaccacggtttttactctcctaaagtaaaatataaatttggaggtgagccaaag

SEQ ID NO: 26642 - DNA, 201 bp, Homo sapiens
tttcgactctctttttcattaattatcttcccccatcacttagctaaagtgggggaaagtgccagttgtctctgtttaaatattaacaacttctgacgtttgacacttgcttttcagcgaagtagacaggaattgaatttttgttttctgatgcaatttataagctcctggtatagacctttcgacctaaaatgtagacat

SEQ ID NO: 26643 - DNA, 201 bp, Homo sapiens
acaattggctagaatcacctcaggagatggtacttggatctgggcaccctttgaatgtttttcacttatccggtaggtaaggacattagctctggactagraaatcttggatctcccacaggtgagctctgtgaccttgagcaagtaatgttacctttatgattctcaaacttagctttgtgagcttcaatttgtaaaatg

SEQ ID NO: 26644 - DNA, 201 bp, Homo sapiens
tgaaataaaaagagaatgttaaatgtctagcaaatttatggagtaaacttcgctgaaacatatgaagccttactagcgcttttggctttaagcctttgtgrgctgattaatgggtgttctaggagattattttgcctaacttttgtaattgtgattctaggtacatgcctcctccggacacaagtactccctgaaagaggc

SEQ ID NO: 26645 - DNA, 201 bp, Homo sapiens; identical to SEQ ID NO: 5196

SEQ ID NO: 26646 - DNA, 201 bp, Homo sapiens; identical to SEQ ID NO: 5198

SEQ ID NO: 26647 - DNA, 201 bp, Homo sapiens
ttctttatcctcatgaaagagccaataaataactttcagggagcatcaatttttatctttcatttcctttgccaactagctcctcttctagattgctagamgtaaaacaaatgtagatttcagtttccttgagaatttctgttgttcattgggctgttttgtttcattttgtgtcctagattggttcctactttggcagta

SEQ ID NO: 26648 - DNA, 201 bp, Homo sapiens
atttatcttattgctgcatgttctctctgcaattcaaaatcagtataatgggatttttgtatttattcctaatacatcagtaatactttttttttttttttactgtgtacaatatctagcatggaacaatgctcttttatataaatctgccattaagatggctgtttctcacaacactgtgtctgctagagactctctttg

SEQ ID NO: 26649 - DNA, 201 bp, Homo sapiens
gaaaagtgtatgtgtatgctctcaatcaggtaatggtgtctgagtttggtagaaatccaggaaaatctcttccttctcttcattttttaataataaattcyaatttttcactcactttgaaaaaacagagcaaagaagctatcaggattcattcactccaccaacccctcagttttgaaatgaccatttataattctaata

SEQ ID NO: 26650 - DNA, 201 bp, Homo sapiens
tttatagaccacaatttgtactctactgtttatagacattttgcttgtgtccagtttgagttattgttataaatgtatcatgaacactaaaaaaaaaaaawaaaaaaaaccaaagtgataatcttcaggtaacacttgcaactatggtaaaaactaatttttttatttattacagaagtgattttttattataaagtttta

SEQ ID NO: 26651 - DNA, 201 bp, Homo sapiens
gagttagagtagctaaaggtcagctcctcaagtatcaggtgaaagggttttattaactctttgcccacatttacgcttggaaaacgcataacagttagaawaaggctattgttgtagctcaaactggaggtaagagaacgtaaaataagatgtcagcagtaaaaatggaaaaggaagggccatgacagatatcaataatag

SEQ ID NO: 26652 - DNA, 201 bp, Homo sapiens
cactgcaacctccaacctcccaggatcaagcaattctcctgcctcagcctcccaagtagctgggaccacaggcgcacaccaccacacttggctaatttttwtatttttagtagagatggggtttcaccatgttggtcgggccggtcttgaactactgacctcaggggatccacctgccttgacctcccaaagtgctgggat

SEQ ID NO: 26653 - DNA, 201 bp, Homo sapiens
ttaaaagaagtttgggaaatgatacatgaaataacatttacatatgtatatataaaaactgaaagaaacatcgtaaatatgcaaacatttacacacacacrtattaactgaaagaaagatctaacatgctttttgttgttgttatttttgaattgtgatagcttgggaacttttgtttctaaaaagttttctgtatttttc

SEQ ID NO: 26654 - DNA, 201 bp, Homo sapiens
cccagcacaatgccaggccaaacagacactcaacaaacaatcattgaaaggaaggaaggaaggaagaaaataaggaaacatgaaaagaggaagaaggaagsaaaaacataagaaggaaggaagggtgagaaaaagaggactgaaaaaaagaagaggaaaagaagaggaggaaaggaagggaagagggtgggaaggcgggaa

SEQ ID NO: 26655 - DNA, 201 bp, Homo sapiens
agggacttttcagatatgatgaaattaaggatcccgagttggaagattatcctcagatatctggctggacctgatacaatcaagcattctaaaaatcagasaacctctcctggatgtggccagagggagacagaactatggaaaaatggtcagagagatgcagtgttgttggctttaaagatggaggggggccacaagcca

SEQ ID NO: 26656 - DNA, 201 bp, Homo sapiens
ctgaggcaggagaagcgcctgaacccaggaggcggaggttgcagtgagccaagatcgtgccactgcacttcagcctgggcaacaagagcaaaactctgccytaaaaaaaaaaaaaaagccagaaaatctacttgtatagtatgttaaaaattattcatgatatttgttaaagattgtaaggaagacatcactcaagaggaa

SEQ ID NO: 26657 - DNA, 201 bp, Homo sapiens
tctctgtaatccctgatctctctaaatgttaaatatttactgtggagtcaacaaacctgagaggagacatcatggagaaggagattccattacctcctacyctcataagaaaatgaaaatcaaatacagaccagggaccatgactgaaaggactctgaaagattgtggaacctttgtataatagtatccatgtttttgttg

SEQ ID NO: 26658 - DNA, 201 bp, Homo sapiens
cccttggataagggatacacatcttagactagaccccccttccaccacttcactatagggattgggtgttttcaactcagtttcctcacttatgaaacattatcatgtttctgttattataatttaaataattagagaagaaagttttaaaaagaccattaaatatatatcatagtattcttatttaagcataaggacata

SEQ ID NO: 26659 - DNA, 201 bp, Homo sapiens
catgtgattaaagttaagtatgaatataactgcaaaactgccctgagcttctcctctctgcctgtgaggtagtcctgcctggcaggagcagtcacggagcygtaaggccaccagagctgtaacgctgcagcttcaaaataaagctgttttcttccacctctggcttgcccttgaattctttcctgagcaaagccaagaacc

SEQ ID NO: 26660 - DNA, 201 bp, Homo sapiens
ccaacatctagccatcagtatgtaagtgcaacgtgcagttcatagcttgaacaattatgcaggctatgatgatgttttctaattcaaataggaaaatatcmtttcacaagcttcttattaagaaaatatgttctctcacacagttcactacattgtactaatagttgtgaatcagacagtgtgagctttgccttgtaatta

SEQ ID NO: 26661 - DNA, 201 bp, Homo sapiens; identical to SEQ ID NO: 5167

SEQ ID NO: 26662 - DNA, 201 bp, Homo sapiens
tcaatgttagccactcacagtcacaggtttaaaccgtgaagttagtgtttatttttatgaatctaaaaacaattgttcccagccatggcatgaagtcttcmtattgccccaacccacataaacacactagaaattttcattcttagggagggatagggaggctgggggctactgaatggacattttgttagttaagagctc

SEQ ID NO: 26663 - DNA, 201 bp, Homo sapiens
tgtattatgactagctacaacaggtgggggttttctttgcagtaatattttcaagtggtatcacctagcagctggattcctttgccttaacagaattggcmccctaaaagcaaaagagatggaagcactgggagtgataaactttgtcagtttagaatcaatttagatcagtttaaaaccattcaaacttgacacattcaa

SEQ ID NO: 26664 - DNA, 201 bp, Homo sapiens
aaccattcaaacttgacacattcaaaagctttcaatgctatccactaagaaatcatatttgaggaatttttttccattaaacatttagtctggcttaaatmtagtaagatgctaatcttttcgaaacttgtttttctttctttttgtaaaagtcagttgagtttaatataacaaaagggctgaataccagaggtagagaag

SEQ ID NO: 26665 - DNA, 201 bp, Homo sapiens
cttagccctcagtggttttgtaactatttcccgcattcaccttaaacaatgccttttagaagtggtttttgggtgattctttttctccaggaagagattayaaataatgaaatgattagaccattagagaatttaaatcagtagagaatgctaatttctttttttgtcatagtaacagagcaagccaacttaatcagtgcc

SEQ ID NO: 26666 - DNA, 201 bp, Homo sapiens
tggggaggacaaacatgtaagcaaatcactgttagaagtaacttgtacaaagtgtgtaaaaggacacagtggtgaaaggggtgacttttaggagaaacttyatagagcaaggaccagtaagtttacctaaaaggggaagaagaaatatggagaaattaagtgggaagatggggaggggaagtgtgctaatcacctaagaac

SEQ ID NO: 26667 - DNA, 201 bp, Homo sapiens
aagccatgacatagtccatactctttacccctgcctgtccctctaaagttaggatgtacttgggaagatatagtgtgcactcaaacagttgagaagaatgyaatactcacagacaagtttgtttcagagttccaagaaggggaagctcaatatgggctatcctggcaacaaggtaagaaaagttttgcagagagagtggaa

SEQ ID NO: 26668 - DNA, 201 bp, Homo sapiens
ggacccaggaggcggaggttgcagtgggccaaggtcatgccactgcactccagtctggcaacagagcgagactccgtctcaaaaaataaaaataaaaaaakaaaataaaaaaataaagttgtaatctaacacaatcccaagtacaaaatctcatactatgtaattaagtcctttgattgctagcagccagagtttttggat

SEQ ID NO: 26669 - DNA, 201 bp, Homo sapiens
aatcgcttggacccaggaggcggaggttgcagtgggccaaggtcatgccactgcactccagtctggcaacagagcgagactccgtctcaaaaaataaaaayaaaaaaataaaataaaaaaataaagttgtaatctaacacaatcccaagtacaaaatctcatactatgtaattaagtcctttgattgctagcagccagagt

SEQ ID NO: 26670 - DNA, 201 bp, Homo sapiens
tatcctgaattgcagtcatagatgtgtctttatccactttattatttttgtgtaattagttggctgtatcctatcttgttcccaaagggtcttttggtcayctttattccaaatatagtagctctctcagaataggtggtaaaggatattgggtgaaagataaactcacagaacaaggctaacctggacatgaattgagca

SEQ ID NO: 26671 - DNA, 201 bp, Homo sapiens
tttttttaaatccattcatccattgatccatacttaaggttaattctatatcttgtctattgtaaacagtgctgcaataaacaggggagtgcagatatttmttcaatatactatttcctttctttgggatatatacccagcaatgttttttttttcttttttttttttcattttaaatacacacctcctgtagtaaccact

SEQ ID NO: 26672 - DNA, 201 bp, Homo sapiens
gaaaaaggaaaatacatgcatataatgtttacttatgtcataaagagcgcttagcataagcaatgcaaaatgcaaagttgttccttacatagaatagccaacatttcactaaaacctaaaaaatttgagtatggtttatgttggaaaagtacatatgattcctaaatttatgtgttaaaattttataatgagttttatttt

SEQ ID NO: 26673 - DNA, 201 bp, Homo sapiens
aaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcacaatcttggctcactgcaacctctgtctcccaggttcaagcggtgcccct

SEQ ID NO: 26674 - DNA, 201 bp, Homo sapiens
ttcagctcacacatttgagtgagaacgtagtgatatttgtccttcagtgcttggcttatttcatttaatataatgttcttcagttccatccatgttgctgsaaatgacaaagttttgttctttttaatggataaataatattctgttgtgaagatataccatgtttttttaaatccattcatccattgatccatacttaag

SEQ ID NO: 26675 - DNA, 201 bp, Homo sapiens
ctcaaacgaggcacaattctggtaaattaagacaagtgctatttttaccttttgctttccaaatgaataaaattgatatcaatctagaaataaccatctgragaatttaaatatagatatttgataaaacggcaagaatactgatatgtatctctggacatttaaacaggactgcaatacatgtaaatttgctaccatcac

SEQ ID NO: 26676 - DNA, 201 bp, Homo sapiens; identical to SEQ ID NO: 5218

SEQ ID NO: 26677 - DNA, 201 bp, Homo sapiens
caaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcacaatcttggctcactgcaacctctgtctcccaggttcaagcggtgcccc

SEQ ID NO: 26678 - DNA, 201 bp, Homo sapiens
tctttccagcctttgataaccaccattctattcagtatgtctatgagatccacattttcagctcacacatttgagtgagaacgtagtgatatttgtccttyagtgcttggcttatttcatttaatataatgttcttcagttccatccatgttgctggaaatgacaaagttttgttctttttaatggataaataatattctg

SEQ ID NO: 26679 - DNA, 201 bp, Homo sapiens
acaaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcacaatcttggctcactgcaacctctgtctcccaggttcaagcggtgccc

SEQ ID NO: 26680 - DNA, 201 bp, Homo sapiens
aactaacccctcttcatccctgctcttccccactactctttccagcctttgataaccaccattctattcagtatgtctatgagatccacattttcagctcmcacatttgagtgagaacgtagtgatatttgtccttcagtgcttggcttatttcatttaatataatgttcttcagttccatccatgttgctggaaatgaca

SEQ ID NO: 26681 - DNA, 201 bp, Homo sapiens
gatgactgtgacggcctttagtttgcatttttagactgcttaatttgggtcaatgtttctcaaagttatctccagtggtctaaactgttaaatctgttccraagtctaggaacctatgtcagtcaaaaaagtatgtttttagacagctctcctcaccccattccgtgtgaagatggccccactgatattcataaaaaataa

SEQ ID NO: 26682 - DNA, 201 bp, Homo sapiens
aacaaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcacaatcttggctcactgcaacctctgtctcccaggttcaagcggtgcc

SEQ ID NO: 26683 - DNA, 201 bp, Homo sapiens
ccatctaattatagttttaaatccattaactaacccctcttcatccctgctcttccccactactctttccagcctttgataaccaccattctattcagtaygtctatgagatccacattttcagctcacacatttgagtgagaacgtagtgatatttgtccttcagtgcttggcttatttcatttaatataatgttcttca

SEQ ID NO: 26684 - DNA, 201 bp, Homo sapiens
gtccccacaactattcagccttaacattttcttacttcattccactgtaatcatttatttagtatagaatttattaggaatctaaatgcctttaaaattaygctagtatttttatttgagttgtttcgactttatgttttagctaaaaaggtgtatggactttgagttgactgccccaactctgtttttatcataagctgt

SEQ ID NO: 26685 - DNA, 201 bp, Homo sapiens
tccttccagactcaccaatcagttagtgtgaaggaagggcaggttgagaaatagccgagaagtattacaaccggtgaggcactcaccccatggaaggaaaygtcagaagtggaaagttagcatttccctctaaaaacatataaagttaaagccatgtttttattcccttttagaccctattttttcctccccttctcccat

SEQ ID NO: 26686 - DNA, 201 bp, Homo sapiens
gtcgggccggtcttgaactactgacctcaggggatccacctgccttgacctcccaaagtgctgggattacaggcgtgagccaccgtgcccagcccactatscatttaatgatacaaataaacaagtctttcgtagattataaacagcagcactttaaacagtaattttagttcttttctaactttctataagtgaaaaatc

SEQ ID NO: 26687 - DNA, 201 bp, Homo sapiens
taagctgtatgatttttatgtgtgattttgtagaaaacacaagattgcttttaggaatgaatatatcacattataatagaaatatctgttttcttgcaacwtaaattgcatatattttatgaatggaagaatgtcaacaacaaaattggcaatgggactatttgagaatttgccatgtggaggccgtttcctgacctttta

SEQ ID NO: 26688 - DNA, 201 bp, Homo sapiens
tctcaaactcctggccttaagtgatccacccacctcagtctcccaaagtgctgggattgcaggtgtgagccatggcacctatccaaatcattttaaatggygatgattatgtccaataagtccatcttattctcttgggcatctcaaccttttcctgccttaggaaaatggaggtcctctaactcctaagatcttgtcaca

SEQ ID NO: 26689 - DNA, 201 bp, Homo sapiens
ctgccttctctctagtaaggaacattcaaaagccactgcactgccttcaagactcactttctcacattaacattgagtgtacattatagtatttcagttgytgctctaaactactatccatttttttttttaaatggagtctcgctctgtcacccaggctggagtgaagtggcacgatctcggctcactgcaacctccaac

SEQ ID NO: 26690 - DNA, 201 bp, Homo sapiens
ctgtaggtttctaccatgactcttctctcccttctcttgccccctcttgggaaagactgatattgcagagaaccctaatactttaccattcccacatttcygagatcctttgttccattgaggtgaccctagtttccgagagtcagacttgttctgtgtgtgtgttctcaggtgcatcaggtcagcctgtgcttcctcttc

SEQ ID NO: 26691 - DNA, 201 bp, Homo sapiens
tcctttaaaaagcaaactggataaatagtacttcagaattctatatattatttgttacaactgcatgtaaacctataattacctcaaaatgaaaagtttartttttaaacaaagcctattattgtatgattaaggtggataattgagctgcttcttatttttattatagtaaaatatacataaaataaaatgtattatttt

SEQ ID NO: 26692 - DNA, 201 bp, Homo sapiens
cttttcttgggcctctctattgcctgaggcacaaaagtattgaaattagtctaaaataggcagggcacagtggctcatgcccgtaatcccagcactttggraggccaacacaggcagatcacaaggtcaggagatcgagaccattctggtcaacatggtgaaaccccgtctctactgaaaatgcaaaaattagctgggcgt

SEQ ID NO: 26693 - DNA, 201 bp, Homo sapiens
cttcatcagcctcaacctcaccttctgtgtctgcgtgtccatcgctgctgtcctgcccaaggtccaggtgagcctgcctgtccccccctggcctgaagccyggccccttagtgggtgggacttcttgtaggaacctgggtcctggggctagggctgtcatcacagaggcacggcctgagtgtgtgggctcccaggtcagcc

SEQ ID NO: 26694 - DNA, 201 bp, Homo sapiens
gctctgcgtgagcagcagccgggacccccgggctgccatccagaatgggtgagagaggggtccctgcctgcaccctgggaccttcccccagtgccttgccygctcctctgcctgtccagggatctgcagaccctacccaccactcaggagccacgggagggcacagcatggagaacagctctgagttatatccatttctca

SEQ ID NO: 26695 - DNA, 201 bp, Homo sapiens
tgtggaggtgcagcaagtaggagagggttacctgcaaaatataactcctctcctaactctggtttccaaaagcctgggttcactgaggagctcctgggtartgagggatggggcagtgatggaggcagcacaggggcttcctggagggagaggagagagtgaggcacagctggagacctcgagagagagaagcatagtctc

SEQ ID NO: 26696 - DNA, 201 bp, Homo sapiens
tttaccagtaggataaattatgacaaaatagttttttgaaggttttgggcctccttcccccttttgggggaagtttgtggaggtgcagcaagtaggagagrgttacctgcaaaatataactcctctcctaactctggtttccaaaagcctgggttcactgaggagctcctgggtaatgagggatggggcagtgatggaggc

SEQ ID NO: 26697 - DNA, 201 bp, Homo sapiens
tttggttctttaagttcctgatcctggtgggcctcaccgtgggtgccttctacattcctgacggctccttcaccaacagtaggcggacttggcaggaggcmtggggggctgtggggagggaagtggggcggcaggttggaggaacgtggtggggctgctctttgctggggcacacagacccctggctgctggctaggtcct

SEQ ID NO: 26698 - DNA, 201 bp, Homo sapiens
gctgctggctaggtcctcgctccccacccgtgagacagcactgtggtgcttggccacacggcctttgtgcaacccaggggtagggggagctgtcttgcccygacccatatcctgccctctgtgcgtagctaggggctccctgagggcagggactctgttcttctcagtgtccccggtgcagggtgtagcagaaaacgcttg

SEQ ID NO: 26699 - DNA, 201 bp, Homo sapiens
ccaggggtagggggagctgtcttgccccgacccatatcctgccctctgtgcgtagctaggggctccctgagggcagggactctgttcttctcagtgtcccyggtgcagggtgtagcagaaaacgcttgttgaacgagtagatgtgagagagggaccctcctcgcctcactcccctctccccacccagtctggttctacttc

SEQ ID NO: 26700 - DNA, 201 bp, Homo sapiens
ggaccctcctcgcctcactcccctctccccacccagtctggttctacttcggcgtcgtgggctccttcctcttcatcctcatccagctggtgctgctcatygactttgcgcactcctggaaccagcggtggctgggcaaggccgaggagtgcgattcccgtgcctggtacgcaggtcagtgctgccaccctgcctccgtgt

SEQ ID NO: 26701 - DNA, 201 bp, Homo sapiens
agcattccatggagtgaaagggccacggctgtccccaggtgttagacatttaggttatttgtagtttcttgagactccaataggctcacaaaacctaaagyttatttaagttttttctttatataaaaatctttatttttatatttgtaaatttaacttaattgaagtattatttgtatacaatgaaatgtacccaagtta

SEQ ID NO: 26702 - DNA, 201 bp, Homo sapiens
tgattcttgtgcttcagcctcccaagtaaccagtgagctgctcacctcagcctcccaaagtgctgggattacaggcatgagccaccacacccagcctaaarttttttttgtttttgtttttttgagacagaatcttgctctgtcacttaggctggagtgcagtggtatgatctcagcttactgcaaccaaccttcgcctcc

SEQ ID NO: 26703 - DNA, 201 bp, Homo sapiens
gcaatagtttctgaggctgtgggaaataaacaataacaagatgtaactggggagctccctcccagggcttcaggcccagagagggctaggaatggaggcggaggcagtggagatagaggtgaggggctcccctccctgtctggtccagcccctgctgggagagcctctttcctggccggccttgggagaccagggctctgg

SEQ ID NO: 26704 - DNA, 201 bp, Homo sapiens
catgggagaggggccacagaatctctgttttcccaagcatctcagatggttctgatgtaggtggtgggtggagaacactttgggaaccactgctttagacrgcgcaatagtttctgaggctgtgggaaataaacaataacaagatgtaactggggagctccctcccagggcttcaggcccagagagggctaggaatggagg

SEQ ID NO: 26705 - DNA, 201 bp, Homo sapiens
agcatctcagatggttctgatgtaggtggtgggtggagaacactttgggaaccactgctttagacagcgcaatagtttctgaggctgtgggaaataaacartaacaagatgtaactggggagctccctcccagggcttcaggcccagagagggctaggaatggaggcggaggcagtggagatagaggtgaggggctcccct

SEQ ID NO: 26706 - DNA, 201 bp, Homo sapiens
cctgcactcagcttccttgtccattccccgaccccttctgtaggttttggttctttaagttcctgatcctggtgggcctcaccgtgggtgccttctacatycctgacggctccttcaccaacagtaggcggacttggcaggaggcatggggggctgtggggagggaagtggggcggcaggttggaggaacgtggtggggct

SEQ ID NO: 26707 - DNA, 201 bp, Homo sapiens
tgaggtgattttgggtaatattgcaatgtggaacatgaaagagggtgtgggctgaaaggtgggtggctggcaggtgcagggctgccgtagttcaggttccyagggctccgcaggagtcctgtctgaatactgaagaggcgctgcctgtgcggagatgctgggaaggaacttgtcagagggagggcacagcgacggcaaagg

SEQ ID NO: 26708 - DNA, 201 bp, Homo sapiens
ggttctgtgaggggtggggctttgacgctgctctgtctgtctccacagctgccctgggtgtgtgaggagggggccgggatccccaccgtcctgcagggccrcatcgactgtggctccctgcttggctaccgcgctgtctaccgcatgtgcttcgccacggcggccttcttcttctttttcaccctgctcatgctctgcgtg

SEQ ID NO: 26709 - DNA, 201 bp, Homo sapiens
tgctggccggatgacgccgcttggcctgagcgtgtccaagcctcagatgacagagttcctggtcccttatgctgccctggggctggtggctgcccttcctsgatcctaagacatcctcctcacctcagagtggtgctggcctcagcggggcttggaggaggctgagctctctgtgtgggcactcacatgggtgtcagcctg

SEQ ID NO: 26710 - DNA, 201 bp, Homo sapiens
ggatagaagtcatgaggtctggggctgggattgtggtcatttagtgtcacaaatttggtcatttggttaaagttaaaattgagagtaggaggtcataaagmcaggattgaagtggcaaggtcaaggagctaaatgacagtaataaggtcaggggccacccctaagttacaggatcaaaggtcagaatcaagggtagcggtc

SEQ ID NO: 26711 - DNA, 201 bp, Homo sapiens
ggacctgacagggcacctgggcacctggctcctgagatcagtacccactggcctcccttggttttctggtattgggttttttgttgtttgtttgtttgttttttcatcactgggatgtatttaaattaaataagatgaccatcagtgaattagcgagctggaactagtgtagtcctgtaggcagagcctggcccttggtgc

SEQ ID NO: 26712 - DNA, 201 bp, Homo sapiens
ccctgtctctactaaaaatacaaaaaattagctgggcatggtggcgggtgcctgtagtcccagcttcttgggaggctaaggcaggagaatggcgtgaacaygggggacggagcttgcagtgagctgagattttgccactgcactccagcctgggcgacagagcgagactgtctcaaaagaaaaaaaatattagccaggcgt

SEQ ID NO: 26713 - DNA, 201 bp, Homo sapiens
aggacctgacagggcacctgggcacctggctcctgagatcagtacccactggcctcccttggttttctggtattgggttttttgttgtttgtttgtttgttttttcatcactgggatgtatttaaattaaataagatgaccatcagtgaattagcgagctggaactagtgtagtcctgtaggcagagcctggcccttggtg

SEQ ID NO: 26714 - DNA, 201 bp, Homo sapiens
caggacctgacagggcacctgggcacctggctcctgagatcagtacccactggcctcccttggttttctggtattgggttttttgttgtttgtttgtttgttttttcatcactgggatgtatttaaattaaataagatgaccatcagtgaattagcgagctggaactagtgtagtcctgtaggcagagcctggcccttggt

SEQ ID NO: 26715 - DNA, 201 bp, Homo sapiens
gagcggggctgctggagagagcggggaactcccaccacagtggggcatccggcactgaagccctggtgttcctggtcacgtcccccaggggaccctgcccbcttcctggacttcgtgccttactgagtctctaagactttttctaataaacaagccagtgcgtgtaccatgttctgtgcccctcaccctcagcacggagcc

SEQ ID NO: 26716 - DNA, 201 bp, Homo sapiens
tcaggacctgacagggcacctgggcacctggctcctgagatcagtacccactggcctcccttggttttctggtattgggttttttgttgtttgtttgtttgttttttcatcactgggatgtatttaaattaaataagatgaccatcagtgaattagcgagctggaactagtgtagtcctgtaggcagagcctggcccttgg

SEQ ID NO: 26717 - DNA, 201 bp, Homo sapiens
atcaggacctgacagggcacctgggcacctggctcctgagatcagtacccactggcctcccttggttttctggtattgggttttttgttgtttgtttgttkgttttttcatcactgggatgtatttaaattaaataagatgaccatcagtgaattagcgagctggaactagtgtagtcctgtaggcagagcctggcccttg

SEQ ID NO: 26718 - DNA, 201 bp, Homo sapiens
tccctgtctggtccagcccctgctgggagagcctctttcctggccggccttgggagaccagggctctggtttataaagggagctgccagggttctgtgagrggtggggctttgacgctgctctgtctgtctccacagctgccctgggtgtgtgaggagggggccgggatccccaccgtcctgcagggccacatcgactgtg

SEQ ID NO: 26719 - DNA, 201 bp, Homo sapiens
aaattaaatggtaacaagccagcatcaggacctgacagggcacctgggcacctggctcctgagatcagtacccactggcctcccttggttttctggtattrggttttttgttgtttgtttgtttgttttttcatcactgggatgtatttaaattaaataagatgaccatcagtgaattagcgagctggaactagtgtagtc

SEQ ID NO: 26720 - DNA, 201 bp, Homo sapiens
tcccgcgtagctgggactataggcacacaccaccatgcccagctaatttttttgtatttttagtagagatagggtttcaccatgttggccaggctggtctygaacccctgacctcaggtgatccgcccgccttggcctcccaaagtgcaggggttacaggcatgagcctccgcacctggcctcattcctttttaagaacaa

SEQ ID NO: 26721 - DNA, 201 bp, Homo sapiens
tccatgtggctctgtagccagggaattcatctttctggctctgtagcattccatggagtgaaagggccacggctgtccccaggtgttagacatttaggttwtttgtagtttcttgagactccaataggctcacaaaacctaaagcttatttaagttttttctttatataaaaatctttatttttatatttgtaaatttaac

SEQ ID NO: 26722 - DNA, 201 bp, Homo sapiens
cccgccaccacacccagctaatttttgtatttttagtagagacagggtcttgcgatgttggccaggctggtcttgaacttctgacttcaaaccatctgccygcctcagcctcccaaagcgctgggattacaggcatgagccgccatgcctagctgcctgtgctcttaatcacagagttcaggttcatgtttttatgtgcat

SEQ ID NO: 26723 - DNA, 201 bp, Homo sapiens
gcaggtgcagggctgccgtagttcaggttcccagggctccgcaggagtcctgtctgaatactgaagaggcgctgcctgtgcggagatgctgggaaggaacytgtcagagggagggcacagcgacggcaaaggccttgtggtgggagaggctgggcagactctccagacggagagcagggaggagggggacagtgggccagg

SEQ ID NO: 26724 - DNA, 201 bp, Homo sapiens
acccagtggtgggatgccccgagcattgtgggcctcatcatcttcctcctgtgcaccctcttcatcaggtatggccaggtctggattctggggaaggatcrtgattgagggccctgagccagagtgaggggagggtgtgggagccaggataccaaactggaacgtgctcttcacattcaatatatccaggtcttgcattgt

SEQ ID NO: 26725 - DNA, 201 bp, Homo sapiens
agtggctcacgcctgtaatcccagcactttgggaggctgaggtgggcagattgcttgagcccaggagtttgagaccagtctgggcaacgtggtgaaactcygtctctacaaaaaatacaaaaattaaccaggcatggtggcgtgtgcttgtagtcccagctactcaggaggctgaggtgggaggatggcttgagcccagga

SEQ ID NO: 26726 - DNA, 201 bp, Homo sapiens
gggctgccgtagttcaggttcccagggctccgcaggagtcctgtctgaatactgaagaggcgctgcctgtgcggagatgctgggaaggaacttgtcagagsgagggcacagcgacggcaaaggccttgtggtgggagaggctgggcagactctccagacggagagcagggaggagggggacagtgggccaggtggagatga

SEQ ID NO: 26727 - DNA, 201 bp, Homo sapiens
ggagatgaaggaattcagtgtgatgagatggggtttcagcaggggaggagggcaagtaatctgaggggtgttaagagaaagaagaattaggactcagcctktggttagtgaggtgggtggtaggtggcctgcttggtgttttccctaagtggggtgtggtggggtatcctaggtgggtgggagtttctgaggtcccttggc

SEQ ID NO: 26728 - DNA, 201 bp, Homo sapiens
cagggccacttggctacctaggcctggcctgcatgggctgagggtgattgtgctcccatctccagaacagaaatgcaacccccatttgccaacccagctgrgcaacgagacagttgtggcaggccccgagggctatgagacccagtggtgggatgccccgagcattgtgggcctcatcatcttcctcctgtgcaccctctt

SEQ ID NO: 26729 - DNA, 201 bp, Homo sapiens
ggctgccacgagggcaaggtcttcatcagcctcaacctcaccttctgtgtctgcgtgtccatcgctgctgtcctgcccaaggtccaggtgagcctgcctgwccccccctggcctgaagcccggccccttagtgggtgggacttcttgtaggaacctgggtcctggggctagggctgtcatcacagaggcacggcctgagtg

SEQ ID NO: 26730 - DNA, 201 bp, Homo sapiens
ggactgggctcccaggagggtgagtctccttttcaggtgtggcatagtgtgtcatcaccagcccctgaatgatttcagccaggccaggggaagggctgacsgcaactggggcagaggaccctggagagggaaagggttagaccgccacctgctgtctagtgctggtatagcctcagagccgaaaatcattccgtttatcca

SEQ ID NO: 26731 - DNA, 201 bp, Homo sapiens
cctcttagtgcttaagcccaggttggggctcctaactcttcccttcatctcagtgttttacagcctagcacagacccagggggacgtgggcatcaccgtakgtgccttatacacattttagtgtgtataaagatgagattccctggggagtttgtagaaatgcagattctcagactccaccttgaggctctattccatggg

SEQ ID NO: 26732 - DNA, 201 bp, Homo sapiens
actgaagccctggtgttcctggtcacgtcccccaggggaccctgcccacttcctggacttcgtgccttactgagtctctaagactttttctaataaacaarccagtgcgtgtaccatgttctgtgcccctcaccctcagcacggagccccactgcatgggggccggtgtggggtttgggaatagaatgttagggctgagga

SEQ ID NO: 26733 - DNA, 201 bp, Homo sapiens
gtaccactgcactctagcttgggtgacagaacgagatcctgtctcaaaaatttttccccctattattttcctattatgatcagtgccacaatgaatttccrtgtgtttgtatatatgtgcacacatctgcccttactccaatggtctggcatttctgtaggaagagatttaaatatatataaaatgacattttggtcaaat

SEQ ID NO: 26734 - DNA, 201 bp, Homo sapiens
tcaagactacatgcaaggaagtgctgaagccagtgagacccagggctgcctaactatagagcctgggctcggagcccctgtactctcctaccccaggagaycattttacagatgaggaaactgagtcccatggaggggaggagagacttgcctgaggtcagattacaagctgtggcagagccagcattaggacctgcattc

SEQ ID NO: 26735 - DNA, 201 bp, Homo sapiens
gatggactggagttacagggtaagagccagagttgaagtcaggggtcataactgggacataaggccaggggccaagatggaagtcaccagactgggcaccrggctcatggggaagatggtgtgttccaggcccggtgagacccggaagatgatcagcacgtggaccgccgtgtgggtgaagatctgtgccagctgggcagg

SEQ ID NO: 26736 - DNA, 201 bp, Homo sapiens; identical to SEQ ID NO: 5223

SEQ ID NO: 26737 - DNA, 201 bp, Homo sapiens
cctgggtgtgtgaggagggggccgggatccccaccgtcctgcagggccacatcgactgtggctccctgcttggctaccgcgctgtctaccgcatgtgcttygccacggcggccttcttcttctttttcaccctgctcatgctctgcgtgagcagcagccgggacccccgggctgccatccagaatgggtgagagaggggtc

SEQ ID NO: 26738 - DNA, 201 bp, Homo sapiens
tccatttctcagatgaagagtaaggctcagaaagggtggcagcaagcctcaggccccgcagcacttcagtgacacagctggggctggacctgggtgaccaycctcaccactgcttggtccttcctcctgccccttagggttttttccagggccaggagagactttctgtgcctatcagaccaccagaaagcccaccctcac

SEQ ID NO: 26739 - DNA, 201 bp, Homo sapiens
tgcacttgctgttttctgaggtcttaacatgtgactggtactatgccaaacacttcatattccttcaacagatagcctgtaagctcctgctgtgtgacagrcactgttcgaatttctaggaataccacaatgaacaaaacgcaaaaattcctgccccgctggaaagcggaggccgacaaaacataaagcctcgctgatggc

SEQ ID NO: 26740 - DNA, 201 bp, Homo sapiens
cctgcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacg

SEQ ID NO: 26741 - DNA, 201 bp, Homo sapiens
ccctgcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcac

SEQ ID NO: 26742 - DNA, 201 bp, Homo sapiens
tgcagggtgtagcagaaaacgcttgttgaacgagtagatgtgagagagggaccctcctcgcctcactcccctctccccacccagtctggttctacttcggygtcgtgggctccttcctcttcatcctcatccagctggtgctgctcatcgactttgcgcactcctggaaccagcggtggctgggcaaggccgaggagtgcg

SEQ ID NO: 26743 - DNA, 201 bp, Homo sapiens
cccctgcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgca

SEQ ID NO: 26744 - DNA, 201 bp, Homo sapiens
gaggtctctgaggagcaaggggcccctgccagcctgctcttttcaaagctcatctttcaattcctgacccttggctccagcccctcgagtgggtgcccacygctcttaggatgaaaaccagtgtcctgttcctgactgctggtgcctatgtggtctggccttgccagcctgtctgacctcatactcaccgctgactgtctg

SEQ ID NO: 26745 - DNA, 201 bp, Homo sapiens
accctgtctctactaaaaatacaaaaaattagctgggcatggtggcgggtgcctgtagtcccagcttcttgggaggctaaggcaggagaatggcgtgaacmcgggggacggagcttgcagtgagctgagattttgccactgcactccagcctgggcgacagagcgagactgtctcaaaagaaaaaaaatattagccaggcg

SEQ ID NO: 26746 - DNA, 201 bp, Homo sapiens
gtgaggagggggccgggatccccaccgtcctgcagggccacatcgactgtggctccctgcttggctaccgcgctgtctaccgcatgtgcttcgccacggcrgccttcttcttctttttcaccctgctcatgctctgcgtgagcagcagccgggacccccgggctgccatccagaatgggtgagagaggggtccctgcctgc

SEQ ID NO: 26747 - DNA, 201 bp, Homo sapiens
ccagaagttgctggacaggtggactgtttcaatttagaccatgaggaatagtttcgtttccaaagcattttgtttagcatctgtgtgaacgagagataggygaggagcatttctagtttgggggagagtaagaggggaggcagatgcccgccagcagggtgtgctgtgtgccttgtgaccagtccagaaagaaaagcagag

SEQ ID NO: 26748 - DNA, 201 bp, Homo sapiens
gcctatcagaccaccagaaagcccaccctcacccctctcagcacctgctgtttgtgggtgggggctctggggccaggcccagtctggcttccagtttcccygcctgcactcagcttccttgtccattccccgaccccttctgtaggttttggttctttaagttcctgatcctggtgggcctcaccgtgggtgccttctaca

SEQ ID NO: 26749 - DNA, 201 bp, Homo sapiens
acccctctcagcacctgctgtttgtgggtgggggctctggggccaggcccagtctggcttccagtttccctgcctgcactcagcttccttgtccattcccygaccccttctgtaggttttggttctttaagttcctgatcctggtgggcctcaccgtgggtgccttctacattcctgacggctccttcaccaacagtaggc

SEQ ID NO: 26750 - DNA, 201 bp, Homo sapiens
ccttgtcctcaggctccacgggagcggggctgctggagagagcggggaactcccaccacagtggggcatccggcactgaagccctggtgttcctggtcacktcccccaggggaccctgcccacttcctggacttcgtgccttactgagtctctaagactttttctaataaacaagccagtgcgtgtaccatgttctgtgcc

SEQ ID NO: 26751 - DNA, 201 bp, Homo sapiens
ccacccctcttcatgtcaccgacgcttcctcagtatccacaggtcacgccacctctcttcctgtcaccagcctttcctcagcatccacaggtgacaccacscctcttcctgtcactagcccttcctcagcatccacaggtcacaccacccctcttcctgtcaccgacgcttcctcagtatccacaggtcacgccacccctc

SEQ ID NO: 26752 - DNA, 201 bp, Homo sapiens
aattgtgaataggagttcattcatgatttagctctctgcttgcctattttggttcactccaggaaccacagaggacacattaataactggaagtaaaactsctgccccagtcacctcaacaggctcaacaacagcgacactagagggacaatcaactgcagcttcttcaaggacctctaatcaggacatatcagcttcatc

SEQ ID NO: 26753 - DNA, 201 bp, Homo sapiens
gcaattcgagctaaggagacagcagcagcaaccctccctcctggccctcagagctgaggatcaacccacaggggtgcggtggaggctgagagcaggggtgyggtggaggctgagagcaggggtgcggaacccgagtcagcaggggcagtgaggaggctgccgcagtagtcaaagcgacggggaggatgtggcaaagcaaac

SEQ ID NO: 26754 - DNA, 201 bp, Homo sapiens
caggcaggaggatgtggcacctggtaaggagaaggaggccgggctgggcaggaggatgtggcacctggtaaggagaaggaggccgggccgggcaggaggawgtggcacctggtaagaagaaggaggctgggccaggcaggaggatgtggcacctggtaaggagaaggaggccgggctgggcaggaggatgtggcacctggt

SEQ ID NO: 26755 - DNA, 201 bp, Homo sapiens
ttacacaggtatatatgtgccatggtggtttactgcacctatcaacccatcacctgcatgtattagctatttatcctgacgctcttcctccccttgtcccrtccctgacaggcgccagtgtgtgttgttcccctctctgtgtccatgtgttctcattgttcaactccaacttatgagtgaaaacatgcagtgtttggtttt

SEQ ID NO: 26756 - DNA, 201 bp, Homo sapiens
tgtgtacagacggtgagaagagggagggagtgtgtacagatcgtgagaaaagggaggggcgtgaagtctatttttaggctgaggaaaacggcctttgcagytgcctcaaggttgtatttggaaacccaagagaaaggggaaaacatgtttaaaatgcattttgaatttaagctgccggctacaaaactgaacaatgtctcc

SEQ ID NO: 26757 - DNA, 201 bp, Homo sapiens
aaaagataaagataaagaaacaggcaacgtcaccctctctccagcctcggctgaaggcaacaaaggccacagggcctgggatgtattccacagatgtgtaygaagtcactgctgtatgccaagtctcgtttcaggctctggagatcacaagagatcagttattccaagggtatcttgagttagtgtctttcctcatcttga

SEQ ID NO: 26758 - DNA, 201 bp, Homo sapiens
tctaggacacagcactggatgcacacagtgaagagtgaaacagacgtggcccagtctcttggcactaaaatcttggtgcagacagacatcaaataattacrgaaatgttctcaactgcacatgtggtaaatgcagtgtggaaaagtacagggtgtgctgagagctgcatttcgaatggccagagagtaggggaggtgcatc

SEQ ID NO: 26759 - DNA, 201 bp, Homo sapiens
taaatgccttttcacccttttcctggagattctgaagaagtctcaggaactgggcatttgtgttgcacgtgaggccttgcaatggcggccctgcttggagraagggcactggcctgggttgcccgcagctccactccccgtgtatgtgtttagggaccacagaggacagacatcgactctctgtagagatgccgccccgcc

SEQ ID NO: 26760 - DNA, 201 bp, Homo sapiens
ttaatttttgtataaggtgtaaggaaggggtccagtttcagttttctgcatatggctaaccagttttcccagcaccatttattgaatagagaatcctttcmccattgcctgcttttgtcaggtttgtcaaagatcagatggttgtagatgtgtggtcttatttccaaggtatctattctgttccattggtttatatgtcag

SEQ ID NO: 26761 - DNA, 201 bp, Homo sapiens
ggaaaagcacgggggcgtgacccggagaaggagtgaaggactgttggtgtgcaagggcgtctccatgacgacccgaagaagctaggcatgtcgtggagcgctgagtcctttgcgtcgctaaggggaccaagtggagctgggccaggagaggagatggtcgtggctgggagatggcacccacacatctgaccgggcatgacc

SEQ ID NO: 26762 - DNA, 201 bp, Homo sapiens
agaggagcgcagaggggcaagacctggggtgggcgtggaaaagcacgggggcgtgacccggagaaggagtgaaggactgttggtgtgcaagggcgtctccrtgacgacccgaagaagctaggcatgtcgtggagcgctgagtcctttgcgtcgctaaggggaccaagtggagctgggccaggagaggagatggtcgtggct

SEQ ID NO: 26763 - DNA, 201 bp, Homo sapiens
ctgcagatgtggttgaaggagtctccacgggaatcatgactcccagagcgaggctggggcttggggcgccggggaggcagcttggatttaggagccccagkgccaagtctttgccgtgaactgttctggcccctgtgaccaggccctgccccgtgtctccccagggccccggtcccctgtgtaaaaagcagtggtgaacgg

SEQ ID NO: 26764 - DNA, 201 bp, Homo sapiens
cttacctctgagctcgggtttaaaagcctccatttgggtcacggccttgcctggggctcgtagccccggcattggccttgggctcctccgtgtacagagcygggaggggagggatgccaggcctgtgggagatgttccctcgggggcccccgtcctcttccccacactttccaggctgtccctctggcttcaggaccaagt

SEQ ID NO: 26765 - DNA, 201 bp, Homo sapiens
agcactgggattcaggcatgaatcaccacacccagctggaatgcaattatttttaaaattttgattatggatatagaactttgctaataatgtatatgttygggaagtttctatgtaaacaattatgttatctgcaaataaccataggcttgtttcatcccttccatacccaaaatcacatttctgtactctcatactttt

SEQ ID NO: 26766 - DNA, 201 bp, Homo sapiens
ctttcaccattgcctgcttttgtcaggtttgtcaaagatcagatggttgtagatgtgtggtcttatttccaaggtatctattctgttccattggtttataygtcagttttggtaccagtaccatgctgttttggttactgtagccttgtagtatagtttgaagtcaggtagcctcccactttgttctttttgcttaggatt

SEQ ID NO: 26767 - DNA, 201 bp, Homo sapiens
cgcagtagtcaaagcgacggggaggatgtggcaaagcaaacaagaggacgcgatggggtgaacacttgggaggaagatcaacgagtactgactaggacacrggggacaaggaagagaaagaaatccagaggacccacagctttctgggctggatgtctgggggactgttgttagcatgaacagaaggaaggaagaaagctt

SEQ ID NO: 26768 - DNA, 201 bp, Homo sapiens
gcttcctcagtgtccacaggtcacgccacctctcttcttgtcaccgacgcttcctcagtatccacaggtgacaccacccctcttcctgtcaccgacactamctcagcatccacaggtgacaccacccctcttcatgtcaccgacgcttcctcagtatccacaggtcacgccacctctcttcctgtcaccagcctttcctca

SEQ ID NO: 26769 - DNA, 201 bp, Homo sapiens
aggcagggcaggccattttccaaagcaattcgagctaaggagacagcagcagcaaccctccctcctggccctcagagctgaggatcaacccacaggggtgyggtggaggctgagagcaggggtgtggtggaggctgagagcaggggtgcggaacccgagtcagcaggggcagtgaggaggctgccgcagtagtcaaagcga

SEQ ID NO: 26770 - DNA, 201 bp, Homo sapiens
cgcttcctcagtgtccacaggtcacgccacctctcttcttgtcaccgacgcttcctcagtatccacaggtgacaccacccctcttcctgtcaccgacactwactcagcatccacaggtgacaccacccctcttcatgtcaccgacgcttcctcagtatccacaggtcacgccacctctcttcctgtcaccagcctttcctc

SEQ ID NO: 26771 - DNA, 201 bp, Homo sapiens
gtaaagataggtcatacttgaacacaggatttcttacctacaaataacctactcaagcttagtagattgagttatctgcaaattgttttcctaaacagctraataatcaatctattgcaggagtggcttcagaggtattgtttaaatgatggtgaaagacaaatgcaataactgtagttttgtcgtaacgaatgctaatct

SEQ ID NO: 26772 - DNA, 201 bp, Homo sapiens; identical to SEQ ID NO: 5280

SEQ ID NO: 26773 - DNA, 201 bp, Homo sapiens; identical to SEQ ID NO: 5282

SEQ ID NO: 26774 - DNA, 201 bp, Homo sapiens; identical to SEQ ID NO: 5283

SEQ ID NO: 26775 - DNA, 201 bp, Homo sapiens; identical to SEQ ID NO: 5272

SEQ ID NO: 26776 - DNA, 201 bp, Homo sapiens
gcccaacaccacagcggctaatgtttgtatttttagtagagatggggtttcaccatgttggccaggctggtctcgaactcctgacctcaggtgatccgctygcctcggctcccaaagtgctgggattataggcgtgagctactgtgcctggccctacttcatagaggtttaaatgccttttcacccttttcctggagattc

SEQ ID NO: 26777 - DNA, 201 bp, Homo sapiens; identical to SEQ ID NO: 5281

SEQ ID NO: 26778 - DNA, 201 bp, Homo sapiens
ttttttaatttttaattttttttttgagacggagtctcactctgtcacccaggcaggagtgcagtggtgcaatctcggctcactgcaagctccgcctccccgggttcacgccattctcctgcctcagcctcccgagtagctgggactacaggcgcccgccaccacgcccggctaatttttttgtatttttagtagagacgg

SEQ ID NO: 26779 - DNA, 201 bp, Homo sapiens
actctttacctttatgattttcttacctccaggaaagaacagggtcagctcgtccacccagagctggagggactgttgggggaccacgccacttccccacrgtatccgcattattatggcgtggcccaggctttggcctggggccatgaacagactttcagcttctagaagcaagtggtcacagggcctccgtgaccctcg

SEQ ID NO: 26780 - DNA, 201 bp, Homo sapiens
agcctgggcaacaagaagtgaaactccatctggaaaaaaaaatgtttaaaggctatgtccaatgttctataagggcagggacacacacacacagtgtctcwcacacacacacacacacacacacacacacacacacacacacagtgtcacacatacatactagcaacacacagaacgggcataaagtaagatgtattaagg

SEQ ID NO: 26781 - DNA, 201 bp, Homo sapiens
aggcacactcttgcacactgccaacaggtctgtaaattggcataagctttctgcaaagaaatttggcagtctgtattaataacatgaaaaattttataacrgcataaaccagcaattccactgatagaaatttatgttaaggagatgagctgaaataatgtaaacaaaacattagacacgaagatagtcatcagggcttta

SEQ ID NO: 26782 - DNA, 201 bp, Homo sapiens
ggagtgcagtggcgcgatctcggctcactgcaacctccacctcccaggtttgagagattctcctgcctcagcctcctgagtagctgggattacaggtgcaygccaccatgcctgggtaatttttgtatttttagtagagatggggtttcatcatgttggccaggctggtcttgaactcctgacctcaaatgatccacccgc

SEQ ID NO: 26783 - DNA, 201 bp, Homo sapiens
cacctgcatcagaatcactctggacatgtgttaaaatgctgatgcaccctctgccttttgagaaccactttttttttttttttttttttcagagaaggggycttgagctattgcccaggctggtctcaaactcctggcctcaaggaatcctcccgcctctgcctgtccgtgctgggattttaggcatgagctaccatgccc

SEQ ID NO: 26784 - DNA, 201 bp, Homo sapiens
tttaccttaaatatacgtctttcttactgctaggctgagttcccgccccagcatgttctgagaaattgagtcaaaataactgagtctgttggcacctcatmgacgatttcttcatagacggtttttttattgttgctgttgttgttggttttttgggtttgtttgtttgttttttgagacagagtttctctctgtccccca

SEQ ID NO: 26785 - DNA, 201 bp, Homo sapiens
ctccaatatcaactctttaggcgcaaatctcccagctctctgctccccaagtttatgcgtttggccagagtgagaacaagtttcagttgtctgacaatctsacggaatctgaagggcctgacttgcatcctggtgagagccaaggtcagttcattctggccaacacttgagcagcaagaacaaggctatgagtatttttta

SEQ ID NO: 26786 - DNA, 201 bp, Homo sapiens
agggagccccggggccccggggagggtgcggagaaggctctgggcattgaaggagatgaagggcacggctttggttctttcagtgaagtagaaaatggagkgtcacggggagagaagagagaggagagacctgtttctctccaatatcaactctttaggcgcaaatctcccagctctctgctccccaagtttatgcgtttg

SEQ ID NO: 26787 - DNA, 201 bp, Homo sapiens
cagcttccacaggtgacaccacccgtcttcctgtcaccaacgtttcctcggcatccacaggtcatgccacccctcttcctgtcaccagcacttcctcagcktccacaggtgacaccacccctcttcctggcaccgacacttcctcagtatccacaggtcacaccacccctcttcttgtcaccgacgcttcgtcagtatcca

SEQ ID NO: 26788 - DNA, 201 bp, Homo sapiens
caccgacgcttcctcagtatccacaggtgacaccacccctcttcctgtcaccgacactaactcagcatccacaggtgacaccacccctcttcatgtcaccracgcttcctcagtatccacaggtcacgccacctctcttcctgtcaccagcctttcctcagcatccacaggtgacaccacgcctcttcctgtcactagccc

SEQ ID NO: 26789 - DNA, 201 bp, Homo sapiens; identical to SEQ ID NO: 5274

SEQ ID NO: 26790 - DNA, 201 bp, Homo sapiens
ccaaaactctccacagacccctctgcccctctgggaaaccccactgtgctccaggacactcaaaaggaaaggatccctggacaagaggtcctgccaggaamatcagccaaattttggccaacgaccagcaaggtgcacagggaagagcaggggctgaaactcagaggtccagcatcagcgacgcccttggcagcccaggga

SEQ ID NO: 26791 - DNA, 201 bp, Homo sapiens
agcccaggccagaggaaaaacacagggtttccacaaaggagctgccgcaatgagggtttccttaaggaacagccctggctctcaagggttaaaggataagrcacagcagacagaggtgggctagacaaggacagatggaaatttggtgtctactggtcgccccaggcaggaatgactcagaaggaagcctggccgtcctgg

SEQ ID NO: 26792 - DNA, 201 bp, Homo sapiens
tcctggcctcgagtgatcctcccaccttggcctcccaaaatgctgggattacagacatgagccaccatgcctggcctctgcctgggaaataattttttttwaaaaagtggttatggtcaataatattagcttcttggtagtctgtgaccagggcaagagtatatgcatttaccccttgggttttttaccagattggcacag

SEQ ID NO: 26793 - DNA, 201 bp, Homo sapiens
cctcgtttgtgtctccctccagggatgatgcccggatggaaggaggagccacgttcctccacaggtgtcctccacaacaggtgtcctcacaacaggtgtcstaacaacaggtgtcctcacaacaggtgtcctaatactcccgcagcccctcagcatctacaggctcactcccaccctacaacctttcagataggtgttatc

SEQ ID NO: 26794 - DNA, 201 bp, Homo sapiens
acgaaaaagaaaagtagaaatttaatttatttttaagaaagataatgctataattcaagttgagagagttaacccggcttatagcaggggtactgtttgcytcttcccatggagtttaacacagttaattcaccattctagtctaacctcaccttcctcctcacaaggaagacaggcgggagctggagaagaccattggct

SEQ ID NO: 26795 - DNA, 201 bp, Homo sapiens
aattccagaaagtggacttgaagctgaattcttccctgagactttgtctctctgagtatcatcttgccaactatctaggagcactgaggttgaaaaaaagrgtgggagcggtggctcacacctttaatcccagtactttgagagtctgaagcaggaggatcgcttgaggccgggagttcgacaccagcctaggcaacatag

SEQ ID NO: 26796 - DNA, 201 bp, Homo sapiens; identical to SEQ ID NO: 5279

SEQ ID NO: 26797 - DNA, 201 bp, Homo sapiens; identical to SEQ ID NO: 5278

SEQ ID NO: 26798 - DNA, 201 bp, Homo sapiens
gttaacttcttcactcctgagtgtttccctttctttcttctcatctcacctctgcattagaaaacatttattacatttataacctgtatttatctggcatyggctggttttgctattagaggcttatctcttcttccatattgctgaaatggagctgtgccacttttataaagaactacaaaaatctttactttaaaaaaa

SEQ ID NO: 26799 - DNA, 201 bp, Homo sapiens
catttattccatttttaattgtttctatagtgagttctggtctgttactatatccttcattctgcttcctttttcttttttcttcctggtctttctagtcyaccttttttgctggcggttccagctttttgcagggaaactcagttcagtgtcgtgaccgagggtcttgcttcctttcctttttcagcctttcagtcagca

SEQ ID NO: 26800 - DNA, 201 bp, Homo sapiens
gtacccttttttgtttctaataatcttgatatctgtgtcttttctgtctctctctctccctcctcccacacccccccccactttctttctcttgccaggtrtttgttttattttcaaagaactaatctttggcttcatttattccatttttaattgtttctatagtgagttctggtctgttactatatccttcattctgct

SEQ ID NO: 26801 - DNA, 201 bp, Homo sapiens; identical to SEQ ID NO: 5273

SEQ ID NO: 26802 - DNA, 201 bp, Homo sapiens
ttcacgaagatggtatgtggctagtgcaggtgctgtgaaatattttaaacaaaaaaagccaatatttaaacattctgcctgggaaatatttttctttattwaatatctatttttattattattattattatttttattttttaagacacagggtctcgctatcttgcccaggctggtctcaaactcctggcctcgagtgat

SEQ ID NO: 26803 - DNA, 201 bp, Homo sapiens; identical to SEQ ID NO: 5277

SEQ ID NO: 26804 - DNA, 201 bp, Homo sapiens
gatggcagaggcttgacagagccttcaaggactcagatgtggggaacgtctctacctcagtgccaacgccagtgccctcctcgtccctggatggagactcytcctctgagagaatgtcttaaaaactatccgttttactcaatgacacacgtgtgtcttctcacagtgatcttgtcaccttaaggtgtcaacagccttcac

SEQ ID NO: 26805 - DNA, 201 bp, Homo sapiens
tgtatgccaagtctcgtttcaggctctggagatcacaagagatcagttattccaagggtatcttgagttagtgtctttcctcatcttgaattctagggaartacccagtggacacaaccctggtcacagttgattctgggctgatacacaaatagcattagctccctgccaaaggcggtggggccagcggttcagcgtctg

SEQ ID NO: 26806 - DNA, 201 bp, Homo sapiens
aaggcaacaaaggccacagggcctgggatgtattccacagatgtgtatgaagtcactgctgtatgccaagtctcgtttcaggctctggagatcacaagagrtcagttattccaagggtatcttgagttagtgtctttcctcatcttgaattctagggaaatacccagtggacacaaccctggtcacagttgattctgggct

SEQ ID NO: 26807 - DNA, 201 bp, Homo sapiens
ctctccagcctcggctgaaggcaacaaaggccacagggcctgggatgtattccacagatgtgtatgaagtcactgctgtatgccaagtctcgtttcaggckctggagatcacaagagatcagttattccaagggtatcttgagttagtgtctttcctcatcttgaattctagggaaatacccagtggacacaaccctggtc

SEQ ID NO: 26808 - DNA, 201 bp, Homo sapiens
caccagcacttcctcagcatccacaggtgacaccacccctcttcctgtcaccgacacttcctcagcatccacaggtcacgccacccatcttcctgtcaccrgcctttcctcagcttccacaggtgacaccacccgtcttcctgtcaccaacgtttcctcggcatccacaggtcatgccacccctcttcctgtcaccagcac

SEQ ID NO: 26809 - DNA, 201 bp, Homo sapiens
cttgcctcggctcccaaagtgctgggattataggcgtgagctactgtgcctggccctacttcatagaggtttaaatgccttttcacccttttcctggagaytctgaagaagtctcaggaactgggcatttgtgttgcacgtgaggccttgcaatggcggccctgcttggagaaagggcactggcctgggttgcccgcagct

SEQ ID NO: 26810 - DNA, 201 bp, Homo sapiens
ggacttgaacctgggaggtggaggttacagtgagctgagatcgcaccactgcactcctgcctgggcgacagagcgagactccatctcaaaaaaaaaaaaaagataaagataaagaaacaggcaacgtcaccctctctccagcctcggctgaaggcaacaaaggccacagggcctgggatgtattccacagatgtgtatgaa

SEQ ID NO: 26811 - DNA, 201 bp, Homo sapiens
gggacttgaacctgggaggtggaggttacagtgagctgagatcgcaccactgcactcctgcctgggcgacagagcgagactccatctcaaaaaaaaaaaaaagataaagataaagaaacaggcaacgtcaccctctctccagcctcggctgaaggcaacaaaggccacagggcctgggatgtattccacagatgtgtatga

SEQ ID NO: 26812 - DNA, 201 bp, Homo sapiens
accgctcttcctgtcaccagcacttcctcagcatccacaggtgacaccacccctcttcctgtcaccgacacttcctcagcatccacaggtcacgccacccmtcttcctgtcaccggcctttcctcagcttccacaggtgacaccacccgtcttcctgtcaccaacgtttcctcggcatccacaggtcatgccacccctctt

SEQ ID NO: 26813 - DNA, 201 bp, Homo sapiens
tgaggatgaaacgagacagcatctggtgtaaagtagaaaaggcataaagggccgggcgcggtggctcacgctgtaatcccagcacttttggaggcccaggygggtggatcacctgaggtcaggagttcaagaccagcttggccaaccctgtctccactaaaaataaaaaattttgccgggcgtggtggcgagcgcctgtaa

SEQ ID NO: 26814 - DNA, 201 bp, Homo sapiens
aggggctgaaactcagaggtccagcatcagcgacgcccttggcagcccagggaacacaggcaacgccttttggctctggagtcttaggctcttcatcggcraactgagcccagggggaaggggctactatgtagggttgtcatgaggatgaaacgagacagcatctggtgtaaagtagaaaaggcataaagggccgggcgc

SEQ ID NO: 26815 - DNA, 201 bp, Homo sapiens
ctatcactgatggacatttgggttggtttcatgtctttactattgtaaatagtgctgcagtaaacatacgtgtgcatgtatctttataacagaatgatttmtattcctttgggcatatacccagtaatgggattgctgggtcaaatggtatttctggttctagatccttgaggaatcgccacactgtcttccacaatggtt

SEQ ID NO: 26816 - DNA, 201 bp, Homo sapiens
ggggttcgccctgttagccaggatggtctcgatctcctgacctcatgatccgcccacctcagcctcacaaagcgctgggattacaggtgtgagccaccackcctggcctaaactatatattttttaaagcataaaaacatcctggaaggaagcattgtctggtagcaagattatgggttttgatctttcaactataaatgt

SEQ ID NO: 26817 - DNA, 201 bp, Homo sapiens
acgccattctcctgcctcagcctcccgagtagctgggactacaggcgcccgccaccacgcccggctaatttttttgtatttttagtagagacgggggttcrccctgttagccaggatggtctcgatctcctgacctcatgatccgcccacctcagcctcacaaagcgctgggattacaggtgtgagccaccactcctggcc

SEQ ID NO: 26818 - DNA, 201 bp, Homo sapiens
atcaactctttaggcgcaaatctcccagctctctgctccccaagtttatgcgtttggccagagtgagaacaagtttcagttgtctgacaatctcacggaayctgaagggcctgacttgcatcctggtgagagccaaggtcagttcattctggccaacacttgagcagcaagaacaaggctatgagtattttttagaataaa

SEQ ID NO: 26819 - DNA, 201 bp, Homo sapiens
agggcccgggagcgtggacggtggagcaggacccgtcagcttcaatgagggtgaggctgggtggtggcacggggccgccggccagggagagcacgtggagsggggggcgcaatacacatctgtcagattcatgaatgaatgaatggatggggccgaactgatgagacgcgtgaggactggagaaaatcgtttttgctgttg

SEQ ID NO: 26820 - DNA, 201 bp, Homo sapiens
cctctgcatgtggcagtccaagaacttggggcaggtcagtgaccatttctccatctttgcctcagctctccatccactcggtggcagtcccagagctgaamagctcgcagcttccgagcaatggctcttaccccgagcccccggccctgctacttccaaggcatataatatcactcggtctcttcaaatctcaatttccct

SEQ ID NO: 26821 - DNA, 201 bp, Homo sapiens
gcgacgcccttggcagcccagggaacacaggcaacgccttttggctctggagtcttaggctcttcatcggcgaactgagcccagggggaaggggctactaygtagggttgtcatgaggatgaaacgagacagcatctggtgtaaagtagaaaaggcataaagggccgggcgcggtggctcacgctgtaatcccagcacttt

SEQ ID NO: 26822 - DNA, 201 bp, Homo sapiens
ccctctgcatgtggcagtccaagaacttggggcaggtcagtgaccatttctccatctttgcctcagctctccatccactcggtggcagtcccagagctgaraagctcgcagcttccgagcaatggctcttaccccgagcccccggccctgctacttccaaggcatataatatcactcggtctcttcaaatctcaatttccc

SEQ ID NO: 26823 - DNA, 201 bp, Homo sapiens
gcaacaaaggccacagggcctgggatgtattccacagatgtgtatgaagtcactgctgtatgccaagtctcgtttcaggctctggagatcacaagagatcwgttattccaagggtatcttgagttagtgtctttcctcatcttgaattctagggaaatacccagtggacacaaccctggtcacagttgattctgggctgat

SEQ ID NO: 26824 - DNA, 201 bp, Homo sapiens; identical to SEQ ID NO: 5275

SEQ ID NO: 26825 - DNA, 201 bp, Homo sapiens
cgcgtctggggtctgccatgcgtctgcactgaggttctgccacgcgtctggggtctgccacgcgtctggggtctgccacgcgtctggggtctgccacgcgyctgcactgagcagatattccaagcacaccacccctttccaaaagacggcatacagtgcatttctgttcctgcccctcacccacatggttccccgcttccc

SEQ ID NO: 26826 - DNA, 201 bp, Homo sapiens
gctcctgccctgcctctcagcaggctaagaacagtcgccgagggaaaatatttcttgggcgcatatttgaggagcttcctgggagtgagtcagaaggcgartgccgtttaaaggctgcaagagaagccatgctggtgaagcggacccttccacctcgggatgtttcaggactaggctgagggcaaaggaaactgccaccac

SEQ ID NO: 26827 - DNA, 201 bp, Homo sapiens; identical to SEQ ID NO: 5284

SEQ ID NO: 26828 - DNA, 201 bp, Homo sapiens
ctgacagaaaaatgaccacgggccgggtgcagtggctcacgcctgtaatcccagcactttgggaggccaaggcgggcggatcatctgagttcaggggttcragaccaacctggccaacatggtgaaacctcgtccctactaaaaatacaaaaaaaattagccgggcgtggtggcaggtgcctgtagtcccagctactaggg

SEQ ID NO: 26829 - DNA, 201 bp, Homo sapiens
gatcgatgtctgactctcacactggtgtgtcaactccgtcagggcagaaaccacatatttgtctgtttgtttttcatctttgtgccccattacttggctgvttcctaacacaaaatgaatgtgcaaaaaacgcttgtcaaatgaatgaggaggtctaaggggccttgagccctctgacgtttccattttataattgtggac

SEQ ID NO: 26830 - DNA, 201 bp, Homo sapiens
cccccaagagctgcccagagaggcactactgggctcagggaaagctgtgctgccagatgtgtgagccaggtaagagggggccttggtaagggccaggtgastggcgaaagagagaggactggggttaatacagtaaataggcgcagggtgagactgagctcaagcaaggagggaaatcctgcagctgtggggaggcaccac

SEQ ID NO: 26831 - DNA, 201 bp, Homo sapiens
ttctggggaaggcggtgctcaccccagcctttgtctgcagagccccacccagcagaggggcagtggcgggcagtggacgtggtcctagactgcttcctggygaaggacggtgcgcaccgtggagctctcgccagcagtgaggacagggcaagggcctcccttgtgctgaagcaggtgccagtgctggacgatggctccctg

SEQ ID NO: 26832 - DNA, 201 bp, Homo sapiens
cctaccacacccgcccccaggataattaacacccagccacccagcatcggacctctacacttgagcaaaatgtatattttaaaggcaaattctcacgcctrtaatcccagcactttgggaggccaaggcgggcggatcacgaggtcaggagattgagaccatcctggctaacacagtgaaaccccatctctactaaaaata

SEQ ID NO: 26833 - DNA, 201 bp, Homo sapiens
gagtagctttctggggaaggcggtgctcaccccagcctttgtctgcagagccccacccagcagaggggcagtggcgggcagtggacgtggtcctagactgyttcctggcgaaggacggtgcgcaccgtggagctctcgccagcagtgaggacagggcaagggcctcccttgtgctgaagcaggtgccagtgctggacgatg

SEQ ID NO: 26834 - DNA, 201 bp, Homo sapiens
cctggctgacatctaggctacagtcactgggccaggtggagggttggtcaggccctctcaaaagtcatgagaggccaggcacagtggctcacgcttgtaawcccaacactttgggaggccgaggagggcagatcacttgaggccaggagtttgagaccagcctggccaacatagtgaaaccccgtctctactaaaaataca

SEQ ID NO: 26835 - DNA, 201 bp, Homo sapiens
aataacaataataatggcaaaggcattgggggaccgtgagcaaagggcaggcctttgcaggggtgggaatggaaagggaagcacgtccctagaggtgggcmtgggatgggggttgggggatgaagcaagtggaccttgaaggtctccacaggtctgagtgtcctatgctccctgggcctctcttcccccaggtcttctcgt

SEQ ID NO: 26836 - DNA, 201 bp, Homo sapiens
tgctgactgcagtgggaaggaggtgacctgtgagatctcccgctactttctccagatgacagagaccactgttaagacagcagcttggttcatggccaacrtgcaggtctctggagggggacctagcatctccttggtgatgaagactcccagggtcaccaagaatgaggcgctctggcacccgacgctgaacttgccact

SEQ ID NO: 26837 - DNA, 201 bp, Homo sapiens; identical to SEQ ID NO: 5288

SEQ ID NO: 26838 - DNA, 201 bp, Homo sapiens
aacttgaggccagcctgaccaacgtggcaaaactccatctctactaaaaatacaaaaattagctgagcgtggtggcacgcacctgtcatcccagttactcrggaggctgaggcgtgagaatggcttgagcctgggagacagaggttgcagtgagctgagattgcatcattgcactctagcctgggtgacagagtgaaatgg

SEQ ID NO: 26839 - DNA, 201 bp, Homo sapiens
acgtccctagaggtgggcctgggatgggggttgggggatgaagcaagtggaccttgaaggtctccacaggtctgagtgtcctatgctccctgggcctctcytcccccaggtcttctcgttcgcaactgcaccatcactgccaatgctgagtgtgcctgtcgcaatggctggcagtgcagggacaaggagtgcaccgagtgt

SEQ ID NO: 26840 - DNA, 201 bp, Homo sapiens
tattttaaaggcaaattctcacgcctgtaatcccagcactttgggaggccaaggcgggcggatcacgaggtcaggagattgagaccatcctggctaacacrgtgaaaccccatctctactaaaaatacaaaaaattagccaggtgtggtggcacacacctgtaatcccagctactagggaggctgaggcaggagaatcact

SEQ ID NO: 26841 - DNA, 201 bp, Homo sapiens
ccagccacccagcatcggacctctacacttgagcaaaatgtatattttaaaggcaaattctcacgcctgtaatcccagcactttgggaggccaaggcgggyggatcacgaggtcaggagattgagaccatcctggctaacacagtgaaaccccatctctactaaaaatacaaaaaattagccaggtgtggtggcacacacc

SEQ ID NO: 26842 - DNA, 201 bp, Homo sapiens
tttggcggagacccttgtcatcactcctctctaccaccagtgctctcccctcctgcactgtcccaggcttcctcattcttcccttgcaggtccttatccawcatggctcacaattcctgggaagccacaaggaaaccaaattctagtagcaactcagagtcagcattcattagcaggtcacagggccataaggatgccaag

SEQ ID NO: 26843 - DNA, 201 bp, Homo sapiens
caaattctcacgcctgtaatcccagcactttgggaggccaaggcgggcggatcacgaggtcaggagattgagaccatcctggctaacacagtgaaaccccrtctctactaaaaatacaaaaaattagccaggtgtggtggcacacacctgtaatcccagctactagggaggctgaggcaggagaatcacttgaactcagga

SEQ ID NO: 26844 - DNA, 201 bp, Homo sapiens
tgtctgacttcagatccccttttcccacagttatagctccacttttttgggacaggtggggagcaaaagggtgcagaggtcaggtcttgaaatcaccaggrgatttccgggtgaggtgggtggtgagaaaggaaacagcaagcagggctctggcagctgctgcagacggcttcacacagggacgcgggctgccatcttgct

SEQ ID NO: 26845 - DNA, 201 bp, Homo sapiens
aatgtatattttaaaggcaaattctcacgcctgtaatcccagcactttgggaggccaaggcgggcggatcacgaggtcaggagattgagaccatcctggcyaacacagtgaaaccccatctctactaaaaatacaaaaaattagccaggtgtggtggcacacacctgtaatcccagctactagggaggctgaggcaggaga

SEQ ID NO: 26846 - DNA, 201 bp, Homo sapiens
accttgaagagggcagagaaccagcccttctcaggccttgatcccttaccctctcctcccaggaacattcctcgtgaaggactgtgaccagcatagaaagrctgctcagtgtgatccttgcataccgggggtctccttctctcctgaccaccacacccggccccactgtgagagctgtcggcactgtaactctggtgaggt

SEQ ID NO: 26847 - DNA, 201 bp, Homo sapiens
tagcggtgataccccaaccagtactccccactcctacccctagataaggtcagcctgtttctgccttcccatcccatccagcacctctcaggccttcagakgtgccctatggggtcccctgctgctactcattctgtctctgtttttccagagatgctggaggccaggacagctgggcacatgcagactctggctgacttc

SEQ ID NO: 26848 - DNA, 201 bp, Homo sapiens
  misc_feature (1)...(201): n = A,T,C or G, or insertion/deletion polymorphism (see Tables 1-2)
cccgcaggtgctggctcagggggagcaggcaggctccggttttcggtaatcctcctggatggggatggtgctgccctcctcctccctggggcagctgtaangacaaggctctgcaggctccacaggactttctcctttgtctgcagaaggagatccgatgagtcttggccagcagtgggggcagggggagacgggagaagg

SEQ ID NO: 26849 - DNA, 201 bp, Homo sapiens; identical to SEQ ID NO: 5287

SEQ ID NO: 26850 - DNA, 201 bp, Homo sapiens
cttgagtggacccccatgaagagctgcagagggggctgggaaaagacaagagaatggagaaaatgaggagaaaggaaactacagagtgagatagagaacakatctgacaggtgtgaccacagcagtgtgacatttatgaacagtgtggaaacaacggcaaagcccctgaattaaaaacttcctggggaaataagccactcc

SEQ ID NO: 26851 - DNA, 201 bp, Homo sapiens
agtcctcagggccacagcactctctgcggtgggaattcaggtgccttgcctgatggtgacaaggctggttttgcataaacagctctctgaatcacacccaratgtggcttctgacttgagtggacccccatgaagagctgcagagggggctgggaaaagacaagagaatggagaaaatgaggagaaaggaaactacagagt

SEQ ID NO: 26852 - DNA, 201 bp, Homo sapiens; identical to SEQ ID NO: 5289

SEQ ID NO: 26853 - DNA, 201 bp, Homo sapiens
ctccatcttaaaaacaaacaaacaaacaatgaccacaccaacaacaactaaacaaaccaaaaacacatttgtatagttatcccacaaagagctcttgctatcagaagatacttcagttagtgaaaaatcagtgatcccacttgccggaattttggtatcctagaccttgaaaactgtatgttagaggaacttaaaaggctt

SEQ ID NO: 26854 - DNA, 201 bp, Homo sapiens
aaaaaaaaaagtgttcgaaaccaaaaaaaaaaaaaagtgaggggctgctgtcagggatggagaataggcatggaaaaggcaacaaaatggccaaaatctcraccccagtctcagtcaagagaagctattcattctggcagccatacaaagtctgcaggactctagaatgacagcctgtttgttaggattaaagcagaaatc

SEQ ID NO: 26855 - DNA, 201 bp, Homo sapiens
aaaaaaaaaaaaagtgaggggctgctgtcagggatggagaataggcatggaaaaggcaacaaaatggccaaaatctcaaccccagtctcagtcaagagaarctattcattctggcagccatacaaagtctgcaggactctagaatgacagcctgtttgttaggattaaagcagaaatccagaaataaaggcacatgtaagt

SEQ ID NO: 26856 - DNA, 201 bp, Homo sapiens
tttgtaattcacccctattttcagacgtggccacaaagttgctgtttaatataaccttggatggacgttagcctaactgaaatcttggattcaagatgacraatcacacatgaaagcttcacccaggtgctaaaggaagatgaacttccttattcttgttgatgcctttgatgccagtgaatactgcaaattttccttaat

SEQ ID NO: 26857 - DNA, 201 bp, Homo sapiens
ggacccatatcacacacactgcatgaaagttgcagctcaaaacagtgatgtaagtttgaagacaatggttcatgcctcacagtgacattgtttgagagccrtaacaatcatgatctatttttggtttttctcattatagaaaagttacaaagcagaatatgaagaagataaaggaaaatgctatttccctcagacaataac

SEQ ID NO: 26858 - DNA, 201 bp, Homo sapiens
gctgctcgggaggctgaggcaggagaatggcctgaacccgggaggcggagcttgcagtgagccgagatcgcgctactgcattccagcctgggcaacatagygagactccgtctcaaaaaaaaaaaaaaaagaacagaggaggtatatggtcaagtcgatccaaggctgggggtttattgaatgtgataaaaagacaagggg

SEQ ID NO: 26859 - DNA, 201 bp, Homo sapiens
attcttcaatcttctgatcattctatttgtaatttgtgctattttttcaaaactcttgtcaaaatagaatccctcaaaatttagtgttgttttcttgatayggaaggtcaggtcagaaagcttatttgtgccccatacaaaatctatggcactgctttttaaaaagcaattttgtcagattgcttatgttgaagttaaagt

SEQ ID NO: 26860 - DNA, 201 bp, Homo sapiens
agggttcttccttgcgatgccctaacatccttggacagttaagaaaatacaaaggactttccctctgctgagcctggaagggctaaaatagcctattttasgtcccattggcctatatccctgtggtgtttaccctccttatttcttggaatctattcccagaaaaagtacaaggaagatgctgagaagtccatgtcgtat

SEQ ID NO: 26861 - DNA, 201 bp, Homo sapiens
ttaattattaatagtgtcttctttactctaaatgtcccagtttggataatagattatatgatcactctatgtacaatgcatattctttggcatttgtgttyctactattccccaattcccaaattgattgatgtccaggaataatttggatgtttgcatttgctgttaggttaaataccgagaaaatttcgataaagaaaa

SEQ ID NO: 26862 - DNA, 201 bp, Homo sapiens
ccattgattggaataaagataagaccaagattcatgtgatgcctgatacaccagatattttacaagccaagcagaatcaaacactgtatagtcaggtaaakttatataaaaattaattttaagttttgtattgaaacttatgaacttataaaataatgtaacagtaaatactgatataaatgttgaagcaatggaagtttg

SEQ ID NO: 26863 - DNA, 201 bp, Homo sapiens
acgcagggaggggaacatgtttgacagagccacctcattcccttagggtcctaccatggtgacagatgtgataatagctgccaagtgtcctgcacacaggwtcagtaatgcagatggcctacccaagctctagatgtctcttctgatctcaataatgctgtcactaactttacaaaatgtaccacacaagaatttttgtat

SEQ ID NO: 26864 - DNA, 201 bp, Homo sapiens
cactaccacaccatacccgataatctggagcagcttcacctaaaagaggccacagaattacagagtatagtaagtggatcaagaccgatttttcctctggygcacattcatccacagtacaatgtgaaaaaaaatttcatagattccctccattgtttgagaaaatgcacaaagatataaggggttttgaatctggtaact

SEQ ID NO: 26865 - DNA, 201 bp, Homo sapiens
atataatttttaattatattttataattatacaaaaataatatagcatattgacactagatcgatttttagtcaaaggaattgctctgtgtaaaaactcawattttcttcacagtataaatacaagtacaattatgaaaaagggaaggggaaaatggttggtttccgcagtctcgaggatgatcccaaattagtccattcc

SEQ ID NO: 26866 - DNA, 201 bp, Homo sapiens
tttcttgcatcagcatttctctcagctggctcttgtcaatgattcttttgtgtccttgaattgaatccaaatcctaattatgccttgcagacagtaatggyacccatcccctcaacacctagacaacaacaaaaatgtactggatctgaaacataacaggaaactgttttgagtggcaatgagatgccatccaattgacag

SEQ ID NO: 26867 - DNA, 201 bp, Homo sapiens
agaaattccttaatatactcacatgtacatgcctgtcatgaactctaactgtgcattatttgggcaggttaagtatcgaatggatggtgatgttgctaagrctatatgtcacgtagatgaaaaagcaaaggatattgaacatgcaaagaaagtgtcgcagcaagtcagtaaggtaaggcaatgatatggatggctggggta

SEQ ID NO: 26868 - DNA, 201 bp, Homo sapiens
tcagccccagacccctgggctgaagcaatcctcctacctcagtctccctagtagctaggactacaggagcatgccaccatgactggctaattaaaaaaaaattgtaggatctcctaattattttttcatagaggtagggtcttgctatgttgcccaggatggtcgtaaactcctggccacaggtgatcctcccaccttggc

SEQ ID NO: 26869 - DNA, 201 bp, Homo sapiens
ctcacagggaacatttaatgacttggaggtcctgggaggagcatatttcaaaacaatctctccttggtcacccatcagttttactttctctcccatctctrttcttcatcttccctacctatccagcccatcccattctctcttattatcctgagaactccaaattcttctcccctctattacgctggagtaatttggctc

SEQ ID NO: 26870 - DNA, 201 bp, Homo sapiens
cgtccctaatgatgcattgaaatgctactcagattttagcacattagcaattctaaataacctattaccataaatattccacgttcaagctctttttttttcaaggtgaaatacctctctcatgctttattttctgcatgcagctgtttctctttgagcatgacaaacagtgatatggatggttaatcctgaagcttgttc

SEQ ID NO: 26871 - DNA, 201 bp, Homo sapiens
tgaaaaaagtaaaaacattatccttactaaatattacttactaaaaaactgcctcctcacatataaccccttcccccatttccttccttccttactctctrtgcctgttttaaatgtcctctgggtactttcttgtatctcacaggttttgtacaaagaaaatttggggaaaggaatcccaacacctatcactccagagat

SEQ ID NO: 26872 - DNA, 201 bp, Homo sapiens
taatgttttcccttcccttgagtgctgtatgttttggtgttaaagataagaaaaaggaagcataaagtgttttacatccttttttttttttttttttttttactaagaaatgagccaagtgtttcatctttatccctttcctcatgtgcttggcctaaacgagcctctccttctgttcaccctacagagcagggtgaggct

SEQ ID NO: 26873 - DNA, 201 bp, Homo sapiens
tttacaacctaatagagaccagtaacttttactttttctggtattttcttgaaaatatgtttaagtttgttatagattgtttttcaaacacagttatgttrcttgtaagaacattcagccactgaagcaccaacgaagcattctgctcaaaaacaaaaaaaaagacgccacagtggtagtttactcttctaaaataaatcc

SEQ ID NO: 26874 - DNA, 201 bp, Homo sapiens
ttaatgttttcccttcccttgagtgctgtatgttttggtgttaaagataagaaaaaggaagcataaagtgttttacatccttttttttttttttttttttttactaagaaatgagccaagtgtttcatctttatccctttcctcatgtgcttggcctaaacgagcctctccttctgttcaccctacagagcagggtgaggc

SEQ ID NO: 26875 - DNA, 201 bp, Homo sapiens
ctcaattcacgcctctggccgatcctccagatatagaatttgccaagaaagtaaccaatcaagtgagcaaggtaagtaaatagagctgggacattgccgcctcccttgaagactctgcttaataatttcaaccatcagagagggttactaaaggtgagactgaagataaaacacaaacactaggagtatttttacatatga

SEQ ID NO: 26876 - DNA, 201 bp, Homo sapiens
attaccctatagaaatccttatatatgtgtgcaaagatatacatacatacatacatacacacaagaatatgttttgcagtttagggtttctgaaaggagaygctaagatgaaaattggagtacagagtattttttagggatcctagtctttgggaagaaggactaggccggaggagaagttgaacagtgatgctggcatga

SEQ ID NO: 26877 - DNA, 201 bp, Homo sapiens
tattaattaatagcctgttctaatcctccagtctcaccctcaaggttcaacctgatagaatgatgggagctggagaggagagacagcatatttttgagggktgctgtgcaattgattccttctgcaattcagcagtgcctgggtagccccatgggttagaacagaatgttcgtgggagccttggctgagggcccatggctg

SEQ ID NO: 26878 - DNA, 201 bp, Homo sapiens
ttctatttggagaaatgtaatgttggtccttgtttacccatcattgatctcattctgactttgcttttgcagttcaagtacaaagaagcctatgaacacaycaaggcatatgggtatacacttggccccaaagatgttccatttgtccacgtccggagagtcaacaatgttaccagcgaggtacctgaatgctgattctcc

SEQ ID NO: 26879 - DNA, 201 bp, Homo sapiens
gctcaattcacgcctctggccgatcctccagatatagaatttgccaagaaagtaaccaatcaagtgagcaaggtaagtaaatagagctgggacattgccgcctcccttgaagactctgcttaataatttcaaccatcagagagggttactaaaggtgagactgaagataaaacacaaacactaggagtatttttacatatg

SEQ ID NO: 26880 - DNA, 201 bp, Homo sapiens
acatgacttcatgtatatttaaaaaggactatatgtctgttttaatttacacagaaaattttaggaggcaaatgctaccttcatgctgtaagataaggggaaaaaacatttttactttccatcttacatcctccctgctgtattgtttgaataagcaacttttccattaaaatttttttgggccaggtgcagtggctcatg

SEQ ID NO: 26881 - DNA, 201 bp, Homo sapiens
agctcaattcacgcctctggccgatcctccagatatagaatttgccaagaaagtaaccaatcaagtgagcaaggtaagtaaatagagctgggacattgccgcctcccttgaagactctgcttaataatttcaaccatcagagagggttactaaaggtgagactgaagataaaacacaaacactaggagtatttttacatat

SEQ ID NO: 26882 - DNA, 201 bp, Homo sapiens
ctcgttgactctgcacatcactcaccttctcttaaaggtataccagaaagacattttctttttccttaaagggtattgtggggatgtaggcatatgccagygccttgagacccattagttatgtctgttaacacatttttatgagccatggagggagaattgctctaactcagcttgggctctagctcatggacccaggtt

SEQ ID NO: 26883 - DNA, 201 bp, Homo sapiens
atgagaacaccaaaaccagctaccatacccctggggacatggttagcatcacagctgcaaagatggcccaggatgtcgctaccaatgtcaactacaaacarccattgcatcattacacatacctacctgacgccatgagtcttgagcatacgaggaatgtcaatcaaattcagagtgatgtaagtatgtgtaacaacagac

SEQ ID NO: 26884 - DNA, 201 bp, Homo sapiens
tgaaatcaattcagtgagcataagtgtattaagtatctagtcaaaactgtaacatgagctatatgtgatttgttaagctcagatcagttacttgatgccckatgtcatttaacctgctcttcctcattcctgcagaatctatacaaaaccagcctgcgcaccctgcccactggatatagacttccaggtgacactcctcac

SEQ ID NO: 26885 - DNA, 201 bp, Homo sapiens
gggcgggatcacctgaggtcacgagttcgagaccagcctggccaacgtggcgaaaccccatctctactaaaatacaaaattagccgggtgaggtggcgcaygcctgtggtcccaggtactcaggaggctgaggcaggagaattgcttgaacctgggaggcggaggttgcagtgagctgagatcacaccattgtactccagc

SEQ ID NO: 26886 - DNA, 201 bp, Homo sapiens
acttatagtgcttcagagtaaagataactctgaaatacctttactctttttggctttctgggctcagaattatctaaaactttagtttctcctcttcccarttcccagagggattttgggcaagttgtgcatcagcactgaggaagaagaatggatatttttcagtggagcagtttgcaccacatttgcctctccataaga

SEQ ID NO: 26887 - DNA, 201 bp, Homo sapiens
ctctgaaatacctttactctttttggctttctgggctcagaattatctaaaactttagtttctcctcttcccagttcccagagggattttgggcaagttgygcatcagcactgaggaagaagaatggatatttttcagtggagcagtttgcaccacatttgcctctccataagaatgacccaggcttgataaaatgctgat

SEQ ID NO: 26888 - DNA, 201 bp, Homo sapiens
gcctactgaatcaagtgattcctttctctcctgttaaaaacagctggactataagaaacagtacgaagccaacaaagcccactggaagtggactcctgacygaccggacttcctccaggctgccaagtcatccctgcagcaaagcgatgtaagacaggagagacacagacgattgtaactgcatactgcacctgagaaata

SEQ ID NO: 26889 - DNA, 201 bp, Homo sapiens
cccccagaacaagtacaaggaccatgtcaagaagcacttggcacagggctcatacacaacactaccagagacccgggacactgttcacgtcaaggaagtgmccaagcatgtcagtgatgtaagtgatcaaccaccggtctcttggcagcaacaatgccacttgactgtagaatctggtgaaataatgtcagttgccttttg

SEQ ID NO: 26890 - DNA, 201 bp, Homo sapiens
ccctttgaattatatttaaatggaattgggtcattgttattagtatatttgtaaatcctaaattcaagaacaactcttacaatctgaggatccttttgcayctatgtttggttctgcaactcttgcgtttaagcacagattttgattttcttttcaatatcttcacaatgtcacttaatttacaagtacttaaagagattt

SEQ ID NO: 26891 - DNA, 201 bp, Homo sapiens
tattatttcttattttagagactttatagagaagcttgggacaaagacaagactcagatccacatcatgcctgatacacctgacattgttctggctaaagmaaacttaatcaacacaagtgatgtaagttttcaaattcagcatgtgttttcagaaagctcattttaattgtttctaaatcagtgaaattgtctagaagtt

SEQ ID NO: 26892 - DNA, 201 bp, Homo sapiens
tagacaatcaaaggattgagtcctttcctatgtgcttctgtttaaaatgtttttcaaaatatgcttttaatctgaatattttgttgatttataattcataycaaaaatttagaattttctaataattcaagtattaaaaatatagagtataatatgaacttttatttaggggcaaatgatttaattatgacaaattatgac

SEQ ID NO: 26893 - DNA, 201 bp, Homo sapiens
acacatgaaaaatatagttatcactagagagtggtttgattaggaagcaggtatattcaaatggtggaaatgtttcttttctttgaagggtagggatgcaraagaataattagctttttaaaaactaccaaaatgatatgggctccaaattaccatgttgtgttcactgagggagccagggaggctgatattctttgggct

SEQ ID NO: 26894 - DNA, 201 bp, Homo sapiens
tctggatattaattgcctatcagatacatgacttgcaagtatttcctattttgtgggttccttttactttgttgatgcttgcacattctcttttgttcaayttaagtttgtggagtcagtcatgagagatcttacaaatagatgtgtgttaactgttgcaaatccaacatataatatttccccttttccatccccacgaat

SEQ ID NO: 26895 - DNA, 201 bp, Homo sapiens
tcttttagttcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggcca

SEQ ID NO: 26896 - DNA, 201 bp, Homo sapiens
agtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgacgtcatccatgctcggcaggcctatgacctccagagcgatgtgagta

SEQ ID NO: 26897 - DNA, 201 bp, Homo sapiens
tacaacatgcttcctgatgccatgagctttgaattggccaaaaatatgatgcagattcaaagtgatgtacgtgaaaaccacatttgcagagcgtttactcyggataataagcaaccatgagtgaccataagcaatgacgttttgaaaatcctgaaagaaattcatctgcaatttcccaacatagtgtttcatttgttacct

SEQ ID NO: 26898 - DNA, 201 bp, Homo sapiens
taggaacagctccggtctacagctcccagcgtgagcgagcgacgcagaagacgggtgatttctgcatttccatctgaggtaccgggttcatctcactaggsagtgccagacagtgggcgcaggtcagtgagtgctcgcactgtgcgtgagccgaagcagggcgaggcattgcctcacttgggaagcgcaaggggtcagaga

SEQ ID NO: 26899 - DNA, 201 bp, Homo sapiens
aaccactttgtagtcaggacctctattctaaccccaataacaagatgctgttgtttttctattttattgtttagaaactgtacaaagctggctgggaagargaaaagaagaaaggatatgacctgaggcctgatgccattgcaataaaggctgcaagagcctctagagacattgccagtgatgtaagtgcttgcactgggc

SEQ ID NO: 26900 - DNA, 201 bp, Homo sapiens
tgtgacagaaccacaaaactccacatggttgtgcggtgggggcaagatggtatttggtgctttggtggtagagggttgccgtattcaacaatttttttctyattgtgtatttagtttacttggcccatctttttgttatttcatccattttctaatatccatttaacctcttttaccatggagttgtaaatctcttcctct

SEQ ID NO: 26901 - DNA, 201 bp, Homo sapiens
gcctgaacccgggaggcggagcttgcagtgagccgagatcgcgctactgcattccagcctgggcaacatagcgagactccgtctcaaaaaaaaaaaaaaaagaacagaggaggtatatggtcaagtcgatccaaggctgggggtttattgaatgtgataaaaagacaaggggttgggagttgaagatgctggttaagagaa

SEQ ID NO: 26902 - DNA, 201 bp, Homo sapiens
ctatgaaaagacaaaagcaaagagcataaattactgcgagacccccaaattcaagctcgatactgttctgcagaacttcagtagtgatgtaagcaatcctwctgtcactctttctgttaaaaaaagaacccattatttcaccaattaataaatgaagtatgttttgtcttgcagaaaaaatataaagattcctacttaaaa

SEQ ID NO: 26903 - DNA, 201 bp, Homo sapiens
gaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatgtaagtcctatg

SEQ ID NO: 26904 - DNA, 201 bp, Homo sapiens
ataaagaaaacaaagcaatgttgaaatcttaacaagatgtttactctttcttcatagctccaataccagtgtgaccttaaaaacagtaaaggaaaaattayagttgttcaagacacgccagaaatactgcgtgtaaaagaaaatcagaagaatttcagctcggtatatttactatttattttgcatttaatgctaacctag

SEQ ID NO: 26905 - DNA, 201 bp, Homo sapiens
taagcattaagatcaattaaagctgagttgtactacatctggatttttagttttagtattcatatcttcctataagcttgaaatgcttcattacaagaaaygtttttccaaaagtattatatatttattatagaaaagttggaaaatatagaaaattatgacaaataaatgaaaaccttctgttatccaacagtcaaagca

SEQ ID NO: 26906 - DNA, 201 bp, Homo sapiens
aatgttgaaatcttaacaagatgtttactctttcttcatagctccaataccagtgtgaccttaaaaacagtaaaggaaaaattacagttgttcaagacacrccagaaatactgcgtgtaaaagaaaatcagaagaatttcagctcggtatatttactatttattttgcatttaatgctaacctagtcatttcactctcctc

SEQ ID NO: 26907 - DNA, 201 bp, Homo sapiens
cctggcccacagtgctgtccaataaatactggtagaatgggaacataaatgcatctaccagggcccctcccttatgacagagtaggtatttgtctcgtaawtggaaaacacaaatgatagccttccgttttaaaggagtctctgcttgatgaaatttatattatgtcagctaatgatatgtgcatgctgtctcctttgttt

SEQ ID NO: 26908 - DNA, 201 bp, Homo sapiens
gagactttcaaagatagatcttggccccagaaaccatcatttgccaacaacagaacttaaaagatgggcccctaagtcttcacaggactttctaattgtgyaattattaagagcccgactaagccgttcaatttaaagcatattaggcaaacgagactgggcttgggattaaaggactaacagcctgagagagagagagag

SEQ ID NO: 26909 - DNA, 201 bp, Homo sapiens
tatttaatgtaagtagtgactgagtcttgttaaaataagtagcctttagagtctattcaaatcacttacaatcctaagcaaatgtaaagatgcaatctacrtgttttaccaggaggcccatggccaggccctctctttaaagatgcaccatgagaaatcctgcctgcagccttttctgtcacttagacaactgagtgggga

SEQ ID NO: 26910 - DNA, 201 bp, Homo sapiens
tgctgggggtggtgctggccaagaagtgccagaccttagtcagcgatgtggactacaagaactacctgcaccagtggacatgcctgcccgaccagagcgaygtcatccatgctcggcaggcctatgacctccagagcgatgtgagtactgagagtcataataacgtgcagaggtgggaaattatttaacaccccttggaga

SEQ ID NO: 26911 - DNA, 201 bp, Homo sapiens
ctcaagcatagcctaggtggacagtatggatgtaatttagttttgaagtcttcagtggaatcaaaaggaaagcccaatttattgtcaaaagtgacaaaatsctttttagcagcacccatagtgacctggattcccctctgtgttgcataatgcagtctaaagcatgatcatttctattttattaggcttcataatacagta

SEQ ID NO: 26912 - DNA, 201 bp, Homo sapiens
atatatatatatataattttgaaggctaattgtttgtataataagagatttcttataggtataggagggagggagattgcgtatttctcaccttatataastttttcatgaaggtttgtttaaaaaaattaaacaacttgcaattgcttaaaacctgtgtttgctgtggtgctatcagtgaggaaagagtatgtgagctaa

SEQ ID NO: 26913 - DNA, 201 bp, Homo sapiens
taccaaagccacagaagcctatgtttggtgtacatgaaaagagaaaatgttttaaattttaaaagacaagacaaggaattgtgcaaataaacaactttaaratggttactttgtaagtggagcttttaaggccaaaatgctcttaagactcctacttatctatcagatttcattttctgtggtctctgttactatcagaag

SEQ ID NO: 26914 - DNA, 201 bp, Homo sapiens
actctttgaagtgcagctttgactcgagcattttccaggttggaattagagtaccacagacttccattaagttggaaataaggatgaaatggaacataacrccagttagaaggaaagcaaaaatcgaagagctgttactatatctcaccaaagaaatatataaaataaccttaatgtctggagtaaggaagctggtcagaa

SEQ ID NO: 26915 - DNA, 201 bp, Homo sapiens
tcaccttacaaaatatgtgtagcaatcttataagtaatttcatacaattagataatcgtaatatatagtattgtaaccagccctcagaatgctacgtctcrtgtatgcttaattgcaaattttaatggtagatcttttagccatatattcatttaaattatatataattcatttattccctgggcctataatgtcccttat

SEQ ID NO: 26916 - DNA, 201 bp, Homo sapiens
taattttatttctaccttgtatacaagagagatgactggcacataatcaaaacaataatatctgtgaacaccaaaataatttttctctctctctctctctyttttttttttttttgtagcgcttatatactgaagcctgggacaatgacaagaaaactattcatgtcatgcctgatacaccagaaatcatgttagccaaac

SEQ ID NO: 26917 - DNA, 201 bp, Homo sapiens
cccaaagatgttccatttgtccacgtccggagagtcaacaatgttaccagcgaggtacctgaatgctgattctccaagagacatattgagtttcaatagcyatggctttgtttgaaatgcattaagaattaatcttatttcagttgtaaacttacataccagcaaaaaatgaaaaaggtccttattgtcacattttgatac

SEQ ID NO: 26918 - DNA, 201 bp, Homo sapiens
gccctgtgacttggactgctttcatttcctcaaggtggccaggccatttccagcctcaggtcccgaatgctcttcctctgcccctctctccaagtttgagygtaaatgttacctctgcagagtggctttactgaccatccttgtttctttgctacaatgattccattgacaacacatcacaaattctagtgatagtttgta

SEQ ID NO: 26919 - DNA, 201 bp, Homo sapiens
cccctaaaacttctacttggttttcctagttttgcatgtgggggaggttattatcctccagaaacataagaataaatgagctcccttttaaaataacaacsctaaaatttctaaagctgaccaccaggtcttctcttgacattcctttcatgagaatgaacaacttcattgtctctagttggtcctcacataccatggttt

SEQ ID NO: 26920 - DNA, 201 bp, Homo sapiens
agacatcaccagtgatgtaagcatctcgtaggggtctttctggagtagtcttaccaagacgcaggcttgctttcagcagttaaaacaaccagtggtctttraacagccttttctgataagcacttctaaacaaagagtacaagttggaggtaagacagtgtgggagaaggatgccacaattctacagctatggaaacagta

SEQ ID NO: 26921 - DNA, 201 bp, Homo sapiens
gaaaagaatgtttcaaattaatatttttatgttgattacatgttggaatgttaattttcagatctactgggttcagtaaactgtattattaaagttatttmccacatgtttccttctacatttaaaaatgtggctacaagaatgacttgcattatatatgcattggatggcaccactctaggtgggcaaggtgacagtgtt

SEQ ID NO: 26922 - DNA, 201 bp, Homo sapiens
tccccctcactttgttatccagagccagttagtgtttaccccctcctggctctgggtctccctttgaatatccaaggacttattaaattctactatcattratattaacatcctaccactactactaaaaattctaaaactaattaaatatccagctacttgtactctagtagcacaatgtaattggtagagattgtgaca

SEQ ID NO: 26923 - DNA, 201 bp, Homo sapiens
atgcccccatcaccagcctccagggctaggcagaagggatcttagcctgcagctacttttaaggggaaatttatcattaactcacttgagcagattatcaytttaatgtgatctgtgcctcctatgaaaggtgctgagcttagttaaatgacaattgtttttgctcctgcctgggaagacatccaggacacatgaaagccc

SEQ ID NO: 26924 - DNA, 201 bp, Homo sapiens
aggacaatcacactattgaaagggactcacccatcactccagaagaaacttattacttactaatcaggagggtataggaataattgagatgtggatatacyttgggatcttattatttccatgatgcaatccatttaaaaatgtattcacactcgagtttctgttttagtttattgttagtttgcaaacagtgagttttat

SEQ ID NO: 26925 - DNA, 201 bp, Homo sapiens
tgcccccatcaccagcctccagggctaggcagaagggatcttagcctgcagctacttttaaggggaaatttatcattaactcacttgagcagattatcacyttaatgtgatctgtgcctcctatgaaaggtgctgagcttagttaaatgacaattgtttttgctcctgcctgggaagacatccaggacacatgaaagccct

SEQ ID NO: 26926 - DNA, 201 bp, Homo sapiens
ttagtgctagacttgattgattcaactagatgtcataaaaaaggaggtggctatttttagacatcccatccctaccattttgttcccattacagcatctgkgtctgaccagcaggtgataaacgaatagactgcctgccagaaagtattgaactgagatctctttgacctcaaaaaagatcatgagcataagagggtggtg

SEQ ID NO: 26927 - DNA, 201 bp, Homo sapiens
caagtcagccctcttagaattttggtgctgggggataaatttcagcttcttctgaaacccaagctgacctttcactaaaatttttgctggaaaatgtcttytctctaagtgtttggaagtttaaattctctgttccctgagtccaaactctctcacttccttacctcaatttcgttttacaattttaactaaactgattat

SEQ ID NO: 26928 - DNA, 201 bp, Homo sapiens
catgaattttgggaaagggggaaggggaagatgtagatttgttcattgcccagtcagtgcctctgaggacagtcccctgggctgtgcactgcacaaacctsggggtggggctgggggtaccattcacattgtttaatataaaatccatctttagtagtaacttctggcaatgaaaacatatttcagacaaatataaatcat

SEQ ID NO: 26929 - DNA, 201 bp, Homo sapiens
atccataaacgtcaagaactgtgttaataaatgtttagccagcttgatgactcagtaattgataaatgtgaaaatcaccttttgaaaacagaagccatgtyctaatgtcacttgacatttttacttatgacagtaatactacagagtcaccaaataaccacacacttccgtgaagagctggtttaaattcactgtgaagac

SEQ ID NO: 26930 - DNA, 201 bp, Homo sapiens
cagcaagctcaattcacgcctctggccgatcctccagatatagaatttgccaagaaagtaaccaatcaagtgagcaaggtaagtaaatagagctgggacaytgccgcctcccttgaagactctgcttaataatttcaaccatcagagagggttactaaaggtgagactgaagataaaacacaaacactaggagtattttta

SEQ ID NO: 26931 - DNA, 201 bp, Homo sapiens
atggattttcctggagatttcacagttcttcaagtaaaccaactctgttcccagcttcctctactcataaaagtaattctggctctatttagacaaattasaaaaagaagtttgtcaaggagaaaggaaaatccaactactccatcatgctggagccaccagaggtgaaacatgctatggaagtggccaagaagcaaagtg

SEQ ID NO: 26932 - DNA, 201 bp, Homo sapiens
gagaggaaacagcggtttgcagacagatggggagagggaacagcatgtacgaggccgtgaagcatctgagggcttcatgtatctggggatctatgaatagytctgcattgttggaaacaggggccaagtctggtggaacaaaagaaccagaggaatcagaaatgaagagagaaaggagggcaagagagaaggatatgcatt

SEQ ID NO: 26933 - DNA, 201 bp, Homo sapiens
tgatcactggtttccctttcaggtttacgtgtctggcgtactaatcctggttcggtttttgactatgatccagcagaagacaacatccagtcccgaagctkacacatgattaatggtgtgttagctgaaaaaggcttacaacataaacatcaccatttagtatgctagagtcaatgactttcatttgggctctgaagttcc

SEQ ID NO: 26934 - DNA, 201 bp, Homo sapiens
gagagttttcaggaatgaaacactgagcagcttcagttgctacagagaagtgttcatggcaatcatgaagttcttggtagtctcaatgagtgtgacttcaytgatgtgggtaggtgggagccaaactatggtcttgagaaattaatcaaaagagaggcaaagaagaaacacaggcaacttggctgagaaaagaagaatgaa

SEQ ID NO: 26935 - DNA, 201 bp, Homo sapiens
cttacaatgcactttataaatccaacttactattaatgtctattttagaaattgtataagcttggcctagaagaagccaagaggaaaggttatgacatgcrggtagatgccattcctatcaaggcagccaaggcctccagagatattgcaagtgaagtaagtatacttggaaagttatttgccttagctttggctcaaaga

SEQ ID NO: 26936 - DNA, 201 bp, Homo sapiens
caggcctatgacctccagagcgatgtgagtactgagagtcataataacgtgcagaggtgggaaattatttaacaccccttggagaaaatggcaatatatgrcacaagctcaccagcccctggaggaggcaaatagcattgcctttatcgacaggaattttaatcctttaacccttcagaccaaagaggaatattgtgtgat

SEQ ID NO: 26937 - DNA, 201 bp, Homo sapiens
tctacaaaatatacgtaaattagccaggcatggtggtgtacaacctgtagtcccacctacttgggaggctgaggtgggaagatcgatggagcctgggaggyggaggttgcagtgagctatgactgtgccttgcagtccagcctgggcaacagagtgaaaccctgtctcaaaacaaacaaacgaatatgtgttagttctatg

SEQ ID NO: 26938 - DNA, 201 bp, Homo sapiens
gtgaccttgaatgcctacagatatttgcacatgaatatgcaaatgcacaaagagtgtccttcctaaaaccacctctgtgaaatatgatccattaggaaatwattttctggtgccattaaattttctttctactttatttgtttgtttatgcatttttttctctttcagatcgcttacaaagccaaaggagaggaaattatt

SEQ ID NO: 26939 - DNA, 201 bp, Homo sapiens
gacctcaagccacagatcctctgctccttctgtctaggttttatacaagcagaactgggaagacaccaaggataagtacctgcttcctcctgatgcccctsaacttgtccaggccgttaagaacaccgccatgttcagcaaggtaagggtctgctccattgccacttctgtcttcctatgtcatcccatcatatatttcat

SEQ ID NO: 26940 - DNA, 201 bp, Homo sapiens
gttttcatgagggagagattagatctgaaaaacagagaggcttgtgagaaggtagaatccggtacagtcaaagaaccaaccttcctggatatatgtatgtsaatctgtttatcctagtcaaacgacctgctgggcataaagacattggagtatacaggaaagggctgcagtctaaataggggcccccatccctgccccaaa

SEQ ID NO: 26941 - DNA, 201 bp, Homo sapiens
aaagccaaaggagaggaaattattcacaattacaacctgccaccagacctgccccagttcatccaggctaaagttaatgcctacaatatcagtgaggtgcrtgggtggactcacgggctgatgcgtatgtccagactttactaacacagtctctaagttgtacttaaatgacatttttctttcagaatatgtacaaagcag

SEQ ID NO: 26942 - DNA, 201 bp, Homo sapiens
gtctctaagttgtacttaaatgacatttttctttcagaatatgtacaaagcagacttgaaagacttgagcaagaagggatatgacctgagaactgatgcgmttcccatcagagctgccaaagctgccaggcaggcggcgagtgacgtaagtccagctgtggtcatacatgggcaactagaaaatgtgggtgggtgggcttg

SEQ ID NO: 26943 - DNA, 201 bp, Homo sapiens
cagaactgggaagacaccaaggataagtacctgcttcctcctgatgcccctgaacttgtccaggccgttaagaacaccgccatgttcagcaaggtaagggyctgctccattgccacttctgtcttcctatgtcatcccatcatatatttcatgtaatacttggtgaactcttgatcatctggaatacaattccccaatctt

SEQ ID NO: 26944 - DNA, 201 bp, Homo sapiens
taagtggttacagaaaatgcataatttagtgcccagttttcaaagtagtaaaaatttttactattttggaaaagacaacataaatattcatggaattttcycccctgttccttgaatgttatatttgagagctagattgtttttatgagtttcccccaaatagcccacatgtggctgctatctaaaggatttacggtcatt

SEQ ID NO: 26945 - DNA, 201 bp, Homo sapiens
gcaggagaatcttttgaacccagggggcggaggttgcagtgagctgagattgcaccactgcactccagcttgggcaacaggagcaaaactccgtttcaaawaataataataataataataataataataataattttggccaggcacagtggctcatgcctgtaatcccagcactttaggaggtcatggcaggcagatggc

SEQ ID NO: 26946 - DNA, 201 bp, Homo sapiens
ctgatgcgattcccatcagagctgccaaagctgccaggcaggcggcgagtgacgtaagtccagctgtggtcatacatgggcaactagaaaatgtgggtggrtgggcttggggtctgacgatgacccaaaagtctccatgcatgcagtccccaattggaagcaaatctgattgaaaactatttaggaaataaagttccctaa

SEQ ID NO: 26947 - DNA, 201 bp, Homo sapiens
caagcaatctattcattaagtacaagtctactgcaggcctactatatttgaggcaccaaagctagatgcaacaaaatggttagatttttctcattggtaartttatttattaatgcattttaggcatgcactaagtggttacagaaaatgcataatttagtgcccagttttcaaagtagtaaaaatttttactattttgga

SEQ ID NO: 26948 - DNA, 201 bp, Homo sapiens
ggatttacttctaatggaatctatggtctgatcttgccatgaaccaaaattatacacaccaatttgatggtgtctccaacttttgaggtctaatttttaaygccaccctcttcatatcacctgcaagtttagtggacatctttttctatttcactttctatgtaattggttaaaatataacacagatacagtcgtatcctt

SEQ ID NO: 26949 - DNA, 201 bp, Homo sapiens
aaaggtcactggatttggccatggtgacattatttattcccagtcttaacccagatttctgagttcttaatgactattgtgcatccaaaataatagttgtrttagggagaaatgcttgtgattggtagaagtccacccaacaacaaaccatccaacaagggaggcacagggctgccaagagtgacttacctttggtactat

SEQ ID NO: 26950 - DNA, 201 bp, Homo sapiens
aggctgattcatacgttgtccagaagtacccctagcactcccgtgggcatgtccaggaaataattccaaatgctcagtcattagagtctatgtgctcactrcctgtctctctctgctgcctggagagaatcacaagcacttgcaaagaggacaggatgtgacctttcagactgcctgtctgcacatgataatctctgctag

SEQ ID NO: 26951 - DNA, 201 bp, Homo sapiens
ggtggagaagggaccagcatcttctctttctatgttttaggctattttggatatattaacaagcacttaattgtcattttaggaaagtgtgatttgttagygtttgcaatgctatagacaagctctatttgtaaagagaggattttccacgcaaattaaatactgtaatgaggatttcagtaagaaagcttaaactttcct

SEQ ID NO: 26952 - DNA, 201 bp, Homo sapiens; identical to SEQ ID NO: 5310

SEQ ID NO: 26953 - DNA, 201 bp, Homo sapiens
aaacaatataccaaaggtcagtattactgaaaatgtcttttaaataattgttttaatactttattattttatatacctcaaggggtagtgcttctgtttgwtccacttgtatagatactaacttattgctgtttggagatggcttcttagaactctttgatgttcttcttctcccaggtaaaatataaagaagacttgact

SEQ ID NO: 26954 - DNA, 201 bp, Homo sapiens
ctccttattaatatgtctctgggtggtttctcctattaaagctgatatgacagccaatataaagtgggattattttaatccacaaataatgtatgacgtgrggcaaaccacctagtttttatagcctcattttcctatttacaacataaagcaattcaattcacttgcatttgggttgtacaataggatccagcaaacttt

SEQ ID NO: 26955 - DNA, 201 bp, Homo sapiens
atgttatgggccagattcattctagggcatattcttctttgtttgttacaatactgtggaatggtgaaacccattctaattcatgaagctgtttaaaaacwggtggcatgctagctgggtcataccccacacctgctcttagaagattatgattatctgattaattactggaaaactcttcaaattaatgtactaaaaacc

SEQ ID NO: 26956 - DNA, 201 bp, Homo sapiens
cttattcatctataaaatgaggagagtaataagaacttttctatctacctcacaagggagagttgtattcagttacatcaataaatatgaaaaattagtckgaactatagagctctatacaaatataatttttaattatattttataattatacaaaaataatatagcatattgacactagatcgatttttagtcaaagga

SEQ ID NO: 26957 - DNA, 201 bp, Homo sapiens
gaagaattactgccagtagcttcctatgaatacaatcttgatatattttgtttctatttttctatttcatgaagaatttccaggtctcctttataatccartaaattaatagcattagaagactattacaaatttcccgtggatgttttagcatcagttatgctttgagattctcacagccttagttggtaaagctgtagc

SEQ ID NO: 26958 - DNA, 201 bp, Homo sapiens
ttggctgagggcccatggctgtcatgatgcctctacttctgctggcctcacttagcacagatgcaccctgaattatcccaagccatttattggaaatgcarcttcacacacgcactactgaggtgtggtgatagtattgtcttccttctgctatgtttcactgcagaagatataacatcaccatgtgttcctttgaaaata

SEQ ID NO: 26959 - DNA, 201 bp, Homo sapiens
gattagtcagtagatgccctcgtcgtcccctactaaatgcctgtaatgatatttcctccaacgtagagactgtatcgggaattgtaccacaaactgaaagwcaagatccatacaactcccgatacccctgagatccgccaagtcaagaagacacaagaggctgtcagtgaggtgggtattttcttaggaaagacagggagt

SEQ ID NO: 26960 - DNA, 201 bp, Homo sapiens
agttcctgatactcctgatcttttaagagccaagcgagggcagaagcttcagagtcaggtaagctcagaggttcataagcctgccactcaggcatcacagrgggtgattatatgtgcctggcctcacctggccagtggcagactcacacacttggttgtcctggctgcaacctcatgcccattaacactgcacttgaagaa

SEQ ID NO: 26961 - DNA, 201 bp, Homo sapiens
gctctcaacatgaataaggtgagtcctagctgccttaagcttctccaagatgccagaagatgttattatactttaatgactaatggagtctaaattatctrtgaaggcgtggggtcgcatttttaccttttaaattacatgcttgaaatcctctaaataattttgattattccaagtttcaatcttgataactagtaataa

SEQ ID NO: 26962 - DNA, 201 bp, Homo sapiens
ggtctcctttataatccaataaattaatagcattagaagactattacaaatttcccgtggatgttttagcatcagttatgctttgagattctcacagcctyagttggtaaagctgtagctgatcagtaccctattttaaatataccgttagatgccataaaacctaatgttgttaatggcatcatatgcaaagatggaaaa

SEQ ID NO: 26963 - DNA, 201 bp, Homo sapiens
aaaccacaacttgctagagataaggaaaaaacccttttgaatatttcccaaaatttgcaagtatcacatcttttattgagtttagtattgtcaacgctgcygttctactggtttgagggtgtaataaaaatatgtaggatatccagcagagctaaagaaatgccccttttcctgcccctgaagctgaaatacaaagagaaa

SEQ ID NO: 26964 - DNA, 201 bp, Homo sapiens
ctattttcttaaggattttttctccttctattttaacacacaagacttgttggtattaaagataataagatgcttgttttatttaaaaaaataggaaaatkcctttgatgatttttaacactagaaaatcatgggtgattgtgctaaaaataactctttaaagcaaacaattaatagattttcctttttgcactatgtgaa

SEQ ID NO: 26965 - DNA, 201 bp, Homo sapiens
aattaatagattttcctttttgcactatgtgaaatgcattttattgcagatcttatacaaggctaaaggagaagatgtgaaacataaatacaccatgagtmctgatcttcctcagtttctccaggccaagtgcaatgcttacaatataagtgacgtaagtagggtctttgctgggatgtgaaattcggacctgacaataaa

SEQ ID NO: 26966 - DNA, 201 bp, Homo sapiens
gatgtgaaacataaatacaccatgagtcctgatcttcctcagtttctccaggccaagtgcaatgcttacaatataagtgacgtaagtagggtctttgctgkgatgtgaaattcggacctgacaataaaattatagactttaagagtaggatggtgccttgacaatttatttaggcccatttctcacaaatcccctactgga

SEQ ID NO: 26967 - DNA, 201 bp, Homo sapiens
acatgaataaggtgagtcctagctgccttaagcttctccaagatgccagaagatgttattatactttaatgactaatggagtctaaattatctatgaaggygtggggtcgcatttttaccttttaaattacatgcttgaaatcctctaaataattttgattattccaagtttcaatcttgataactagtaataagactcac

SEQ ID NO: 26968 - DNA, 201 bp, Homo sapiens
ctgattttaaaaactacttttatgatttaaaataatacatattaatcctactttttaaagacaacttaaattttgtgaaatttctttagcaaatttacccytttttcctttgggctacttctagcctaaccccataataacaaggttgctttaatccataaagttctaatatcaagaagtaacagattttcctataaaaca

SEQ ID NO: 26969 - DNA, 201 bp, Homo sapiens
ataataggttaatatatcactatatattaatgttcattgatatatcccatttatttctaacgctatatagtatttttggtagaatataatttatttgcttkccactattgccagaaacttgaattgtctccagttcctatccttttttaaattttaggatataagtcacttaataatctctgaattgttgatgtcaaacct

SEQ ID NO: 26970 - DNA, 201 bp, Homo sapiens
ttttatgatttaaaataatacatattaatcctactttttaaagacaacttaaattttgtgaaatttctttagcaaatttacccttttttcctttgggctayttctagcctaaccccataataacaaggttgctttaatccataaagttctaatatcaagaagtaacagattttcctataaaacatccttttgcttctctct

SEQ ID NO: 26971 - DNA, 201 bp, Homo sapiens
tattaatgttcattgatatatcccatttatttctaacgctatatagtatttttggtagaatataatttatttgctttccactattgccagaaacttgaatkgtctccagttcctatccttttttaaattttaggatataagtcacttaataatctctgaattgttgatgtcaaaccttttgctttaactctttgcctttct

SEQ ID NO: 26972 - DNA, 201 bp, Homo sapiens
aattttgtgaaatttctttagcaaatttacccttttttcctttgggctacttctagcctaaccccataataacaaggttgctttaatccataaagttctamtatcaagaagtaacagattttcctataaaacatccttttgcttctctctctccaaacttactctctatccactacccccaaggtctctttgttttagata

SEQ ID NO: 26973 - DNA, 201 bp, Homo sapiens
gtctggaaaagaacaaaacaatcccagcagttgaggaatcacttacagatgctgacattctgtttgcttttctgtccaggtctgttataaacgggattggyatgacttaatagccaagggcaacaatgtgctgggcgatgctattcccatcactgcagccaaggcatcgagaaacattgccagtgatgtgagtacaaattt

SEQ ID NO: 26974 - DNA, 201 bp, Homo sapiens
cagctgcaaagatggcccaggatgtcgctaccaatgtcaactacaaacagccattgcatcattacacatacctacctgacgccatgagtcttgagcatacsaggaatgtcaatcaaattcagagtgatgtaagtatgtgtaacaacagacccagagatgtttgcacttaaaggatgatcacttctcgcttttattagactt

SEQ ID NO: 26975 - DNA, 201 bp, Homo sapiens
acttccatggaacatttgtgttttgtcttctgtgcatgtctgtcctgccacagaaattgaacagtggtggtgctttctcaattcacagaagaagtcaaaamagttttgcagttttgactcctaaatctttggtacctgctaccctcatgtcctcgaacaacttgcagcagttgatgaaataatagggagcaaatcaacatt

SEQ ID NO: 26976 - DNA, 201 bp, Homo sapiens
gatcagcaacacccatctctactaaagaatacaaaaattagctgggcatggtggcacacacctgtaatcccagctactcgggtggctgaggcacgagaatygcttgaacctgggaggcagtgagccgagattgtgccactgcactccagcctgggcgacagagtgagactgtctcaaaaaacaaaaaacaacaataaaaaa

SEQ ID NO: 26977 - DNA, 201 bp, Homo sapiens
tggggagaaaatatagtatcttttcctcacccatggcaaggttcatggcgaaaacccctgtaacaaaagacagattaacaagagagacacacaatttattyaataaaagcttcagaaatgactacccaaagaaacagggaaatatgtgtatttttatggatagagatgcggaagtgtgattggacaaagaggggtatgatc

SEQ ID NO: 26978 - DNA, 201 bp, Homo sapiens
agtatgctctgataatcatttgatgttaacatttttccaggcatttctgccagaaccaacattttcaaaagggcaatgatcctgaaatcccaggtccatakatgaatcattgtccgagataatagtccacagcaaaataagaaaaaataagcacaatgcattgagtttttcataaaacagaatagagtacattttaaaata

SEQ ID NO: 26979 - DNA, 201 bp, Homo sapiens
aggcacatcttcacatggtggagcaggagagagagagcaaagggggaagtgctacacacttttaagcacctggatctcatgagaattcactcactatcacragaacagcaagggggaagtccaatcacctcccaccaggcccctcctccaacattgaggattacaattcaacatgagatctggatgaagatgcagagccaa

SEQ ID NO: 26980 - DNA, 201 bp, Homo sapiens
taagtcattaaaaatattaaaaaatattaaatgcatctgtagcatatttaaaatccagatactagtccggtatccttaattcaatctaatttgagaatggrgtataaaaatgaagtttaattatttgtatcacactttttagggattttccttatgtttaagattttgtctttacacaggctcagcaatgaaaagtacact

SEQ ID NO: 26981 - DNA, 201 bp, Homo sapiens
tgcacctttccagggcagagagagtaaaggggcagaaaaggcctcagttaaaataactgagctttgtctatagaaagaaaaccttaggcataaggaagaaktgttctctatcaacaacattgattactgacttttttaaaagtaaaatgcaattttatagacacgtggtttattaatatgatacaaccaaaatttagaaag

SEQ ID NO: 26982 - DNA, 201 bp, Homo sapiens
cccccgagatgagacgggtgagggagacccaacggcacatctcaacggtgagtcaggaattctttaggattggctggctgcctgtcagaatgtgtaaaaarggatatagtcacaccatcatattttcataaagcaaattcatgacatttcaggtgaaatatcatgaagactttgagaaacacaagggttgcttcacaccag

SEQ ID NO: 26983 - DNA, 201 bp, Homo sapiens
attacattttatgggattccactggcaaactgaagtcacaatgtcttttctgttcgtggtgatttccagtgagtcagtgggactgagtagtattttagacwcttcagaggattgtcagataaaatactggcccattatttctgccaaaatattcatgcccactaattccatccctaccaattagatacatcagtaaatcac

SEQ ID NO: 26984 - DNA, 201 bp, Homo sapiens
gagatgagacgggtgagggagacccaacggcacatctcaacggtgagtcaggaattctttaggattggctggctgcctgtcagaatgtgtaaaaagggatwtagtcacaccatcatattttcataaagcaaattcatgacatttcaggtgaaatatcatgaagactttgagaaacacaagggttgcttcacaccagtggtg

SEQ ID NO: 26985 - DNA, 201 bp, Homo sapiens; identical to SEQ ID NO: 5291

SEQ ID NO: 26986 - DNA, 201 bp, Homo sapiens
cctgttctgactttgctgtcttgctgcgtactctaggcggaatacctcaaaggccaaaggagagggcacggcgctgcatcttatgacacccctatgatgargcatcttaagaaaattaatgtacacatcagtgatgtaagaaagactgagaccagcaagccattatttctgtcttcctctgattcttgtctactttcttgg

SEQ ID NO: 26987 - DNA, 201 bp, Homo sapiens
gggaattgaggctggatatgaagaaagatcaggagcagtgatggattgattggtttgcctactgactgcatttctgagtaactttcaatcaaatttttttwaaaaaaatctgctgcttttgtaccattttggccatcagcaactcctcactcacattcacatagaaaagtatcagctgatggaaaataataattggcttgg

SEQ ID NO: 26988 - DNA, 201 bp, Homo sapiens
caggcagaatggggagtctgtattctctgttccttgcagtccgttgttatacatatcatcataaggtggcttatattgctcttcccagtgtggacaggcaytctttgcaggcagaggcaattcttattgaatctacagtgcttatctagaatcgtgcctgacacatagtagacactcaatgaaattttggatcagtgagca

SEQ ID NO: 26989 - DNA, 201 bp, Homo sapiens
ggagaaggtcaagaaagcaggcgatgcattaaatgagaggaagtatcgacagcacccagataccgtcaagttcacaagtgtgcctgattccatgggcatgrtgttggctcagcataacacaaagcagctaagtgatgtgagtgctttcctttcaaaatgatttgcccgtaaataaccacacgtgtctgagccgctcctccg

SEQ ID NO: 26990 - DNA, 201 bp, Homo sapiens
tagttggctttttatgccatttaccctaccttgaatatacatattattgtattaaaaaataggcagatagaaaggtagatagattagacagacagatagayagacagacacaaaaatatcttcatttcaggagggaaaaaatatctcaagtcaactattaatgactaaaacataattttcattaaaaataattcttgctat

SEQ ID NO: 26991 - DNA, 201 bp, Homo sapiens
atatgtttaagtttgttatagattgtttttcaaacacagttatgttacttgtaagaacattcagccactgaagcaccaacgaagcattctgctcaaaaacaaaaaaaaagacgccacagtggtagtttactcttctaaaataaatccaggctttcatatttagaagaaaactcttccctttgcctctctttacagaaactc

SEQ ID NO: 26992 - DNA, 201 bp, Homo sapiens
gcaagacaaaataaaataaattatagtgaggtaagatcatttgttttatttctttggtctggccacattgattgttgccgatgtaggaatgtgagaattaygaaattaatcctcatgtaagccagttagcttagttggctttttatgccatttaccctaccttgaatatacatattattgtattaaaaaataggcagatag

SEQ ID NO: 26993 - DNA, 201 bp, Homo sapiens
catctgctctaaatatcacactacatttactgtagccattaactatttttaagctttcttcttgagaggtgttctcactaatagtaatagattaaacatarcatttccccccaacttgcaatataattaatagtgattattacctcgtagtgactttcgggcatgactttgtatctcacaggtgttatacaaagagaacct

SEQ ID NO: 26994 - DNA, 201 bp, Homo sapiens
gggcatcggatggatccctattggttccctggaggtggagaaggtcaagaaagcaggcgatgcattaaatgagaggaagtatcgacagcacccagataccrtcaagttcacaagtgtgcctgattccatgggcatgatgttggctcagcataacacaaagcagctaagtgatgtgagtgctttcctttcaaaatgatttgc

SEQ ID NO: 26995 - DNA, 201 bp, Homo sapiens
tatgtttaagtttgttatagattgtttttcaaacacagttatgttacttgtaagaacattcagccactgaagcaccaacgaagcattctgctcaaaaacaaaaaaaaagacgccacagtggtagtttactcttctaaaataaatccaggctttcatatttagaagaaaactcttccctttgcctctctttacagaaactct

SEQ ID NO: 26996 - DNA, 201 bp, Homo sapiens
acgtgtctggcgtactaatcctggttcggtttttgactatgatccagcagaagacaacatccagtcccgaagcttacacatgattaatggtgtgttagctraaaaaggcttacaacataaacatcaccatttagtatgctagagtcaatgactttcatttgggctctgaagttccttccctccagagttttccattttctg

SEQ ID NO: 26997 - DNA, 201 bp, Homo sapiens
atgtaagtggatgttttggaaaagccatttcttattcaaagatgttgacaaatagaagcttttagagtttttcttgctagaaatttagttacccctataartctcaattccctttagtgattttcccctatacaaaattgtaaatggaaaaaaagaaaagcacaaaattctagacccattatacccatcaatcaatcaaaa

SEQ ID NO: 26998 - DNA, 201 bp, Homo sapiens
attcaatcctttggtggttgttaaaattcatgccttggttttcaagttattggaaaactccaagaacacttgttctgatcactggtttccctttcaggttyacgtgtctggcgtactaatcctggttcggtttttgactatgatccagcagaagacaacatccagtcccgaagcttacacatgattaatggtgtgttagct

SEQ ID NO: 26999 - DNA, 201 bp, Homo sapiens
ctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaaggtgagtctccagctgttttctgtt

SEQ ID NO: 27000 - DNA, 201 bp, Homo sapiens
ataaagacgagtataacagcttcttgaagggcatcggatggatccctattggttccctggaggtggagaaggtcaagaaagcaggcgatgcattaaatgasaggaagtatcgacagcacccagataccgtcaagttcacaagtgtgcctgattccatgggcatgatgttggctcagcataacacaaagcagctaagtgatg

SEQ ID NO: 27001 - DNA, 201 bp, Homo sapiens
ttacactgtgtgtctcataattgaaacttttctcatcagtaaatgactgacagaataatttctcagggcagcattaagagaaatgttctgtttttttgcctttttttttttcatcttctgtgttctttttacctactaaaggcctctttagcactaacagcaaagtacatgcataagtcagtgtgatgcatcatcacaaaa

SEQ ID NO: 27002 - DNA, 201 bp, Homo sapiens
ataaaaactttattaataacaaaaattttattaagtaatacagtattgtcttggtttgcttattaattttaagcaaaaactctaataaaagggaataatayagattttatatcaaatttgagtaacttacgtgaaaagattccagaaatctttgccctaacatgaaagggttttggatcaaatccaaaagaaaatttaaaa

SEQ ID NO: 27003 - DNA, 201 bp, Homo sapiens
agccaaagtcaacgccctcaacatgagtgatgtgagtatttggcccagtgctaatattgcgtatgcgggcctctcctttctggttctttgcaactcttgcyctgagaattgtagggggcgcaattcagtgtggaccctgagcctccacattaaacccttaaccatgcaacatgagcctagggggcggcaataaaattttgc

SEQ ID NO: 27004 - DNA, 201 bp, Homo sapiens
agaagacaacatccagtcccgaagcttacacatgattaatggtgtgttagctgaaaaaggcttacaacataaacatcaccatttagtatgctagagtcaakgactttcatttgggctctgaagttccttccctccagagttttccattttctgagctgcccatttggcataaaaataccttgttaactagtgagcaaaact

SEQ ID NO: 27005 - DNA, 201 bp, Homo sapiens
gtcctttaggctgaaaacttaatgttaagagttaaggaggctcagagagtggaggttccttaatgttttcattaaaatgcatagtccttagatactactaytaaaaaatatggacttctcccaattcagaaaacactagtttacttgatccagcaattagcagtaaaaatttcaggtaaagatgctcttcctgaaaaataa

SEQ ID NO: 27006 - DNA, 201 bp, Homo sapiens
aattttattgccctgaatcttggacagagttacagctgttgaagatctcagggcttcaggggttctacagcactgttatattttaactgtgtttttaaagscattacagatattttgaaatgtatagaagaatacatcgcagggaataagaatccaaaacaatccaaccactagaaaaacccactcttattcatgtaattt

SEQ ID NO: 27007 - DNA, 201 bp, Homo sapiens
aatctattatttattttcccattgcacttagtcttgtgtattagaagtaccatgttattcaaggcaaatagcgtttattcagctggtgcttttgagctccygtgatgtgccgggctctttaggaggcaatgaggggctaaagctcaatgagacaagccttcaggagatcgtgcaagtgaggggaacagacttaaattgata

SEQ ID NO: 27008 - DNA, 201 bp, Homo sapiens
tacactgtgtgtctcataattgaaacttttctcatcagtaaatgactgacagaataatttctcagggcagcattaagagaaatgttctgtttttttgcctttttttttttcatcttctgtgttctttttacctactaaaggcctctttagcactaacagcaaagtacatgcataagtcagtgtgatgcatcatcacaaaat

SEQ ID NO: 27009 - DNA, 201 bp, Homo sapiens
gccacaactgtatgctttgtggagcaggttctgtgtctgtttatctctgtgttcattgtgcttgataccaagcaggaaatcaatagaaaattgttgaaaawaaattgcatcaaacagccaggtgtgatgacatgcacctgtagtcccagctactcaggaagctgaggcaggaggatcccttgagctctgaagtttgaatcc

SEQ ID NO: 27010 - DNA, 201 bp, Homo sapiens
ggtttggaaaaattactcttctattttctgttcacatctaccagtatctgtacaaaactgcttatgagaaacagaaaggccattacattggctgtcgcagygccaaggaagaccctaaactggtttgggcagcaaatgtgttgaagatgcagaatgacaggctgtacaaaaaggcctacaacgaccacaaagccaagatct

SEQ ID NO: 27011 - DNA, 201 bp, Homo sapiens
gaccccctacattgcacacagtcagaaaatgcaggatctttttagcccagtaagtttcaaacaacttctgctaacctggcttgattattaagaaattactkatctcaactcactctgttttggatgctggctggatttgtttctcaaacctgtatgaaacaaaaacttattttgcaaattataggctcttgtgactgttga

SEQ ID NO: 27012 - DNA, 201 bp, Homo sapiens
attccattattccatttttaatgatctccagggcaggtctcaagatgagccattaaaaatattttgctaattgtttattttaaaatacaaaaaaaaacttygatgttacctagattcagactgaagttggcttttgcttaatttgttgtataaattcagtttatatcagacttctatgctagccaacttctgtttgccctt

SEQ ID NO: 27013 - DNA, 201 bp, Homo sapiens
ccgatgccttgaatgtggagcactccaggaatgccatgcagattcagagtgatgtatgtactggttaccaagttgttatccatttctaatgggtgggaggraaaaacaggagccacttactccatcccacacctggctgcactcactgtaattaaggattccctccagaactcagagttttaggatttcactcatttgaac

SEQ ID NO: 27014 - DNA, 201 bp, Homo sapiens
aacaaaacacaaaccctgcttctacctgtgttttctttttcaggccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacac

SEQ ID NO: 27015 - DNA, 201 bp, Homo sapiens; identical to SEQ ID NO: 5338

SEQ ID NO: 27016 - DNA, 201 bp, Homo sapiens
cagtggacctgcatgcccgaccagaacgatgtgattcaggccaagaaggcctacgaactgcagagcgatgtgagtgggctgcatttggggttgaactcttwtctcagtttgccatgacttccagagagtttatgacactaaccccttctgtcatcattttacgacttcatatcaccaagaatttaatattagtgagacctt

SEQ ID NO: 27017 - DNA, 201 bp, Homo sapiens
aacagaacagtcttataattcatgacattccgtgttcgattgtcaggtttttttctttttgttttgttttgttttgttttgttttgagacggagtctcgcrttgtcgcccgggctggagtgcaatggcgccatctcggctcactgcaacctccgcctcccgggttcaagcaattctcctgcctcagcctcccaagtagctg

SEQ ID NO: 27018 - DNA, 201 bp, Homo sapiens
atttttataattaatttcttctgaaagactgtagggagtaaaaagcagattattctccccctcccagcttctctttttctttttgattgtaagtaaatcayatagccaaagaaacacaagccctgactctttctgaaatgaaattttttttctcattgtaaagaatctgtacaaatctgacttcaccaattggatgaaagg

SEQ ID NO: 27019 - DNA, 201 bp, Homo sapiens
ttgactgtagaatctggtgaaataatgtcagttgccttttgcttcctttatgtagcttcactcttaccatcaatatctacatgtgaatcttaaactctgayttttaaaatgacccagtatttattggctttccaattctggcaattatggcaaatgtgggttttgctacaggacatgtaatctagccatatcagatattac

SEQ ID NO: 27020 - DNA, 201 bp, Homo sapiens
ggtcactaaagagagcataaacttcgaagccaaacacacttggttctaaccctggccttggctatgctggagaaagcaggattacatcacttagaaggctrttacagcatccacgtgtaagacggtgttttggaccaggagggtagcagggcaggtgataagaagtcttttgaaagcacagctgacttgatttgctgatgg

SEQ ID NO: 27021 - DNA, 201 bp, Homo sapiens; identical to SEQ ID NO: 5290

SEQ ID NO: 27022 - DNA, 201 bp, Homo sapiens
tttcttttgctgtgcagaagttctttagtttaattagattccaatggcctttgttgccattgcttttggtgtttcagtcatgaagtgtttgcccatgcctrtgtcctgaaaggtattgcctaggttttcttctggggtttttatggttttaggtcttatgtgtacatttttagtccatcttgagttaatttttgtatgagg

SEQ ID NO: 27023 - DNA, 201 bp, Homo sapiens
aggtgggaggttcatctgaaccctaggaagtcaaggctgcagtgagccgtgattgtgccactgtactccagcctaggcaacaggagtgagaccctgtttcaaaaaaaaaaaaaaaaaaaaggaagaaagaaatcttattttgatacttattcaaaacaagccatttcatgaatagaaatccaggccttctgattttttttt

SEQ ID NO: 27024 - DNA, 201 bp, Homo sapiens
catctggaacataccacttggaataggaaggtagactagactcagagatggactcctaatgtatgtgtatgttaggttgctgacactgatcaagttaaatratgaaatgaaaacaaactgagaatctcatcttcaaccaaagaaacctctgcctcttctgaagttatctgccatttttgatttttaatatactgaagattg

SEQ ID NO: 27025 - DNA, 201 bp, Homo sapiens
attaactttattaagatattaatgagaatgacttccattttggaagaaatcaaacaccccatttgaatgctaaccaaactatacagcattttctttacaartgtatcaccattactgtaatcttgattaaacccacaatttaaaactgctgccgttatttagaaagcacaactttagcagaatatttgtatgtgattttat

SEQ ID NO: 27026 - DNA, 201 bp, Homo sapiens
taaggatattgagatgtgtatacataggaaccctcattctctgttagtgaaacataaaatagtgtaaggattttgactggcaacttgacaatatctatcarttttcaaaatgtgcatatatcttctgcctcagtatttctatttctagaaatttaccttacagatacatttcatataagtatacaaaggtaatgtacaggg

SEQ ID NO: 27027 - DNA, 201 bp, Homo sapiens
gctctcaaaaaaccaagttggagtaaaggcaggttttaattcgtcttctaaaactgctttcttccccacttcccaaccccgatgttcaaagggacagagaygaagagaaagttctgaaaatggaactctgtctcttagtatctgtatagcaatagaagaaaagatctactccttattctttgcttcaactagctaatcatc

SEQ ID NO: 27028 - DNA, 201 bp, Homo sapiens
attgtgtacctttgccactggaaattgtccttagtgctagacttgattgattcaactagatgtcataaaaaaggaggtggctatttttagacatcccatcsctaccattttgttcccattacagcatctgggtctgaccagcaggtgataaacgaatagactgcctgccagaaagtattgaactgagatctctttgacctc

SEQ ID NO: 27029 - DNA, 201 bp, Homo sapiens
gatcttggacatctgaaataaagttttactgttctctctactctaacttaaacttgaaaagaaagagagagaagcaaggatgcactatctaattagtggcrcagctctaaaaaaagagtgagatttggcatacaagttaatgccaaccatttaaataatgttgcctcttttataagcgtatttctaagatggatttaccaa

SEQ ID NO: 27030 - DNA, 201 bp, Homo sapiens
aaggactatgatctgagagcagatgctatttccatcaaaagtgccaaggcctccagggacatcgccagtgacgtgagtaccttccatctaactctctgtgrtctccactgtgctgaacaacccagagggtggctggtgaaccacacactctatagtgatttccacatgtaccttccagtcctacttcctacctctcaagac

SEQ ID NO: 27031 - DNA, 201 bp, Homo sapiens
tagtggaaattttggttggcctccagtcaatgaagagcattgctggaattctgacacaaatatatactcccatctctcttttgttacagaggtgcaaatcrctgagttttggaagaactgttattttattattgtgtgctatgagattggatcttagtctctgtcttaacctggtttatataatcatggaacactaattaa

SEQ ID NO: 27032 - DNA, 201 bp, Homo sapiens
catattagcaccactctgtttaggacaatcacactattgaaagggactcacccatcactccagaagaaacttattacttactaatcaggagggtataggartaattgagatgtggatatactttgggatcttattatttccatgatgcaatccatttaaaaatgtattcacactcgagtttctgttttagtttattgttag

SEQ ID NO: 27033 - DNA, 201 bp, Homo sapiens
ttgtgattggcatagggacaagcagttttactgtgtggagttataacttgtaggacaccatctctgccaccagggatggtgtctccagggcttcgtccctratgatgcattgaaatgctactcagattttagcacattagcaattctaaataacctattaccataaatattccacgttcaagctctttttttttcaaggtg

SEQ ID NO: 27034 - DNA, 201 bp, Homo sapiens
gtttggaaaaattactcttctattttctgttcacatctaccagtatctgtacaaaactgcttatgagaaacagaaaggccattacattggctgtcgcagcrccaaggaagaccctaaactggtttgggcagcaaatgtgttgaagatgcagaatgacaggctgtacaaaaaggcctacaacgaccacaaagccaagatctc

SEQ ID NO: 27035 - DNA, 201 bp, Homo sapiens
acctactacgtagataggactgttgtgaggataattaccccattatgttgtcatcattattcttgtccacctaagcatttattagtgtaaatggcactccrgttcacattaattaactgactaagccaagggaatgaaaatctcttataatattgatgcgattcatttttttaaagttcattattctttgtctcctactac

SEQ ID NO: 27036 - DNA, 201 bp, Homo sapiens; identical to SEQ ID NO: 5539

SEQ ID NO: 27037 - DNA, 201 bp, Homo sapiens
tgtataaactggggtgtcatcaacatacagagagtgtttcatgccatgagtctggagagcatcaagggagtgagtgtaaacagaaaactttaggggctgarctctggggtccttccatgggaacatatatgtaagatgagggagaagcaaaatcaggagagggcaatgcgttgggaagcaagtgaagggggaagggagtca

SEQ ID NO: 27038 - DNA, 201 bp, Homo sapiens
gaaatcataaatacagatttaatttaggccagttcacagaagctacttaacatatttaaacaatgtcagcagaatagcttcttagtagactagctaacagyatataaaaaggtatgtaaagaggtgtatagtgaagaagaacatttattttaaaaatccaagatcagactaagaactcatttgaaattgaggatctgaatg

SEQ ID NO: 27039 - DNA, 201 bp, Homo sapiens
tttgaaagcacagctgacttgatttgctgatggattggatgacacgggttttggtctaagcagttagatgaatggggtttccctttattgagacagggaakactatggaagaagttggtaatttttttggaggacagacaagagctcatcttcagatatggtagatttgagatgccttttagacatccacatggaagtgtc

SEQ ID NO: 27040 - DNA, 201 bp, Homo sapiens
aaagccaagatctccatccctgtggacatggtgtccatcagcgctgccaaagaaggtcaggcactggcaagtgatgtggactatcgccattacctgcaccrctggtcttgctttcccgaccagaatgatgtgatccaagccaggaaagcctacgacctacagagcgacgtaagtgtgtcccccaggaaacaagtcccccat

SEQ ID NO: 27041 - DNA, 201 bp, Homo sapiens
ttatggtaagaccctcttactgactgcaaagtgagattagtacaagttaaagggactctttttaattattctttgcctgaggagccaaattgtacagttaygaaattgattaatttagcatctcctcactggaaaacataagtctattgtttttcttttctcttaagttccctgctcctggcccttaagagatctttcttg

SEQ ID NO: 27042 - DNA, 201 bp, Homo sapiens
tgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaaggtaaggactcacctgccagcctcgcccagggaaccctcatggt

SEQ ID NO: 27043 - DNA, 201 bp, Homo sapiens
ggcccaattgccccttcccaatcctaaggtttttctcctttgacaacaagcaagaggtagggccatgtctctccaaaaaatgatgcattaggagatcctarcctgaggtatgtgtacatcaagaacctctgaagttataactgtttgtgagcattttatagctttctcagtttcttgaagaggtctgtctccaaaaaaaag

SEQ ID NO: 27044 - DNA, 201 bp, Homo sapiens
gtactttgttctcttttaccattttcatcaccataatttcttctctgtccacagtacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaag

SEQ ID NO: 27045 - DNA, 201 bp, Homo sapiens
ttaaaaaactaatctttcagtgacatattgttacacagcatgaggataccaggcccaggccctctaaaaccatggagattcttccatcacatagaattggraagatttccattgatttcaccagaagagatttgattgagtcaagcaggcagtgttaggcccactgtggacaataaaaataccagctgggttctttatacc

SEQ ID NO: 27046 - DNA, 201 bp, Homo sapiens
tcttcagtgaggtattccaagattttaccctgacattcagtacatttcccaagaaagtgacaaaatgcacaagctaaaatatagtcatctaatatcagcartcttaaccatttcaattgctgtgatttaaactgagcatatatatttttcaaaatgtactgtcgctatcacattatgggaccacatccataatataatatc

SEQ ID NO: 27047 - DNA, 201 bp, Homo sapiens
atggatgtgtcatcctgaccagaacgatgttattcaggcaagaaaggcctatgacctacagagtgatgtaagtgatttttgtttcttcattatctagaaaygcatggtacactctgagaatgatgagcaacatcccagatccacaagtgcttgaaatttgaggccatcgatatttaatttgttcccaaagggaattgaggc

SEQ ID NO: 27048 - DNA, 201 bp, Homo sapiens
aaggcctatgacctacagagtgatgtaagtgatttttgtttcttcattatctagaaacgcatggtacactctgagaatgatgagcaacatcccagatccayaagtgcttgaaatttgaggccatcgatatttaatttgttcccaaagggaattgaggctggatatgaagaaagatcaggagcagtgatggattgattggtt

SEQ ID NO: 27049 - DNA, 201 bp, Homo sapiens
ccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgatgtacgtgaaaaccacatttgcagagcgtttactctggataataagcaac

SEQ ID NO: 27050 - DNA, 201 bp, Homo sapiens
tggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaagtaagtctttcaataatgcagtgtttcatatgcat

SEQ ID NO: 27051 - DNA, 201 bp, Homo sapiens
gtttagactactatattaaatatttatagatcttcaaacttcaatgacttacactttaacggctacttgcaaagagcaatatgtaaagcctggcacataayatacttattaactggacatcagaaagcacgaaacccaatttgttttacagatcaaactatcaataaattttgataaatttttaaaacctattacttaact

SEQ ID NO: 27052 - DNA, 201 bp, Homo sapiens
gtagatttgttcattgcccagtcagtgcctctgaggacagtcccctgggctgtgcactgcacaaacctgggggtggggctgggggtaccattcacattgtktaatataaaatccatctttagtagtaacttctggcaatgaaaacatatttcagacaaatataaatcatctgaatgtttttaaaataattgttgctattat

SEQ ID NO: 27053 - DNA, 201 bp, Homo sapiens
gcctgaacattttctatttaccaatgcatatgacactgactgtgcacatgtaaagaagctacatattatttcagctataatgctttattttttaaaaattycccttggtgttaatctatagaaaatgtcagaaaataccagtcactgccctgcccccaactgttcgctgtgagttggttagcctgacttctcatgtatggc

SEQ ID NO: 27054 - DNA, 201 bp, Homo sapiens
atataacttctggctccttggatgactgtgttttttcctcatccttaaaaagtcccaagaaatgaaatgttactcatggttgtttttctggatgctttctyatcgcacaggtgttatacaaagaaaacatgggcaagggaacccctttacctgtcactcccgagatggaaagagtcaaacacaatcaagaaaatattagct

SEQ ID NO: 27055 - DNA, 201 bp, Homo sapiens
gagtttgccttgttttgttctttagtatatttccatttctccatagtctagagttaagaggaggttatgtaaaatagggacattgtcacaggccagctctkgggggtggctgagctggagaaagttgctaggagcagagcaaccatctctcaggaaggcgtatggcattcttattaaactgcagtccaggtgtgccatcgt

SEQ ID NO: 27056 - DNA, 201 bp, Homo sapiens
gcttaaactttcctagaagagtagttatcaagtgtcctagaagactctagaagccccatataagtgttggttacactgttataaaattcaaatgcatctcrgtctgttgagtagtgctgatgaatataaatctcatgagttaaaagcaaccaaaccctctgtgaaaaccagcagtttcaagcataaggaatggtccaacat

SEQ ID NO: 27057 - DNA, 201 bp, Homo sapiens
acaaaaaatagccaggcatagtggtggctcacctgtaatcccagctacttgggtggctgaggcacaagaatcgtttgaacctaggaggcagaggttgcagygagctgagatcgtgccacttcactccagcttgggtgacagagcgagactctgtcaaaaaaaaaaaagtatatatatatatacttttatatatatatttta

SEQ ID NO: 27058 - DNA, 201 bp, Homo sapiens
tgaatataaatctcatgagttaaaagcaaccaaaccctctgtgaaaaccagcagtttcaagcataaggaatggtccaacatgggcttgttttcttcctctyggcagatcaagtataaagctcacatgttgaaaacaaggaatgactacaagcttgtcacagatacaccagtctacgtgcaggctgtcaaaagtgggaaaca

SEQ ID NO: 27059 - DNA, 201 bp, Homo sapiens
taaattagaaccagctatggtagaataagaagcaagcaggctctggagttagagttgtggagtgcagtctcacctctaccacacattatctataaggcttrtgaaaagcacttaatccatctgagcctcccattctgatgcataaaatggggacgtaaggaagcacccactatgacgcctgacacaaagcaggcagggcag

SEQ ID NO: 27060 - DNA, 201 bp, Homo sapiens
agaggtgaaacttggttacctatcttctctgcatttcccaaattcttgctagatgccatacagccaactgggcatatgtttggaagcacagaggaattagwgtttttttttttttttttttttttggagacagggtctcctctgtctcccaggctggagtgcaacggtgcaatcacagctcactgcaatctcaaattcctg

SEQ ID NO: 27061 - DNA, 201 bp, Homo sapiens
aggtgaaacttggttacctatcttctctgcatttcccaaattcttgctagatgccatacagccaactgggcatatgtttggaagcacagaggaattagtgkttttttttttttttttttttttggagacagggtctcctctgtctcccaggctggagtgcaacggtgcaatcacagctcactgcaatctcaaattcctggg

SEQ ID NO: 27062 - DNA, 201 bp, Homo sapiens
cagacccctgggctgaagcaatcctcctacctcagtctccctagtagctaggactacaggagcatgccaccatgactggctaattaaaaaaaaattgtagratctcctaattattttttcatagaggtagggtcttgctatgttgcccaggatggtcgtaaactcctggccacaggtgatcctcccaccttggccccacaa

SEQ ID NO: 27063 - DNA, 201 bp, Homo sapiens
ttttttcctaatctcaatcattttctatatcctcgatatttcctcccctcttccttatgtaaaatattttattcttgattagtcagtagatgccctcgtcrtcccctactaaatgcctgtaatgatatttcctccaacgtagagactgtatcgggaattgtaccacaaactgaaagacaagatccatacaactcccgatac

SEQ ID NO: 27064 - DNA, 201 bp, Homo sapiens
gtgggctgcattgctgaaataaaggagagggacatttcaaaatacacctactgctgggaattgtgggctctaaatatgtgctgtgagaatgagcagttgarttactatgagctagttcacaaatctagaaaagcatgaaccatagatcatgttgctgtaaatgtgaacccaaagaaacttctaaaagcttggcttagcaac

SEQ ID NO: 27065 - DNA, 201 bp, Homo sapiens
tgttgtctctaaacttatttcaaaattttctttctctttaattcctgctatcaggagccccgagcatggcagtgccattggagaagtcttcagtggctccytgctctgctgcccattcagtacaattcagactacttagtttcattttcatctggcattgaggctcctgatatattgcagttatttgtgaatagatctgat

SEQ ID NO: 27066 - DNA, 201 bp, Homo sapiens
ttggaaaactccaagaacacttgttctgatcactggtttccctttcaggtttacgtgtctggcgtactaatcctggttcggtttttgactatgatccagcagaagacaacatccagtcccgaagcttacacatgattaatggtgtgttagctgaaaaaggcttacaacataaacatcaccatttagtatgctagagtcaat

SEQ ID NO: 27067 - DNA, 201 bp, Homo sapiens
tgaagtgcttcctggctccttacattgtgttagcacttgtaagtgctattaataaacaatgacaaataatgaccaaaaaaaaaaaaaaaaaaaaaaaaaargaaggcaggtagagtcacagagaaaagttgaaacaaaatcagacacatctgcccctctgaaaataagaaaaagcagggcatgctatcagtaaaaatgact

SEQ ID NO: 27068 - DNA, 201 bp, Homo sapiens
atgcccatcactgcaatgacgttcagagtgaggtaatacatcctgatgggagtgcattttgcaaaagtgggaccttgctcccagggattccagttatgccraaggcagagatagcaccttccaggtgttcagtttcagtgtggcagacctggccaggcttggtgatggttggagtacctgctcacttttcggtctttcttc

SEQ ID NO: 27069 - DNA, 201 bp, Homo sapiens
tacctgccatgttggggtagataacctgtggtggtagacctgtcttaattgtctccgtttctttacagatcaaatataagaaaaatgcccttgaaaactaycctaactttagaagtgtggtggatcctccagagattgttttagccaagattaattctgtcaatcaaagtgatgtaagtttgctttgtgcatgctgaagtg

SEQ ID NO: 27070 - DNA, 201 bp, Homo sapiens
agatcttgagtgatgtatgatgtcccttctgcagcttgactcagctacagcttccatgactgtgtcttggctaccccccaaccctggctgccatgctcccrttgtccctgtattcataaatcttgctgcttctcaaaacaaagtggcatgagccactttttggtataagaatccaccctaagccataggacacatatgtta

SEQ ID NO: 27071 - DNA, 201 bp, Homo sapiens
gtacatttaaatcatattctcaatttttaaattatgttacagatctgaaaaaacaaattctttcacttaagcttttaaaattcattatttaaaccttcttmaaaacataagttttagaaattatggtggactcagtatcttacctatagatgtggatcctattttggatggtcccattttgggagacagactatttcacaa

SEQ ID NO: 27072 - DNA, 201 bp, Homo sapiens
catgcataagtcagtgtgatgcatcatcacaaaatctgggttctaatcctcagtggcctcagcaggttgctcagctctctgggtctcagcttattcatctrtaaaatgaggagagtaataagaacttttctatctacctcacaagggagagttgtattcagttacatcaataaatatgaaaaattagtctgaactatagag

SEQ ID NO: 27073 - DNA, 201 bp, Homo sapiens
tgtttgtataaaagaaaacttgtttttgattcctttgcttggtactaatgtggttttaaagtattgtgcttcttattgacacaagacatttagacctgaawatgtcacaaataccgattcactgagctgaaattcttgattctcattaaaaatcagactgtctgcatgtgtctatttattactggcctataccagtcatgt

SEQ ID NO: 27074 - DNA, 201 bp, Homo sapiens
tgacttctaattatattctcacacacgaatcataacaaattattttagtggcagaattacatcttaatttttcttttttttctgtgtgtataaatatacasacattctttgcaggcaaagataatttttattgaatctgcggtacttatctagaattgtgcctgacacatagtagatactcaatgaaattttggatcattg

SEQ ID NO: 27075 - DNA, 201 bp, Homo sapiens
ttaattctgtcaatcaaagtgatgtaagtttgctttgtgcatgctgaagtgcacagactggggagtaaattgtctatcattgggtggattagcttaacttyagataattgcttgtaaaaaaattgggaggtggtaaattctaagatcatctttggggggtatgtcttaaaagtcactagcaggtggtgaattgtattcact

SEQ ID NO: 27076 - DNA, 201 bp, Homo sapiens
ctcacacacgaatcataacaaattattttagtggcagaattacatcttaatttttcttttttttctgtgtgtataaatatacacacattctttgcaggcaragataatttttattgaatctgcggtacttatctagaattgtgcctgacacatagtagatactcaatgaaattttggatcattgagcatataaaacccatg

SEQ ID NO: 27077 - DNA, 201 bp, Homo sapiens
tttatagtaataaaagatttggttttctctccttaggtaaaatataaagaaacatttaataaagcaaagggcaaatatacgttttcaccagatacaccacrtatctcccactccaaagacatgggaaaactctacagtactgtaagttctcttttatgtaataaccactcaatttctaatttgaagctcttgttgcattca

SEQ ID NO: 27078 - DNA, 201 bp, Homo sapiens
gaaagaagttgaaagaaaacttttgttgccatgtatttctttgttctagatactgtataaaggggcgtgggagggcaccaaggcctatggctacaccctgratgagcgctacattcccattgttggagccaagcatgctgatctggtgaacagtgaggtcagtatgaccttttcctctcctaagtttgagagtctttactg

SEQ ID NO: 27079 - DNA, 201 bp, Homo sapiens
ccagagttggtgcgtttgaaagcactgaagatgctgctggctattgtttcctgaaacctgatgcattcaagcagtttgctggggcggagttgtaggtgatscgagtctatgaagtaactttgtgccttagcacttccaacgtgttttttgtgccctgtgtcatagcaagtttatttctatctaggccatttaataaattag

SEQ ID NO: 27080 - DNA, 201 bp, Homo sapiens
tgctctgtcttttcacagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagaca

SEQ ID NO: 27081 - DNA, 201 bp, Homo sapiens
ggcagtttcttaaacagaagaatgtccatggtccttcagctatgaatcaaagaagggcaggaccatcttcctcaaacttaatttgaaaagttagcagcacrctccagaccacttgtttccttttacttgacgttcttcacaatgtggtctttcattaactcacctaaggcatttttagatttactcgtattttccgccctt

SEQ ID NO: 27082 - DNA, 201 bp, Homo sapiens
acaggcaacttggctgagaaaagaagaatgaaggccattggctagagactggaaaaggcttaattaatgacaggaggtcttgagtctgtttgcaggtgaaragaggggattgggaaaacaggaagggtggaagatacagaggagatggagacagttgctggaatagggtactagaagggacaactgcaaatgggaccaaga

SEQ ID NO: 27083 - DNA, 201 bp, Homo sapiens
tgagtacatacttacttgttcactgctaggaaactcttgggttttaatctcattgactgaaggcatttatttgaatttgatgaaaaatcaactctgttcarcccctcatgattcttctagaactctctccttattaatatgtctctgggtggtttctcctattaaagctgatatgacagccaatataaagtgggattattt

SEQ ID NO: 27084 - DNA, 201 bp, Homo sapiens
gattgaagatagtaagtagattcaacagcatgtaaaaggtctgaatatttaatgttttcatctaatgtgtctcttgttcaattatcactacaactgttgcrgggagatgaggattaccgtgcagctctatgaatattgtatatattcatggcgcctcttgactttgatgctgaattgctaggttatttccagcacatctga

SEQ ID NO: 27085 - DNA, 201 bp, Homo sapiens
tccctcctatccaaacccacatataccaaaacttgctaggtatgtctccagcaatgacaatatacagttctatatatttttaaaaggcagaatgattgctrtattcatcagttcattcattcatcaaatattgtctatgtgcctgacactaggaatgagatgatggatgataaacagtttttgcccttaaggggtccttaa

SEQ ID NO: 27086 - DNA, 201 bp, Homo sapiens
tgagctggtagggaaaggcttctcttccatcagcagttatcaagatgttctgaactcaagatttgctgatttggggaaaggaaaacctgaatgaatagggktccaactggtcctttcagcacaagcacagaaacaaaaattatatggcaggctgggcacagtggctcacacctgtaatcccagcactttgaaaggctgagg

SEQ ID NO: 27087 - DNA, 201 bp, Homo sapiens
taccaactggagcctaaattttttttaaaaaactaatctttcagtgacatattgttacacagcatgaggataccaggcccaggccctctaaaaccatggarattcttccatcacatagaattgggaagatttccattgatttcaccagaagagatttgattgagtcaagcaggcagtgttaggcccactgtggacaataaa

SEQ ID NO: 27088 - DNA, 201 bp, Homo sapiens
gtgcctggcagaaaataaatacctagtgtttgatcatttttggtaaaaattaaacccgaatttagtttgaaattaaaagtactcgattctgaagatgattrggctggactggcagaactagagagattgaagaatcatttcacccggaggcctttaaaaattttagcctctatttcgggaccacagggtcccaacagatga

SEQ ID NO: 27089 - DNA, 201 bp, Homo sapiens
aattatatttaaatggaattgggtcattgttattagtatatttgtaaatcctaaattcaagaacaactcttacaatctgaggatccttttgcatctatgtytggttctgcaactcttgcgtttaagcacagattttgattttcttttcaatatcttcacaatgtcacttaatttacaagtacttaaagagatttaatttca

SEQ ID NO: 27090 - DNA, 201 bp, Homo sapiens
atccctgcagcaaagcgatgtaagacaggagagacacagacgattgtaactgcatactgcacctgagaaatacaatgaataattatttataataaccactrtcatgagtgttaacccttgctcgtttgagatccgagaaggagaggaggatggttgggggagcgataggcgagctcagaacccaaacctgcccatggagcc

SEQ ID NO: 27091 - DNA, 201 bp, Homo sapiens
tccaattctggcaattatggcaaatgtgggttttgctacaggacatgtaatctagccatatcagatattactaacctattaataacagaaggaaacattgytgattaggagtggcctctcctattattaaactgctacccaattttagaaaggtaaaactacctctttgggcctcagtaatctctgcctgctctatcctta

SEQ ID NO: 27092 - DNA, 201 bp, Homo sapiens
caggttctccgaagattgccaggtggttctagtgttgggttgcaggacacaaatgacagagaagaactagaatatgggtcttatctaagtcccagactgaygccaaaatggggagcatggattttcctggagatttcacagttcttcaagtaaaccaactctgttcccagcttcctctactcataaaagtaattctggctc

SEQ ID NO: 27093 - DNA, 201 bp, Homo sapiens
agacttaaattgctgttggttttgctagttaggagtgctaaaatgctccaaatcaagtacattaaatcacatctctgaatttagcctgaagccttttccattttttttttttttgttttgcattagaaagaggtgattactttttataccttggaataatataaaaatgagcaaggccagtgatcatatatttgaatgcct

SEQ ID NO: 27094 - DNA, 201 bp, Homo sapiens
tcttgctgcttctcaaaacaaagtggcatgagccactttttggtataagaatccaccctaagccataggacacatatgttaaatatttaattggtttcacratagactcagacattgatattgctctcaagcttctttaggcttgggaattaaagaccttccagctggtgagaggcctaccctatgtcttctaagcaataa

SEQ ID NO: 27095 - DNA, 201 bp, Homo sapiens
cattgatattgctctcaagcttctttaggcttgggaattaaagaccttccagctggtgagaggcctaccctatgtcttctaagcaataagcacagccaacrgctgataggaaattatcaaatgctcaattgtaaattcagaataccttccacatttcattgttctctctttcttgcagaatgtgtataaagatgacctgaa

SEQ ID NO: 27096 - DNA, 201 bp, Homo sapiens
gctagagaaagcaaatatggcaaaaatgttaataaattggatagttggtattcattgtagcattcttgcaacttttctgtaagtttgaagttttgcaaaakgtggaaagtatacattttaaaatattaaaacatacattaaaatatttgactaagtgtgataatataaagatttcattttttaaataaagaaaaagaaata

SEQ ID NO: 27097 - DNA, 201 bp, Homo sapiens
aagtgtgataatataaagatttcattttttaaataaagaaaaagaaatagtcatattcatcctagtagttactatgatgcatgtctgaaagtattaaaacraaactttaccaaacatggctgggtgcagtggctcatgcctgaaatcccagcaatttgggaggctgaggcaggagggatcacttgagttcaagagtttgag

SEQ ID NO: 27098 - DNA, 201 bp, Homo sapiens
agctatttgacaaatgcactttagaataaacaaccattactgaaagactaccaaaggcatggtagacaagctgtttttgcctgctttctgtgcttatatcrtaattattgatgctgtctttattaacttatggataaaagataaaactatattccactaactatgagagccactttgattcacagcaagaggagatgggta

SEQ ID NO: 27099 - DNA, 201 bp, Homo sapiens
attctcaatgtttaacccactttacagcttaaatacaaagagacatatgagaagcagaaaggtcactacctggctggaaaagtgatcggtgaattccctgrtgtggttcactgtctggatttccaaaagatgaggagtgcggtaagtaaatgtccactttaacacgggatttgtgccccataagtgtgctgccgtgtctgc

SEQ ID NO: 27100 - DNA, 201 bp, Homo sapiens
ttccctggtgtggttcactgtctggatttccaaaagatgaggagtgcggtaagtaaatgtccactttaacacgggatttgtgccccataagtgtgctgccrtgtctgcctgtttataacttgccctttggttcaggttagctgggaaatggagtagcgtagggtccttcctgagattttcctcacccctccaagtcagcct

SEQ ID NO: 27101 - DNA, 201 bp, Homo sapiens
tttttctagcaaaaatacaaagaagactatgaaaataaaatcaaaggcaaatggagtgagacaccttgctttgaagttgcaaatgccagaatgaatgctgrtaacattagcacagttaagtgggaagggatggctggttggtcatcctgggagggagacccctttccttagtgacttctagctacttgctctacctgaatg

SEQ ID NO: 27102 - DNA, 201 bp, Homo sapiens
agttctgggaatttacaaaattactaaatttttaagatacagtcatataccgcatgatgtttttggtcaacagcagaccacctgtatgacagtggtcccayaagattataatggagctaccctatgcaggtgtaccattttaaaacctttaataccatatttttactgtaccttttctatgcttagaggtatcaagataca

SEQ ID NO: 27103 - DNA, 201 bp, Homo sapiens
agaaaattttatttatacaacaggcttgaggatcttttgagactgtcaggttttttaacaagtcagtcaatatgtaaactagttttcatttttataccaatttattggctgcattaaatatatggccagtcaggacccacatagagttgtttacttataaataaagctccatgtgttatccattcaatctagaccccaggt

SEQ ID NO: 27104 - DNA, 201 bp, Homo sapiens
tggtgtaacacagtcaaaagtaaaatctaacaccctttcaaaaggacaatgttaattagaattttatttgtatttattgtggctgtttaatgtattctttrtgtttgcagcttttaagtttttttttttttatgtttagatgtttatttatttttccataagtttgggaggtacaggtggtatttggttactaagttcttt

SEQ ID NO: 27105 - DNA, 201 bp, Homo sapiens
actaagttctttagtggtgacttgtgagattttggtgcacccatcacccaagcagtatacactgcaccatatttgtagtgttttattccctcgcctcactyccactctttcctgcaagtccccaaagttcactgtatcattcttatgcctttgcatcctcatagcttagttcccacatatcagtgagaacatacaatgttt

SEQ ID NO: 27106 - DNA, 201 bp, Homo sapiens
taggctctggggacattcagagcaaagggcagaaactgaggaattaagtagctgtttggagctggggcaaactcgacatcttggccttatttctgagtcartccactcatttgatgccaggaattccttgcttagaatatcttgggagttcttcctctcctttcaagccctaagtttagaacagtttttaggcatcttagc

SEQ ID NO: 27107 - DNA, 201 bp, Homo sapiens
aatttttacacagattgcatttaggcaaaattgcccagtggtgcataagcctattagatactgtggaaaatagacaatgccacatattgaacctctatacytgaccatctctacaacaacttgaacttaatgacaaggaccaaattgccatattgcatagatttggcctgttaaatatttgttagaccgtaagacaaacgc

SEQ ID NO: 27108 - DNA, 201 bp, Homo sapiens
tggtaaaacattaatataatcatttaacttaataaaaaaagtgttcagtattatattcctgcttttacaaatgtaacattctcagtgtctaagcatccacwtttatactgctttggcaaatttgatctgaacctaaagcttaaacaaatgtattttgcaaagatccgactattatcctcgtttcttattctaaccttttct

SEQ ID NO: 27109 - DNA, 201 bp, Homo sapiens
agatggagagagtcaaacacaatcaagaaaatattagctcggtacttgggcaagaaaagaaaaaaactacttactgattttaaaaactatttcatgatttmaaataatacatattaatcctattttctaaagacaaattttgtgaacttctttctttagcaaatttatccttttttcctttgggctacttctagcctaaca

SEQ ID NO: 27110 - DNA, 201 bp, Homo sapiens
acctctcaacaaatgaaatgttactcatggttgtttttctggatgctttctcatcgcacaggtgttatacaaagaaaacatgggcaagggaactcctttasctgtcactcccgagatggagcgagtcaaacacaatcaagaaaatattagctcggtacttggcgagaaaagaaaaaaactacttactgattttaaaaacta

SEQ ID NO: 27111 - DNA, 201 bp, Homo sapiens
cgtgccattgcactccagcctgggtgacagagcaagactcctctgtctcaaaaacaaaacaaaacaaaacaaaaaaaaacaaacagctgatgtattaggarcagcctcaaccttctcagtgtgattgaagctcatgcctgtaactcctgtttggatcatctctcaggggcttgacattgagagactagcggtaaaatgatg

SEQ ID NO: 27112 - DNA, 201 bp, Homo sapiens
ggtctgttatagagggggccagagaatttgcatttttaacaagttctcattactgaccttgctgtccaaggaccccacgttgagaatcactatttcaacasaattcttcctcttcaatgtcatttcctaaatctcccacgtttccaagaatgacactgaggggagataccgaggttgaggatttatcatgatgtgttacta

SEQ ID NO: 27113 - DNA, 201 bp, Homo sapiens
atactctgaaatggatgccttctttggatatattttggggttttagtgtctggaggactttgatttctatattagcatattggtttatgaagtctggacayaacctaaggaaaataatcacttgttttaaaggacagttctttcaaattccctacaatgtcagatttagagccaaataccatcgaatatgttgatgctgta

SEQ ID NO: 27114 - DNA, 201 bp, Homo sapiens
gctccacccccacgtctacccaggcacattccagccctgtgacttggactgctttcatttcctcaaggtggccaggccatttccagcctcaggtcccgaaygctcttcctctgcccctctctccaagtttgagtgtaaatgttacctctgcagagtggctttactgaccatccttgtttctttgctacaatgattccattg

SEQ ID NO: 27115 - DNA, 201 bp, Homo sapiens
aatctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaa

SEQ ID NO: 27116 - DNA, 201 bp, Homo sapiens
atctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaag

SEQ ID NO: 27117 - DNA, 201 bp, Homo sapiens
tctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaagt

SEQ ID NO: 27118 - DNA, 201 bp, Homo sapiens
ctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaagtt

SEQ ID NO: 27119 - DNA, 201 bp, Homo sapiens
actaaagtcttgttttctactattgttgctgggagcattgttggattctgaattccacaacagcaaatggaacttcatttcagaaagagtgtattgaaagraatatgtctagcaaagatggtcaaaagcataataggcttttaatagaggaataaaagggaaagtaagaaatcagataacctgatagctccagcccctccc

SEQ ID NO: 27120 - DNA, 201 bp, Homo sapiens
agcaaggggagggggcgttagtaccctctttctccattctctatccctatcgcccaactttctggttgggtaaattgacagtacattggaagatttttttwaaaggcatttattaaggacctaagaatggcttgctgaagatatttttaaaagttaatcattatttcttaatttgctgtcttatttgtcaattcatgagtt

SEQ ID NO: 27121 - DNA, 201 bp, Homo sapiens
gccccttcagttgacccaagcgtccctcaccagctcctatccatctctatctgctggaaaggctttgaggtttcagatttaggacagcaccactcattcayggtctctcctgcatcaggttctttattctgatagtttccggaaacaaatacaaggcaaagctgcctatgtattggatacccccgagatgagacgggtgag

SEQ ID NO: 27122 - DNA, 201 bp, Homo sapiens
tggtgttgtacacctgtagtaccagctgttcagggggctgaagtgggaggatagcttgagcctagaaagttgaagctgcagtgagccgtgattgtaccacygcccttcagcctgagcaacagagaccccatctcaaaaaaaaaaaaaaaggatattatgtagagacagtcctcaaaggatttatactccagttttctgatc

SEQ ID NO: 27123 - DNA, 201 bp, Homo sapiens
gggctgaagtgggaggatagcttgagcctagaaagttgaagctgcagtgagccgtgattgtaccactgcccttcagcctgagcaacagagaccccatctcaaaaaaaaaaaaaaaggatattatgtagagacagtcctcaaaggatttatactccagttttctgatcaagacacagaagtaaatccatggttgcattctga

SEQ ID NO: 27124 - DNA, 201 bp, Homo sapiens
cagcttacaaacatgcaaaaaccacagagctcccacaacaacgatcatcttcagttgctacccaacagacaacggtatcttccatcccatctcatccatckactgctggagtaagtgaataacaactcacttaaataaattattcttaatttttgatatgtgcaaacatgattataagtattaggtattacggtttttttt

SEQ ID NO: 27125 - DNA, 201 bp, Homo sapiens
taaacatttgctgggcatagtgaatcatgcctataatgccagcactttgggacgctgatgcaggaggattgcttgagctcaggagtttgagaccagcctakgcaacatagtgagacttcatctctactaaaaaccaaaaaattagccaggtgtggtggtgcatctatagccccagctactgaggaagttgaggtgggagga

SEQ ID NO: 27126 - DNA, 201 bp, Homo sapiens
cactgtactccagcctggatgacagagggagaccctgtctcaaaaatcaagaatgtatagatgtatgcaatgtgcccacatatatacatgccttatcttasatctcccctattaatatatatagaaatggtaagccaaatcatcttcacagttcaccagactacttcacaactcttagtttaaaaccctggatctcattca

SEQ ID NO: 27127 - DNA, 201 bp, Homo sapiens
ctgtcttttttatcatcaccattctggcatgtgtgaaggggtatctcattgtggttttaataatttgcattttccagatgactaattttgagcatcctttygtgtgctttttggctatttgtctatcttttttggagaaatgtctattcatatcctttgcctcttttggtgggggaaggcattgagttgtaggagttcgtc

SEQ ID NO: 27128 - DNA, 201 bp, Homo sapiens
aattttgagcatccttttgtgtgctttttggctatttgtctatcttttttggagaaatgtctattcatatcctttgcctcttttggtgggggaaggcattragttgtaggagttcgtcatatgttctggatattaattgcctatcagatacatgacttgcaagtatttcctattttgtgggttccttttactttgttgatg

SEQ ID NO: 27129 - DNA, 201 bp, Homo sapiens
gatttgcatttctctaatgaccagtgatgatgagcattttttcatatatttgttggccgcataaatgtcttcttttgagaagtgtctgttcatatccttcrcctactttttgatggggttgtttgtttttttcttgtaaatttgtttaagttctttgtagattctggatagtagcccattgtcagatggatagattgcaga

SEQ ID NO: 27130 - DNA, 201 bp, Homo sapiens
ggaccccacgttgagaatcactatttcaacagaattcttcctcttcaatgtcatttcctaaatctcccacgtttccaagaatgacactgaggggagatacygaggttgaggatttatcatgatgtgttactatgtttctcattttccactgattcgccatgatagtgatataagagccaaaaaccttattccttaatgata

SEQ ID NO: 27131 - DNA, 201 bp, Homo sapiens
ctggtgccattaaattttctttctactttatttgtttgtttatgcatttttttctctttcagatcgcttacaaagccaaaggagaggaaattattcacaawtacaacctgccaccagacctgccccagttcatccaggctaaagttaatgcctacaatatcagtgaggtgcgtgggtggactcacgggctgatgcgtatgt

SEQ ID NO: 27132 - DNA, 201 bp, Homo sapiens
aatcatgaaaaactcttccttttcgcttcaaaataaatttcaaggattttgacgtattaatcttcagtggaaaacaagattgtttttctctttttgatttrccaaacagaaaaaatatcgccaacatccagacaccctcaagtttacctcgattgaagatgctccaattacagtacagtctaaaattaaccaggcccagag

SEQ ID NO: 27133 - DNA, 201 bp, Homo sapiens
tcttgattttccattctacttaaaatgcccagagtaaaaaacaacagtttgaattttgtatctaaaacgtaaatttttggtaccacctatggtcagacaayaagagtagcattttaatagcgtcaagtaactgtgcctcaactaggaccaattccaaataataaccgccctcttatgcaaattaacgagtgcaactgtttt

SEQ ID NO: 27134 - DNA, 201 bp, Homo sapiens
gtaagcaaacgacccttgtggttctataagagcatgcccttcaaggttaggaagaactgatctggcttgcaccctatcactgtttccctctgggaaatatrtcaaccttgctaagtttagagtcctcctctgtaaaatggaaataaatcaaaaacattgtttggaggatgtaaatgcatgcaaaatacttagcatggtgcc

SEQ ID NO: 27135 - DNA, 201 bp, Homo sapiens
tttgaagttgagtgaggtttttgcacttcttagaggtatctgcattgtcctatgtatgtaagcaaacgacccttgtggttctataagagcatgcccttcarggttaggaagaactgatctggcttgcaccctatcactgtttccctctgggaaatatgtcaaccttgctaagtttagagtcctcctctgtaaaatggaaat

SEQ ID NO: 27136 - DNA, 201 bp, Homo sapiens
tgcacatctgtacttgccagcttgggtcaccgtctctaacacatatgtgaccatgggaaactaggatgagtttagagttttctgaaaggcagtgggtcaamatttttctgtcaaagtaattggtgagtggatacaatgaagctgggaatttgacccaactagcaccttgtctaaccattccagaaaaccagacaatgaagg

SEQ ID NO: 27137 - DNA, 201 bp, Homo sapiens
gtatgtggtcacagtcactatcaatcactcttcttattggcttaggtgggcaatggactctgccttggaattacttcttgcatagttctcaatcttgtgcrtttttgcctttggctccaaaattaaacagcctcatccgttctttacactcccttccttacacctaacgtcaccttttaaaaaatttaaataaagttctgt

SEQ ID NO: 27138 - DNA, 201 bp, Homo sapiens
aatctctgcctcccaggttcaagcaattctcctgcctcagcctcccaagtagctgggattacagacatgtgccatcacgcccggctaatttttgtattttyagtagagacggggttttaccacattggccaggctggtgttgaactcctggccttgagtgatctgcccaccttggcttcccaaagtgctgtgatgacaggt

SEQ ID NO: 27139 - DNA, 201 bp, Homo sapiens
cagctacttttaaggggaaatttatcattaactcacttgagcagattatcactttaatgtgatctgtgcctcctatgaaaggtgctgagcttagttaaatracaattgtttttgctcctgcctgggaagacatccaggacacatgaaagccctgctcagcttacacatgccagacatttgaaagacaatatgacatgaatc

SEQ ID NO: 27140 - DNA, 201 bp, Homo sapiens
taaaagcagtgaaggcatctgcagagaacataacatgcccatgaaacagaaatgatggtgataacttggtttatgtctagctggtctacagagctgcaggsaagaagcagaagtcaatctttacttcagttcctgatactcctgatcttttaagagccaagcgagggcagaagcttcagagtcaggtaagctcagaggttc

SEQ ID NO: 27141 - DNA, 201 bp, Homo sapiens
atttatgcagtttctctgctgcttttaagagttactatgagtattttgtttataaaatgtcaagctgccatttttctaaagagaaaattgatttgtggaartatgtcatattcataatagagacgggggcaaaaataacccatagagttactttatcattttatttcactcctacaggtaaaatacaaagaagactatgaa

SEQ ID NO: 27142 - DNA, 201 bp, Homo sapiens
ttataggaagtatctattgtaacttttgaatggaagtttaaaaatgaattatacatatgaagacaaattttctaagaaacttgaaaacaattgttccctakaaatacgttaggcacttttgttgttggccagtagagtcctttggagactcaaatattacctcattgatatcatagctccttgttttaatcaagctctggt

SEQ ID NO: 27143 - DNA, 201 bp, Homo sapiens
aaagggcagcaccctgggtgcaggagtcattccctctgaaggatgtttctcctctgagccagggaaggggtgggagacgcagggatgaatatggagaagayaagtgtgtagcgtttcttcactctatgaaagaggaagctgagagtaaggtggggttgattgtgggcttaaggacagtgttggggttttagactggcccct

SEQ ID NO: 27144 - DNA, 201 bp, Homo sapiens
caggaaagcagctaaagacaataagcacagctgttccaataaaactttatttctggatactgaaattttaatttaatatgttttcatgtgtcacaaaatgyccttcttttgacttttttcaccattaaaaaatgtaaaaaccagtctcagctcacagatagtacaaaaaacaggtggcatgctagtttaccaatctgtgct

SEQ ID NO: 27145 - DNA, 201 bp, Homo sapiens
gaaattaagccaggcttgtttgtggaatttgtgtaaatacatttcaaaatctgtcttttgtatcccaattgatttgatgtccatgaaagcttttggtatargcactaggtagatattattgggataagatacagttagacttggttaaagtataaagatgattgggaccttgggattattcaactgctttacttgataaat

SEQ ID NO: 27146 - DNA, 201 bp, Homo sapiens
caggatgtcatacttaataaacatttatcctattcaaatgttgcttttaccctaaggacttaaccagccatgaaatatcctgttgtcctatgcctaaaatraagtcttcagtttgtatttttttttttttttttttgagacagggtctcactctctcacccaggctggagtgcagtgatacaatcttggcttattggctta

SEQ ID NO: 27147 - DNA, 201 bp, Homo sapiens
atctgatttgtctgaaacttcttggcaggatgtcatacttaataaacatttatcctattcaaatgttgcttttaccctaaggacttaaccagccatgaaawatcctgttgtcctatgcctaaaataaagtcttcagtttgtatttttttttttttttttttgagacagggtctcactctctcacccaggctggagtgcagt

SEQ ID NO: 27148 - DNA, 201 bp, Homo sapiens
atttgatagaaacataatacttaaagttccagggaacaaacgtctcacatttggttaactgacaatttcacttactctttgaagtgcagctttgactcgarcattttccaggttggaattagagtaccacagacttccattaagttggaaataaggatgaaatggaacataacaccagttagaaggaaagcaaaaatcgaa

SEQ ID NO: 27149 - DNA, 201 bp, Homo sapiens
tactcaatttggacttagtaagccagttcagactgattgggatttacttctaatggaatctatggtctgatcttgccatgaaccaaaattatacacaccartttgatggtgtctccaacttttgaggtctaatttttaacgccaccctcttcatatcacctgcaagtttagtggacatctttttctatttcactttctatg

SEQ ID NO: 27150 - DNA, 201 bp, Homo sapiens
aaatgcattgctgatacagagataaatatttattggctatttgtgtcaacagaatatgtacaagtctgatctccagtggatgagaggcattggctgggtgyccattggctctttggatgtggaaaaatgcaaaagggcaactgaaattttgagtgataaaatctatcgccagcctccagacagattcaaatttaccagtgt

SEQ ID NO: 27151 - DNA, 201 bp, Homo sapiens
aaaaatgtatgcattaatatttaatagaatattgattgtattcttaaaaccttttggaaaacatcactagatattttcatattttcttctaattgaaaaayaatttttaaaatgataattttcaaactgtctttactttggaagacatttatgagtcacaaaaatcttaatagagtatcgttcttcattgactttagtaat

SEQ ID NO: 27152 - DNA, 201 bp, Homo sapiens
tggggtggaaccggggaacacaacaattatgttgaggaaggccatttgctacaaaatttcagatttttataaatcttaattttcattagtttatatctacmcgaatttggggcaaaagaaggacatgcagatttaagataagtgttcattatttaacaaattctatgtgagaagccatgctgggccaggcactttccttgg

SEQ ID NO: 27153 - DNA, 201 bp, Homo sapiens
ttagcattgcctaatccatggagttgcaggttttcttctgtggcattcagcatcctaggcataagaacagaggaagttggccaggcgcggtggctcacgcytgtaatcccagcactttgggaggccaaggcaggcagaccatgaggtcaggagatcaagcccagcctggctagcatggtgaaaccccgtctctactaaaaa

SEQ ID NO: 27154 - DNA, 201 bp, Homo sapiens
agagaacccacagcttaggcagctgaaggcagcaggagatgccctaagtgacgtaagtatatttttgtcaaagtgtttttaaaccttagctgcaaaagagrtgaaaattttctcctttaatgactaaatgaatatataactttgcaaatacattaaggttatggagtggtaggttcattggaactatgtaaccacagaaag

SEQ ID NO: 27155 - DNA, 201 bp, Homo sapiens
tttcttctattattcagtatctgtatgttgaacttgccaccaaagagagaccccatcatcacgctggaaaccagaccacagccttgaagcatgctaaagaygtgaaggacatggtcagtgaggtaagatgggaattcagcactgaggcactgggtaaaaagaaaaatactttgttaaaaccttcccctgctacctctgatc

SEQ ID NO: 27156 - DNA, 201 bp, Homo sapiens
tacttgtgttgggctctacaactcaccatatacatatacatatattttttagcaacctccctcttctgaaattctccagaaagaagccatatttacattamctttgggtaagacttacagctgtctttgtgttttttataacagataaaatacaaggagaactacatgagccagttgggtatctggaggtccattcctgat

SEQ ID NO: 27157 - DNA, 201 bp, Homo sapiens
aataattttggccaggcacagtggctcatgcctgtaatcccagcactttaggaggtcatggcaggcagatggcttgagcctggagttcaagaccagcctgrgcaacatggtgaaaccctgtctgaacaaaaatacaaaaataaataaattagccaggcatagtggcatgcacctgtggtcccagctacttgggaggttgag

SEQ ID NO: 27158 - DNA, 201 bp, Homo sapiens
cccgtctctactaaaaatacaacaaattagccgggcacggtggcgggtgcctgtagtcccagctgctcgggaggctgaggcaggagaatggcctgaacccrggaggcggagcttgcagtgagccgagatcgcgctactgcattccagcctgggcaacatagcgagactccgtctcaaaaaaaaaaaaaaaagaacagagga

SEQ ID NO: 27159 - DNA, 201 bp, Homo sapiens
taaataaattagccaggcatagtggcatgcacctgtggtcccagctacttgggaggttgaggtgaaaagattacctcagcccagggaggtcaaggatgcartgaactgtgatggtgccactgcactacagtctgggtgacacagtgagaccctgtctcaaaaataaaataaaaataatttggtttttcatattttaaatgt

SEQ ID NO: 27160 - DNA, 201 bp, Homo sapiens
aaagcataatcgtttttaaaatacatccctgtcttttatttcatcaggttgcctacaaaaaaggtctcgctgaacagcaagctcaattcacgcctctggcygatcctccagatatagaatttgccaagaaagtaaccaatcaagtgagcaaggtaagtaaatagagctgggacattgccgcctcccttgaagactctgctt

SEQ ID NO: 27161 - DNA, 201 bp, Homo sapiens
tcaagtgccatatcccccctgatactcctgcttttatccagcacaaagtcaatgcctataacttgagtgatgtaagttccttatgccctgtaccatgtgakgtactgacaacctgtgcttttatgtttgaactgctttgttgcaattcaatgaatagattaatgttaaaaatgagaagaactgttaacatttgtatcatgt

SEQ ID NO: 27162 - DNA, 201 bp, Homo sapiens
gggagtttaacttaatgccctttgaattatatttaaatggaattgggtcattgttattagtatatttgtaaatcctaaattcaagaacaactcttacaatytgaggatccttttgcatctatgtttggttctgcaactcttgcgtttaagcacagattttgattttcttttcaatatcttcacaatgtcacttaatttaca

SEQ ID NO: 27163 - DNA, 201 bp, Homo sapiens
gtaagcaagttgattttgcacagacttgtggcctctaaggggttacaataaaaacctgatttgtgcattttcattttagtacaaatataaagatggttacygcaagcaacttggccaccatattggagcccggaacattgaagatgaccccaagatgatgtggtccatgcacgtagccaagatccagagtgacagggagta

SEQ ID NO: 27164 - DNA, 201 bp, Homo sapiens
gcccagtggacatgctgggggtggtgctggccaagaagtgccagaccttagtcagtgacgtggactataagaactacctgcacgagtggacatgcctgccygaccagagcgatgtcatccatgctcggcaggcctatgacctccagagtgacgtgagtacagcatctataaatggagctgtgcatagaaataatttaaact

SEQ ID NO: 27165 - DNA, 201 bp, Homo sapiens
aagggggtaacctaaaccagtatacttcaatgcagtataaaattggatgtgattctataatttttcatatctacaattatgagaaattcatctccatattytgagcatagagcctcacagaaaatagaaaatggcaaaagaggtgttaaaaaataacttagttacatgtattggttcaatatcagaagaagagctgataga

SEQ ID NO: 27166 - DNA, 201 bp, Homo sapiens
gaggctgaggcagaagaattgcttgaatctgggaggtggaggttgcagtgagccgagatcgcaccactgcactccagcctgggtgacagagtaagactccrtctcggagggaaacaaaaaaaggaaattattagtagtagtatcatctgctcactccatttcacttttgctatcagacacaaatttatagtaaacatttcc

SEQ ID NO: 27167 - DNA, 201 bp, Homo sapiens
ccctattcagataaacaatagcaccaagaaagaaaattgctccatattgaaaccaaaagaaatcttatttggggccaggcgtggtggctcacacctgtcayctcagcactttgggaggtcgaggcaggcagatcacttgagcccaggaggtcgagaccagcctagccaacatggtgaaattccatctctgctaaaaataga

SEQ ID NO: 27168 - DNA, 201 bp, Homo sapiens
taccaagcaggaaatcaatagaaaattgttgaaaaaaaattgcatcaaacagccaggtgtgatgacatgcacctgtagtcccagctactcaggaagctgargcaggaggatcccttgagctctgaagtttgaatccagtttgggcaacattgggagaccctgtctctaataaataaatacataaataaagtaaaaattgca

SEQ ID NO: 27169 - DNA, 201 bp, Homo sapiens
taaaacatattggaacttgggaggctgaggcagaagaattgcttgaatctgggaggtggaggttgcagtgagccgagatcgcaccactgcactccagcctrggtgacagagtaagactccgtctcggagggaaacaaaaaaaggaaattattagtagtagtatcatctgctcactccatttcacttttgctatcagacaca

SEQ ID NO: 27170 - DNA, 201 bp, Homo sapiens
cactttcctcatccctaaaattgggaccataaaagtgcctatgacattggattgccatgaggactaaatgggaaattctgtataagattctcaatacagtrcctggcccatggaaagtactggataactatgagctatttttgttattacccagttttaacacacatacatccattcaatcagtaaagtcaactcagaaag

SEQ ID NO: 27171 - DNA, 201 bp, Homo sapiens
atgtgcccttgggtcagtctcgtaacctctgggggcctccgagtacatgtgtataaaacatattggaacttgggaggctgaggcagaagaattgcttgaayctgggaggtggaggttgcagtgagccgagatcgcaccactgcactccagcctgggtgacagagtaagactccgtctcggagggaaacaaaaaaaggaaat

SEQ ID NO: 27172 - DNA, 201 bp, Homo sapiens
aaagaagaagaaaaaacatgacataggctgggcgctgtggctcacacctgtaatctcagcactttggggaggctgaggtgggtggatcacaaggtccagartttcaagatcagcctgaccaacatggtgaaaccctgtctttactaaaaacacaaaaattagcctggcgtggtggcatgtgcctgtaatcccagctacaca

SEQ ID NO: 27173 - DNA, 201 bp, Homo sapiens
ttttggatcaaatccaaaagaaaatttaaaagttgcatagtgggactagcaacatgaaaattgtgaagtaattttattatttttgtttctttccacagccraagtacagagaggtttgggacaaggataaaacttcaatacacataatgccagatactccagaaattaatctcgctagagcaaatgctcttaatgtgagca

SEQ ID NO: 27174 - DNA, 201 bp, Homo sapiens
ccaacgtgatgaatgaaaccccatctctactaaaaatacaaaaaatagccaggcatagtggtggctcacctgtaatcccagctacttgggtggctgaggcmcaagaatcgtttgaacctaggaggcagaggttgcagtgagctgagatcgtgccacttcactccagcttgggtgacagagcgagactctgtcaaaaaaaaa

SEQ ID NO: 27175 - DNA, 201 bp, Homo sapiens
aaaataataaaaacaaaagaaaggagattgtcaagcccagacctttggactccagacaccattacatgttccaggacaatggtgcatagaatgattctcayctatgctcttctttaactgctctcaagtccttgggcttcaaaactgtgcccctgtggtattaattccacctgagccattgaaggtattggcaaatttgaa

SEQ ID NO: 27176 - DNA, 201 bp, Homo sapiens
aaaatcaccaaatccaagaaggacctggactttatatcaagaaataaatggtagtatgaatacaggtcttaattgtatcagattaaagaaaactgtgaaartattctttctatagaatttagatagcaatagaggcttatatccagtaaaatattggcagcccatggacaggatgtaggcacagacatgcttttttaattg

SEQ ID NO: 27177 - DNA, 201 bp, Homo sapiens
ttggcagcccatggacaggatgtaggcacagacatgcttttttaattgatacagtgtttagaaattttgaattaagttgccaagattttaaaatccaaaawtttttgtgtacaaatgtcggatttcccatttctcttggaaattcagaggacacagctctgaattatcccttagtaacaataaccagaatggaatcaagga

SEQ ID NO: 27178 - DNA, 201 bp, Homo sapiens
gatgaatatcaaatacactgatatttcactaaggaaatacaaaacatgttctcacccagatctgtgcctgaacagagaggttgacttgttgaatctgtctyttctgtctgacgtctgtagttttataccaggttccccacaaggtagatgaaagggctgttttgactgctcttgttttttctggatgctttcttgtgtcat

SEQ ID NO: 27179 - DNA, 201 bp, Homo sapiens
ttggggtagataacctgtggtggtagacctgtcttaattgtctccgtttctttacagatcaaatataagaaaaatgcccttgaaaactatcctaactttasaagtgtggtggatcctccagagattgttttagccaagattaattctgtcaatcaaagtgatgtaagtttgctttgtgcatgctgaagtgcacagactggg

SEQ ID NO: 27180 - DNA, 201 bp, Homo sapiens
tgaaagccttgtagaaactgaaatccaaggattgtgttttcttagcagcagacttttcagttattaaaaacaaagatattcctaagcacagttttaatctygcactccttttagtaagaaaaacaaagccattaccacaagagaatatttttaaattacataatctttaaaatgaattgcttgtagtagcagtaaaagtac

SEQ ID NO: 27181 - DNA, 201 bp, Homo sapiens
catctgaaatacagattttaatcattgaaatgatggatgctaacaattgcttggacaacatgatgctttcttaacaagtaacttgcccccttgcctctcatttttttttttttagattaaataccggaaagactggaatgccaccaaatcaaagtacaccctcacagaaacccccctgctgcacactgcccaggaggctgc

SEQ ID NO: 27182 - DNA, 201 bp, Homo sapiens
atagtgctgggattacaggtgtgagttatcatgcccagcctgaacattttctatttaccaatgcatatgacactgactgtgcacatgtaaagaagctacayattatttcagctataatgctttattttttaaaaatttcccttggtgttaatctatagaaaatgtcagaaaataccagtcactgccctgcccccaactgtt

SEQ ID NO: 27183 - DNA, 201 bp, Homo sapiens
caattctacagctatggaaacagtaataagaggaccacctggggaagacagaattgccatcattcttgatcactcagtgaccaccattctacattcaacayggaatcattccaactcctcactccctaactccctgtgtggcctccatcccaggtcatgttgagtattttcctctcactcatccctactctgacctcatta

SEQ ID NO: 27184 - DNA, 201 bp, Homo sapiens
tgatggaatttatattcctcttctcgccagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgat

SEQ ID NO: 27185 - DNA, 201 bp, Homo sapiens
tagctccagcttgagaagaaatatttaaaatatgcatgatttcctagacaataaaaagggcccatttattttatattaagataaggtatttagttacccaytagtctttaaaggtcgtgacatgcatatcacttttgccaattcctttgctgaatttttttgtccagaatctttataagcaagactgggagaagagcaaag

SEQ ID NO: 27186 - DNA, 201 bp, Homo sapiens
tgatctcccagttgatgcaatttctgtacagctagctaaagcttcaagagacattgctagtgatgtgagtactagtttgagttctataaggctatattttyatctgaatcaggtgacttaatgtcggtaactatttttatggatagtctttacctttcaaaatataatgcttccttcattttctcctaccctcttcattta

SEQ ID NO: 27187 - DNA, 201 bp, Homo sapiens
aatgagaaaagactagaattgtggagggctgcatgaagttagatgtttcattttctttgatttctctttttggaaatcattctaagttgggggaaaaagayatcactcagctgctaaacacagattaaaggatacctagccatttttcttcttataaagaatttgccccctttttttcagcttacaaacatgcaaaaacca

SEQ ID NO: 27188 - DNA, 201 bp, Homo sapiens
tgttgatgcttgcacattctcttttgttcaacttaagtttgtggagtcagtcatgagagatcttacaaatagatgtgtgttaactgttgcaaatccaacayataatatttccccttttccatccccacgaatagaaaatcttccgtgccatgtatgactatatggctgctgatgcagatgaggtgtccttcaaggatggag

SEQ ID NO: 27189 - DNA, 201 bp, Homo sapiens
ttatccagcacaaagtcaatgcctataacttgagtgatgtaagttccttatgccctgtaccatgtgatgtactgacaacctgtgcttttatgtttgaactrctttgttgcaattcaatgaatagattaatgttaaaaatgagaagaactgttaacatttgtatcatgttgctatgcctctgccagtataactgaattcacc

SEQ ID NO: 27190 - DNA, 201 bp, Homo sapiens
tggtgagatgtccctcaccggacacaagaacaagtggcaaagtaagcagagctttttctcagtacccgcttgcctcttctctactccttttcttcacatgsgaaacacctcctaagggtggccagtgtcctcattctgtaacaagcctccttaggactcaaatccagactttccctcttctggaagggcctcatgccttag

SEQ ID NO: 27191 - DNA, 201 bp, Homo sapiens
agcatgacatgatgtctttctgctttttgatctttcagatcctttataaattggaatacaacaaggccaaacccagaggctacaccacaatccacgacacrcccatgttgctgcatgtccgcaaggttaaagatgaagtcagtgatgtaagtactagaatggtttagcagtccctctcatcttggcctccttctaatgaga

SEQ ID NO: 27192 - DNA, 201 bp, Homo sapiens
tcctcccacagctgaaatacaaagaagtataccaaagaaataaatccaactgcaccattgagccagatgctgttcatatcaaagcagccaaggacgcctayaaagtcaacaccaatgtaagttccagaaacttccccaagcatggtgggggatttaccagcttctgtaggacacatggcctctttttacatctcttcaggc

SEQ ID NO: 27193 - DNA, 201 bp, Homo sapiens
aggactccctgtgtgtttaatcaaatgcccagcttcctcctgtgctgtcacccttcccttttcttctgcctttcttctatcacagtttgaatataagctgraccgggagttcctcaagggttgcaagctttctgtcactgatgacaaaaacacggtgctcgccctcaggaatactttaatagaaagtgatgtaagtaccta

SEQ ID NO: 27194 - DNA, 201 bp, Homo sapiens
aaatatagagtataatatgaacttttatttaggggcaaatgatttaattatgacaaattatgacaaattgtgataaatgatttaattatgacaaatttgtcacttgcactttcagaatttgtacaagtcagaccttcagtggctaaaaggcattggctggatgactagtggttctctcgaggatgagaaaaataaacgagc

SEQ ID NO: 27195 - DNA, 201 bp, Homo sapiens
ggtattcctgatgggttggctgcaatggtgatagatacaaaatgcaaaaatagaagaattttctatccttcctgaatttgggaaaggtgttttttttttttcctttattaactcaaggtcacaatgtcatccatgtaaatctctgtaatgagtcatctaaaattaaccaggaaggttttgtgcttgcaacatgattcatgg

SEQ ID NO: 27196 - DNA, 201 bp, Homo sapiens
ctattaccatgaatcatgtaagtcctatgtttgtttgaggaggttattaattttttttgtttatggaaacactgaagtctgtttgtataaaagaaaacttrtttttgattcctttgcttggtactaatgtggttttaaagtattgtgcttcttattgacacaagacatttagacctgaaaatgtcacaaataccgattcac

SEQ ID NO: 27197 - DNA, 201 bp, Homo sapiens
cctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaattctatta

SEQ ID NO: 27198 - DNA, 201 bp, Homo sapiens
acctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaattctatt

SEQ ID NO: 27199 - DNA, 201 bp, Homo sapiens
ctggtcacagacacgcccctctatgtgactgctgttcagagtggcattaatgccagtgaggtgcgtcttcctgtactcctcttccagggacaaactatttyttgtctttatgtattttctaacaacagaggtgaataacctattgttgcttgtctacaggtaaaatataaagaaaattatcatcagattaaggacaaatac

SEQ ID NO: 27200 - DNA, 201 bp, Homo sapiens
cagtgaggtgcgtcttcctgtactcctcttccagggacaaactatttcttgtctttatgtattttctaacaacagaggtgaataacctattgttgcttgtytacaggtaaaatataaagaaaattatcatcagattaaggacaaatacacaacagttctagaaacagtggattatgacagaaccagaaacctgaagaatct

SEQ ID NO: 27201 - DNA, 201 bp, Homo sapiens
caagtgatgtggactatcgccattacctgcaccactggtcttgctttcccgaccagaatgatgtgatccaagccaggaaagcctacgacctacagagcgaygtaagtgtgtcccccaggaaacaagtcccccattgctttgcctgatggctccttccaatgctctgaaaacacaactctctgtacgtaggcactccacttt

SEQ ID NO: 27202 - DNA, 201 bp, Homo sapiens
ttccagcacatgctgaaaggtaaatttgatgcagcaataaacagtgataattggtaactaccagacacaatgttagtaataataccatttttcccagaccaaaaaaaaaaagttaattgagctttcctcttagcaacttgttttgtcattttagtttaccatgaaatcaatatgtgaaatgaggaggttaagctccaatta

SEQ ID NO: 27203 - DNA, 201 bp, Homo sapiens
tagaaatttcatgtttgctacatctcccccaactgcatctctcccagtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacaggtacaag

SEQ ID NO: 27204 - DNA, 201 bp, Homo sapiens; identical to SEQ ID NO: 5320

SEQ ID NO: 27205 - DNA, 201 bp, Homo sapiens
ggtgtggcagctagcaaggtatgaggaaatcatcccatttatcttgatggtttgagtgtgggtaaatttcttataactttggctcttgtatataattagtwaaaaaggggaggagtggttcttgggggaactaccagggctgagaccagtggatgtgaggcatttgaaaaagagtagaattgaaacaacaagaacaacaac

SEQ ID NO: 27206 - DNA, 201 bp, Homo sapiens
agaattgaaacaacaagaacaacaacaaaagtactttggaattataatggggctactaaaaatgttttgccatgtatgagcattaataacatctaattacyatcttcaatatttcctaatttattatttgcctgaggaaccaaactgtacatttatcaatttgatttagtgtcttctcactggaagggccttttgctgttt

SEQ ID NO: 27207 - DNA, 201 bp, Homo sapiens
cgtttgggatacaccccaaatcctccatgccaagaaatcatacgaccttcagagtcaggtgagccaccttcctagaaggactggttctccatgggtcatcrgaatccatggtggtgtcagtgggctgatgggcaggcaaagaaagttgctgtaacagtgtaggctctaactgaccaaagcccctcctctcccaatcaaagc

SEQ ID NO: 27208 - DNA, 201 bp, Homo sapiens
cacctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaattctat

SEQ ID NO: 27209 - DNA, 201 bp, Homo sapiens
cctcactcagggccatcttccatggtacagtccccagggacaccagggaaggatggagaagagctgcttccatcagggctcaggtatgggtcctgaattayggcctgtcctgtgaggggcgccagcagtcaagcagggcagcagcagtgcaagggccattagatccaggtgacagtcctcgatttatactgcaccagcaga

SEQ ID NO: 27210 - DNA, 201 bp, Homo sapiens
aagcacctctacattatgaggaaattattgtatgctttcactgatacaattataatttggaaagtttttagcagaagtgaaaaacttattctctctagggmtaatactttctctctagggataaaaaaatagaaactaacaaaaatggaagagctattaactcacaggcaaataataaattgatttggctttggtgaattc

SEQ ID NO: 27211 - DNA, 201 bp, Homo sapiens
tgttctactggtttgagggtgtaataaaaatatgtaggatatccagcagagctaaagaaatgccccttttcctgcccctgaagctgaaatacaaagagaarcatgtcaaggaaagaggaacctgccatgccgtacctgacacgcctcagatcctgctggcgaagactgtcagcaacctggtgtctgaggtaacccccagcc

SEQ ID NO: 27212 - DNA, 201 bp, Homo sapiens
taagcacctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaatt

SEQ ID NO: 27213 - DNA, 201 bp, Homo sapiens
acttggcacagggctcatacacaacactaccagagacccgggacactgttcacgtcaaggaagtgaccaagcatgtcagtgatgtaagtgatcaaccaccsgtctcttggcagcaacaatgccacttgactgtagaatctggtgaaataatgtcagttgccttttgcttcctttatgtagcttcactcttaccatcaatat

SEQ ID NO: 27214 - DNA, 201 bp, Homo sapiens
ataagcacctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaat

SEQ ID NO: 27215 - DNA, 201 bp, Homo sapiens
tgctggagccaccagaggtgaaacatgctatggaagtggccaagaagcaaagtgatgtaagttttccctctcaacactcttgggggcccatttgaagcagkggaacccagattggtgcattctcttgttccagtgtgtggtcactctaattcctctgtggtagtttcaaaaagttagtggcgagaattggtttgggtttaa

SEQ ID NO: 27216 - DNA, 201 bp, Homo sapiens
tataagcacctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaa

SEQ ID NO: 27217 - DNA, 201 bp, Homo sapiens
atactcacataatcacattgtgatgattaaaatcacagaattaatttccactggtctgctagtctacagaatttattcaattttatcactaatatcctttmtaagaaaagaaaatattttctctggctcaggatttaatccaagaccacaggttgcattacttgctatgtctttagtctcctttactctggactagttcct

SEQ ID NO: 27218 - DNA, 201 bp, Homo sapiens
catgtataagcacctctacattatgaggaaattattgtatgctttcactgatacaattataatttggaaagtttttagcagaagtgaaaaacttattctcwctagggataatactttctctctagggataaaaaaatagaaactaacaaaaatggaagagctattaactcacaggcaaataataaattgatttggctttgg

SEQ ID NO: 27219 - DNA, 201 bp, Homo sapiens
acatactcacataatcacattgtgatgattaaaatcacagaattaatttccactggtctgctagtctacagaatttattcaattttatcactaatatcctytataagaaaagaaaatattttctctggctcaggatttaatccaagaccacaggttgcattacttgctatgtctttagtctcctttactctggactagttc

SEQ ID NO: 27220 - DNA, 201 bp, Homo sapiens
tcatgtataagcacctctacattatgaggaaattattgtatgctttcactgatacaattataatttggaaagtttttagcagaagtgaaaaacttattctmtctagggataatactttctctctagggataaaaaaatagaaactaacaaaaatggaagagctattaactcacaggcaaataataaattgatttggctttg

SEQ ID NO: 27221 - DNA, 201 bp, Homo sapiens
gtatttcccaagaataagaacatactcacataatcacattgtgatgattaaaatcacagaattaatttccactggtctgctagtctacagaatttattcarttttatcactaatatcctttataagaaaagaaaatattttctctggctcaggatttaatccaagaccacaggttgcattacttgctatgtctttagtctc

SEQ ID NO: 27222 - DNA, 201 bp, Homo sapiens
ctgagtggggaaatctgctttctaaatctctctaaaccaatttatttacacatctcttcgattaactctgagattattttctttccatggactcaagtctsgggaaaaaaaaaatgaagtaaaaagagtttgctccctccctctcacgagtgcctcccttccaattttagagtagctctaaaacccttcatctaagacaaa

SEQ ID NO: 27223 - DNA, 201 bp, Homo sapiens
catcttcaacttattttcttcaccagctctgacaccagtatctagcacataataggtactcaataaatattcattgaaaaaatacataaaatatagcaggrtggagtaattatatgcaaagaagggaaagattactcaacactgctcagctaaaagcctaactttgaacattacagaatactgaagtatgtgccctgaaat

SEQ ID NO: 27224 - DNA, 201 bp, Homo sapiens
tctagaaacagtggattatgacagaaccagaaacctgaagaatctttacagcagtgtgagttgagttttttttcccccttatatatgagccacctttcccmcttctgggacagtaagagaataaatgggatggacactctttccctaaaggcttttctatggttttttcctggaccttcaatcttactttacctcataaaa

SEQ ID NO: 27225 - DNA, 201 bp, Homo sapiens
tcgctattatcataatcatcacattcatcattatcaatgatttttacatagattactatctgaaaagaaaatatatgatttaacataaatatttataacgkttttttctgcagatcagaacttctttaagcaaattcatttgtccaaaccacacaactgaatacttcatcctaacaattctattttttaaaatgtgacaaa

SEQ ID NO: 27226 - DNA, 201 bp, Homo sapiens
attaaagcagaaatccagaaataaaggcacatgtaagttggcacaagcagctacagctgatgacagacctgtatgttaccatttttgatgacttttgtttytcttcacagctacaatatacagcagcaggtaaagaaaatctacaaaactataatctggtcacagacacgcccctctatgtgactgctgttcagagtggca

SEQ ID NO: 27227 - DNA, 201 bp, Homo sapiens
tgccttccagcaccttgtccctgacacacgccaagaaccagaagcatctggccagccatgtaagtaaagcaaaaacatgacagctttcccaccctccctcycctcccctgctctccactccaagaatctttcaggctgattcatacgttgtccagaagtacccctagcactcccgtgggcatgtccaggaaataattccaa

SEQ ID NO: 27228 - DNA, 201 bp, Homo sapiens
acgatctcggctcactgtaatctctgcctcccaggttcaagcaattctcctgcctcagcctcccaagtagctgggattacagacatgtgccatcacgcccrgctaatttttgtatttttagtagagacggggttttaccacattggccaggctggtgttgaactcctggccttgagtgatctgcccaccttggcttcccaa

SEQ ID NO: 27229 - DNA, 201 bp, Homo sapiens
aaggaatataaatcattctattataaatatatatgaacacatatattcattgcagcactattcacaatagcaaagacaaggaatcaacaacgatagattgkataaagaaaatgtggtacagatagaccatggaatactgtgcagccataaaatggaatcagatcatgtcctttgcagggacatggatggagctggaagcca

SEQ ID NO: 27230 - DNA, 201 bp, Homo sapiens
ggtacatgtgcatgtatatattcacccaatgccctgaactgattaaggtagtttgcaaaaatatatatataggaaaatgaaaagaagtaaagaaattaatktaagggcaaagtaagaaaaactacataaggcataaactcaaaagcaaagcattttattttaagaaatttatagaatattgatcttattttaaagacttta

SEQ ID NO: 27231 - DNA, 201 bp, Homo sapiens
ggtcatcagaatccatggtggtgtcagtgggctgatgggcaggcaaagaaagttgctgtaacagtgtaggctctaactgaccaaagcccctcctctcccartcaaagctcttctagtgtcctgctctggggctggatcttcccagtctgagtctctcctttggtttaaggcaatgcacatttataataaaagcttatctgg

SEQ ID NO: 27232 - DNA, 201 bp, Homo sapiens; identical to SEQ ID NO: 5700

SEQ ID NO: 27233 - DNA, 201 bp, Homo sapiens
ggagtggtggtgcattggtcctgagggcgtggaacccagagctgcagcacagcaggcactctcgatagtgacttctgtggggtccatcactttgggggctrcatttgttattttggagtattttgggcggcaagttaagatggttatagatgcattttggactatctaaatgtcaatatggagagtttccttggaagatgt

SEQ ID NO: 27234 - DNA, 201 bp, Homo sapiens
gattcacattgaagtatttactctatattttactgctgttacattcaaaatgtatcagaagtctcatggttcaattaataaaatgttattcgttttcgtawctcagtgacgttcctttcaccaacacagatttatcccaccttagtaaagaacttctaacagacactgcattacactctgctggttaaaataatgtgcgac

SEQ ID NO: 27235 - DNA, 201 bp, Homo sapiens
gagattttagctgttctggccaaaacagagggaaaaaaaaaaaaagtaactgtgagatgatgggtgtgttaatttgttaaactctaatgacttttttttttactatccataccataataccatgttgtataccttaaatatacacaatgtaatttatcagcaaacaaaaatgggcatcaaggaaacattttagcttttttt

SEQ ID NO: 27236 - DNA, 201 bp, Homo sapiens
gcttctggggagcctgtaggaagattccaaacatggtagcaggcgaagtaggaacaggcgtctcacgtggcgggagcaggagcaagagagagtgaggggggaggcgctacacacttctaaacaaccagatgtcgtgagaactcactgtgataaagaacagcaccaaggggtggtgcgaaaccattcatcacaaatccaccc

SEQ ID NO: 27237 - DNA, 201 bp, Homo sapiens
acaaattttttcctttctactctcacacttaacacagaactcttctgtggccagtgttggggagttttctcctacacactaaaaaattctccagcagacamcagctagattgccttataattcaatttaattctggcactgtctacctggagttagagtcatctcccacaggttgcccacaggtaaagggctcagtctcac

SEQ ID NO: 27238 - DNA, 201 bp, Homo sapiens
gagccactgtgcccggcaggattttcttttttatggttgaataatattccattatataaatatacacacacacactctgtatatatatatatatatatatacacatacataaatatatatacacacacattttctttacatattcattcctggatgggcactttggttgtttctatatcttggccgttgtgaataatactg

SEQ ID NO: 27239 - DNA, 201 bp, Homo sapiens
caggagacagatgccttcctcttatctcaactgcaaaaaggccttcctctttttctaatcctcctcagcacagaccctttacgggtatcccccggtgtcaygctgggggacggtcaggtctttcccttcccacgaggccatatctcaggctatcacttgggaagaaaccttggacaatacctggctttcctaggcagaggc

SEQ ID NO: 27240 - DNA, 201 bp, Homo sapiens
tactctcacacttaacacagaactcttctgtggccagtgttggggagttttctcctacacactaaaaaattctccagcagacaccagctagattgccttakaattcaatttaattctggcactgtctacctggagttagagtcatctcccacaggttgcccacaggtaaagggctcagtctcacaagacctccccggctca

SEQ ID NO: 27241 - DNA, 201 bp, Homo sapiens
tgagccactgtgcccggcaggattttcttttttatggttgaataatattccattatataaatatacacacacacactctgtatatatatatatatatatatacacatacataaatatatatacacacacattttctttacatattcattcctggatgggcactttggttgtttctatatcttggccgttgtgaataatact

SEQ ID NO: 27242 - DNA, 201 bp, Homo sapiens
gtggcagggttttcagtaaaatgttttgcctcatcgtgtgctaggaaataatgcagaaaaaacttatgaaaacattcaatgtagaagacttttaggaaaayatcagagaatttaatgaaggaaagaagccttggcaaaatgatggatgagagctttctgtcacaattctaaccttaacagataatatgcctcatgtgcatt

SEQ ID NO: 27243 - DNA, 201 bp, Homo sapiens
gaaaattaccactcttttctacaaggcttgtgcattttgtatttgtttatatcaaaagatatttggaatccctatttagccacagggcagtgacttgattyagtcattttgtaactcttctttccagggagggagtagaggatggaggaggagagaaataggcaagaaatgactgactgtcactacaagatgtatctttgg

SEQ ID NO: 27244 - DNA, 201 bp, Homo sapiens
acaggaagcagataagctgtaggtctgtttttctttctggcttaggccatatagcccttctgcgcagataacatacatagctcataaactttctgcttcartttttcatcaaacacctaacagaagaaggcaagttagctccctgcttccttggcgttatctttcatttatgtatttgtttatttattgagacaagagtct

SEQ ID NO: 27245 - DNA, 201 bp, Homo sapiens
ttgtgactttatactctaatttaaaatttgtttctttaaattgtactcatgaggatgaaaattaccactcttttctacaaggcttgtgcattttgtatttrtttatatcaaaagatatttggaatccctatttagccacagggcagtgacttgattcagtcattttgtaactcttctttccagggagggagtagaggatgg

SEQ ID NO: 27246 - DNA, 201 bp, Homo sapiens
ccccttcacagccactgcttttcctgactccgcgttgcaggaggtcacccgagtctgtcttgtgacacccactgtcgttccttcccaaatttttactccastggaaaatgtgctcttccgggaggtgggcatcgtattcctcccctttcctcctgaatgtgtgggtgagagggatcaggagaggaaaagagggggagcgac

SEQ ID NO: 27247 - DNA, 201 bp, Homo sapiens; identical to SEQ ID NO: 5686

SEQ ID NO: 27248 - DNA, 201 bp, Homo sapiens
atcaatagtagtagtttaaaaaaaaactcatgttcattatattttgcaggtatctctcctaaatgtgtgatcaaggaattaccaccaacagagaacagtartacaggagaaaggttccaaacagtggcactggaaagacatcaaagctatgatattgaaaatttatacttcagggaaatacagaaacatctacatgacctt

SEQ ID NO: 27249 - DNA, 201 bp, Homo sapiens
taatcccggcactttgggaggctgcagcaggcaggttgcttgacctcaggagttcgagatcagcctgagcaacataggaaaactctgtctctaccaaaacwacaaaaaaattaggtgggcgtggtggtgaacatctttggtctcagccatttgagaggctgaggtgggaggatcgcttgagtcttaggagtggaggttgca

SEQ ID NO: 27250 - DNA, 201 bp, Homo sapiens
aatgggggcatagacgttgggtaaacattcccattccaaaagggagaaagccacaagaaagggctataggttccatgcaagttcaaaacccagcagggtartcattaaatctagtgcaaggcgtgggttcccaaggccttgggcatcctctgctcatggggctccctcaggcagacatcatggtttgcagacagctgtatc

SEQ ID NO: 27251 - DNA, 201 bp, Homo sapiens
ccccctaggtccttgtgggttacgtagtggcgccccaaacagtgacaggatcgggcgctctacagttggcgcctgtaatcccaattacttgtgaggctgargcaggaatcacttgaacctgggaggcagaggttgcagtgagctgagatcctgccactgcactccaggcctgggcaacggaataggctctgtctgaaaaac

SEQ ID NO: 27252 - DNA, 201 bp, Homo sapiens
actatctataccttgctatattgtgtaccttaaatatacacaataaaatttgtaagcaaacaagtaaaaaacagggcatcaagaacacccttcataacctmaaaaaagaacatcaaggcatatatatttaaaaacttttaactacagaacatgaaatagctcctagaatgcagtaaaagaaaattgagcataaaatgaaaa

SEQ ID NO: 27253 - DNA, 201 bp, Homo sapiens
atgcactgtcagctctcagtagaccaggagtagagaagctgtatgtggaagtcacatgttaatatgcaaaaatacctcataaattcttgaaaagatgcctytaaggggagatcttttctgcctgattttataccacatttgaagctataatgaatcagtcactctttctaactccacaatcttaatgaccgggaatggaat

SEQ ID NO: 27254 - DNA, 201 bp, Homo sapiens; identical to SEQ ID NO: 5736

SEQ ID NO: 27255 - DNA, 201 bp, Homo sapiens; identical to SEQ ID NO: 5702

SEQ ID NO: 27256 - DNA, 201 bp, Homo sapiens; identical to SEQ ID NO: 5704

SEQ ID NO: 27257 - DNA, 201 bp, Homo sapiens
agctccttgaggttatctactgggacatctagagaatgccatcttgcaaaccctactctggactgagtagctgaccccttcttccacccgccttctcactrtctcttttgcctaataaatatggagggctgtgtaaagctcagggcccttgtccactagaggcaaggtgtcccctgatcccttcttccaaatatactcttt

SEQ ID NO: 27258 - DNA, 201 bp, Homo sapiens
ggccttgggcatcctctgctcatggggctccctcaggcagacatcatggtttgcagacagctgtatccttcccaggtggccctacagaggaaggcacaccygacttttccaatgtcctgcagacccagctgtctcaactcttatggtgatccaagagtgagggcccctccctacttggacaccacccaagctggcaagtcc

SEQ ID NO: 27259 - DNA, 201 bp, Homo sapiens
acctccgtctcccaggttcaagcgattctcctgcctcagcctcctgagtagctgggattacaggcatgtgccaccacacctggctaattttgtatttttartagagatggggtttctccatattggtcaggctgatcttgaactcccgacctcaggtgatctgccagtctcggcctcccaaagtgctgggattacagacgt

SEQ ID NO: 27260 - DNA, 201 bp, Homo sapiens; identical to SEQ ID NO: 5685

SEQ ID NO: 27261 - DNA, 201 bp, Homo sapiens; identical to SEQ ID NO: 5708

SEQ ID NO: 27262 - DNA, 201 bp, Homo sapiens
catgacagatccttatattggttgtgaagtcattggtaatgtagggatgttttatttgtcctgatgtcatttgcctacgtttaatatttagaaataggcgytaaaatgtatagatagaggattttgctcctaccaaagtatatttgagaaaggaatatagatgcaggctgtattgtgaaaatttttaaaaaattatcttat

SEQ ID NO: 27263 - DNA, 201 bp, Homo sapiens
acaaggatgtgatgttggagaactataggaacctggtcttcctaggtgagtataatttccttctagaagttcagattcgcccttgtgcatttttgtatttyctctgttgtctttcttgggaacccctccgttatttgagactgaagccttattggttcaaaaataaaaagcttcacaatgctgcatctggcctttcactgt

SEQ ID NO: 27264 - DNA, 201 bp, Homo sapiens
ttacttccatatatactgtgtctccatgaacgtgtatttaaaccttgacaacaatttcctgctttcttagttttttcagattaatatttgcccattttgcyagcgtgtcttcttctgcatcccaagtctccttaacattgttgtactatcaataaggttttatgttgtctttttgtgtgtgtacaaaataaattcatccat

SEQ ID NO: 27265 - DNA, 201 bp, Homo sapiens
ttctagtgaaaaaccttataaatgtaatgagtgtggcaaatcttacattagtcgctcaggcctcactaaacatcagataaaacatgctggagagaaccttmcaactaaactcaatgtggaaaggccgttagatgttgtcctaacctctgggatccccaaataatttatacttactcatatagcttgtatatttgtcctttc

SEQ ID NO: 27266 - DNA, 201 bp, Homo sapiens
aaacgtcgcggccatcttagccttctattcagctgctgaaagggatttacctccacgccatttttgtcttgtgtaaactggagcctctgtatatggacccstatttatgaagggttgaggtgccaggaaatgggacagtttcagtgctctttcatcttcccggccatccccggtcacccccggtcacccccggtcaccagc

SEQ ID NO: 27267 - DNA, 201 bp, Homo sapiens
ttgactatgtgtgtattgtataaagacctatttagaaagcagccaaatctatatacattgtgaattatctagccttgtttgtacagttgcttttacttttmggtgtgtttatattattgtgttttatttgtaagaaatgaaggatatttatacatggaatttcctttatgtgtaagagataaaaggaatcttacacatctc

SEQ ID NO: 27268 - DNA, 201 bp, Homo sapiens
aatatgaaagaatccatgctttgttggtagttcaacttttgaccattacaatgatacatgaatcacccaccactcaagaaggaactatggttgtcattttratgtacatactccagaccatttttggaatattggcattctttgcatgctggtgcctgccaaccaacttttttaaaattactaatttatttatttatttat

SEQ ID NO: 27269 - DNA, 201 bp, Homo sapiens
ataaaaggaatcttacacatctctcccaatgtgtaagagatgagggatatttatacatggagtttcctttatactaaaatagggttttcaaccccctttarctgtaattttccactacctacccaaatgctataaaactgccctccccttatcacccttttctgactcctttttcggactcagtccgcctgcacccaggtg

SEQ ID NO: 27270 - DNA, 201 bp, Homo sapiens
acaaagttcagtctcactacacatcagaaaactcatacaggagaaaaaccttatatatgtagtgaatgtggaaaaggcttcattgagaagaggcgtcttaytgcacatcatcgaactcatactggtgagaaaccctttatatgcaataaatgtgggaaaggcttcaccttgaagaacagtcttatcacacatcagcaaact

SEQ ID NO: 27271 - DNA, 201 bp, Homo sapiens
tattttgaaataagtttagattcacaaaatcttaccaaaatattccagagttcttgcccttaacccagcttcttccaaagataacaacttacataagcatrgttcattaccaaatacaggaaagtgaaattgttacaatactgttaactacagaatttatttggaaatcaccagttttaacatgcatgcatttttgtttgt

SEQ ID NO: 27272 - DNA, 201 bp, Homo sapiens
cctcatctctacctaatctgctccccagaacctctctgacctcatctcctccctgtgtccttcctgctccctctgctccagccacacaggcctctttcctsttccctgggctgaggttgctcctgcctcagggcctctacctgggctgtctggcccctcagctgcaggtgcaaacatccttccttcttgaggtctttgttc

SEQ ID NO: 27273 - DNA, 201 bp, Homo sapiens
tgaaataagtttagattcacaaaatcttaccaaaatattccagagttcttgcccttaacccagcttcttccaaagataacaacttacataagcatagttcrttaccaaatacaggaaagtgaaattgttacaatactgttaactacagaatttatttggaaatcaccagttttaacatgcatgcatttttgtttgtttttt

SEQ ID NO: 27274 - DNA, 201 bp, Homo sapiens
ttcctggtgctgagctccttgaggttatctactgggacatctagagaatgccatcttgcaaaccctactctggactgagtagctgaccccttcttccaccygccttctcactatctcttttgcctaataaatatggagggctgtgtaaagctcagggcccttgtccactagaggcaaggtgtcccctgatcccttcttcca

SEQ ID NO: 27275 - DNA, 201 bp, Homo sapiens
ttttatgtatgtgtctgcatatataaacacatttattatgacttcttttgcttcagtggaatcacattccacctgttggtcaccttagatcaagcttgtayaacctgtggcctgtgggctgcatgcagctcaggatggctttgaatgtggcccaacacaaatttgtaaattttcttataatgagaattttttgcatttttt

SEQ ID NO: 27276 - DNA, 201 bp, Homo sapiens
cagaagttcaagaccagcctggccaacgtggcgaaaccctgtgtctactaaaaatacacacaaaaaattagctgggtatggtgctgggctgttgggagccraaggcccatgggatgtgaccaactcagcattccactggaggctatatgatcaaacagcaaactttatcatgaatgcacgatgtgggcaaactcatgactg

SEQ ID NO: 27277 - DNA, 201 bp, Homo sapiens; identical to SEQ ID NO: 5711

SEQ ID NO: 27278 - DNA, 201 bp, Homo sapiens
tcctccctttttgaaatgcagggcattggagctgcaaatcttctctgagtctgaagtatcctgcctgacacatttgctcgcactcacccatgccttccttyagtccctctcttctgcacttagattccagatctcacagtgactcagtgacatgagcttgggaagaggctccactgggcatggtcctgggaagggctcaca

SEQ ID NO: 27279 - DNA, 201 bp, Homo sapiens
ttgttctgtctcctccctttttgaaatgcagggcattggagctgcaaatcttctctgagtctgaagtatcctgcctgacacatttgctcgcactcacccaygccttccttcagtccctctcttctgcacttagattccagatctcacagtgactcagtgacatgagcttgggaagaggctccactgggcatggtcctggga

SEQ ID NO: 27280 - DNA, 201 bp, Homo sapiens
catttaacactccagccacaccctcaccccacccctggtgcatattatgtgtctctgtgtttctggtccattgtgttctactgtctacaaactggtaacartgaagccccaaggggacagcagagctgggaggatggggctgtgctagtcttgccccctttaagatgtgttcaaccctggcttcacattagcgtgctgagg

SEQ ID NO: 27281 - DNA, 201 bp, Homo sapiens
cccaggcactccagactgggcaacagagtggaccttgcctcaaaaagagacaaaaaaaaaacaaaaaaaaagaaaaactctcatataccaagggtgagaakagcaaatggaacacgaacttgactctgaaaaatagtttgacaatttctctgtatatttatatactgatacctatatcacacacatagattcacacaggca

SEQ ID NO: 27282 - DNA, 201 bp, Homo sapiens
aatatatgtttgcacaacataagtcttttggtcataggatgtttgaaactaggctttcctaaacttaatttgaattacatgtagtcaccctttctttactrtagacttctattcattttgtatttctaaaaataaaagatcatggtggagaactctcacacctgtctagtataaagattatgtttagtgtaggtatgtttc

SEQ ID NO: 27283 - DNA, 201 bp, Homo sapiens
acttagaatactttgcaagtatcaagatgtggatggcggccgggtgcagtggctcatgcctgtagtcccagcactttgggaggctgagatgggtggatcasttgagctcaggagttcaagaccagcctggccaacatggtgaaaccccgtttctactaaaagtacaaaaattagcagcgcatgtggcgttcacctgtaatc

SEQ ID NO: 27284 - DNA, 201 bp, Homo sapiens
agcaggagaatcgcttgaacccaggagatggaggttgcagtgaacagagatcacgccactggagtcttactcactccagcctgggcaacagagtgagtgaractcagtctcaaaaaaaaaagaaaaaaagtcaaagatgtggatggtaatgaataatttaaataagatagtgcttattatttgcttaggacagtgttctca

SEQ ID NO: 27285 - DNA, 201 bp, Homo sapiens
atgttcattatattttgcaggtatctctcctaaatgtgtgatcaaggaattaccaccaatacagaacagtaacacaggagaaaaattccaagcagtgatgytggaaggacatgaaagctatgacactgaaaatttttacttcagggaaatccggaaaaatctacaggaagttgactttcaatggaaagatggtgaaataaa

SEQ ID NO: 27286 - DNA, 201 bp, Homo sapiens
aatacaaaaattagctgggtgtggtggtacacctgtaatcccagctatttgggaggctgaggcagaagaattgcttgaacccgggagacagagtttgcagygagctgagattgcaccactgcgcaccaacctgggtgacagagtgagatgcagtctaaaaaaaaacttattaaaaaaatatattatatatatggaaataaa

SEQ ID NO: 27287 - DNA, 201 bp, Homo sapiens
aaagaaaaagtaagagtgggggggatcatctataatatctaattctaccttagaactttcctttggtggtgggggtgggttctgggagtttgacagattgytaggttttggtataaggtcataaaatcctgtgcatatgggatttctgaccatttgccctgcctcttgcaaaataggtctaatggcaggatggtgtcataa

SEQ ID NO: 27288 - DNA, 201 bp, Homo sapiens
tgggcgtggtggcgtgcgcctgtagtcccagctactcgggaggctgagtcaggagaatcgcttgaacctgggaggcggaggttgcagtgaaccaagatcaygccactgccttccagcttgggtaacagagcgagactcagcctcaacaaaaaagaagtgttaaaaagttttacttttaaatatttcttttgaagaatgttc

SEQ ID NO: 27289 - DNA, 201 bp, Homo sapiens
gatttagattatagttagatgcagctgtagactatagacttttgaattggtagtagaaaaagttaagactttggggggccattgggatggaatgcattttrtatgtgaggagtacatgaattttggtggggcaagatggaatgctgtggtctgagtgtttttctctcctccacaattcatttgaaacttaatctccaatgc

SEQ ID NO: 27290 - DNA, 201 bp, Homo sapiens
tctgaggcttagtgattgatgaatcattaagggaatccagtgtacgtgtgtgtctattccaggttttcctattttatctggcggggtggtggtcttttgtstagagacaagtgaaagccgaagtcttttcacaagagccctggctggttttgtgtgtgtgtgtgtgtgtgtgtgtgtgtgtgtgtgtgtgtgtgtgtgtgt

SEQ ID NO: 27291 - DNA, 201 bp, Homo sapiens
gcaaagcctttaattggggctcattactaactgtacatcagagaattcataccggagagaaaccttacaaatgtaatgtgtgtggcaaggtctttaattayggtggatacctttcggttcatatgagatgtcatactggagagaaacctctccattgtaataaatgtggcatggtcttcacttactattcatgcctagcac

SEQ ID NO: 27292 - DNA, 201 bp, Homo sapiens
ttgctggcaagttttctcagcaggcccaactttgtggtcttcatactgaaggcccagggtccttcagtttgcagtttgtgtacactcctgctgtgttgcaygtgcccagagatcctgtaccttttagcctagtttgttcatgcatgcatggaggagaggtagaaaaatgggggaaaatggaggggagtccatagaaggctc

SEQ ID NO: 27293 - DNA, 201 bp, Homo sapiens
caatgcccagctgcctttaaactagacttaatattgtcagcacttgctggcaagttttctcagcaggcccaactttgtggtcttcatactgaaggcccagsgtccttcagtttgcagtttgtgtacactcctgctgtgttgcatgtgcccagagatcctgtaccttttagcctagtttgttcatgcatgcatggaggagag

SEQ ID NO: 27294 - DNA, 201 bp, Homo sapiens
tagggcccctcttctgagacatcctcactgaacttaatctagccaatgcccagctgcctttaaactagacttaatattgtcagcacttgctggcaagtttyctcagcaggcccaactttgtggtcttcatactgaaggcccagggtccttcagtttgcagtttgtgtacactcctgctgtgttgcatgtgcccagagatcc

SEQ ID NO: 27295 - DNA, 201 bp, Homo sapiens
aaaaaagtcaaagatgtggatggtaatgaataatttaaataagatagtgcttattatttgcttaggacagtgttctcagattgcagtatcctagaatgtaraaagacctctgaaaaggtagatgggtacacatggttttaaagaaaaaatgtgtgcatcttaactgtctatgtgacctctttcctaaaactggtctgcctg

SEQ ID NO: 27296 - DNA, 201 bp, Homo sapiens
tgctggccatttcccacaacagaagaaaatgatcaatgcccaggtgactttttctctattttattctctcctttattccatagtggatttgtagagacccrtaagaaatcatttcagaatctagagagaaataaactttaaatctaactccaacatcatggcaaagtaagatcaggaatatagtgtttatgtgattcctac

SEQ ID NO: 27297 - DNA, 201 bp, Homo sapiens
ggacatcaaggcatatatattttaaaaatttaactacagaatatgaaatggctcctagaatgcagtaaaggaaaactgagcaaagaatgaaaattattttkgtttgatttccacaaaataatgaaacctcctcacagtccaaggaattggaaaatggaaatacgaagggttttcattttccccatagcctcaaaatgtaaa

SEQ ID NO: 27298 - DNA, 201 bp, Homo sapiens
agttatacagtgactgtggggagaaagcagacaggttcctcaggagattattatttcatggcacttagatctcaagaaaaatttgctattcttcccagagktgatatggtgaacagtgttttgaactagctttctaataaaggcagaagatttcttactgctgtttattacacggttcctcagagactcctatggaaatag

SEQ ID NO: 27299 - DNA, 201 bp, Homo sapiens
gtgttttattccatcattgatttaaaaatatgaaatcaacctgaatgtcagattctagccatggtcagaatatccatctcacagagactgcggtgttcctkcggggactcttaccagcagttgttttaagttttaaggttataattttgctcagatgtaagagctgaacatttgttatcagagaagatggagccaaattct

SEQ ID NO: 27300 - DNA, 201 bp, Homo sapiens
gaaatttttttattactcacatgagtctccctgaaaactcggggatcagggtttttaaggataatttgataggtaggtgtcagtgagtcgggagtgctgaytggttgggtaggagacgaaatcatagagatctgaagctgtcattttgcactgagtcagttcctgggtggggtcacaagaccagatgagccagtttatgga

SEQ ID NO: 27301 - DNA, 201 bp, Homo sapiens
agtgaagtaatttgaaaagattaaatgttaagacaggcatggtggcttatgcctgtaatcctggcactttggaaggtcgaggtgggaggattgcttgagcycaaaagttcaagaccagcctgggcaacatgatgaaacatcatctccacaaaacatacaaatatcagctctgttatatatgaaataaacagagttttccaa

SEQ ID NO: 27302 - DNA, 201 bp, Homo sapiens
ttttctttatttcttttttcagatattttgtctttagtgtatagaaagatttagggcccctcttctgagacatcctcactgaacttaatctagccaatgcycagctgcctttaaactagacttaatattgtcagcacttgctggcaagttttctcagcaggcccaactttgtggtcttcatactgaaggcccagggtcctt

SEQ ID NO: 27303 - DNA, 201 bp, Homo sapiens
taacacaggagaaaaattccaagcagtgatgttggaaggacatgaaagctatgacactgaaaatttttacttcagggaaatccggaaaaatctacaggaasttgactttcaatggaaagatggtgaaataaattataaagaagggccgatgacccataaaaacaatcttactggtcaaagagttcgacatagtcaagggga

SEQ ID NO: 27304 - DNA, 201 bp, Homo sapiens
ttggctttaaagataggaagtcgtgggggcaaggaaactctctaaaggaaattaatctggcaacaacctaaataattctagaaaaggattcttttccagartcaagaacagagccaggtggttcttctcttctaaagacatttccatgggccagttccaccgcaagcttctcagagagaatatgttctgccgtacggacac

SEQ ID NO: 27305 - DNA, 201 bp, Homo sapiens
attgcaaaatattcattagtgtcatcatatcatagccagatctacaaccccagagtaattcccatggttatgttacatggcaaaaaggactctgcattgtrattaagtttattaatcagctgactttagcattgggagattattctggattgcccaagcacttaagaataggagaaaccggagagatgcagcagcaatagt

SEQ ID NO: 27306 - DNA, 201 bp, Homo sapiens
cttttccagagtcaagaacagagccaggtggttcttctcttctaaagacatttccatgggccagttccaccgcaagcttctcagagagaatatgttctgcsgtacggacaccgaacgtcccctaagatggccgcccccatgatgctctcccctaagggctctggctccgttacctgcaacgcaccgctcgcttattttttg

SEQ ID NO: 27307 - DNA, 201 bp, Homo sapiens
cagaaaaaaagaacaacaacaaaaaagaatacatagtgaagtaatttgaaaagattaaatgttaagacaggcatggtggcttatgcctgtaatcctggcaytttggaaggtcgaggtgggaggattgcttgagcccaaaagttcaagaccagcctgggcaacatgatgaaacatcatctccacaaaacatacaaatatcag

SEQ ID NO: 27308 - DNA, 201 bp, Homo sapiens
tcattttgtatttctaaaaataaaagatcatggtggagaactctcacacctgtctagtataaagattatgtttagtgtaggtatgtttccaatataaaatrtttgtttatcaatagtagtagtttaaaaaaaaactcatgttcattatattttgcaggtatctctcctaaatgtgtgatcaaggaattaccaccaacagag

SEQ ID NO: 27309 - DNA, 201 bp, Homo sapiens
gaaagggatttcacatactattgttggctttaaagataggaagtcgtgggggcaaggaaactctctaaaggaaattaatctggcaacaacctaaataattmtagaaaaggattcttttccagagtcaagaacagagccaggtggttcttctcttctaaagacatttccatgggccagttccaccgcaagcttctcagagag

SEQ ID NO: 27310 - DNA, 201 bp, Homo sapiens
attctggattaatctgaggcttagtgattgatgaatcattaagggaatccagtgtacgtgtgtgtctattccaggttttcctattttatctggcggggtgrtggtcttttgtctagagacaagtgaaagccgaagtcttttcacaagagccctggctggttttgtgtgtgtgtgtgtgtgtgtgtgtgtgtgtgtgtgtgt

SEQ ID NO: 27311 - DNA, 201 bp, Homo sapiens
taaattataaagaagggccgatgacccataaaaacaatcttactggtcaaagagttcgacatagtcaaggggacgtagaaaacaagcatatggaaaatcarcttatattaaggtttcagtccggtctgggtgaattgcagaaatttcaaactgcagagaaaatttatggatgtaatcaaattgagaggacagttaataatt

SEQ ID NO: 27312 - DNA, 201 bp, Homo sapiens
tgtagaaattaaattttttttctcataaaatttgtcccttttttttcctttatggcttttaacatgaatatatttcgtatttgcttctgcttccacaggtkcttttgctttctggtaaggactttaaacaggaaaaacttatttttgagtatgaaattaggtagaaacctacattttttttcaaacagatttatttctcgt

SEQ ID NO: 27313 - DNA, 201 bp, Homo sapiens
aattaggtagaaacctacattttttttcaaacagatttatttctcgtgtgaaataattcccgaatgtgatgagatcagcagcattaagaatttgcagactycagcaagtctgttcttttctctgtgtattaatctctgtgattatatggggatagattatcccatcaatttgtgaaggggtgggttgcccctccacacttg

SEQ ID NO: 27314 - DNA, 201 bp, Homo sapiens
gacttcagcaagtctgttcttttctctgtgtattaatctctgtgattatatggggatagattatcccatcaatttgtgaaggggtgggttgcccctccacrcttgtgggtgtttctcgtaaggtggaacgagagacttggaaaagaaaaagacacagagacaaagtatagagaaagaaataaggggacccggggaaccagc

SEQ ID NO: 27315 - DNA, 201 bp, Homo sapiens
taaaatgtttaggtattatttttaggaacattttatgattatccatttatccatgaattttgtttttcctgcctttaatcttcaatctagactattacttwtattgcagtgtattgctttctgactcccctttccttataatctataacaaaagataaattaattttaaatatttattttatatttggtcatcttaattct

SEQ ID NO: 27316 - DNA, 201 bp, Homo sapiens
acacatctctcccaatgtgtaagagatgagggatatttatacatggagtttcctttatactaaaatagggttttcaaccccctttagctgtaattttccaytacctacccaaatgctataaaactgccctccccttatcacccttttctgactcctttttcggactcagtccgcctgcacccaggtgattaaaaagcttta

SEQ ID NO: 27317 - DNA, 201 bp, Homo sapiens
taggtccgtgccctgaatgggagctcagtccagcctagctacacactgctgcagcctgtgtgtgggcttctcccagaggggagctaatgctgaagaaaacrgtgaaagattcacttggtctttgtgtaggaatttattattcttgcatcccccctggtgcagtgggctgtctctccacaggctgagttcttccctgtgtgc

SEQ ID NO: 27318 - DNA, 201 bp, Homo sapiens
gacccacagaggtgacggggggctgtgcgctgcatggggtttgatcagggataggtccgtgccctgaatgggagctcagtccagcctagctacacactgcwgcagcctgtgtgtgggcttctcccagaggggagctaatgctgaagaaaacggtgaaagattcacttggtctttgtgtaggaatttattattcttgcatcc

SEQ ID NO: 27319 - DNA, 201 bp, Homo sapiens
attaaaatcatcaaagataaaaagtatagaaagaagaatccaggagaaactgggtgcaagctttcagttctcctgttctagtggagttgcacaaagtgctraattttccctgcaacagtgtttgtcaacacatgtgaagttattgccaactagggaagctcatctaagcccagtgtctgtagccacccagagtcaaaacaa

SEQ ID NO: 27320 - DNA, 201 bp, Homo sapiens
gcttctgctggaatggatgaggcctttatttacacagtcaacaagaggctagtctgggctttcttacaatgtgttggaagatctctaagagacaagcaagscttgatgagcaagcttatttctcacctccatttgtgttacacttgctactgtcctattggacacattagtcagtcactatggagaatactatccaaagat

SEQ ID NO: 27321 - DNA, 201 bp, Homo sapiens
ccaaaaagcgcactaagtgattagagagttgtggctttgagccatgtaataccagtcaggaaggggagggaactggagactgaactcagctacatgggcartgcttcaataaactgtgcctacatcatgaagtctcaataaaatctctggacatcaaagtttaggtgcgcctcgctggctggcaagtactcttgaatattg

SEQ ID NO: 27322 - DNA, 201 bp, Homo sapiens
gcatattgttttatgtattttacaagatttccttctttagtacagatggtatagctcagcagcagtttccctaaaacttacagaaactccataatgttgtrttgatagtatcagttattccttttacttctgtttcacctgacttaattcctactatgaaagtatatatttgtcggttaaattgattacagtttttaagtt

SEQ ID NO: 27323 - DNA, 201 bp, Homo sapiens
cgtctcctcctgaggaaaagccggaaggccgcattccgctctccatggaaacgcggctgaccgtctctggaggtttagagggggagggagttgggcgaggrgcccagaagtggaagaagtttagggaagtaagttcagcttttaagaggtcgcggcgattccaaggagagtcaggtcagtgtgtgggtcagggcgtggaaa

SEQ ID NO: 27324 - DNA, 201 bp, Homo sapiens
ctgtttgtcttactgccttcgtttttatatagttgatttttttttcctgaaatagttttatttccattgtgtgtgtcttctatacattctctgtggttacygttgcaattacagaaaacactttagatttataacatcctattttaaactaataacagcttaacttcaattacatacagaaatgactttttacagatctgc

SEQ ID NO: 27325 - DNA, 201 bp, Homo sapiens
gtctctggaggtttagagggggagggagttgggcgaggggcccagaagtggaagaagtttagggaagtaagttcagcttttaagaggtcgcggcgattccmaggagagtcaggtcagtgtgtgggtcagggcgtggaaacgtggtgggagggagctttctgagggcgtctgcgttgttggtggcgctatatggtggaggta

SEQ ID NO: 27326 - DNA, 201 bp, Homo sapiens
tttctcttacttaatttagaggaaatgaatccagtgtttcacttgttgggtgaaatatttttccttaacagtttttgggttttttttttttttttttttttacagatttcctttgcaacatgatttttaaattttctaataatttatgcaagcatatactgctgcaatacatattgtttctatcttaatctgttaaatttt

SEQ ID NO: 27327 - DNA, 201 bp, Homo sapiens
gacatcagtcctgctgacaccttgatcttggattccccagccagcagaatcatgagaaatacatttctgttgttcataagttagttagtctctcttatttygttatagccacacagaaagactaggacatactctgtaatataactgtcggattctgttgattcaactctaatttttagacatctgggttcaggtgcttgc

SEQ ID NO: 27328 - DNA, 201 bp, Homo sapiens
gacagtgaaataatacaaattaaaatcatcaaagataaaaagtatagaaagaagaatccaggagaaactgggtgcaagctttcagttctcctgttctagtrgagttgcacaaagtgctgaattttccctgcaacagtgtttgtcaacacatgtgaagttattgccaactagggaagctcatctaagcccagtgtctgtagc

SEQ ID NO: 27329 - DNA, 201 bp, Homo sapiens
tcttttatcagtgtcttaagagctttcagtgtacagatcttttacttcactggttaaatctgttcctaagtattttattccttttgatgctattacaaatrggactgttttctttatttcttttttcagatattttgtctttagtgtatagaaagatttagggcccctcttctgagacatcctcactgaacttaatctagc

SEQ ID NO: 27330 - DNA, 201 bp, Homo sapiens
atgatctctaactactggtgtcaagtgatcttgtcgcctcagcttctcagagtgctgggattacagccatgaactgctatgcctggcctagatgtctcttmaagatactggtttcatttatttcctttggatatatacccagaaatgggattgctggattgcattgttgttctatttttaatattttgaagaatgtccata

SEQ ID NO: 27331 - DNA, 201 bp, Homo sapiens
cttgattttattccaaatgagttgagaacacagtagggagttttgagtagagaagtgacatgatataactaatttatttgatagattactttgcctgctaygtagaaggtagacgttaatggggaggagagggaactgctacactcatgattacagtttgtgacagtgaaataatacaaattaaaatcatcaaagataaaa

SEQ ID NO: 27332 - DNA, 201 bp, Homo sapiens
aagcagctggtggaacagtaagtgttaggagttggcactgtgcttgtagggtgggaacagctctttgttaaggtgcctttgagcagatagatgatgaacaygtgtaggctccctggatgaagagtgttccaggtgtgagacaatgagaagttgaaaaatgaccctggagtgtgtttgaggaacttctaggaagcttgaatg

SEQ ID NO: 27333 - DNA, 201 bp, Homo sapiens
gatagcctactatattccaacgctatcagcagtacaaataagaaagaaaaaacataccatgtccttattcttcacaatgcttttgttctcttagaagtaaycatataaccagtaataagcagatatataaataacatatcttggagtaaaaattgctataaggaaagttaaagcagctggtggaacagtaagtgttaggag

SEQ ID NO: 27334 - DNA, 201 bp, Homo sapiens
aaaattagggaccaataactttctcacagatgccatatagatatgtcaaaacacacacttcaaagtgatgtgatagttctctcctcattttgtgtaaacaraagagctctcatattgcttctttttgaaatgtgtttttcatttcaggggcatttgacattcaaggatgtagccatagaattctctcaggaggagtggaaa

SEQ ID NO: 27335 - DNA, 201 bp, Homo sapiens; identical to SEQ ID NO: 5735

SEQ ID NO: 27336 - DNA, 201 bp, Homo sapiens
tagatagtgtcaggatgagactggtccccagaaagaccaagcaattagaggattggaactgaaaggaggaatggactggagagtaagttctataaaaactyttgaacaggctgggcatgggggctcgcgcctgtaatcccgagcggatcatgaggtcaagagatcgagaccatcctggcctacatggtgaaagcccgtctc

SEQ ID NO: 27337 - DNA, 201 bp, Homo sapiens
ttgatatcccaggatactttcatcgtatatactgtgtctccattaacatatatttaaaccttgacaagagtctcctgctttctttgttttctcaaatcttygcctgttgtgctacgggtcctcattctgcaccccgtctccttaacgttcttgtactatcagtaaagttttgtggtgtctttgtgtgtgtacaaaatgaat

SEQ ID NO: 27338 - DNA, 201 bp, Homo sapiens
tctactcaaaagccagaacttgtaaatctaggtaattaaaagggcatagatgtatgaaatgaaatgagggtggcaaaacctttactagagttcaatcactrcttgtcataagagagtttatactgaaaggaaatcatataaatgtatgtgtcagaggctttccccaggcattggaactcactaggcatcagaatatacatc

SEQ ID NO: 27339 - DNA, 201 bp, Homo sapiens
acatctgggttcaggtgcttgctctgctgtttgcaggttgttgacctaggtgactttcttagcctgtctgtgacacagttgtcttctagtaagatgggaaraaatatttctgtcataggtgattatgtcatcatttgagttagaacacgtaaatcctttgaagtaatgcccggtacatggggagtgttccaaaactttagt

SEQ ID NO: 27340 - DNA, 201 bp, Homo sapiens; identical to SEQ ID NO: 5746

SEQ ID NO: 27341 - DNA, 201 bp, Homo sapiens
cctatttaaaatagccttcgtaagaggtatgaggtgatagcttatggtggttttgattagcattcctctgatgattagtgatcttgagcatcttattatayacctgttggtcatttgtatgtcttatttggaaaatgttcaggtcctttgcccatttttattgagattatttggggtattttgctgtagaattgtaggagt

SEQ ID NO: 27342 - DNA, 201 bp, Homo sapiens
attcacctagttgtgtaaccataccacaatcaattttggaacatatactatgtataaatatatattatcaaatagtcttgatgattatggttctatagtargttttgaaattgggaagtgtgagtcctccatctttgttctttgctttgaaggttgttttgactattctgagtcctttgaatttccatttgaagtttagaa

SEQ ID NO: 27343 - DNA, 201 bp, Homo sapiens
gaatctgtgaagccagagaagttatctgcttccaaaatacaatggtgggacaggcataggaaacaccctcagccctggaaaccacccttctactttgttaytctgaatttgatgtttgtacttagcacgtgtaagtaagtgcatgaagtatgtttctttgtgtgtgttgggaacgggtgctcagtgtcgcaaaaatcaaca

SEQ ID NO: 27344 - DNA, 201 bp, Homo sapiens
cccactttttttccttgagatttcatctttgtttattttatgcacatcttgtttttgtctacataattatcttcttaggattttcaaatctgccttttctygtccactgtcacagtgtctctgcttgtgtattacctctcttgctatgaaattccattttccaggcctctccggaaagagagacctttgaactcattactt

SEQ ID NO: 27345 - DNA, 201 bp, Homo sapiens
gtcatactggagagaaacctctccattgtaataaatgtggcatggtcttcacttactattcatgcctagcacgtcatcaaagaatgcataccggagagaamccttacaaatgtaatgtgtgtggcaaggtcttcattgacagtggaaacctttcaattcataggcgaagtcataccggagagaaacctttccagtgtaacg

SEQ ID NO: 27346 - DNA, 201 bp, Homo sapiens
aagcaatgaaggaagaagaaggaggttgctggccttggatatcataatttctggggacaactttaagtggacactaatatttctgactaggaaaacttcaraaacttcatggcaaatgcagaagagacaaagacgtatagtccatgttatccactattttctgagcacagaagaaaatgatcaagacccaggtgatatttt

SEQ ID NO: 27347 - DNA, 201 bp, Homo sapiens
gggtttcaccatgttgatcaggctggtctcgaaatcctgacttcaagtgatccatccaccttggcctcgcaaagtgttgggattacaggtatgagccaccrcaccctgccaaattagtatgttgggtttttaaaaatccaactgatacagctgtacattagcaacagagctcttgcttttacattatacaattttagttca

SEQ ID NO: 27348 - DNA, 201 bp, Homo sapiens
tcagcattgccatgactttgcacatactattcgcggttggcacacgtagtataacgtgatctccttcttaacctttctttcttttgttttttttttgagayggagttttgctcctgttgcccaggctggagtgcaatgacgccatcttggcccacagcaacctccgcctcccgggttcaagcgattctcctgcctcagcct

SEQ ID NO: 27349 - DNA, 201 bp, Homo sapiens
tactctgaagtggtagattctcacatcattctcttgccccacacaagagagtataatctaccttcttgttacagatctgatacctatgtagtccttaaaaygtaactctcctttttcaatattgccagccccgtttgatttgtctaaatcttctgtcatttcccatgaacagggtatcaagccagcaaaccagatgcactc

SEQ ID NO: 27350 - DNA, 201 bp, Homo sapiens; identical to SEQ ID NO: 5689

SEQ ID NO: 27351 - DNA, 201 bp, Homo sapiens
aataaatgtggcatggtcttcacttactattcatgcctagcacgtcatcaaagaatgcataccggagagaaaccttacaaatgtaatgtgtgtggcaaggkcttcattgacagtggaaacctttcaattcataggcgaagtcataccggagagaaacctttccagtgtaacgaatgcggcaaggtcttcagttactactca

SEQ ID NO: 27352 - DNA, 201 bp, Homo sapiens
caggtgttatgaaattaatataaataagatgtttttgtaagtttttattttgaaataagtttagattcacaaaatcttaccaaaatattccagagttcttdcccttaacccagcttcttccaaagataacaacttacataagcatagttcattaccaaatacaggaaagtgaaattgttacaatactgttaactacagaat

SEQ ID NO: 27353 - DNA, 201 bp, Homo sapiens
gtagaaggtagacgttaatggggaggagagggaactgctacactcatgattacagtttgtgacagtgaaataatacaaattaaaatcatcaaagataaaaagtatagaaagaagaatccaggagaaactgggtgcaagctttcagttctcctgttctagtggagttgcacaaagtgctgaattttccctgcaacagtgttt

SEQ ID NO: 27354 - DNA, 201 bp, Homo sapiens
tcttattcctcttatactgaatcctgagtttctccatactttttttttttggaaagaaggtctcatctgtcacccaggctcactgtagccttgacctcctyggctcaagcgatcctcccacctcagcctcttaagtggctgggactacaggcacacatcaccatgctcagctgatttttgtatttcttatagaggtggggt

SEQ ID NO: 27355 - DNA, 201 bp, Homo sapiens
tctgaggacacagcaacagcccctccatcactccttcttcccaaggaagagctcttttttgttatagtatggaaaatatgccccactttcttttctttttytttttttttttttgagatggagtcttgctctgtcaccaggctggagagcagtagcgcaatcttggctcactgcaacctccgcctcccgggttcaagggat

SEQ ID NO: 27356 - DNA, 201 bp, Homo sapiens
atctgaggacacagcaacagcccctccatcactccttcttcccaaggaagagctcttttttgttatagtatggaaaatatgccccactttcttttcttttyttttttttttttttgagatggagtcttgctctgtcaccaggctggagagcagtagcgcaatcttggctcactgcaacctccgcctcccgggttcaaggga

SEQ ID NO: 27357 - DNA, 201 bp, Homo sapiens
atttctttgacttttcaacattgttgaatgaatggatgaccgcacagttacagaatattttactggaattcttattctgtcaaaatgtactaagaaaaaaaccccaccagcttcctatgtggtgaaaatgagcggaatgacttccttgacattcttttcctatcaccaaaagaatatgacttcattaaacagaagtgtgtt

SEQ ID NO: 27358 - DNA, 201 bp, Homo sapiens; identical to SEQ ID NO: 5738

SEQ ID NO: 27359 - DNA, 201 bp, Homo sapiens
ttagtcttattcttggaagtggaagacagcagttatcagagaggagaatttaatcaaaagaatcagaatagcatggtcacaggccagattcacattgaagyatttactctatattttactgctgttacattcaaaatgtatcagaagtctcatggttcaattaataaaatgttattcgttttcgtaactcagtgacgttcc

SEQ ID NO: 27360 - DNA, 201 bp, Homo sapiens
aacagatttgtttaatcatctaataatctttgtgctttatacatgttttatatagtctcttttatttcattcagaataaaataataatatggttaactatrttaaccatagttatttagaatgcattgtcttgtgatactagcatctgccatgtcttcattacagagtttgatattggcctgaaagctcatagtgaattta

SEQ ID NO: 27361 - DNA, 201 bp, Homo sapiens
gcacaaacatttcggtgcaataaagagcagtattgctgccagcatgtctcacctgcagccctaaggtggttttctcctatctcagtaaacagaacatacartcaggttttacaccgagacattctattcccagggatgagcaggagacagatgccttcctcttatctcaactgcaaagaggctttcctcttttactgatcc

SEQ ID NO: 27362 - DNA, 201 bp, Homo sapiens
cagtaaacagaacatacagtcaggttttacaccgagacattctattcccagggatgagcaggagacagatgccttcctcttatctcaactgcaaagaggcyttcctcttttactgatcctcctcagcacagaccctttatgggtgttgggctgggggacagtcaggtctttcccttcccatgaggccatatctcaggctat

SEQ ID NO: 27363 - DNA, 201 bp, Homo sapiens
ccaggagatggaggttgcagtgaacagagatcacgccactggagtcttactcactccagcctgggcaacagagtgagtgaaactcagtctcaaaaaaaaaagaaaaaaagtcaaagatgtggatggtaatgaataatttaaataagatagtgcttattatttgcttaggacagtgttctcagattgcagtatcctagaatg

SEQ ID NO: 27364 - DNA, 201 bp, Homo sapiens
tcccaaagaccacacctccaaatactatcacattgaggattgggtcctcaacataggaattttggcagacattaagtctttatatcaaagcagccttcatygtatctgtaagttttcattttgtagtttcttccaaacagtgtttgttgtcttttatcttagttcatatgcttttcaagtagaaatctcttgatgatatat

SEQ ID NO: 27365 - DNA, 201 bp, Homo sapiens
acctccgcctcccgggttcaagcgattctcctgcctcagcctcccgagtagctgggattacaggcatgcgccaccatgcctggctaattttgtatttttastagagacagggtttctccatgttggtcaggctggtctcgaactcccgctctcaggtgatccgcccacctcggcctcccaaagtgctgggattacaggcgt

SEQ ID NO: 27366 - DNA, 201 bp, Homo sapiens
cggcttcccaaagtgctaggattacaagcgtgagccaccgtgcctggcatttgtatgtcttatttgcaaaatgttcaggtcctttgccccctgtccccccyccgctttttttttttttgagacaaagtcttactctgctgcctagactggagtgcaggggcgccatctcggctcactacaacatctgcctcctgggttcta

SEQ ID NO: 27367 - DNA, 201 bp, Homo sapiens
cccacagcaacctccgcctcccgggttcaagcgattctcctgcctcagcctcccgagtagctgggattacaggcatgcgccaccatgcctggctaattttrtatttttagtagagacagggtttctccatgttggtcaggctggtctcgaactcccgctctcaggtgatccgcccacctcggcctcccaaagtgctgggat

SEQ ID NO: 27368 - DNA, 201 bp, Homo sapiens
ttcttaacctttctttcttttgttttttttttgagatggagttttgctcctgttgcccaggctggagtgcaatgacgccatcttggcccacagcaacctcygcctcccgggttcaagcgattctcctgcctcagcctcccgagtagctgggattacaggcatgcgccaccatgcctggctaattttgtatttttagtagag

SEQ ID NO: 27369 - DNA, 201 bp, Homo sapiens
tagtcccagctattcaggagcccaggagttccaagttacagtgagctgtgatctccccaggcactccagactgggcaacagagtggaccttgcctcaaaaagagacaaaaaaaaaacaaaaaaaaagaaaaactctcatataccaagggtgagaagagcaaatggaacacgaacttgactctgaaaaatagtttgacaatt

SEQ ID NO: 27370 - DNA, 201 bp, Homo sapiens
aagtggacactaatatttctgactaggaaaacttcaaaaacttcatggcaaatgcagaagagacaaagacgtatagtccatgttatccactattttctgakcacagaagaaaatgatcaagacccaggtgatattttccctttgattttttgatagatttatggtggcctgaagaagtcagttgaacttaaggaagtatat

SEQ ID NO: 27371 - DNA, 201 bp, Homo sapiens; identical to SEQ ID NO: 5698

SEQ ID NO: 27372 - DNA, 201 bp, Homo sapiens
cataagttcttcttaagtttacatcttatattcattgtctattaatacctaagaaattactccaaaaggtagtgacttgaaacaacacttaaaaaaaaaaatctcacactttctgtggctcaggaataagggcatggcttacctggctactttgattcacagtctctcatgggggttgtcgtcaaggtgttagctgggttg

SEQ ID NO: 27373 - DNA, 201 bp, Homo sapiens
attagcgtgctgaggcagtttgcaaatacacgttttgtgcccttttaccatagattccacttccagtaggtaggatggactcaacctccatattgtttaargtacccaaattgattctaatttgtatccagcattgagcgtccagcctttgtgtcttctgtttctgagagctgagctcagcctgtgatccacagggaggtg

SEQ ID NO: 27374 - DNA, 201 bp, Homo sapiens; identical to SEQ ID NO: 5682

SEQ ID NO: 27375 - DNA, 201 bp, Homo sapiens
ccacagaggtgacggggggctgtgcgctgcatggggtttgatcagggataggtccgtgccctgaatgggagctcagtccagcctagctacacactgctgcwgcctgtgtgtgggcttctcccagaggggagctaatgctgaagaaaacggtgaaagattcacttggtctttgtgtaggaatttattattcttgcatccccc

SEQ ID NO: 27376 - DNA, 201 bp, Homo sapiens
aagttgaaaaatgaccctggagtgtgtttgaggaacttctaggaagcttgaatggatagagtagagtgagcaaaagcaaaactgtctggaaataagaacartgggggcatagttggaagttttggtacagaggtcacatactgcctgtcaagggcattcatgaccttgattttattccaaatgagttgagaacacagtagg

SEQ ID NO: 27377 - DNA, 201 bp, Homo sapiens
accgggacgtgatgttggagaactacagcaacctggtggcagtgggtgaggacagctgccctgtgtcactcagagggtgcccagtcagtggccttcctttstcagctgcttacctgcagtactctgaagtggtagattctcacatcattctcttgccccacacaagagagtataatctaccttcttgttacagatctgata

SEQ ID NO: 27378 - DNA, 201 bp, Homo sapiens
ggatagctgtgtattacagacatttctttgacttttcaacattgttgaatgaatggatgaccgcacagttacagaatattttactggaattcttattctgycaaaatgtactaagaaaaaaaccccaccagcttcctatgtggtgaaaatgagcggaatgacttccttgacattcttttcctatcaccaaaagaatatgac

SEQ ID NO: 27379 - DNA, 201 bp, Homo sapiens; identical to SEQ ID NO: 5741

SEQ ID NO: 27380 - DNA, 201 bp, Homo sapiens
tggaatattttaacactatatatattaaaacttcctgatatattattatcagtattatttttccagtcaatactgatttaggctttattaattacttaccrttttgttcctcttcagaccttgctcctctgcttacactggagtcatctttcttttgcttgaagaatatccgttaggatttgctgtaatatgtaattcctc

SEQ ID NO: 27381 - DNA, 201 bp, Homo sapiens; identical to SEQ ID NO: 5742

SEQ ID NO: 27382 - DNA, 201 bp, Homo sapiens
atttttagtagagacggggtttcaccatgttggtcaggctgatctcgaactcctgacctcgtgatctgcccacctcggcctcccaaagtgttgggattacmggcgtgagccaccgcacccggcctatatgttcttatggaatattttaacactatatatattaaaacttcctgatatattattatcagtattatttttcca

SEQ ID NO: 27383 - DNA, 201 bp, Homo sapiens
aacagtagagttgagtagctgccacggaaaccatagacctctcttttaacatggaaataattttttaaaaattagttttattgctgacactattgattacraacaacatataaacttatttgttaatgttatggtaattagtattttatactcttctgctatgcagatatcttaaaatacgttttcatttgccatcctcct

SEQ ID NO: 27384 - DNA, 201 bp, Homo sapiens
tttatggttcaggttttgtttgggactaaatgattgaggaactgtcttgggggttaaggtacggaggtttctgatccaggttttggaattaatcccggtgscggtggtggtagcgccacagattccgatgtgggctgcagctctggaggcctgggaaccatggcaggtgatgggttagccccagccctggctgctggaaca

SEQ ID NO: 27385 - DNA, 201 bp, Homo sapiens
gcttggctgagggtttcactatgttggccaggctggtctcgaactcctgacctcaggtgatccacctgcctcagccacccaaattgctgggattacaggcrtgagccaccacaccggcctaagagtatgttgtttccacatatttgttgataatctaattttcttctgctgttgatctctagttttattttattatgatgg

SEQ ID NO: 27386 - DNA, 201 bp, Homo sapiens
agggtttgttttgtcagcgaatcggtttatggttcaggttttgtttgggactaaatgattgaggaactgtcttgggggttaaggtacggaggtttctgatycaggttttggaattaatcccggtggcggtggtggtagcgccacagattccgatgtgggctgcagctctggaggcctgggaaccatggcaggtgatgggtt

SEQ ID NO: 27387 - DNA, 201 bp, Homo sapiens; identical to SEQ ID NO: 5709

SEQ ID NO: 27388 - DNA, 201 bp, Homo sapiens
tcaagcgattctcctgcctcagcctcccgagtagctgggattacaggcatctgccaccatgcttggctgagggtttcactatgttggccaggctggtctcraactcctgacctcaggtgatccacctgcctcagccacccaaattgctgggattacaggcgtgagccaccacaccggcctaagagtatgttgtttccacat

SEQ ID NO: 27389 - DNA, 201 bp, Homo sapiens
agttgcttttacttttcggtgtgtttatattattgtgttttatttgtaagaaatgaaggatatttatacatggaatttcctttatgtgtaagagataaaargaatcttacacatctctcccaatgtgtaagagatgagggatatttatacatggagtttcctttatactaaaatagggttttcaaccccctttagctgtaa

SEQ ID NO: 27390 - DNA, 201 bp, Homo sapiens
acccacagaggtgacggggggctgtgcgctgcatggggtttgatcagggataggtccgtgccctgaatgggagctcagtccagcctagctacacactgctscagcctgtgtgtgggcttctcccagaggggagctaatgctgaagaaaacggtgaaagattcacttggtctttgtgtaggaatttattattcttgcatccc

SEQ ID NO: 27391 - DNA, 201 bp, Homo sapiens
attctactgagtgacattctagacccaaattctcaactctgccattgtaatgtgataatagcctgagatgaaatgtcatggaatgcatgtagctgtgttcytataagactttatttacaaaacaggtggtccaggtcctggatactatattactgactcttgatttaggtgaccatatggcttttctgcacaaattcacag

SEQ ID NO: 27392 - DNA, 201 bp, Homo sapiens
tattgttagtatattctccagaatttttcaaatgcatgagcatatttattttctgaaagaaaacagcctattttgcatttatcatgccatgaacttattatacatcatcatacctattttctaagatcaacatgttttataatatattcatgattatggtacaaagatagtaaaattaagtataaattgggaatatttttc

SEQ ID NO: 27393 - DNA, 201 bp, Homo sapiens
atattgttagtatattctccagaatttttcaaatgcatgagcatatttattttctgaaagaaaacagcctattttgcatttatcatgccatgaacttattatacatcatcatacctattttctaagatcaacatgttttataatatattcatgattatggtacaaagatagtaaaattaagtataaattgggaatattttt

SEQ ID NO: 27394 - DNA, 201 bp, Homo sapiens
aatattgttagtatattctccagaatttttcaaatgcatgagcatatttattttctgaaagaaaacagcctattttgcatttatcatgccatgaacttattatacatcatcatacctattttctaagatcaacatgttttataatatattcatgattatggtacaaagatagtaaaattaagtataaattgggaatatttt

SEQ ID NO: 27395 - DNA, 201 bp, Homo sapiens; identical to SEQ ID NO: 5710

SEQ ID NO: 27396 - DNA, 201 bp, Homo sapiens
tctcccactcctggcttcaaatgttggtttcatgtcagcctcccatagtgctcggattataggcaagagccactgcactttgtatttttttttattattgkattttttattgttttttaaaaaatattttcaatccatggttggttgaatccctggatgtgaaattttcagatattaaggtctgactgtaatctgcccttt

SEQ ID NO: 27397 - DNA, 201 bp, Homo sapiens
acacctcctcctgaatactttaaatcatctccaaattatgcctgatacttaatacaatgtaaatgctatgtacatagttgttatactatatgttttaattwatttatttatttattttttctttagagacagtgtctcggtctttcactcaggctggaatgtagtggtgccttcatggctcgctgcagccttgaactgggt

SEQ ID NO: 27398 - DNA, 201 bp, Homo sapiens
attataagtcatgttgagacaggagagtggcagtttagttgacaagagggtctcaatttattttccagtggcattcagggctaggccataccatacaatttgccaattgccacagaatcaggacattgaagacattattctgcacttttcttgcttcttttgtttctgtggaagtcagttgttaggacattttatttttct

SEQ ID NO: 27399 - DNA, 201 bp, Homo sapiens
gcagtgtttgtgtccctgggtacttgagattagggagtggtgatgactcttaaggagcatgctgcctttaagcatctgtttaacaaagcacatcttgcacygcccttaatccatttaaccctgagtttgacacagcacatgtttccgagagcacggggttgggggtaaggtcatagattaacagaatctcaaggcagaaga

SEQ ID NO: 27400 - DNA, 201 bp, Homo sapiens
gttttctaaatttgtatttataactcgtattccttttctctgtctccctctttttttctatgtgtttcttgttcttcatattgaagtgtgtatataaacaytttttttttttttttgagatggagtcttgcttttgtcgcccaggcttgagtgcaatggctgggctcactgcaaacttcgcctcctgcgttcaagccattc

SEQ ID NO: 27401 - DNA, 201 bp, Homo sapiens
ttatatcatgaacatgttttcatttattccttttttttttttctttatttgagacagggactcgccctcttccccaggatggagtgcagtagcacaattayggctcactgcagcctcaaccaccatctgcctgccttagcctcctgaatagctgagaccacaggcatccactaccacacccagctaattttttgttctttg

SEQ ID NO: 27402 - DNA, 201 bp, Homo sapiens
aagaaggaggttgctggccttggatatcataatttctggggacaactttaagtggacactaatatttctgactaggaaaacttcaaaaacttcatggcaartgcagaagagacaaagacgtatagtccatgttatccactattttctgagcacagaagaaaatgatcaagacccaggtgatattttccctttgattttttg

SEQ ID NO: 27403 - DNA, 201 bp, Homo sapiens
ggtctttgcatcatagacaaggtaaaggattaagtgctgtgcttttagatacgcatacacataaacatctcagtgctttacaaagcagtattgctgcccgmatgtcccacctccagccctaaggcggttttcccctatctcagtagatggagcatacaatcgggttttataccgagacattccattgcccagggacgggca

SEQ ID NO: 27404 - DNA, 201 bp, Homo sapiens
agggtcagcagacaaacacgtgaacaaaggtctttgcatcatagacaaggtaaaggattaagtgctgtgcttttagatacgcatacacataaacatctcartgctttacaaagcagtattgctgcccgaatgtcccacctccagccctaaggcggttttcccctatctcagtagatggagcatacaatcgggttttatacc

SEQ ID NO: 27405 - DNA, 201 bp, Homo sapiens
aatttgtcccttttttttcctttatggcttttaacatgaatatatttcgtatttgcttctgcttccacaggttcttttgctttctggtaaggactttaaamaggaaaaacttatttttgagtatgaaattaggtagaaacctacattttttttcaaacagatttatttctcgtgtgaaataattcccgaatgtgatgagat

SEQ ID NO: 27406 - DNA, 201 bp, Homo sapiens
ttagaaagcagccaaatctatatacattgtgaattatctagccttgtttgtacagttgcttttacttttcggtgtgtttatattattgtgttttatttgtragaaatgaaggatatttatacatggaatttcctttatgtgtaagagataaaaggaatcttacacatctctcccaatgtgtaagagatgagggatatttat

SEQ ID NO: 27407 - DNA, 201 bp, Homo sapiens
tttcaaccccctttagctgtaattttccactacctacccaaatgctataaaactgccctccccttatcacccttttctgactcctttttcggactcagtcygcctgcacccaggtgattaaaaagctttattgctcacaaaaaaataaataaataaaatagggttttcactaaagagtcacctcacaccaaggcagtttta

SEQ ID NO: 27408 - DNA, 201 bp, Homo sapiens
ggtgttcctccaagccctgttgtttgcttgtaataatgacttgcttgtattttactgtgtccgcatgttttgcaaggtcctgtttagaaagctgtcaaatygatatagattgtcaactgcctcaccttatttgcacacagactgcttttactttttggtttgtttatattattatgtttttaccaaagtgtatacatgaag

SEQ ID NO: 27409 - DNA, 201 bp, Homo sapiens
caaaccacacttaacatcaccaactcccttctttttttgttccttcgtattgtttttcctaattagaattcagcatgagtgaaaagaaggcatattttgtrtatcccaaatgccagcagagtgccttgtccataggagtcatttgacaaataactagtggagtgaataaatacaaccctcagaattgtgaatcagttgcct

SEQ ID NO: 27410 - DNA, 201 bp, Homo sapiens
ctttcctacacatctttcattgtggtctctgggaataaatcagtaaggtgagagggcctgcttcattaggtgtggttccttcatatccatgttttctggargattaaggtcactgtactgtgtgagttaagcagcatggaatatggtggagaatgatgtaaatttacaatgtaagtcactgagcttgttgtgttcagagtg

SEQ ID NO: 27411 - DNA, 201 bp, Homo sapiens
gttggaaatttttaatatcttgagcataattttttaagttactatcttaattgtggaaataccatttaatagattgatcgttctttgttatataacatacrttgcttttctgtagtaagtttcagtttcctaaatatagcttgctgggttttgttcaaattgcactgtttttttctttcttggaacaaatgctgtattata

SEQ ID NO: 27412 - DNA, 201 bp, Homo sapiens
agatgctaaaattcagaataaaaattgtccaggtaagtgagaaccagcaaggacagtggctataggagtcttattgtagtcattaaggaaaggtgtcacakatatgaagtatctgagggtacctaagcagctccactatatattcatctccccatctgataacttttttaatgctgttatagctttaaagactttttgtct

SEQ ID NO: 27413 - DNA, 201 bp, Homo sapiens
agtcatctttgattatttttttatactgcattctactgagtgacattctagacccaaattctcaactctgccattgtaatgtgataatagcctgagatgaratgtcatggaatgcatgtagctgtgttcttataagactttatttacaaaacaggtggtccaggtcctggatactatattactgactcttgatttaggtga

SEQ ID NO: 27414 - DNA, 201 bp, Homo sapiens
gcacacttttgccaatattaccttttaagaaagttttaggaatggggttttgggttaccaggtatacctttattggcaattttcaatagaatgttaaattrttcccaagaaaggttctgctcttaatactgactcgatctgtatatgctttaggaggatataggatttttctatttaaattttgtatccagccacctgact

SEQ ID NO: 27415 - DNA, 201 bp, Homo sapiens
ctgtgttttccctatgaaaaatcaagtgaagaaagtaaaaatgacctgtcagatagcacacttttgccaatattaccttttaagaaagttttaggaatggrgttttgggttaccaggtatacctttattggcaattttcaatagaatgttaaattgttcccaagaaaggttctgctcttaatactgactcgatctgtatat

SEQ ID NO: 27416 - DNA, 201 bp, Homo sapiens; identical to SEQ ID NO: 5691

SEQ ID NO: 27417 - DNA, 201 bp, Homo sapiens; identical to SEQ ID NO: 5694

SEQ ID NO: 27418 - DNA, 201 bp, Homo sapiens
gtaattaagtttattaatcagctgactttagcattgggagattattctggattgcccaagcacttaagaataggagaaaccggagagatgcagcagcaatagtcagtggtttcaaatatgaaagggatttcacatactattgttggctttaaagataggaagtcgtgggggcaaggaaactctctaaaggaaattaatctg

SEQ ID NO: 27419 - DNA, 201 bp, Homo sapiens
tgtaattaagtttattaatcagctgactttagcattgggagattattctggattgcccaagcacttaagaataggagaaaccggagagatgcagcagcaatagtcagtggtttcaaatatgaaagggatttcacatactattgttggctttaaagataggaagtcgtgggggcaaggaaactctctaaaggaaattaatct

SEQ ID NO: 27420 - DNA, 201 bp, Homo sapiens
gagactaggattgcaacccctgcttttttttgttttccatttgcttggtagatcttcctccatccctttttttttttttgagcatatgtgtgtgtctgcaygtgagatgggtctcctgaatacagcacactgatgggtcctgactctatccaatttgccagtctgtgtcttttaattggagcatttagcccatttacattt

SEQ ID NO: 27421 - DNA, 201 bp, Homo sapiens
tttgaagtgttttttatgtctgtatctccgtcagttctgctctgatcttagttatttcttgccttctgctagcttttgaatgtgtttgctcttgcttctcyagttcttttaattgtgatgttagggtgtcaattttagatcttttctgctttctcttgtgggcatttagtgctataaatttccctctatacactgctttaa

SEQ ID NO: 27422 - DNA, 201 bp, Homo sapiens
ccaattcaggatgtttgtgtttgtctttcctcatgaacagggtatcaaactagcaaaccagatgtactctccaagttggcacatggacaagaaccatggayaacagatgctaaaattcagaataaaaattgtccaggtaagtgagaaccagcaaggacagtggctataggagtcttattgtagtcattaaggaaaggtgtc

SEQ ID NO: 27423 - DNA, 201 bp, Homo sapiens
gggtgtatgtgtccaggaatttatccatttcttctaggttttctagtttatttgcgtagaggtgtttatagtattctctgatggtagtttgtatttctggrgatcggtggtgatatcccctttatcattttttattgtgtctatttgattcttctctcttttcttctttattagttttgctagcagtctatcaattttgtt

SEQ ID NO: 27424 - DNA, 201 bp, Homo sapiens
aaataggaaatcctttccccatttcttgtttttgtcatgtttgtcaaagatcagatggttgtacatgtgtggtactatttctgggggctctgttctgttccattggtctatatctctgttttggtaccagtatcgtgctcttttggttactgtagccttgtagtatagtttgaagtcaggtagcgtgatgcctccagcttt

SEQ ID NO: 27425 - DNA, 201 bp, Homo sapiens
gtccctacaaaggatatgaactcatcctttcttatggctgcatagtattccatggtgtatatgtgccacattttcttaatccagtctatcattgatggacrtttgggttggttccaagtctttgctattgtgaatagtgccgcgataaacatacatggacatgtgtctttatagcagcatgatttataatcctttgggtat

SEQ ID NO: 27426 - DNA, 201 bp, Homo sapiens
agcttcatccatgtccctacaaaggatatgaactcatcctttcttatggctgcatagtattccatggtgtatatgtgccacattttcttaatccagtctaycattgatggacatttgggttggttccaagtctttgctattgtgaatagtgccgcgataaacatacatggacatgtgtctttatagcagcatgatttataa

SEQ ID NO: 27427 - DNA, 201 bp, Homo sapiens
tgctagtcttgccccctttaagatgtgttcaaccctggcttcacattagcgtgctgaggcagtttgcaaatacacgttttgtgcccttttaccatagattscacttccagtaggtaggatggactcaacctccatattgtttaaagtacccaaattgattctaatttgtatccagcattgagcgtccagcctttgtgtctt

SEQ ID NO: 27428 - DNA, 201 bp, Homo sapiens
agtgctgggattacagacatgagccacaaccctggcccattaatcttttattttttaattttttttattatactttaagttctagggtacatgtgcacaaygtacaggtttgttacatatgtatacatttgccatgttggtgtgctgcacccactaactcgtcatttacattaggtatctttcctaatgctatccctcccc

SEQ ID NO: 27429 - DNA, 201 bp, Homo sapiens
tctaattatttcactgaacttaaaatgtaagggaccttctacatattgatagaacacatgctttgcatctgtcatttctctgtgtgtgtgtgtgtgtgtgkatatatatatatatatatatatttttttttttttttttttttagacagagtctcgctctgtcgcccaggctggagtgcagcggcgcgatctcagctcact

SEQ ID NO: 27430 - DNA, 201 bp, Homo sapiens
aggtgactttcttagcctgtctgtgacacagttgtcttctagtaagatgggaagaaatatttctgtcataggtgattatgtcatcatttgagttagaacaygtaaatcctttgaagtaatgcccggtacatggggagtgttccaaaactttagttcttgctgttgctcttgtcatcgctgtttttagtttctgacctttct

SEQ ID NO: 27431 - DNA, 201 bp, Homo sapiens
tttgaatttttgtgtatatctttttgtagattatatttgattgcttttaaagtttcagattataaatgtcataataggttcatatgaagattggcaaaccyctccattttctttccaaaattttgttggttctttttttatacaacagtcacattttattaaattcccacatattttgtttgtgtttgaatggccatgaat

SEQ ID NO: 27432 - DNA, 201 bp, Homo sapiens
gggctgaggttgctcctgcctcagggcctctacctgggctgtctggcccctcagctgcaggtgcaaacatccttccttcttgaggtctttgttctgatatyaccttctccattgggacttctgtgcctcaccctcctctcaccatttaacactccagccacaccctcaccccacccctggtgcatattatgtgtctctgtg

SEQ ID NO: 27433 - DNA, 201 bp, Homo sapiens
ttatgtttagtgtaggtatgtttccaatataaaatgtttgtttatcaatagtagtagtttaaaaaaaaactcatgttcattatattttgcaggtatctctyctaaatgtgtgatcaaggaattaccaccaacagagaacagtaatacaggagaaaggttccaaacagtggcactggaaagacatcaaagctatgatattga

SEQ ID NO: 27434 - DNA, 201 bp, Homo sapiens
ctgtacttcctggctttagctttacatgtcagcatatatttgaaacagagaaaacatgacattaaaaagaagtgctttaattcatgtgataaagaaaagtyatgtttacttaaaaagggtgaggaaatgcatagtttctgaaattactgtgagctgtgggagaaagatgtttgaatacctcatctctacctaatctgctcc

SEQ ID NO: 27435 - DNA, 201 bp, Homo sapiens
cacccacctacccacctacacgtctccatgtcccctgcagacctgtcccctgaactctagaattctgtgtccttttgtcctctcctctctctgcttagccrtctaacaggtatctccaccaaaagtgattgcctgaactcaccaagtacattcccctgcactcctgcacatctcagatgatggtgaccctgtacttcctgg

SEQ ID NO: 27436 - DNA, 201 bp, Homo sapiens
ctgactctgaatgtttcccaatgtgggaatgactcatggcttagtccttgaacctcttcttgtttctgtccacacccactgtctttcctcatcatctcatyttatgaatttaaaccccactgtattagtccattcttgaattgctataatgaaatactggagactgggtaatttataaagaaaacaggtttaattggctca

SEQ ID NO: 27437 - DNA, 201 bp, Homo sapiens
tgcattttgtatgtatttgtatcaaaagatatttggaattcctatttagccagagggcagtgacttgatccagttatttgtggtaactctcttcttcccartgatggagtagagcataaaggaggggagaaatggggcaagaaatgactgactgtcactacaagatatgtctttggtgttttttttggctttgttctgttt

SEQ ID NO: 27438 - DNA, 201 bp, Homo sapiens
tacaggtgtgagccaccgtgcctggccttgatacgacttttctactgcatgcagaatgtgattgaagaaaatgacagttttcatatcccatgcagcagcamattttcttctgaaggcaactacatggtacactggccagttgcaaaattccctatcattgttttcctgtttcataattaatgaaacatatgataacgcaac

SEQ ID NO: 27439 - DNA, 201 bp, Homo sapiens
aatatctaggctaaaatgtgggagctaagaacacagagtatattgatttatctattatggctagcagatatttaagaatattagcacaggtctttgagtamattttgcttctaagagaggttactatctattctcaattagactgggaggaaagtccctttgaagaggaacctctacttatttcattttctacactgtgtc

SEQ ID NO: 27440 - DNA, 201 bp, Homo sapiens
gattacaggtgtgagccaccgtgcctggccttgatacgacttttctactgcatgcagaatgtgattgaagaaaatgacagttttcatatcccatgcagcarcacattttcttctgaaggcaactacatggtacactggccagttgcaaaattccctatcattgttttcctgtttcataattaatgaaacatatgataacgc

SEQ ID NO: 27441 - DNA, 201 bp, Homo sapiens
gtttactttctgcagaaagggtgctgctcactagcagtcttgccacgagagtacacatgaacaaaagagaagggtcatttataacctgacgcatctggccrggcgcggtggctcatgcctgtaatcccagcactttgggaggccgaggtgggcggatcacgaggtcaggagatcgagaccatcctggctaacgcagtgaaa

SEQ ID NO: 27442 - DNA, 201 bp, Homo sapiens
aggcagaggttgtggtgagccaagattgtgccattgcactccagcctgggcaacaagagcacaactccatctcaaaaaaaagaatgaaggcatgaaatagraattgtgcaaggccatgggcctgactatcaaaagattggcttcaagttggccaaatacaggtcagtgatagaagctgcttgttggagaaatcgtggagca

SEQ ID NO: 27443 - DNA, 201 bp, Homo sapiens; identical to SEQ ID NO: 5687

SEQ ID NO: 27444 - DNA, 201 bp, Homo sapiens
gaattcaagatgtgaagtctattcatgacagatccttatattggttgtgaagtcattggtaatgtagggatgttttatttgtcctgatgtcatttgcctaygtttaatatttagaaataggcgctaaaatgtatagatagaggattttgctcctaccaaagtatatttgagaaaggaatatagatgcaggctgtattgtga

SEQ ID NO: 27445 - DNA, 201 bp, Homo sapiens; identical to SEQ ID NO: 5706

SEQ ID NO: 27446 - DNA, 201 bp, Homo sapiens
tacagattaacagcatctcaaggcagaagaatttctcttagtacagaacaaaatgaagtctcttacgtctacttctttctacatagacacagtaacagtckgatctctctttcttttccccacatctgacaccagatatgtggggtttttcccacacatcaattcaattctccatacctattaggtattctaaaatttact

SEQ ID NO: 27447 - DNA, 201 bp, Homo sapiens; identical to SEQ ID NO: 5688

SEQ ID NO: 27448 - DNA, 201 bp, Homo sapiens
agtattcagaagagtgtgaaacagtgccatgaacagaatatgtttggaaatattgttaatcagaacaaaggtcatttcctgctgaagcaagattgtgataygtttgacttacatgaaaaacctttaaaatcaaatttaagttttgaaaaccagaaaaggagctctggcctaaagaactctgctgagtttaatagagatggg

SEQ ID NO: 27449 - DNA, 201 bp, Homo sapiens
actccagagctgaggtacgtgtaaaaccttatggcggagttaatatatccaattccctgttcttcctgttttctatccttgtgctttttttttttttttttgacacagtctcagtctgtcacccaggctggagtgcagtggtgtgatcttgtgatcttggcacactgcaaccttagcttcttgggataaagccatcctccc

SEQ ID NO: 27450 - DNA, 201 bp, Homo sapiens
ttgttgattcacaaataaaaagcttcataatgctgcatctggcctttaactgtcccatttctatggatattctgcttccttctttgtacattagtggtgaytccagagctgaggtacgtgtaaaaccttatggcggagttaatatatccaattccctgttcttcctgttttctatccttgtgctttttttttttttttttg

SEQ ID NO: 27451 - DNA, 201 bp, Homo sapiens; identical to SEQ ID NO: 5693

SEQ ID NO: 27452 - DNA, 201 bp, Homo sapiens
ttttttattatactttaagttctagggtacatgtgcacaatgtacaggtttgttacatatgtatacatttgccatgttggtgtgctgcacccactaactcrtcatttacattaggtatctttcctaatgctatccctccccactcccctcaccccacgacaggccctggtatgtgatgttctccaccctgtgtccaagtgt

SEQ ID NO: 27453 - DNA, 201 bp, Homo sapiens
agaaatacgaacatgaaattcttattctctagaaattacaaaacgtaagtaaaatgaagaaattttaagtcaccataattgtacggaacagtcaaatattrttagtatattctccagaatttttcaaatgcatgagcatatttattttctgaaagaaaacagcctattttgcatttatcatgccatgaacttattatacat

SEQ ID NO: 27454 - DNA, 201 bp, Homo sapiens
ctgcccacacagagcaggcgtcaaagcagtgagggcatctgaggacacagcaacagcccctccatcactccttcttcccaaggaagagctcttttttgttrtagtatggaaaatatgccccactttcttttctttttttttttttttttttgagatggagtcttgctctgtcaccaggctggagagcagtagcgcaatctt

SEQ ID NO: 27455 - DNA, 201 bp, Homo sapiens
ttgtttcatgtttataatgagatagcatattggctttaccttagtcagcatgactagctatatcagataccatagatagggtggtttaaacagcagaaatkgacttttcacagatctgggtggtgcaaagttcaacatgtcagagccagccactttggttcttggtgtggacttttttctggtgtgccatggctgactctg

SEQ ID NO: 27456 - DNA, 201 bp, Homo sapiens
agacagggtttcaccgtgttagccaggatggtctcgatctcctgaccttgtgatccgcccacctcggcctcccaaagtgctgggattataaaaactttttwacatatttctttgtcccagtgatttgcttaatttttaaaattgccttctatattatcatgtgaatggattagttttatgaatagtaatgtattatgtgtg

SEQ ID NO: 27457 - DNA, 201 bp, Homo sapiens
gatggagtagagcataaaggaggggagaaatggggcaagaaatgactgactgtcactacaagatatgtctttggtgttttttttggctttgttctgttttkttttggggggggacatggtctctctctgccgcctaggctggagagcagtggcatgatctcggctcactgcagcttctacttcctggcctcaagcagtctt

SEQ ID NO: 27458 - DNA, 201 bp, Homo sapiens
aggcagagcttgcagtgagccgagatagcgccactgcactccggcctgggcgaaagaacgagactccgtctcaaaaaaaataataataataataacctgaygcgtccaccctactgctgtgtctggtttccattggctggaatcggacccaattctgtgcttgacctgattggctagcaccttagaacttcccaaaagagg

SEQ ID NO: 27459 - DNA, 201 bp, Homo sapiens
cgtgggtgcttgtagtccctgctactctggagcctgaggctcgagaattgcttgaacccaggaggcgaaggttgcagtgagctgagatcatgccactgcaytccagcctgggtgacagagggagactctgcctcaaaaaaacaaaacaaaacaaaattttaaaaaactgcctttcttcatggtccaggacatataaacaaa

SEQ ID NO: 27460 - DNA, 201 bp, Homo sapiens
attagccgggtgtggtggtatgtgcctataatcccagctactcaggaggctgaggtgggagaatcgcctgaaccctggaggcagacattgcaatgagccargttcatgccactgcactccaggctggatgacaaacccccctgcctccaccacacacccaaaacttgtgttttgatagcctactatattccaacgctatca

SEQ ID NO: 27461 - DNA, 201 bp, Homo sapiens
cgcaaaaatcaacactgagacaaaggatctctcagcaaggctagtttactttctgcagaaagggtgctgctcactagcagtcttgccacgagagtacacawgaacaaaagagaagggtcatttataacctgacgcatctggccgggcgcggtggctcatgcctgtaatcccagcactttgggaggccgaggtgggcggatc

SEQ ID NO: 27462 - DNA, 201 bp, Homo sapiens
gtttattcaggtttcatttttctgttccacaatgaagtgttgtgagtgaggagaactctactgggctctcaatgaaaagaagtctcatgagactgtcatgmgatccttgcttgtgacttgaagttacattttggcttattcttttatattttttagaagtgggggtgaatatttggtgtgagcaaaagaggaacagattat

SEQ ID NO: 27463 - DNA, 201 bp, Homo sapiens
taagctctgttatgcttctagcaaattgtgagactgtttgtttccaccctcataacctgttgcaataaatattatttctcacatattttaatattattaartttgttggagaaaacaaaccataaaaattcatttgctgttcagttttcaattacaataaagaaatagaacattgttaatttctgagacttgatggacagt

SEQ ID NO: 27464 - DNA, 201 bp, Homo sapiens
ccagattcacattgaagtatttactctatattttactgctgttacattcaaaatgtatcagaagtctcatggttcaattaataaaatgttattcgttttcrtaactcagtgacgttcctttcaccaacacagatttatcccaccttagtaaagaacttctaacagacactgcattacactctgctggttaaaataatgtgc

SEQ ID NO: 27465 - DNA, 201 bp, Homo sapiens
ttgaggattgggtcctcaacataggaattttggcagacattaagtctttatatcaaagcagccttcatcgtatctgtaagttttcattttgtagtttcttycaaacagtgtttgttgtcttttatcttagttcatatgcttttcaagtagaaatctcttgatgatatatattttgtggccagttaactaggtaattagagg

SEQ ID NO: 27466 - DNA, 201 bp, Homo sapiens
ctagccagtttttccagcaccctttattgaatagaatgtcttatctcaattgtttttgttgactttgtcaaagatcagttggttgtaggtatgtggctgtrtttctgggtttcctattccattccattggagatctgtggctgtatttctgggttccctattctgttctattggagatcttctattttaacagaagcattt

SEQ ID NO: 27467 - DNA, 201 bp, Homo sapiens
agacgtatagtccatgttatccactattttctgagcacagaagaaaatgatcaagacccaggtgatattttccctttgattttttgatagatttatggtgrcctgaagaagtcagttgaacttaaggaagtatatactgggataattgtgttctagggagaaattaacttacattgcttttgggagtagaggtgggggttc

SEQ ID NO: 27468 - DNA, 201 bp, Homo sapiens
gtagcccatttcttgcacttcaaggacttctcaactgatgtttataaaacctatatattttttcccgtcatgcttagggaatgaggaataaattttttttwaaaaattatattttatccagaagtgtttttcctaagttttcttctaggatttttgtagcctgaggtcttacatttaagtctatatccatcttgaattaat

SEQ ID NO: 27469 - DNA, 201 bp, Homo sapiens
attttcaaatcttactttattatacatgtagcccatttcttgcacttcaaggacttctcaactgatgtttataaaacctatatattttttcccgtcatgcytagggaatgaggaataaattttttttaaaaaattatattttatccagaagtgtttttcctaagttttcttctaggatttttgtagcctgaggtcttacat

SEQ ID NO: 27470 - DNA, 201 bp, Homo sapiens
gtgccctatttgagtttcagacttaacatgggagtggctacctcttctttcctgtttctgcattttggagttgaaatatttagcctgtgtctacgccaccrttggatgttggaagcacttaagtcgtttgatttcacacgttcacagctggagagcagtttgcctcaggatgaaacacatttttgagtctcacccatatct

SEQ ID NO: 27471 - DNA, 201 bp, Homo sapiens
tctggtactgcagatatctgtggtactagatcttcaccctcatgtctttctgtgttattgcagacaccggtttacgtcagttatctttttgctcagtggcscctaacctttcatcctgttcctttcagtgctaccacaggaggtcaccactaaggcaattctcagcctagccatggaggcagggacaccttagagagtgct

SEQ ID NO: 27472 - DNA, 201 bp, Homo sapiens
tcgctcttcacccttagagacaagtggctcttgtaaaagggggtcatctggtttggcacggtggctcacgcctgtaatcccagcactttgggaggccgagstgggcagatcacctgaggtcgggagttcgagaccagcctgaccaacatggagaaaccccgtctctactaaaaatacaaaattagatgggcatggtggtgt

SEQ ID NO: 27473 - DNA, 201 bp, Homo sapiens
gtgttccccactgagtgtttgggggacttagtagggtccccagtgtttgctcctggttttagcctcaggagcacttggtaagggggctatagggatggtcrctcttcacccttagagacaagtggctcttgtaaaagggggtcatctggtttggcacggtggctcacgcctgtaatcccagcactttgggaggccgagctg

SEQ ID NO: 27474 - DNA, 201 bp, Homo sapiens
actatgcctacaggtgcaaaccaccatgcttggctaatttttttttttttttgtagagatggagtctatgttgcccaggctggtctcccactcctggcttyaaatgttggtttcatgtcagcctcccatagtgctcggattataggcaagagccactgcactttgtatttttttttattattgtattttttattgtttttt

SEQ ID NO: 27475 - DNA, 201 bp, Homo sapiens
caaatactcccaaacctggaaaacaaaatcctgctgggtgagaggcggagtggagaacaggccccgcctcggccccgcccacccctggaggccccgcttcrtcccagttttcggtccagccaagccccacctagtcacgccccctaccgccctgggcctcccaccaccctttcgggccactcccaagtcaggccagtcttt

SEQ ID NO: 27476 - DNA, 201 bp, Homo sapiens
ttggcctctcaaaatgctgggattataggtctgagccaccatacctgtctccatttttttttttttttttgagactgctctgtcgcccaggctggagtgcrgtggcgaaatcttggctcactgcaacctccgcctcctgggttccaatgattctcctgtctcaggctccggagtagctgggattacaggcacgtgccacca

SEQ ID NO: 27477 - DNA, 201 bp, Homo sapiens; identical to SEQ ID NO: 5707

SEQ ID NO: 27478 - DNA, 201 bp, Homo sapiens
caactttaagattcaaccttaaattctgaaacattaatttaaaatgggcaaggagcaacgctgcttcacaggacaagaaatagtcacaaatactcccaaayctggaaaacaaaatcctgctgggtgagaggcggagtggagaacaggccccgcctcggccccgcccacccctggaggccccgcttcatcccagttttcggt

SEQ ID NO: 27479 - DNA, 201 bp, Homo sapiens
agctgaatctcctcttcttataaagaaatcagccagattggatcagaacccactttaacaagcttatttttacttgatcactcctgtagatgccatatatycaaatacagttatattctgaggtactgggtattaggacttcaagatagggttttttttgtgtgtggaaatttttctgctcataacacactgtgttctgga

SEQ ID NO: 27480 - DNA, 201 bp, Homo sapiens
gaggtttcaccatgttggcctggctagtctcaaactcttggcctcaagtgatctgcccaccttggcctctcaaaatgctgggattataggtctgagccacsatacctgtctccatttttttttttttttttgagactgctctgtcgcccaggctggagtgcagtggcgaaatcttggctcactgcaacctccgcctcctgg

SEQ ID NO: 27481 - DNA, 201 bp, Homo sapiens
ttccgatatttcttttgaaaaatgtttcatgtgcagttctgaaaaatttgtattgcactgtttttgggtgatgtgttatgcatatataggttaggttcaayttgatatatagtttaggttctctagttccttgtttttcttctgtctgattgtcctatttataagtaaaaataggccattgaagtctcttattattactgt

SEQ ID NO: 27482 - DNA, 201 bp, Homo sapiens
tttcagtataaccactggtacttgaggagttgaatagttttaatttcttgccctgtgtttcacaaacacagtttattttgattaggaacttctactgggtmtgaagatgaggcttgaactgctgtcagtgtttaagatttagcaagacttggtgtcctttttagacccaggagtcaaagccctttaactgaatggaacagg

SEQ ID NO: 27483 - DNA, 201 bp, Homo sapiens
tgtgatggtgcacacctatagtctcaggtacttgcgaggctaatgcaggggaattgcttgaacccaggatgcagaggttgcagtgagccaagatggtgccwctgcactccagcctgggtgacagagtgagattccatctcaaaaaataaaataataacatatagtaagtcatatcagaattataagagttttccataattt

SEQ ID NO: 27484 - DNA, 201 bp, Homo sapiens
agaatcgcttgaacctgggaggctgggaggcaggggctgcagtgaacccagatcatgccattgcactccagcctgggcaactgtctcaaaaaaaaaaaaaattgctgtcaatagctcaaaagaaaagtttccttgactctgcaaaacaaaacaaaggatcaaaagaaaaaatcagaaagattactttagactcctattagt

SEQ ID NO: 27485 - DNA, 201 bp, Homo sapiens; identical to SEQ ID NO: 5683

SEQ ID NO: 27486 - DNA, 201 bp, Homo sapiens
ttccttgaaaatgtcagtaagctctgttatgcttctagcaaattgtgagactgtttgtttccaccctcataacctgttgcaataaatattatttctcacayattttaatattattaagtttgttggagaaaacaaaccataaaaattcatttgctgttcagttttcaattacaataaagaaatagaacattgttaatttct

SEQ ID NO: 27487 - DNA, 201 bp, Homo sapiens
tggctaccctgggaagagacaagaagtaaatgaagaaagaggaagattccaggacctagatatgatttctgtggacacccttcactggtgactgaagtttstaaatagaaatttaaggcagatccagaggagacaaagacagagtatcccaggtgctggccatttcccacaacagaagaaaatgatcaatgcccaggtgac

SEQ ID NO: 27488 - DNA, 201 bp, Homo sapiens
ttttattatatgattagctcctgcatttctttggttctaagtttgtgttatttcagaataactaaagtacttcagaatgaaactggatacagtatattcarttcataagtgtaattgaccatacttgaatatgtttaagtttataagtaacatcaggtgttatgaaattaatataaataagatgtttttgtaagtttttat

SEQ ID NO: 27489 - DNA, 201 bp, Homo sapiens
gggaagataaaccccctcagaagtgatcatagatcatgaataaactactaattcgtggaaatgtaataattataggaacgtctttgcccaaaaataaaacytcaacagattgagagagttcacactggagaaatactttcctctggcaaacccctgtggcagggttttcagtaaaatgttttgcctcatcgtgtgctagga

SEQ ID NO: 27490 - DNA, 201 bp, Homo sapiens
atcatttctggggacatccttgattggagattgaagtttttgaaccgaaatttagagctgattcagaagagacaaatacagaacgtccaagttagcagtcrtttcccaaatttaggagacaatgatgcaggcccaggtgacttttggtttgttttattctttcctttattctccaatgtatttttaaagtcctgtaaaaat

SEQ ID NO: 27491 - DNA, 201 bp, Homo sapiens; identical to SEQ ID NO: 5739

SEQ ID NO: 27492 - DNA, 201 bp, Homo sapiens
actcaggacagtatgtattttaaaggagcaagtgcatgtgtgaaaatggctcattcagtttataaaatattacattaaatttgaggtttctgttttttttmttttgtgacagtcttgctctgttccccatgctgtagtgcagtggcaccagttcacctcactgtaacttccacatcctggtttcaagcaatttgtgcctca

SEQ ID NO: 27493 - DNA, 201 bp, Homo sapiens; identical to SEQ ID NO: 5740

SEQ ID NO: 27494 - DNA, 201 bp, Homo sapiens
gagacttgctttggataaatgcatttctagggtcggacattttatgcttttttcctgctgtgataacccatcttggggttatgaatatcttgtggactatygtatggagtgagtttactgggtaagagaaaatttttgaaggagagcactttgagtaatgagttttaacatcatcttgctacatacagaggtaactattaa

SEQ ID NO: 27495 - DNA, 201 bp, Homo sapiens
ctattttcattttcctttgttttgagatattttatcatttcccttgagatttccaatttgacatattggctgtttaggaatatgttgtttccacatatttkttgatattctaattttttttctgctgttgatctctagttttattttattatgaagggataagttacactttatgatttcagtctttaaaatgtgttaaac

SEQ ID NO: 27496 - DNA, 201 bp, Homo sapiens
tttgagactgaagccttattggttcaaaaataaaaagcttcacaatgctgcatctggcctttcactgtcacctttgtatatatattctgctgccttctttstacatcagtggtggttccagagctgaagttcgcagagaactttatggcagagttaaaatatccaattccctgttttctgtccatgtgcttttttgtttgt

SEQ ID NO: 27497 - DNA, 201 bp, Homo sapiens
tcatacttgttatatcagacacattgcttttctgtagtaagtttcagtttcctaaatataacttgctggattttctttaaatcacacttttttttttttttggaacaagtgctatattataataattattctcctgtctgctttcaagtccatcatgttatactgaattattattttcaaatcttactttattatacatgt

SEQ ID NO: 27498 - DNA, 201 bp, Homo sapiens
gctgtattgttcaagggtcagctgaattgaggagcaagtcctaagctgagcccacggggagagtgggcagctggagtggtggtgcattggtcctgagggcrtggaacccagagctgcagcacagcaggcactctcgatagtgacttctgtggggtccatcactttgggggctacatttgttattttggagtattttgggcg

SEQ ID NO: 27499 - DNA, 201 bp, Homo sapiens
agtccaaggaattggaaaatggaaatacgaagggttttcattttccccatagcctcaaaatgtaaacagaacatagtagtaagttttttttttttttttttattgggtgggaaatccacccaatatgtgtcgttggtgtatgaggacaccattgcaccttagggtagtgggaaatcttgccagatccaggaaaataggaaa

SEQ ID NO: 27500 - DNA, 201 bp, Homo sapiens
aagtcctaagctgagcccacggggagagtgggcagctggagtggtggtgcattggtcctgagggcgtggaacccagagctgcagcacagcaggcactctcsatagtgacttctgtggggtccatcactttgggggctacatttgttattttggagtattttgggcggcaagttaagatggttatagatgcattttggacta

SEQ ID NO: 27501 - DNA, 201 bp, Homo sapiens
gctcccctattttctgtactattgtggatagactctggtactgcagatatctgtggtactagatcttcaccctcatgtctttctgtgttattgcagacacyggtttacgtcagttatctttttgctcagtggcccctaacctttcatcctgttcctttcagtgctaccacaggaggtcaccactaaggcaattctcagcct

SEQ ID NO: 27502 - DNA, 201 bp, Homo sapiens
ggcaggaatacgtggcggctggggacaatgggaaagtttggggagaaagagcaacaagaggtgaaataaatttcgaagcattgggcagaatagacataaargagggaataaagaaaggggagaaaaacagcaaagggaaaaaagacgtgcagaatgagagcgggaaacacatagtagtgaagagagtgggcgaggacccca

SEQ ID NO: 27503 - DNA, 201 bp, Homo sapiens
tattcttgcatcccccctggtgcagtgggctgtctctccacaggctgagttcttccctgtgtgcatggttgtgacacagaaaggaatgtgttgtttccaarcattaaacaacagattttttaactttcaggtttgatgtgtgaataattacattgactgagaaagaaacccagaagaggaagaagaggaaggaaaaggagt

SEQ ID NO: 27504 - DNA, 201 bp, Homo sapiens
acctggagggtgcccagtctgtggcctttgctttctcagttgcttacccttggaagttactgcagtgctctgaatattagatttttggcacatcctctggyttctgataaaaggatataccgtcacccctcagtgtccaagagggattggtttcacaactttccatggatatgaaatccacagatgctcaagtctcatata

SEQ ID NO: 27505 - DNA, 201 bp, Homo sapiens
ccttttgcactgagtcagttcctgggtggtgtcacaagaccagatgagtcagtttattgatctgggtgtcaggtgatccatcaagtgcagggactgcaaartttctcaaacactgatcttaggttttaaaatactgatgttattcccaggaacaatttgggaaaggtgacaatcttgtagcctctagctgcatgactccta

SEQ ID NO: 27506 - DNA, 201 bp, Homo sapiens
ttttgtagagatggtgttttaccatgtttgccaggctgatctcaagctcctggcctcaagtgatttgccaccttggcctcacacgttgctgagattacagrcatgagccaccacacctggccaatggggcgtttcttaaaatagctactagactatgacgtttatcctaaggtttgaagtctatcatcttccttacatatc

SEQ ID NO: 27507 - DNA, 201 bp, Homo sapiens
ttttatcatgggttaatagagtgttttatttattaatttatatgatgattattaattagtttatcttgtgaatatttaccattacactatatcttgctgtrgtttggcatttgtttgtacacagtaaatatgaagtaaatatatataacttttattctcttatgagagagccacattttctgccaatcggttcgtaatttg

SEQ ID NO: 27508 - DNA, 201 bp, Homo sapiens
agtctcactctgtctctcaggctggggtgcagtggcatgatcttggctcactgcaacctctgcctcctgggttcaagcgattctcgtgcctcagccttccragtaaatgggactacaggcctgagacaccatgcccagctaattttttttgtattttagtagctatggggtttcgccatgttggccaggctgatctcaaac

SEQ ID NO: 27509 - DNA, 201 bp, Homo sapiens
tcacactggagaaatactttcctctggcaaacccctgtggcagggttttcagtaaaatgttttgcctcatcgtgtgctaggaaataatgcagaaaaaactwatgaaaacattcaatgtagaagacttttaggaaaatatcagagaatttaatgaaggaaagaagccttggcaaaatgatggatgagagctttctgtcacaa

SEQ ID NO: 27510 - DNA, 201 bp, Homo sapiens
ttttttctttaaagagttctcttcttacccccagccatcaaaaaattaaaataccataagcaaatggacacatgctcctctggaatttatttttggaatcratggggcaaatagggaaaaggccttcctaccacttgccccaaaattggggaggagaggagtagggaaggcataagaaacatgggaatcgaaacaaggaca

SEQ ID NO: 27511 - DNA, 201 bp, Homo sapiens
gggtttaaagtgaattttaagcattttagcatccactttgaggttttcttttcatagaaggaactcgtgagaaataacttgttattagctaaaataaaagrggacagatttaaaaggagtagaaaatagaagattgtttaaagcttgttgggagcaaataaagattttggggaaaatcccaagggaaattctctgatattt

SEQ ID NO: 27512 - DNA, 201 bp, Homo sapiens
gctgaggtgcagtggtgcaatcatagctcacggcagcctcaaactcctgagcccaagtgagagatgagtcagagccaagcccttctgctaacagagctatktgttgctgaggaagttctcagtttctcctctgaatggtgccaatatcctccagttgcttaaggcagagtgagagaagctgactgtggatacccacatgaa

SEQ ID NO: 27513 - DNA, 201 bp, Homo sapiens
agttttaacaggggctagaacctaagttgtcagtgtgtgcaccacagaggtctgtggcaagaagaatgtgtgtgagtcattggcctgtcattattgtctaygttactttagacacactgaactgctctgaacctcggtttcctcatctgtgaaatatgcccacttttcaaggcaaatttgttgtaaaacagatgtaaagtg

SEQ ID NO: 27514 - DNA, 201 bp, Homo sapiens
ctctgttgacctccacaccatgtcctgtccatcatatttaggaatcctctgccttttccagttgtggttttttcctcctcactagttttaacaggggctaraacctaagttgtcagtgtgtgcaccacagaggtctgtggcaagaagaatgtgtgtgagtcattggcctgtcattattgtctacgttactttagacacact

SEQ ID NO: 27515 - DNA, 201 bp, Homo sapiens
gggggtcatttactcttcaaagatggtgaaatgccaccttctccaggacattctccctgactcacccaagtagggcttctggaacccctttgcgtacatartgatcatcgtgtgttgacattgtggtttacttgtgatgcaccagcactgtcacccggcatgtttctagaagggaaggattcaccctttctcatgttcata

SEQ ID NO: 27516 - DNA, 201 bp, Homo sapiens
taatagctttattgacatataattcacatgccatgcaaatcaccatttaaattgcagaattcagtggtttttaatatattcagagttgtgcagccatcgcygcagtcaattttagaacattttcatcaccgcccttcaaaaaaaactccatccatactcattagcagccaccccccattttcccaattctcctcccccagc

SEQ ID NO: 27517 - DNA, 201 bp, Homo sapiens
aatagctttattgacatataattcacatgccatgcaaatcaccatttaaattgcagaattcagtggtttttaatatattcagagttgtgcagccatcgctrcagtcaattttagaacattttcatcaccgcccttcaaaaaaaactccatccatactcattagcagccaccccccattttcccaattctcctcccccagcc

SEQ ID NO: 27518 - DNA, 201 bp, Homo sapiens
tttttaatatattcagagttgtgcagccatcgctgcagtcaattttagaacattttcatcaccgcccttcaaaaaaaactccatccatactcattagcagycaccccccattttcccaattctcctcccccagccctagataacctttaaagtactttctgcacaattactttttctcctccaaatgtaaacatagtaaat

SEQ ID NO: 27519 - DNA, 201 bp, Homo sapiens
actttctgcacaattactttttctcctccaaatgtaaacatagtaaatgctcataacagaaaattcagaaagaacaagaaaagataaagaagcaaataatsatcatccataattatccagccaatgagagataaccacttttgtctctctatgctgatatactcatagacacatagtttttgcgaacagtgacatcttaca

SEQ ID NO: 27520 - DNA, 201 bp, Homo sapiens
aatatagatttacatgatcatttttgctggccatggatagatcataatttatttgactggttcttttttaatggacatttaggttgtttctagtttttgcwtgtacatacttgtccaaatacttacttttgacaaattcccagaggtggaatttcagggacaaagggtgggcacattttcaagtgttgtacatattaccaa

SEQ ID NO: 27521 - DNA, 201 bp, Homo sapiens
gtttcacagtgacccctagagagggagccccagggaagagatcggatgcctcagcctccctctccctccctcctgtcttctgctggggctccctgttgctraaaccaccctgtagcagaggaggagcaagcccttgcactagtccctgaggtcaatttggggtgcagagtcagacggaaaagggaggaccagtggaggggg

SEQ ID NO: 27522 - DNA, 201 bp, Homo sapiens
tcagacacagacataagagagatattcattctttcaccttccatttgtttgcttgttcattcagtcagcttccactgagtgctctaataggtctgataccrtgctacctgttggggccttttagtctggatctgaagattacaacagggtgatctatacacccttgattcggccctccagccagatcagtgactaacacaa

SEQ ID NO: 27523 - DNA, 201 bp, Homo sapiens
tctcaaccaacccctttgatgggggaaaagttcccacatcagtgggtaagctgaccacaggagggctacatcaagaaatataaagcagttccccccatccyttgcttaactggcactaagaaggggtcagcttttcttgtcttgttgtcactgtcatagttgtgaacctacctgatgttccatggggtaggcaagtgctcg

SEQ ID NO: 27524 - DNA, 201 bp, Homo sapiens
ttctggacaaaagagaaagggctttctcagaaacctccagcctcatatcttattgaccccaattgggttacatattccttctaaagtaattagtggcagaygatggggatggttttaagccagtgaggcccacacctgggactgtgggcacatgtacttcatgggaagggagatcccagttgaaatcagcaatgaggagcg

SEQ ID NO: 27525 - DNA, 201 bp, Homo sapiens
taatgtgctgtttcctgatctgggtgatgtttcattagtgtaaaagttccttgcatgacacacttatgacatagataattttgtgtatgtatcttatatgkcaataaaaacatgtcatgtagctgaaaagtggtggaacatgagtgaaacctacactcgcctgattccaaagcctgtgctcttagctgtaacacaaggcca

SEQ ID NO: 27526 - DNA, 201 bp, Homo sapiens
tatagtataactcaatccacaaaatgtaatttaataaaagcttatatatatataaggatatatatatatatatatatatatatatatatatatatatatawgaatgtgtatattcaggaagaagattttgaattttctttatccttcctgacttcaagctatatttttctttaaatatgttctaaaatttactacatactt

SEQ ID NO: 27527 - DNA, 201 bp, Homo sapiens
taatggacatttaggttgtttctagtttttgcatgtacatacttgtccaaatacttacttttgacaaattcccagaggtggaatttcagggacaaagggtrggcacattttcaagtgttgtacatattaccaagccaccctccagaaaggtttaccaatctgtatttctatgagcaattttgcaagtatacatttcttgcc

SEQ ID NO: 27528 - DNA, 201 bp, Homo sapiens
gtagattgaggtgaggcagagaagggctttatgagccatggttgggggttccacttgattctgttttaaagtcagagagtggcatgactagacatatttaraaacactctgcaatggtgcggaagatggatgggtggaggatgaactgctagaggctgtggaagtacctggctggggcatgattaagtcctaaagtaagac

SEQ ID NO: 27529 - DNA, 201 bp, Homo sapiens
ttaattggggaaggggggcagtgaaactttcttattgggtgataaaacccaatctgaaaggttgaacaagagtttgtaaaattgttaagaagatgatggaraaaatggtgagaggcagaagtattgttcagaaaagagaaaattttagctactagaattagcatctccagagtcataaaggccagaaaggagcctggcatg

SEQ ID NO: 27530 - DNA, 201 bp, Homo sapiens
agcctcagtcctcagtctcccaggctcaggtgatcctcctgtcgcagccttgcaagtagctagtgctataagcacgcatcaccacgcccagctaattttcrtttctttttttttttttttttttttttttttcagtagccatgaggtcttgctgttgttacccaggctggcctcaaactcctgagctcaagccatcctccc

SEQ ID NO: 27531 - DNA, 201 bp, Homo sapiens
atgcagtagtttgagagtaacaaactaaggcagatcagtctgtgtcaagccagaccatggctgcctagacagctgtgaactcctgagaagcctttccagcrtcaccttctcctcttccaagaagccttcttttccgtgccacacaaaagagactatggtggtcgggcgtggtgtctcatgcctgtaatcccagcactgtgg

SEQ ID NO: 27532 - DNA, 201 bp, Homo sapiens
agctgacgtgtgaaggacagactggcggggagtgtggcggggcctgggtgcctatgaaaacagacagaggagaagctgttagaatagatccactgagcgcygaaggtaaactggacaaaggtggtagcaatgaagataatgaaatgtggttgacttcccaatgtattttgaagggagagccaacaggatttgctgatcagt

SEQ ID NO: 27533 - DNA, 201 bp, Homo sapiens
gtaaagaagaaggaagaagtacctcccactctcagggctccagggaaagaggacacagtataatgtgcccctggggccactagggagtattcctggaggarcaggaaagagaagtgctgttcacagcttcagagagaggattagggaagtcttcaatgcactcttccagttaggagcagaactcctcaaggataagggctg

SEQ ID NO: 27534 - DNA, 201 bp, Homo sapiens
ccctggccagtacttctagaagaaagtatgtgatttagctcttatttgaggatggtttatcaattagtagttaaattacctcctcagcaaggctagcattytgaatacagtatgttcaatttgcatttggttagatggtgtcagattcttacttccttctgtgaagcatgctttagaacaaactgtgcttctagtagttaa

SEQ ID NO: 27535 - DNA, 201 bp, Homo sapiens
aagtaaaactaatgagtaaagacttaataaaatggataaactgaggctttaaactattcctgaaggttgaatagtttgattggtggattgagtgtttgatrtttaggatgacactggttttggcttagtgtatacagggatgcctcacctatgttagcaggctcttgtgagagtaagatggatgcaaaactacttgcagag

SEQ ID NO: 27536 - DNA, 201 bp, Homo sapiens
actggaaatttaaggcggatgtgatgatgatgagtctaacaaaaagctgtcctcatcacatacccagtcctccacaaggtttttgtggatacagtcagtgmaatacccactcttaggccatctagattagttcctcacagattctggggatttcctacatctgatgagtttctgattgcatgtcctgaaatggcaccattt

SEQ ID NO: 27537 - DNA, 201 bp, Homo sapiens
gaattccagttaacattcaaaggctactttcttcatacttgataattattttctacctcaagcattcacttgaggagagagtagtgaataaaccttctgtytaacctatctgaaattccacaggttctctctctctctctctctctctctctctctctctctctctttttttttttttttttttttttttgagatggagtc

SEQ ID NO: 27538 - DNA, 201 bp, Homo sapiens
ccctggtatgcagctcctgcgctgcccaggctgggagggccaccccaggctttttccctgccagaaccacaacatccacagtgcccaaaatagccccagcrttacattactgaagtcctgcttctgtgatgaatccagccatctgtctcaggagacttctaaggcaggcttttgatagcaaaacaaatagtcctgtggaca

SEQ ID NO: 27539 - DNA, 201 bp, Homo sapiens
attttttaaggtatatttatatctatttaggtataagtgaatgaatttccaggacattttttctgggctaagtggagagattgccttgctgagtactgttkggggagatattctcaaaccaccttcatagtttaagaatatatcgatttcccataagggagcttcagtgagaagagaatgtcagttcctgggagagtctca

SEQ ID NO: 27540 - DNA, 201 bp, Homo sapiens
ctgctcctaccagttctgggctggacacttcctgagtttctctctagagagagggcctcacccaacatccccttgtatagactacttacgggaagattttytcaaggagaaaatatatcagtcacaactaagttccctactcttgtgaaggaaaatattctacccaatgggcaaaggatattccaccctgaccacaatgct

SEQ ID NO: 27541 - DNA, 201 bp, Homo sapiens
ttaaaagggatttgttctttagggcccccaaattttcaagacgccctacacattcggttggccattttaatctcttctcagggatgggttttgtccattaraacctctgtcctccgtgccagtgaactggaaatttaaggcggatgtgatgatgatgagtctaacaaaaagctgtcctcatcacatacccagtcctccaca

SEQ ID NO: 27542 - DNA, 201 bp, Homo sapiens
ggaagtcaggtggttccacctcctaataatggcacagatagcaaagatgagcactaataacctggagttgcttgtgacttctgtggaagagtaaaaaattraaatgcttatacatgaaaacagactcatttgcaaacaatgaccactgatatgtcctgtgatttttctctgaagtattatttgcgttggtaatttttgacc

SEQ ID NO: 27543 - DNA, 201 bp, Homo sapiens
attatcctgtatgcaagctttacttagaattgcagaaagaatgagacatccttagtggtaaacattaatgaaatctacgaatagatactctcaacaacaaygcatatgcatatctgttgacatggaaagacagtcgtgttgtattaactggaaaacagcatgatataaaacaacacagaaaggatgatcccattttatgta

SEQ ID NO: 27544 - DNA, 201 bp, Homo sapiens
aggattatgtaacaatttttttctgttaattatcatggacatgttaggatttgattatttggagaggactagcatgcttaattagcgttcagaatttacartttataacagggctctctttgcagtgtactcatttttgttacactggagacttctaaaaaagcaaaaagttgccttgattatcaatgaggaatcaaatgc

SEQ ID NO: 27545 - DNA, 201 bp, Homo sapiens
ccagctacccatctgatatcagaaatcctgtctacagacttggatctgtttgtaattatgattgaggctgtctaacagttattcatttcttcagcaatctttttttttttttttttttttttttttttttttttttgagactgagtctcgctctttcacccaggctggagtgcagtggtgcagtcttggctcactgtaacc

SEQ ID NO: 27546 - DNA, 201 bp, Homo sapiens
tcaataaaagggagcgtgatatagtggaaaggaacaggttggtatcacatactcctgggttggagttttttgtttttttttttgtttgtttgtttgtttgtttttgagacggagtctcgctctgtcgcccaggccggactgcggactgcagtggcgcaatctcggctcactgcaagctccgcttcccgggttcacgccatt

SEQ ID NO: 27547 - DNA, 201 bp, Homo sapiens
acgtgaatcacctagtgctggcccagagtatcatctgtgatttttgccctgaatagtgaccttgactgaggctctctagctaagtcacctgactgccaggktgtggaaagggaagcagaggaaatccttgttgtgcctctggcattcaggggtggatgagttaattgttaaagaatcagccctaagtctcttgaatcctgg

SEQ ID NO: 27548 - DNA, 201 bp, Homo sapiens
cccttcaagtgatatgtaagtatttctgatatattgaacttttttaaaccattctataattgtttttctacccttccaaaaaacttctttttttttttttkgctgggtgcagtggctcacgcctgtaatcccagcactttgggaggctgaggcaaacggatcacgaggtcaggagatcaagaccatcctggctaacacggt

SEQ ID NO: 27549 - DNA, 201 bp, Homo sapiens
agagaacccaggagggggtccctctggcctgggattgtcacaggagctctctctaaaaaggtataatgtgctatctaagaatacattattacatttactgwattggactgaaatgacctgttagatatctattgccactgacatactctgagtgccttgaaggcgggaaccatgcatgcattggtcagccctgtgatagtg

SEQ ID NO: 27550 - DNA, 201 bp, Homo sapiens
ggggttctggtgatcagcctggtaggggaccatgtgtgaggactgtgagtgcttcctgtttgagagaacccaggagggggtccctctggcctgggattgtyacaggagctctctctaaaaaggtataatgtgctatctaagaatacattattacatttactgtattggactgaaatgacctgttagatatctattgccact

SEQ ID NO: 27551 - DNA, 201 bp, Homo sapiens
tcactccttcgacagatatttattgagcgtctatgtacagatgctgccgctcccctgctcatgtctttgagtgctccccggaaggcactgcagacagtgcycattcacacagagggcttcctgcatctcagcctgagactatgccctggttgtgtctgggcagttagggatggaaggtggcaggtaaatgccccagattcc

SEQ ID NO: 27552 - DNA, 201 bp, Homo sapiens
tgtggtgagtcccaggcatctgcagtcttaaaaactattccacaaatgattttgactctcaaggttgatatataagttacagtctttcccctcaagaagtytgcaaaccagatgagaagatgggacaagcagtggcatgaggcagaacgtaagtgctatagattaggcgctcccaggtctggctccccctgcacaactttg

SEQ ID NO: 27553 - DNA, 201 bp, Homo sapiens
ctttctgtcgctggtggcagcgggaaatgagaggttgtacagaagaccgtgggggttgacagacattgttcactcactccttcgacagatatttattgagmgtctatgtacagatgctgccgctcccctgctcatgtctttgagtgctccccggaaggcactgcagacagtgcccattcacacagagggcttcctgcatct

SEQ ID NO: 27554 - DNA, 201 bp, Homo sapiens
aatctcacccttttaccaacctgtggcattattttcttgctgttgatgcccaagcctttccttatttcctcatacaaactctgatgtgagtcctgactggsttagctatttgtgattgtccctattgtaaagatatgtaaagtatggtctggggttccctgtgggaagtcccaggatccttccaggggttctgagagatca

SEQ ID NO: 27555 - DNA, 201 bp, Homo sapiens
atggcatcaggaattcctgtcctgactgacaaactgtaagtcgtagaacagaatttcagtggaaaagcagaaacgtgggtggtaacaaatctgatgcttgrtggtaatgaattctggttcactttagcaggcaggtgctttaaatctttctgtcgctggtggcagcgggaaatgagaggttgtacagaagaccgtgggggt

SEQ ID NO: 27556 - DNA, 201 bp, Homo sapiens
agcaggaatcattgccttgagttgattgatcactgaatttattcagcaaacatttatcttgggtgatatgattgttttcacagggctgtttctgaaacttygttttgcattatcttaatcccaggtgtctatctctggtaggctgatgagacagtttggagttgagtagtcttcattgcatgcagcctggtcttattctgg

SEQ ID NO: 27557 - DNA, 201 bp, Homo sapiens
tgtacaaaaatggaacatcatggggaggtggtcaggccaggtaccgcctcctctgaggaggtgctgattgatgagagttctgcagggagtgagcagggagstctccgagggcctgcaggagtgtgtgagcagcaggagggaccagtgcccctcctcagccaaaggaacaactcagagtgacaggagctgagtgcgagaagg

SEQ ID NO: 27558 - DNA, 201 bp, Homo sapiens
gagtgcaatggcgtgactttggcttacagcagcctccacctgtcaggctcaagtgattctcctgccttagcctcctgagtagctgggattacaggcatgcrccgtcatgcttagctaagttttgtattttcagtagagacaacggggtttcgccacgttggccaggctggtcttgaaccccaggcctcaggtgatccgcct

SEQ ID NO: 27559 - DNA, 201 bp, Homo sapiens
ttaatttccactgagcccacctgcagttgacaaggcatagcagtgtcagatctgaccagcaatagaatagaatctaggatttgtacattgaactaaaccartgcttgactgtgagtacacagctttatccccttggagagatgtttcttagtatattcccatttctgtcttagatctactgaattatagttgttggtatga

SEQ ID NO: 27560 - DNA, 201 bp, Homo sapiens
atttttttttttttttaaccacagatggcataaaattcatctccagagagacttctaactaaacctgagtatgaatttttatctctcagtttcttatgcartttttcactgcatacctacatagccttcttttggaagttgttttattgacttttaaattttgcttttgtgtgttttacttgctgcttctcttgtcttctc

SEQ ID NO: 27561 - DNA, 201 bp, Homo sapiens
ggaggattggattggctccacttgggtcaggagaccacccttgctccagtcagctttggccaggatgagggggttatgtgatgggtggggctaagtcttcstcttcagcctgggggtgatggtggtcctcagaggagagtaggaggatagggaagcacaccgtttatacccagatcacacagcaaagctgggactagattc

SEQ ID NO: 27562 - DNA, 201 bp, Homo sapiens
atgtacttcaggtggtcctggtgtctaaaacctactctgccatttgatactgtgagaacttgagcagattactgtgccctgagccttcttttcttcatttrgaaaatagcaaataattctgcctggcaaatttgttgtgaggattgagggagataacacctgttattttctagtaccatacctggcacatagtaggttttc

SEQ ID NO: 27563 - DNA, 201 bp, Homo sapiens
catagagatacctacacacatttaaactgggaaaggaaacaatgatccatcgtaaagcttacccgtaagacaaattgcctttggcaatataaaccttaaaygctcatgaaggcctcacatgagttaagtacagtttaacatgattctgccatttgagcacctactatgtgcctggtttttggtagatgactgagggaaggg

SEQ ID NO: 27564 - DNA, 201 bp, Homo sapiens
ctggccagagctgaaacttggattgaggccagcagccgtttcacagtgacccctagagagggagccccagggaagagatcggatgcctcagcctccctctycctccctcctgtcttctgctggggctccctgttgctaaaaccaccctgtagcagaggaggagcaagcccttgcactagtccctgaggtcaatttggggtg

SEQ ID NO: 27565 - DNA, 201 bp, Homo sapiens
tggtgaccttcggcaccttttttctgagcctcagtttcctctcctttccacttgcgctgccaataccccctgcagagtatggtggagattaaattgggatyttataggccaagtatgtggcatctgagaggccctgaataaaagtcagttgttctacactgaaccctgtccacatgtgggattctcggcaagggcttattg

SEQ ID NO: 27566 - DNA, 201 bp, Homo sapiens
agaccgaggcaggtggatcactcgaggtcaggagttcaagaccagcctggccaacatggcgaaaccccatctccactaaaaatacaaaaattagccagacrtggtggcgcatgcctgtaatcctagctacttgggaggctgaggcaggagaatcagtgaacctaggaggcagaggttgcagtgagctgagacgatgccgtt

SEQ ID NO: 27567 - DNA, 201 bp, Homo sapiens
gtggtatctttctggcatattagttttactcagagattttgagtgggaggagtggaagaacttagacaatttaagtgactagtaatcattttatatttaarcaaccatggaaatacaaaggagtgcaaactatgcacaagtgttggtgataaaacagagtctttattaggtttatgtagttagagtagtgagtgctttagg

SEQ ID NO: 27568 - DNA, 201 bp, Homo sapiens
agtgtaagattataaacttgaatatcccttttcacacttaacactgttccctcctgctaattctccccacttgtttctgatcagtcaacctaagtgaaacrtattggcctccttaagaattactggcctggccgggcactgtgactcacgcctgtaatcccagtactttgggagtctgaggtgggtggatcacctgaggtc

SEQ ID NO: 27569 - DNA, 201 bp, Homo sapiens
tagcattttgtctttgacaatttttgtttcctagcagggaactgcatctgcatcagaaagtccctagatggcgataaagatgaaattgctagagaacctcrccattgtctattatctattatccatttatttccaaaaggaaagttacacttcctgatactgagcatttgttgttgttttcctcatatgccaagcacagga

SEQ ID NO: 27570 - DNA, 201 bp, Homo sapiens
actgccagggtgtggaaagggaagcagaggaaatccttgttgtgcctctggcattcaggggtggatgagttaattgttaaagaatcagccctaagtctctygaatcctggtactttcttcttaattatcagtgtcatagaaggaggtggaaggacagatggatagctaatgctgtttcctgtgtggaagtcagttgacaga

SEQ ID NO: 27571 - DNA, 201 bp, Homo sapiens
tggaagtcagttgacagagcaatgtggcacatatcatgcccgggcaccagcctgtcctgtaatcctggccagccctgctgacttacactagtgtcccagcrcactctactccaccatgcctgtttctccatctgaatgtggagataacagctcctccgttctacactgagtccttctttgtataaatatacggttaattac

SEQ ID NO: 27572 - DNA, 201 bp, Homo sapiens
cctttgtgttagagccctctcagaaggaagaaaacacttcttaggcactgtacatcctttaattcaaaatataccaatgtcttatccccattttcagattaaaaaaaaaaaactgaagctcatgacgattaagcagtttactatggtcacacagctggggtgctgtagaactaaaagatttaatccaaagttcatttactg

SEQ ID NO: 27573 - DNA, 201 bp, Homo sapiens
ggcaggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcata

SEQ ID NO: 27574 - DNA, 201 bp, Homo sapiens
gcaggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcatat

SEQ ID NO: 27575 - DNA, 201 bp, Homo sapiens
caggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcatatg

SEQ ID NO: 27576 - DNA, 201 bp, Homo sapiens
aggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcatatgc

SEQ ID NO: 27577 - DNA, 201 bp, Homo sapiens
ggatttttttgggggggttggattttttggtttggggaagttattttgtaattattattatgtatcatactgtatcgtcgcatgtcccagagtgaatcagwtactatatctagttgtgtttgacttcctccttaggatccggaaagtatggcagaggaggaagtgttcagtcaagaatgggattctgaccatctcacatgc

SEQ ID NO: 27578 - DNA, 201 bp, Homo sapiens
ggcaggaggattgcttgagcccaggagtttgaggctgcagtgagctatgattgtactactgcactcttgacctgaatgacagagcaagaccctatatcttaaaaaaaaaaaaaaaaaaaattaaccttcaaaacaagtaattagtaagtaaataacagttgttatttattgaacataatcatgcactgtataataacattt

SEQ ID NO: 27579 - DNA, 201 bp, Homo sapiens
tctaaaaaccaggggaactgatggtgtaaatcccagtctatgtttgaagttctgagaaccaggagcgccagtgtccaaaaaagaagatgcatgtcccagcycaagcagagagcaaactcacccttcctgctactttctgttctattaatattatgccttcaatggattggatgatgcccactcacgttgggaagggtactc

SEQ ID NO: 27580 - DNA, 201 bp, Homo sapiens
ttattgttagttatttatcatgtggtctaaaccatgtgcagaatattcatagaaaaagattagaataagtaacacagatgaatgcacatcccttttccctrttagatgtcttattcaaagggacttccttttgtctgtcagcaaacattgcacagcttctctgtatcaagcactctgatagtctctaaggcagcaggtctc

SEQ ID NO: 27581 - DNA, 201 bp, Homo sapiens
gcaggaggattgcttgagcccaggagtttgaggctgcagtgagctatgattgtactactgcactcttgacctgaatgacagagcaagaccctatatcttaaaaaaaaaaaaaaaaaaaattaaccttcaaaacaagtaattagtaagtaaataacagttgttatttattgaacataatcatgcactgtataataacatttc

SEQ ID NO: 27582 - DNA, 201 bp, Homo sapiens
ttctctttactgagaaaactctagtggttttgcttggagtatttaaattgaattaagtacatttgggactagaattggcttttttttattattattattamctgaaattgcacgagtgcaattgggaagcactcatacaaagaacatgaaaaaagcagtttatgtagactatgggaacatgagcctaagtgtaaaagatgg

SEQ ID NO: 27583 - DNA, 201 bp, Homo sapiens
gagaaaacttacaaagagaatttagcaacttgtctaaagtctcccagctagtaaagacagtttggaggattaaacccagttctcactgagttttccttataagcagttaactacctctgaaagttcattcatgcattaattgattgcctatgtattggacatttcctgtatcacaggcaggatgtaaggaatggccaaaga

SEQ ID NO: 27584 - DNA, 201 bp, Homo sapiens
gtgtgccaaactttatactgttacaatttttaaatagtaggcaattgtgcataggcattccttgattctgtgatgcaaagacaacataatctgttgtagaygggagtttctgaaggtctttaatcctatccttgaaatataactgggaaaggtggagtgggaaacccttgggaaccaggatacttggcatttggctcagtt

SEQ ID NO: 27585 - DNA, 201 bp, Homo sapiens
ccaagatggcaccactgcacttcagcccgggcgacagaatgagactctatctcaaaaatacatacatacatacatacatacatacatacatacattttttwaaaaaaaaaaaaaagagagactatgggccgggcatggtggctcacacctgtaatcccagcactttgggaggctgaggcgggcggatcacgaggtcaggag

SEQ ID NO: 27586 - DNA, 201 bp, Homo sapiens
atcactactaaaaatacaaaaaattagctgggcatggtggcacatgcctgtaatcccagctacttgggaggctgaggcaggagaatcgcttgaacctgggwgacggaggttgcagtgagcagagatcgcgccactgcactccagcactccagcctgggtgacacagcgagactctgtctcaaaaaaaaaaaaaaaagaact

SEQ ID NO: 27587 - DNA, 201 bp, Homo sapiens
cagtacaactaggtgagtactgtggggcacagtcctcttgccccaaattaggagtgtcagttaagtgatggtgtgccaaactttatactgttacaattttwaaatagtaggcaattgtgcataggcattccttgattctgtgatgcaaagacaacataatctgttgtagacgggagtttctgaaggtctttaatcctatcc

SEQ ID NO: 27588 - DNA, 201 bp, Homo sapiens
atgatgaaaccccatcactactaaaaatacaaaaaattagctgggcatggtggcacatgcctgtaatcccagctacttgggaggctgaggcaggagaatcrcttgaacctgggtgacggaggttgcagtgagcagagatcgcgccactgcactccagcactccagcctgggtgacacagcgagactctgtctcaaaaaaaa

SEQ ID NO: 27589 - DNA, 201 bp, Homo sapiens
cttctcctgtagtagggcagtgttgcagtgatgagaccatcagctgaaggccccattgctttgtcctgctgatctttttttccattggccactccatttgrcatttccactgacaatgtcttatttctgagatgaggggaaacgcttttttaagtgtctagtctatatttgaagttagatgaacatggactgaaccccaac

SEQ ID NO: 27590 - DNA, 201 bp, Homo sapiens
cacttgaccattattgtaagaggagcaggtgagccaggccctgaaggaaggaaactgccatgtgcctttcactggggtgaacagagtcaataaaagggagygtgatatagtggaaaggaacaggttggtatcacatactcctgggttggagttttttgtttttttttttgtttgtttgtttgtttgtttttgagacggagt

SEQ ID NO: 27591 - DNA, 201 bp, Homo sapiens
cctgtcccatcagtggcacagaatacatgctatgttcctctcttatttctggagagccacagaattctgctcataccctttttgccttatactcacttctyttctctctcccactcgcttacttttgttattgctcacacacacaatcttctctggggaattttactcttttcccatttcaaaggagaaatgataaaggat

SEQ ID NO: 27592 - DNA, 201 bp, Homo sapiens
tttcccagaagataattctcactatgggaagctgtagccaatggaaaatagcatgcagtaggcacttaagagatgtttggaaggcaggtcctatgacattrtgttcacacccagatgatatcactgacaaccattcatcctgtctgtttctatacctgtccctgccccaccagactgtgagctctctatgggcaatgacct

SEQ ID NO: 27593 - DNA, 201 bp, Homo sapiens
tgtcctgctgatctttttttccattggccactccatttgacatttccactgacaatgtcttatttctgagatgaggggaaacgcttttttaagtgtctagkctatatttgaagttagatgaacatggactgaaccccaactctatcacgtagtagttttaaggccttgggaaagggacctaactgtaaaaggaggtgataa

SEQ ID NO: 27594 - DNA, 201 bp, Homo sapiens
gacagcataggctattgttattttagacgtaaatttctctacttttcaaaattaccacctatttggataccttttcttagttttataaaatatggccattrgggaaaacttgaaaattgagcaaaatacagagaagagaattttaaaatgacccatgattccaccactcagataactacagatggcattttggtgcattgc

SEQ ID NO: 27595 - DNA, 201 bp, Homo sapiens
tccgacagcacgaaggtcctcaggtaggttcatgcctgacacattcacgaaacaacaaaaggaggtcatgtggccaaggtgtagagcgtgtgaggaagaaraggttggaaaggtggcaggagccagattatgcatggcctgctgactgctgtcaagactttggcttttactctaaataatagggagtctttggagttttgt

SEQ ID NO: 27596 - DNA, 201 bp, Homo sapiens
aaatgcttatacatgaaaacagactcatttgcaaacaatgaccactgatatgtcctgtgatttttctctgaagtattatttgcgttggtaatttttgaccstagctttggaatgctctttattacttaaaggattataaaaataattttttaaaactttatggaccagaggcaattattgagagacaaaggagcaattgct

SEQ ID NO: 27597 - DNA, 201 bp, Homo sapiens
tagccagacgtggtggcgcatgcctgtaatcctagctacttgggaggctgaggcaggagaatcagtgaacctaggaggcagaggttgcagtgagctgagaygatgccgttgtactccagcctgggcaacaagagcaaaactccatctcagaaaaaataaaaataaaaataatggtgttaccaagacatagaaggtggggtc

SEQ ID NO: 27598 - DNA, 201 bp, Homo sapiens
ttgggaggctgaggcgggaggatcatttgagcccaggagtttaaggctgcagtgagctatgattatgccactgcactcccacctgggtgacagagcaagamcttgtctcttaaaaaaaaaaaaaaaaaaggccacgtgtggtggctcacacctgtaatcctaacactttgggaggccaaggtgggaggatcagttggtctc

SEQ ID NO: 27599 - DNA, 201 bp, Homo sapiens
acagtatgttgctcacagtaagtgctcagtaaacggtcgttgctgttaataatgttactatcagggcgtcttgatgggtaatgaagagcacattgatttgyggtcaggactcccaggtacaccatttccccacgggacctgcagccatttattcatttagtctcatttccttatcttatgatgccagtctcatgctgtgag

SEQ ID NO: 27600 - DNA, 201 bp, Homo sapiens
catacatacatacatacatacattttttaaaaaaaaaaaaaaagagagactatgggccgggcatggtggctcacacctgtaatcccagcactttgggaggytgaggcgggcggatcacgaggtcaggagatcgagaccatcctggctaacatggtaaaaccctgtctctactaaaaatacaaacaaaaattagccgggtgt

SEQ ID NO: 27601 - DNA, 201 bp, Homo sapiens
cactagtgtcccagcacactctactccaccatgcctgtttctccatctgaatgtggagataacagctcctccgttctacactgagtccttctttgtataawtatacggttaattactttttaaagtaattaacttaagctttccactcttttaagctttatactatgaaaaccattagatcagttaggaggaataagttca

SEQ ID NO: 27602 - DNA, 201 bp, Homo sapiens
gttgtagaaagaaaaattctattatatgaatcatttcatgtttcagcttgtggcccagtgaaggcttagcctgtactctgttctttctctgttgattttgytggtagtggtgtgtgatttctccttcagtaggttctgtgatggttataaggagttattgttttaagatgtgtgtgtgtgtttgtttttcccattgtacct

SEQ ID NO: 27603 - DNA, 201 bp, Homo sapiens
accatgcctgtttctccatctgaatgtggagataacagctcctccgttctacactgagtccttctttgtataaatatacggttaattactttttaaagtarttaacttaagctttccactcttttaagctttatactatgaaaaccattagatcagttaggaggaataagttcaagagatctgttgtacaacctggtgcct

SEQ ID NO: 27604 - DNA, 201 bp, Homo sapiens
aataagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatc

SEQ ID NO: 27605 - DNA, 201 bp, Homo sapiens
tcagcgcaactttaacatctgtgctgcttccccatcgggaagcaagtgatgatgatgccagttcgctgagctgggcaaaacttgcattttattaaagtcgwcaagtatgtaagcttgttaaaaagcaattatacaaaataatatagccacctagaccaaagcttgaccctaactaaatgcctcggcctcccaaagtgctgg

SEQ ID NO: 27606 - DNA, 201 bp, Homo sapiens
tataaaatggtgcagtatttgcatataacctacacgcattctcctgtgtactttaaatcacctctagattacttgttatacctactacaatgtaaatgctrtgtaaatggttgctatactatattgtttgtttgttgttattgttgttggattgttattttttattgtgagtttcttttttctgaatatatttaatccagg

SEQ ID NO: 27607 - DNA, 201 bp, Homo sapiens
ataagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatct

SEQ ID NO: 27608 - DNA, 201 bp, Homo sapiens
taagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatctg

SEQ ID NO: 27609 - DNA, 201 bp, Homo sapiens
atgcagaaggctgacctctcaactctgcattgctaacatagttggaagggttaggaagccttgtgatttctggatgtaaaagaaaaagaaatgtgttttaraaaaacagtattcaagttctgctgcgaaaatcctttcaaaataattgagtctatttaaaattcaactggttgtttcacagcattgactatacttcagtta

SEQ ID NO: 27610 - DNA, 201 bp, Homo sapiens
actgttccaaaaaaattgaagacaaaggaatttttcctaactcttccaatgaggccagcattgccctaataccaaaaccagacaaggacacaacaaaaaawgaaaactaccagccaatattcttgtggaacgtagatgcaaaaaatcctaaccaaatactaacaaactgaatccaacaacacatcaaaagataataaacca

SEQ ID NO: 27611 - DNA, 201 bp, Homo sapiens
gtactgtttggggagatattctcaaaccaccttcatagtttaagaatatatcgatttcccataagggagcttcagtgagaagagaatgtcagttcctgggrgagtctcaggagatcgctgccactttttgagagactaaattgttgggcccaggaatgtgggacaagagctttggcctgaaaactgcccgtgggcctgcca

SEQ ID NO: 27612 - DNA, 201 bp, Homo sapiens
cagatggtttggtttctagagcaaagggtttttggatttctcttttttctaggtaatgctttacgtccagttctttcttcattatttagaaaagccttaattttttttttttttttttttaagaaaagcgtcaggcagtttgctgactagaagaaaaagttgtagaaagaaaaattctattatatgaatcatttcatgttt

SEQ ID NO: 27613 - DNA, 201 bp, Homo sapiens
tttcatcaaaaaggcctttcccccaaataacattccatgaaagtcacaagtttcacatcagcgtttcatatcacaaattaacctcctttccaaatttctctttaagttttaatcctcttgtttaagtggctttatttcttaaggtttgaagtgcctttattcacattgtatagactcgaacattcctcaaataaatttacc

SEQ ID NO: 27614 - DNA, 201 bp, Homo sapiens
aggcaggcttttgatagcaaaacaaatagtcctgtggacagatttgggttttgtagggaatttatgatttttgaagttgcatttcattgaacctctttccttttttttttttttttttttttaaagacaacgtcttgttctgtcgcttaggctggagtacagtggcacaatcatggcttattgtagcctcaacctcccggg

SEQ ID NO: 27615 - DNA, 201 bp, Homo sapiens
ggcaggcttttgatagcaaaacaaatagtcctgtggacagatttgggttttgtagggaatttatgatttttgaagttgcatttcattgaacctctttccttttttttttttttttttttttaaagacaacgtcttgttctgtcgcttaggctggagtacagtggcacaatcatggcttattgtagcctcaacctcccgggc

SEQ ID NO: 27616 - DNA, 201 bp, Homo sapiens
tttaatagttaagaggtgggggaaggtagcctaatgggttatgccagccacttatctttaggatagtctggataaaatataaagtactatttctcatgtcstctgcttatgctgggtccccatacaccatctgaactaatggactttttggcatcatctccttaaatgcatcatagggaatgaatttctccaccaagaagc

SEQ ID NO: 27617 - DNA, 201 bp, Homo sapiens
tctaataggtgggaactcttacctctctcatccacttagccccccaaaaaagacagttaaacttgaaagctaccagactgtgaaaaagtaaataagaaccmctggccagggagagggcttcagccttagatgtttacaagggcctgaagcagagaaagagatagaaaatatgtaaaagcaaattttacctgcttggaaagt

SEQ ID NO: 27618 - DNA, 201 bp, Homo sapiens
atattgctcttgtcctgcataatgtaagctaacattggcaaaattgatgggggaatgcttcaaggaaagaatttcgtttaacaaacagtagtataattttrtggagactgcaaatgattcttaaactggagtgctatcaaggagcctgaatgcctcccctctaaatgtagtatatcatgcaacaatataattttttaaata

SEQ ID NO: 27619 - DNA, 201 bp, Homo sapiens
ctgtttctaatatttttttttttaggctaggctgacagcagtgttcttttcttcccttttttcactgaaattgtatacttgaggagatctcttacgggcartttttatccagccttaccctaaagtgttttctctggaggtgccatccaaggaaaggacagagagccacttccagacccaaacttcagggaaaaagagtca

SEQ ID NO: 27620 - DNA, 201 bp, Homo sapiens
aaacaaatagtcctgtggacagatttgggttttgtagggaatttatgatttttgaagttgcatttcattgaacctctttcctttttttttttttttttttyttaaagacaacgtcttgttctgtcgcttaggctggagtacagtggcacaatcatggcttattgtagcctcaacctcccgggcccaagtgatcctcccatc

SEQ ID NO: 27621 - DNA, 201 bp, Homo sapiens
agtctcatgctgtgaggaaggaaggctggatgaatataaaagcatgtgggcaatcggtggtgctattgagcagatgtgcagtgtagtgaggatcagttagtttttttttcagccctgccctcttcatctgccctcctggtgctcagcctcctcagccagcccattcccagtgccacctaggcagtattatagtcttctagg

SEQ ID NO: 27622 - DNA, 201 bp, Homo sapiens
tcatggtcacttttctccttaacacccttttgagatttccttttgagcttcagataaatgcaagctccctatatcaaggcccacagggccctgcatgatcrggctcttatctcctagaccctctcctgccactctatcttcagggctggccttctttcacttcttggatacaccatcctctgcctcctgagggccctccca

SEQ ID NO: 27623 - DNA, 201 bp, Homo sapiens
cacttgaactctggagttcaaggctacagtgagccatgattgcaccactgcactctagcctgggtgacagagtgagactgtctcaaaaaaaaaaaaaaaaragagaatgaatgacgagtcagtaagtgcctgagggcctggcccaacagatgaccacttatccaccaccctgctaatggtgttcacatgcacattccactt

SEQ ID NO: 27624 - DNA, 201 bp, Homo sapiens
aataatgataggccagcaaattaggaaacctagaggaaatggacaaattcctggaaacaaccaccaagattgaaccaagaagaaatagaaaacctgagcarattaataataagtaacaacattgaatcagtaataaaaagcctcccaacaaagaaaactccaggaccagatggctttattacttgaattctgccaaatctt

SEQ ID NO: 27625 - DNA, 201 bp, Homo sapiens
tatggtggcacatgcctgttgtaccagctccttgggaggctcaggcaggaggatcactgaagcccatgtggcagaggttgcaatgagccgagatcacaccmccgtaccccaccctgggcgacagagtgagaccccatctcaaaaaaaaaaaaaaaagttttactttgacctaatgttctgttgttaacagctgtgacctta

SEQ ID NO: 27626 - DNA, 201 bp, Homo sapiens
acgctcttatgttcccctaaacctctcatctctcctcagcccatgaggatcagggcctttgaactgtgagagatcaggactgggaggtagacaccaggcaygagcaggtagtaaaagaacagccccttagctctcaccaggccttacctctccacccccaaagctgaacatgtctgccatcttgaggtacaccacattccc

SEQ ID NO: 27627 - DNA, 201 bp, Homo sapiens
tcaggcaggaggatcactgaagcccatgtggcagaggttgcaatgagccgagatcacaccaccgtaccccaccctgggcgacagagtgagaccccatctcaaaaaaaaaaaaaaaagttttactttgacctaatgttctgttgttaacagctgtgaccttaaggctgagttaacttaaccttttggtgccttattttccac

SEQ ID NO: 27628 - DNA, 201 bp, Homo sapiens
tggccaagagccaggacagaaaggagcacacacctttcatcttctctctttgactactttttgttttgttggttggtttggctttttcttttcttttaaaygcagttagctgaggcacaagaatcgcttgatcccgggaagcagaggttgcagtgagctgagatcgtgccactgcactccagcctggtgacagagcaagac

SEQ ID NO: 27629 - DNA, 201 bp, Homo sapiens
gtcatggactgcttctgttctgcatcttcccttactccttaactcatccaaacagtcccacagctttacacccatctggaaagctccacatttgtatttgttttttttttttttgagacggagtttcactcttgttgcccaggctggagtgcaatggtgcgatctcagctccccgcaacctccgcctcccaggttcaagcg

SEQ ID NO: 27630 - DNA, 201 bp, Homo sapiens
gttattctgcctgctctaggtgctctggggaactgaagggaacaagctcccccatcacagttcctatttaaagctgccagcagccctttgttgccatgagwaaagggccacatccttggctcagttcacaatattctttgaaagatctttttcttttttaccacttccttgtacaccagtaattttagtcttcatagcttc

SEQ ID NO: 27631 - DNA, 201 bp, Homo sapiens
tgccagcagccctttgttgccatgagaaaagggccacatccttggctcagttcacaatattctttgaaagatctttttcttttttaccacttccttgtacmccagtaattttagtcttcatagcttctcctcccatactttgcctgtgttcctccctctttcttaagatgtttttcttttcctttgattcttgggggtcat

SEQ ID NO: 27632 - DNA, 201 bp, Homo sapiens
tctacacctagttgtagtttgtgttccttcagtaaaatttgtgcatggcccatcatggtctcttctctgtcaaattctcttctctagttcaaattcctgasagggtgggatctgactggcccagctcatctttttttcctccagccacatcttgggttgctgggaagcctttgggtcatgctaccttccctggttcagtta

SEQ ID NO: 27633 - DNA, 201 bp, Homo sapiens
gtctgggttttaattcttttaaggaactctcactgtgttgtaacatggaagtggtgttttcatgagtatttttttggtctttaaataccttgttgtacctrtaattattattttcccaagaatgggactgaaattgcatcaagatgaacaagccatggtgcttgtgggtgggtgtgctaactccgaactttaaaactacaa

SEQ ID NO: 27634 - DNA, 201 bp, Homo sapiens
acttaggatttatgtacttttctgtaggtatgtatattatataccaataaaaatatatttaaagtattatatacaaggaggttcactgaagccttgattgygatttggaagagcagaaaataaaagggatttattaaataaaccatagtatacatataatagactactacacacccctttgaaaaagagagaaactcaagt

SEQ ID NO: 27635 - DNA, 201 bp, Homo sapiens
aggcattttgcattcttgtgggtccacctccttgggaggtgaaaacaaattaaaataatgagttccttcattattttaataatgaagggtcaaggaagggrtttttttcccccaaagggaatatacttacccaggagagcattactccttaaattatgtggggataaactagagggattcaaaagaatgctgtttaaaaat

SEQ ID NO: 27636 - DNA, 201 bp, Homo sapiens
gcaccagatgctcatgcactgtgccactagctgaggatgcaagggtgtgcttttgcttttcaaaagaggtgctgtaaaaaatgagtgcatggttaagatgygggccatgtgaatgttcattacaagaaccttaactgtctgggtaaaacagatgaagttgtaagtaccactgaaatttcccagccctattcttgtatccat

SEQ ID NO: 27637 - DNA, 201 bp, Homo sapiens
ggtggtgattagaaggctggctagggcctcatttcgtttcattggactgctgtgacacttgtttccttcatggtatttagacttcctgggttatttcccartccagactcatgttctgtttcatgagtgcccattgcacccatgcacttattgaggtgtgtttgaaagcagaatttaaaaatttgatctcagttattgaac

SEQ ID NO: 27638 - DNA, 201 bp, Homo sapiens
attaaccaagccgcagctttgaaagtccagctcactgaaagaactacagcagtgtccattgggtagggatgcagaagtgaaccataggtaatccctgcctyttgcggtctggtggtaggaaaagatctgtgtgtgtgtgtgtgtgtgtgtgtgtgtgtacatatatacacacatatatacacatatatacacatataatat

SEQ ID NO: 27639 - DNA, 201 bp, Homo sapiens
tgaattcttttttcataggtctccaaaatcagaaaaggatatcagatgaggtaggagtcttggtggtaaggtgggacctctttggcctcagacagaaggtmtcaggagtagctccagcacatgagggagatgaaacctgtgtgtcttctcggttgagctcgtgtggcctttcttttctgtttttctgagccgctcctctga

SEQ ID NO: 27640 - DNA, 201 bp, Homo sapiens
gtgagttagaatatttagtgtactcctaacctaacctttgggacatgtgcaataaataattgatacagtttatgcttccattttgagaattcgtagtgatyggtgttcaaagtaacttttcattgtggcaaataatagttcagactcctttcttcttcttttttgtttttagatcatgtacaaaatgaagaaaactatgca

SEQ ID NO: 27641 - DNA, 201 bp, Homo sapiens
aagttttctactcttacaaaggaactgtccacactgctgaaaaatctggtaagacatttcatatgtgagtaaaaagaattacagcctttccaaaatattaygtcatatagagaacatttcaataatccttccccctcaatccttggtcctaggggtgagaaagaaaaaacaaaaagctttttagtcctaggtaacttccac

SEQ ID NO: 27642 - DNA, 201 bp, Homo sapiens
gaggcgaaagatcacttgagcccaggaggttgaggctgcaataagctcatgactgcacgtcagcctgcatgacacagtgagaccctgtctctaaaaaaatkaaattaatttcatgtgttccttttaacttttttcctgtggctgctgacaatttgaaactccatgcatgggttgcactgggttatatttctgttggccagc

SEQ ID NO: 27643 - DNA, 201 bp, Homo sapiens
aaagattagccagggcttttttagtattagtggtagaaacccaactcagactagcttacactaaaaaagaagtacagttgctcacattactaggaagtccragggttggactaacattaggcatgggatagatttttgtggatccagtggttcaaatgaggtcaccacgactctcccgcatctcttgccatcttttggtta

SEQ ID NO: 27644 - DNA, 201 bp, Homo sapiens
tgctcacattactaggaagtccaagggttggactaacattaggcatgggatagatttttgtggatccagtggttcaaatgaggtcaccacgactctcccgyatctcttgccatcttttggttatgatcattcttaggccagctctctgatgtgtggcaaagatggtcaccagtagctgaaggcctactaagtcttagagag

SEQ ID NO: 27645 - DNA, 201 bp, Homo sapiens
gaggttgcagtgagctgagatcgtgccactgcactccagcctggtgacagagcaagactgtgtctcaaaaaaaaaaaaaaaaaaaaaaaaagcagcagcarcagcaaccaactcttaggacatcaggggacagaaatggagagatgagataataaaggggttcttggcagatggggctcaggcacttggctactgctgctt

SEQ ID NO: 27646 - DNA, 201 bp, Homo sapiens
accaaaaccataggcagcacccaataaatgatagctactgttaccattattctcagcctagcattttgctggatagctagagatgggagaaacctgcattmgtttcctgaggctcctgtaacgcataccgcaaactggatgttgtaaaatgacaaatttattctttcagtattagaagctagaggtccaaaatccagcagg

SEQ ID NO: 27647 - DNA, 201 bp, Homo sapiens
aggctaagacaggagaatcgcttgaattcgggaggcggaggttgtggtgagccgagattgcaccattgcaccccagcctgtgcaacaagagcgaaactccdtctcaaaaaaaataatctccttgtctcaagatccttaacttaattatatttacaaagaccctttttcctagtcaggtcacatttacaaattccagggatc

SEQ ID NO: 27648 - DNA, 201 bp, Homo sapiens
tgatgattagccccgcccagtcccccatgctgacctttaagaaggaggtagaaggtggtttaagaaggaagtagatgttgcatttagccttggaagatgartggaataggcaggaggaaataagcaaggcagctgatgttgagtgttttgtgagaacgagggccagagatcataacctttaatgcatctacttcacagaag

SEQ ID NO: 27649 - DNA, 201 bp, Homo sapiens
ttacgtcatatagagaacatttcaataatccttccccctcaatccttggtcctaggggtgagaaagaaaaaacaaaaagctttttagtcctaggtaacttycacacctcaactaaaaagctttttagtcgcctaggatttgcttaaagaaaatcccattgtgaaattcctggaatttgtacctttggcccagctgatagag

SEQ ID NO: 27650 - DNA, 201 bp, Homo sapiens
tgcagtgaagattaaacaaggcagttcatgagagagcttagcactctgtacctggtgcatggtatatagtaggtcctctgcactgtgcctggttcatagtmgatcctctgggctctgctgtcctctcagatggcctcattttcaggcaggctttctccccttgatggtctctactggttctgtgcttacagactcctggct

SEQ ID NO: 27651 - DNA, 201 bp, Homo sapiens
tctctgatatggcctccttatttgttttaaaagcatttttatgtttatttggataatatttagaaaatataatagatttaaacataattttaaaagcatcraaatgcttacgtttctctaattgtgcaagaatctttatatacatagtttttttttttaactgaagttgcatcctgccagtaaaatttgaacgaattgctt

SEQ ID NO: 27652 - DNA, 201 bp, Homo sapiens
accccagcagcctctcatgaagacccactgaaggaatgggacaagagtggaggtaggttggtacatcacagactcatggggcagcatctgcaagacccttytatgatttatgcagaggaagcctggcttggagttttttagaccacccaggtcaggatcttagttctgccgcacactgtcttggacacgttatttcatatc

SEQ ID NO: 27653 - DNA, 201 bp, Homo sapiens
ggaggtaggttggtacatcacagactcatggggcagcatctgcaagacccttctatgatttatgcagaggaagcctggcttggagttttttagaccacccrggtcaggatcttagttctgccgcacactgtcttggacacgttatttcatatcttgtgagttatgatttttttcatctataaatctggcccagtgtctccc

SEQ ID NO: 27654 - DNA, 201 bp, Homo sapiens
gactcatggggcagcatctgcaagacccttctatgatttatgcagaggaagcctggcttggagttttttagaccacccaggtcaggatcttagttctgccrcacactgtcttggacacgttatttcatatcttgtgagttatgatttttttcatctataaatctggcccagtgtctcccttgcaggattgttgtgtgagtc

SEQ ID NO: 27655 - DNA, 201 bp, Homo sapiens
tttgcattctggaatatttccaaaagcattgctattgatgttgaattccactttggggttggagattaggaaatttttggaagtgttgaagtaaaattagwtgttctttgtattattttttatttgacagtgtacaaataatgaaactgtaaactaaagtacaatgacataatcacagaaatgatcataaaaatggttatt

SEQ ID NO: 27656 - DNA, 201 bp, Homo sapiens
atccttttacttgaagaaagtgataagagaagtagaaagaaaatcaggctgagattaactaaggaagcagcctttttattctactttcagccattcagaaragggaaaaaatccagagtttctaataagaaaacgaaaagttgttttgcattctggaatatttccaaaagcattgctattgatgttgaattccactttggg

SEQ ID NO: 27657 - DNA, 201 bp, Homo sapiens
tttttgagacggagtttcactcttgttgcccaggctggagtgcaatggtgcgatctcagctccccgcaacctccgcctcccaggttcaagcgattctcctrcctcggcctcccaagtagctgggattacaggcatgtaccaccacgcccatcaaattttgtatttttagtagagacaggggtttctccgtgttggtcaggc

SEQ ID NO: 27658 - DNA, 201 bp, Homo sapiens
ttctggctaaaattaccatttaggtgataaagtgtgtcctgttgcctgggtattgtgccattcatgtctatgcttgccttttctccttaccagattgtaartgcatgaaagaatccaagccttaagatttcttcagtgtcttgtactgtctttcttgtgcatagcttagcatgataattgactgactaaaatgctatccat

SEQ ID NO: 27659 - DNA, 201 bp, Homo sapiens
actgattgtctagtggcctgatgactgaatccttgttgttgtttttttttaagggtcctccatcttttgaaccccattgtgtcaggttgaagggttggagwgcaacatggttatgaatatagaccttgagatcaggaagacctgctttggaatcctggctctcttattagctgcatatcttagggccattctgatgttcaa

SEQ ID NO: 27660 - DNA, 201 bp, Homo sapiens
ctgacctgcttgggtggcacaaccccagtgacctgcaagttgactccttcccactttgctttttatctcaactactctttagctgttttacatagagcctsctggaatgggaagaaaaaggtctttgaaactgattgtctagtggcctgatgactgaatccttgttgttgtttttttttaagggtcctccatcttttgaac

SEQ ID NO: 27661 - DNA, 201 bp, Homo sapiens
aagggttggagagcaacatggttatgaatatagaccttgagatcaggaagacctgctttggaatcctggctctcttattagctgcatatcttagggccatkctgatgttcaattttcttatctgtcaaacataggtaatagaaaccttcttataagttactgtgttgattatataagatgatataagattaatggcaatgt

SEQ ID NO: 27662 - DNA, 201 bp, Homo sapiens
taagatgatataagattaatggcaatgtcacattgtcattttatcatcatcaatactggggagaaaagagacaagaatgaaccaaaatcagactctgaggmccattggggaaaggaggaaaagaagcaaacacatgtctgtgccaggtattatatgagaaaggtgttaacagtacctttagtatcagagagagtgactaac

SEQ ID NO: 27663 - DNA, 201 bp, Homo sapiens
ctttccccctctcaaattccatttcatgccttcataaactcctttttctttgtttttgagacagggtcttattctgtcacccaggctggagtgcagtggcktgatcatagctcactgcagcctccacctcacaggctcaagctatcttcccacctcagtctcctgagtagctgggactacaggtgtgcaccaccatgccca

SEQ ID NO: 27664 - DNA, 201 bp, Homo sapiens
ccttttccattggagagttacaacaaaaaagcaaaataaatctatcttttctctgatatggcctccttatttgttttaaaagcatttttatgtttatttgrataatatttagaaaatataatagatttaaacataattttaaaagcatcaaaatgcttacgtttctctaattgtgcaagaatctttatatacatagttttt

SEQ ID NO: 27665 - DNA, 201 bp, Homo sapiens
tgtgaaaatgtacttatgattcttccatgaaaacctaaagtattaaaaacccaacagttcacttgtgttctttcatgaacaggtatgtgcatgctatgatkgctttcatttgccaagtcattttttaatttaatgagctgtcactctgctgtcattggatcagttgtagatgaggggacaccttttggccttcatttgatg

SEQ ID NO: 27666 - DNA, 201 bp, Homo sapiens
ttctactttcagagtagcctgttagaaaggatgaaaagctctgaattttctccatttttttttaatgtgatactagagaggaatgatacttcttcctggtwgtgtggaaagctacatctaggttggttataattttcattttaactcttcctccttcatacagccctagacttctcagtgtttaaatctaggtgtcaggcc

SEQ ID NO: 27667 - DNA, 201 bp, Homo sapiens
atgagacacagactcaggtttctaacctggcacatagttgatgtttataaaagttagttcccatctcctctttttagttgtaggttttatattgattattkgttcaagagaggcaaaaggttgtaaatagctcagggtcgctttagttatggacgcccctaactattttagtggaccggtttcctgcttaacgctctatgt

SEQ ID NO: 27668 - DNA, 201 bp, Homo sapiens
cattagaacctctgtcctccgtgccagtgaactggaaatttaaggcggatgtgatgatgatgagtctaacaaaaagctgtcctcatcacatacccagtccyccacaaggtttttgtggatacagtcagtgcaatacccactcttaggccatctagattagttcctcacagattctggggatttcctacatctgatgagttt

SEQ ID NO: 27669 - DNA, 201 bp, Homo sapiens
acacattcggttggccattttaatctcttctcagggatgggttttgtccattagaacctctgtcctccgtgccagtgaactggaaatttaaggcggatgtsatgatgatgagtctaacaaaaagctgtcctcatcacatacccagtcctccacaaggtttttgtggatacagtcagtgcaatacccactcttaggccatct

SEQ ID NO: 27670 - DNA, 201 bp, Homo sapiens
tttgagatcttggatcattattactaaatttccaggttttatggatagaattttgtttttaaaagggatttgttctttagggcccccaaattttcaagacrccctacacattcggttggccattttaatctcttctcagggatgggttttgtccattagaacctctgtcctccgtgccagtgaactggaaatttaaggcgg

SEQ ID NO: 27671 - DNA, 201 bp, Homo sapiens
ctaatttttgtattttgagtagggacgaggttttgccatgttacccagcctggtctcaaactcctgatctcaagtgatctgcccacctcggcctccccaamtgccgggattacaggtgtgagccaccactttcgccggacctgggttttttaatgggccttggtctccattttcacatttcttcttcctgggtcatccaga

SEQ ID NO: 27672 - DNA, 201 bp, Homo sapiens
acagcttcaccctctcaggcatgtggaatcattgagctaagaggcagtgtcatctcttgccctgagactcttttgagttgtctcatttgcccatttatttrtttactctcagctactatttctccttctctccattaatctccaaacttttttgaagggacattagaatcaccactgtgctggtctagattacaagcagca

SEQ ID NO: 27673 - DNA, 201 bp, Homo sapiens
ctcagaggtactttctgttgtccctgcgtaattttctcctttgtgggtaactttaaggctagtggactaagctcaggcagacccacatctgagcttagtcyagcctcaagtcctgacccagcaccctcttttattttagccattatagacaacaataaccagggattaaatatttcacttttttcttagtttgcatttctt

SEQ ID NO: 27674 - DNA, 201 bp, Homo sapiens
ccctcttttattttagccattatagacaacaataaccagggattaaatatttcacttttttcttagtttgcatttctttatgcatccagtgccccaactcmtggggagttggatccatctctgaattccactggtaacttttacctttagtaactgatctcagcacagctgtggcttcataccctgggtgaccacatggcc

SEQ ID NO: 27675 - DNA, 201 bp, Homo sapiens
tcattcttaaccatggttacacagagagaaaatgctattatctcaacttcggggcgcagaaaggttaagtgatttacactgtttctcacagctagtacgtsggggccaggattcacctgcagcctgtgtggctgagagccagccctcctcaccctctccacgcaccactctgtgctcgcaaaatgcaggcccactggccat

SEQ ID NO: 27676 - DNA, 201 bp, Homo sapiens
accatacctggcacatagtaggttttcagtaagtggctaaaaataatagatatatcagaaacttgttagcaggcagtgattttctaagttaagacaggtascaaattatttatgatatctgttccagtaaagccttggctcattattttgcttttatttatttttaatcagtattggaacattgttggtactcgctcagca

SEQ ID NO: 27677 - DNA, 201 bp, Homo sapiens
ttaacagctgcattgctaaattacccctccctcccagtggctgcatcctacatcacagtctgcatgtggtctctgtggttcattgtcactggttcccaaaycaaaggaagccattggtcttgttgagtggtgacgcttatcttcataaatcctggctgtactgggcgcatcccttttagtttattttcagcccagccctca

SEQ ID NO: 27678 - DNA, 201 bp, Homo sapiens
caccttatcacagaatgtaagccgccccactaaaatgtaagctccatgagagccagaaccttgtcttggtcttgttctcaccagtgtttactggaaccacrcctggcatacagtgaatattcaggaatcacttgagaatgaataaatttgcccagagtcagcttgttaatcatttcagtgacattgactgcacatgacaaa

SEQ ID NO: 27679 - DNA, 201 bp, Homo sapiens
agtttataaggaagagtttggcctacacaaacaagagtttttcaaaatagaagatgctttgtaaagtatacatatattagccttcgctagtaatggtgatkctaacttgtatagctaatgcatcctccctttattctcttattctttgctttttccctttccacaaatatgtattagtcttttaccaaagatcagctactg

SEQ ID NO: 27680 - DNA, 201 bp, Homo sapiens
ggttgggacttgggctttttttttttttttctgagatggagtctcgctctgtcatccaggctggagtgtagtggtacattagacaattttgatatatgtawacaagtagttaaaaaattggttgggacctgtgcttttttttttttttctttcttgatggagtctcactctgtcacccaggctggagtgcagtggtgtaat

SEQ ID NO: 27681 - DNA, 201 bp, Homo sapiens
gtagctgtattaccaagaaaaaaggaagctagcacttggaagttagggagaatgggaatgatggatgggcagaagtgttgtgaattggtttgggtgctcartgttgctttttttcttttgcattttccaatttcctctgtacgccatacactgtaatagtcattccatttaaaattgcagctgggtagaccagatattgct

SEQ ID NO: 27682 - DNA, 201 bp, Homo sapiens
tgttgttgaaataaaatcaatggctgctgctaagtcaaccatgagcataaaataccaattctaggcctgttatttgtagaatcctttcatggactagacarttttcatatatatatacaagtggttaaaaagttggttgggacttgggctttttttttttttttctgagatggagtctcgctctgtcatccaggctggagt

SEQ ID NO: 27683 - DNA, 201 bp, Homo sapiens
ttttaatgcctggtaatctattaggcagtaggataaaaagatgccctcaaggatgtctctcaaggctagaggggagatgcttattgtttatcaaagatctrctgagtgcctagcattgtgttatgggccttacatacatagtatgcctaattttaatatagtatgataaattctttgcaagtgatgtctgcaaaggactat

SEQ ID NO: 27684 - DNA, 201 bp, Homo sapiens
tgccacccccaccagactataagctcctaatggacaaggtcactgatggctgctcatctgctaaagttactccagtgccaggcacagagtctggtacatasatgttcagtaaatatgtattgttgttgaaataaaatcaatggctgctgctaagtcaaccatgagcataaaataccaattctaggcctgttatttgtagaa

SEQ ID NO: 27685 - DNA, 201 bp, Homo sapiens
ccagctgttcacatagtgccacaacactcaaatccaaggacaactcttagaggaactggagtgcagggagaattattcattacatctgctcagaaagataragtgccctaccaacacctttgcaaattgaaattcccttgctcttggcatgtgatcatcctgccaactctgtgaaagctcccttagctactcagatgctgc

SEQ ID NO: 27686 - DNA, 201 bp, Homo sapiens
ccaaacttcagggaaaaagagtcagctcttatccagagtttctgaaagatgagaaaacaaaatctctctttttttgagatagggcctttctctgtcacccrgactggagtgcagtggtatgagcacagctcactgtagcctcaacctcctgggctcaagagatggtcctgcctcagcctcccgagtagctggaaccagagg

SEQ ID NO: 27687 - DNA, 201 bp, Homo sapiens
gtatgttttcttcctagcagttgtaacaatctggaattgtttgttctcttgtgtatgtctgccacccccaccagactataagctcctaatggacaaggtcrctgatggctgctcatctgctaaagttactccagtgccaggcacagagtctggtacatagatgttcagtaaatatgtattgttgttgaaataaaatcaatg

SEQ ID NO: 27688 - DNA, 201 bp, Homo sapiens
atgttttgttggggacgtgtgtgggagtgattcatttccagctgggtccagctgtaatgaaaatgtcctgtttgacaaattgaggaattagattacaactrtctctccctgaaagctgtgacactagctgtaacatcaaacatccctccctttgtggggcaggacaggagggaaatggtgattcagggctgctggatgtgt

SEQ ID NO: 27689 - DNA, 201 bp, Homo sapiens
atgtaatggcagcatacacaacatgccgcagtgtgctatgtacacttttatcaccgttccttttgtggatgaaaagctattaagcagaatacaggaaaacrctgggttcttaatgggattaaagcagtggggctgggcacggtggctcacacctgtaatccaagcactttgggaggcccaagctggaggatcacctgagtc

SEQ ID NO: 27690 - DNA, 201 bp, Homo sapiens
tcagaaggatggatctaagagcaagatgacattgtgatgtcaactaaccttccagagaatggtctaaggggtaatagggccctactcgctctttccactcraaatagccatgccccctttccttaactttggagcccacaacacttaagattagctgacatttaatatgtgtgcctgctaggttccaggctctttttatat

SEQ ID NO: 27691 - DNA, 201 bp, Homo sapiens
gtcaggcccagaatctgcctcccaactctttttttccatctctttttccactagggtggttgtatgctctttaggcactgttgatttctggctttgaatcrtgatctcttcatatttcagtatgcatgaataataggacaatttcatgcattcattttgctatttctgagtagaagttagtgtgaccaaccaagttttaat

SEQ ID NO: 27692 - DNA, 201 bp, Homo sapiens
tagctatttgtgattgtccctattgtaaagatatgtaaagtatggtctggggttccctgtgggaagtcccaggatccttccaggggttctgagagatcaaractatttttatactaaggtcaagacattttttgcccttttctctcttattctttcataaatttatagtttatgagactggagctgtttgggagaagtagt

SEQ ID NO: 27693 - DNA, 201 bp, Homo sapiens
gcccagcctgtactgagtactttacataggctgtttcaaactctcacattaccctgctagtacctgagggaggtgggaatcaaatctgggtttgcctggcyccatagcccccacctccccactgccaccctgccttgctttggtattagtgatttagctgcaaagtgcaagtaaacggaagagaatctggttagcatttac

SEQ ID NO: 27694 - DNA, 201 bp, Homo sapiens
gtgagagtagagggaaaagcacggttagaggagcaagttttccccacacagtgtctgacaggcttctctacttaaaactggaatacggactccggctccaytccagactgttccttcctcagtgtccccgtctgttaaaggcagtgtcattcttccaggtgttcaggccttaaagcctgagagaggtgcttagctcttccg

SEQ ID NO: 27695 - DNA, 201 bp, Homo sapiens
tccaccgttgtcagctaggatcaaatgagcatcatctcttgtctggacagttggagcctcctaccctgtctgcctggagccttctaacctggtcctgcagkctgttctcaacagaacactggagccttccacattcaatcatgtcactcctctgtcctgaaccatctggtggttcttctcgcaacccccaccagatatcag

SEQ ID NO: 27696 - DNA, 201 bp, Homo sapiens
ctccctcggtatcttggaagatggggatgatggtgatatccacatcgcggggctcttaggaagatgaagctacgtcatgcagcaggtctcaagaaggccartctcctctctttccctgccctgtagtcccatctctctcctgcccagagttgagtcacctgggccagtgtaccctgaggccctggccagccttgcctcttc

SEQ ID NO: 27697 - DNA, 201 bp, Homo sapiens
gccgggcacagtggcttacgcctgtaatcccagcactttgggaggccaaggtggggggatcacctgaggtcaggagttcgtgactagcctgaccaatatgrtgaaatcctgtctctactaaaagtacaaaaattagctgggctgtggtggcgtatgcccataatcctggctacttaggacgctgaggcaggaaaattgctt

SEQ ID NO: 27698 - DNA, 201 bp, Homo sapiens
tttttagagatgaagtctcactatattgcctaggctggtcttgaactcctagcctcaagctatccttctgcctcagcctgaattaccctgtagtttaaaargcatccccagtttcccattttgacaatgcatatagaagtcttcctgatgcttcccttatttgtttttatctaattctgttaatgtattcatcaacagata

SEQ ID NO: 27699 - DNA, 201 bp, Homo sapiens
aggcctggttgactctgttccactcttaaaaccaccttcctctctatcgatttggcattggaagccaatatgcacgattttgttttttctattgaaggccyattacatgattctctttagtgcaatcaatactaatctaattgaggtaattagaaaatttttacaggtaactggcttacaggccaatgcagcagacaataa

SEQ ID NO: 27700 - DNA, 201 bp, Homo sapiens
gctcagcgcaactttaacatctgtgctgcttccccatcgggaagcaagtgatgatgatgccagttcgctgagctgggcaaaacttgcattttattaaagtygacaagtatgtaagcttgttaaaaagcaattatacaaaataatatagccacctagaccaaagcttgaccctaactaaatgcctcggcctcccaaagtgct

SEQ ID NO: 27701 - DNA, 201 bp, Homo sapiens
agggtcagtgatgaggtcagatgacagagaaatgaagtcagatgtgtatacttcagggacccggactggggaggcacagatgggactaaggagaggactarggcaacaccaaacactttgaccattgtgggtcatggtcatagccaatttgatctgaagcagactgtcaactcagtgtaactgtataatcagcccttagtg

SEQ ID NO: 27702 - DNA, 201 bp, Homo sapiens; identical to SEQ ID NO: 5759

SEQ ID NO: 27703 - DNA, 201 bp, Homo sapiens
tctccgtgaaacaggctctctcactctgtcgccgaggctgcagtgcagtggtgcgatctcagctcactgcaacctctgcctcccaggttcaagcaattctstcacctctgcctcctggggcagctgggactacaggtgcacaccgccatgcctggctaatttttgtatttctaatagagacgcagtttcatcatgttggcc

SEQ ID NO: 27704 - DNA, 201 bp, Homo sapiens; identical to SEQ ID NO: 5760

SEQ ID NO: 27705 - DNA, 201 bp, Homo sapiens
cccttctctccgtgaaacaggctctctcactctgtcgccgaggctgcagtgcagtggtgcgatctcagctcactgcaacctctgcctcccaggttcaagcrattctctcacctctgcctcctggggcagctgggactacaggtgcacaccgccatgcctggctaatttttgtatttctaatagagacgcagtttcatcatg

SEQ ID NO: 27706 - DNA, 201 bp, Homo sapiens; identical to SEQ ID NO: 5761

SEQ ID NO: 27707 - DNA, 201 bp, Homo sapiens
atgagtgtagttcagtgggaagccaatgatgggttttaagcaggagagtgatataatctggtaatcactttaaaagatcgctgtaacagcagagcacagasgaaatgagagtggcctttggagtcagtaaaaaccttaattaataacctgatcatctgctttactcactgtttgaccttgggcgagttacttaacctctct

SEQ ID NO: 27708 - DNA, 201 bp, Homo sapiens
gttcgagaccagcctggccagcatggtgaaaccccgtgtctactaaaaatacaaaaaattaactgggcatggtggcacgcacctgtagtcccagctactcrggaggccaaggcaggagaatcgcttgaacccgggaggcacaggttgcagtgagatgagatcacaccactacactccagcctgggcaacagagcgagactc

SEQ ID NO: 27709 - DNA, 201 bp, Homo sapiens
gaaagtgacatggagacagaggaagagtgttccagacagagtaaagcacgtgcaaagtgggagagatctctgtgggttgagaagccaaaaggagttgtagygcagtgagaatgggtagagggactcaaaacaggttggcagggccagagctaaattgggagcttggatatgagtgtagttcagtgggaagccaatgatggg

SEQ ID NO: 27710 - DNA, 201 bp, Homo sapiens
cagcagacaataaaattgccattcgccaccatcagtctcaaactttcacagtattcttcctccacggtaaccagaaaacaagtgatagtacatagcagccttttttttttttttttactggctagaacaacactttactcacaaagagaagagacagaacaagattagctttgatttgagtatggtaccccgcagtgggtc

SEQ ID NO: 27711 - DNA, 201 bp, Homo sapiens
caaagcctaacagctgcaggatgggaggggtacccttggtttgtcactcccaaccatatcctgggagcagttctaactcttctgtccctctcctgaatctwgccccttcccccattctggtgctgagcactccaggacgaccaaaactggttcaggttctataacacttgatgtttcagagcagtccttctgatttggaga

SEQ ID NO: 27712 - DNA, 201 bp, Homo sapiens
catagcagccttttttttttttttttactggctagaacaacactttactcacaaagagaagagacagaacaagattagctttgatttgagtatggtacccygcagtgggtcttgccaggcagctgacacagcttaatggtctgtatgcatcctacctgggctgtgggcaaagaaaccccttccttcccaactaggaatagg

SEQ ID NO: 27713 - DNA, 201 bp, Homo sapiens
ttgcatccatttcaccttgagagcttgttaaaacttaggttgctgggacccactcttggagtttctgattaattaggtctgggatttcataaccaacaagyttccaggtgatattgacactactgatttgaggaccacacttttgagaaccactaggaaggattgtcactctggacagagatccagaatttcctagtgtta

SEQ ID NO: 27714 - DNA, 201 bp, Homo sapiens
gccatatagcacaccccctccttttactttctcctttgtcttggtcttataaatcctagctacttcccctttccatataattatcgtcaaatgaaatcagrtgctgcagataatgcacagggaaatggtactttcattttcacttgatgtaggagatgatgttaaatctaacccaccatttactaaattgaattagataaa

SEQ ID NO: 27715 - DNA, 201 bp, Homo sapiens
acatgaagaaatggcccgctgatgcagtcttgaactagtatctgactacatctttcagtaaaaatgagtggatcttttcattgacatattgccacagataygttaagcaactgaaaattcagaaaattggcagaaatagcttgactttgaagttggatataattgagttctatctctgctccaccacctcccaagctaggt

SEQ ID NO: 27716 - DNA, 201 bp, Homo sapiens
cctcagacaaggccaccactccagatctggactgttgggaggtcctacagcccagcctggtgcttttttcagggctgatgttagccagcaccgggaaacaygggttagtgaggggagcatggctggacttcaggcttcccttgtacaagccaggtgggtgctttgagccatgtacaccctgcacagccgtacacagtggcc

SEQ ID NO: 27717 - DNA, 201 bp, Homo sapiens
cagccttgcctcttcccctcaagggtctcagactggtgccaacagtcacattgtcacaccaaagccaggagtgcggagagaggatgtggaacagggtctaratacctgaagctggggacagcatggccctgcacgtctctactaaaaaattaaaaattagctgagtgcggtggtacatacctgtggtcctagctactcagg

SEQ ID NO: 27718 - DNA, 201 bp, Homo sapiens
ggaacgagattcatgtaaattaacttttagagccaagccacctcagcagaagcttagggaccagcctgtgagcagggtgccccttgattttgacttttttrgagatatgactagacaggtcatgagcagaaacagccctagtacagcctgtgacatttacaacatgaggtttatctgtttcttctccttctttaagaatgt

SEQ ID NO: 27719 - DNA, 201 bp, Homo sapiens
tacaaagagctatggaaatgggtcaacaaattgatacatttcctaagctgtgcatactgtgcagccattaaacagaataaaaaagaactgatttggagctytcctaaacatagtaagtgggagaaaagcaaagtttcagactatgtatcccttgtatggtttttaaaagacatagcacacgcgtgtgtatcaccaaaatgt

SEQ ID NO: 27720 - DNA, 201 bp, Homo sapiens
ggggcagctgcccagatggctctgcgctcagcatactcgctgagagtgaattcaagattgtttgaaatgaccttgaagatatgatcacacaatgggcagcmcagcagaccctaggctcccttggatttcacattccacacttgcacttcttcccaggggaaccctgaagaaaatgtataatttgtggtggcccagactggg

SEQ ID NO: 27721 - DNA, 201 bp, Homo sapiens
aaggataggatttggaatcaaatgaagtgggatctaatcctttcttcaccactgagtttcatttttcttatctataaagcaactgccttgagggagtatcrcatgagtttcaggatattcactgtgattgaatccctctacttagtcagtgcttaataagtagcagccataattagagtcgctgagaatcaaaggttaggt

SEQ ID NO: 27722 - DNA, 201 bp, Homo sapiens
ttgttcctggtatttgtcatcaagtctttcacatagtggattctgaatagatattgtggcacacaatattctagtatccacgatagtctttcctgagtgtrtcagtggagaaggataggatttggaatcaaatgaagtgggatctaatcctttcttcaccactgagtttcatttttcttatctataaagcaactgccttga

SEQ ID NO: 27723 - DNA, 201 bp, Homo sapiens
cctgacatggtagagtctggagctaagacctggattttcaggtttctcaatcacttggcatctggctaaagttaaaagacttctagaggctcctgcacttwaccaagtacactagttaggagcacaggctttggggtcagtgcctgtcactactgcttcttagctgtatgacattgagcaacttgcttaactactctaaac

SEQ ID NO: 27724 - DNA, 201 bp, Homo sapiens
ctggagaggtttctccaattaagcgtttagcaagaaagaataactatttactgattctgtgatgcctcatttgggtatgcaagtcaagcagattgttgctrattctgaactggttttcattgataatcagtgccataagacagaacatttagaggttgatagaggatgactttgctcggctagtttgtctgttgcattcac

SEQ ID NO: 27725 - DNA, 201 bp, Homo sapiens
tatgtctcatcaaagtaggattgtattttcctgtataaagctgttgcacttaaactgtagcaaagaatctgccctctgaaaacaaccatgccatgacaacytctaacaagcagtcatatgtgtgtgtttagttttatttctagttcacatgtcaatgtgaatttttaagtgtatttttatgactggagaggtttctccaat

SEQ ID NO: 27726 - DNA, 201 bp, Homo sapiens
tatgatgtggaagtcatattttcaaaacacagctaaattgttataaacagttttgcagctttttcattacaaggaagacagccattgattttctcatttcsttacatttttgtctcccattccttttcagttagaattaagtagtagatagttttataacacagggtttgtgttttttaaggcaaaaaatgtgtggtgttc

SEQ ID NO: 27727 - DNA, 201 bp, Homo sapiens
aataaatgttagcttattggtaacacatggtgccccttagaatctataacattgttggtctgaaagttgaggcttgtaaatcctttaatatttctgggcargaaaaaaatgacagtggtatataattttattaccagcatatgatgtggaagtcatattttcaaaacacagctaaattgttataaacagttttgcagcttt

SEQ ID NO: 27728 - DNA, 201 bp, Homo sapiens
aaacacagtgagacatactgcacttttagaaatggaagcatgtggttcataataagcgtgggtatactgagttggctattctaccaaatgaattaggttgraaatgttaatctttttgagcagatacattctcacacaacacaggtacaggtatacacttctttctgggactaggaactcaggatattcctgctactaggt

SEQ ID NO: 27729 - DNA, 201 bp, Homo sapiens
ggatgtgttactacctgggaagctctctgagaccagctattaatattcactaatcatgaatattcatgaatggatccatcaaatggaaaatcccagcattrtaacctgtgggatgactttggtgtttcccagatgagaccaccaatagtagtttccatggtcatgtctcagaaatatagggacaaactcagatccctctgg

SEQ ID NO: 27730 - DNA, 201 bp, Homo sapiens
gggggggcgaaggggagggaggtaggcaggcccttcaccgcaaatggcttccttttgcccgtgttacatgtaggactttgtaagacttcctttacaactckcagtgattaattgagaggagtgtgcttcatccaggtcgtaagccctcataaatgattataaaatgatttcattattgatacgtgatgtgactgacttttg

SEQ ID NO: 27731 - DNA, 201 bp, Homo sapiens
ggagtaagtgttcagaaatttgattttcactttaacttgaaaggattaattttttttttcctctttcaagatcatagtagtacttgtatttgaaagactcyttgaacattttcagcgttaaaaatgctcttggaaaatgatcattggaaaaaatgtgcctcttcacataatggtattgacagaggaatgagattaggcact

SEQ ID NO: 27732 - DNA, 201 bp, Homo sapiens
agttgaattttaatttttcccccatgcttacatatgtggaagtagtgcattattataaatatcttaggtgggtcacaattcagttctttaaaaatatgggrcttaacattaccacactcaatataagaaaaaatttgggggcataccacaaaatcttgttggcatatgcttcacaactgagatatttggaaactttaagaa

SEQ ID NO: 27733 - DNA, 201 bp, Homo sapiens
gtaaagtagacatgaattggggatggattggatatgggggtgagggagatggtggaactgagatgtctctcggtttttcgccctggatggagatgccacaytgagctaggaatcactggataaaagccaaggaggtcccttggctcaatttatttttatatccccacctctgtttccctctattctgcaaatattgaagct

SEQ ID NO: 27734 - DNA, 201 bp, Homo sapiens
taagtggagagatctttaggaagtaaagtagacatgaattggggatggattggatatgggggtgagggagatggtggaactgagatgtctctcggtttttygccctggatggagatgccacactgagctaggaatcactggataaaagccaaggaggtcccttggctcaatttatttttatatccccacctctgtttccct

SEQ ID NO: 27735 - DNA, 201 bp, Homo sapiens
gtccagcatctctggtgaagtagagtgtttccaggtgcaatgtcttctttctgacaccacttctgactccaaatgtttggggttttctctataccaagcarttctccaattttcctacccgaactacatgttcaacaactgaatttaattctgaccctaactgtctggaattagggcaacccccacaattctgtgggctca

SEQ ID NO: 27736 - DNA, 201 bp, Homo sapiens; identical to SEQ ID NO: 5767

SEQ ID NO: 27737 - DNA, 201 bp, Homo sapiens; identical to SEQ ID NO: 5768

SEQ ID NO: 27738 - DNA, 201 bp, Homo sapiens
agcaagactctgtctcaaaaaacagaaaaagaagatgacacaggttcccagaagtgatttttcatcactcaagatcagccagaaattaggtgggagagccygtgttggaatgtgtctttctgtcccaagggctctcctctttgctgtgcttgggaaattcccccagccctgggctgcagcatgagggggcagctgcccaga

SEQ ID NO: 27739 - DNA, 201 bp, Homo sapiens
gctgcaaaggcgagtctgtgaaagtagattgaggtgaggcagagaagggctttatgagccatggttgggggttccacttgattctgttttaaagtcagagrgtggcatgactagacatatttagaaacactctgcaatggtgcggaagatggatgggtggaggatgaactgctagaggctgtggaagtacctggctggggc

SEQ ID NO: 27740 - DNA, 201 bp, Homo sapiens
gccatgcatagcatattttgaatcatttaggtcaagacccagacaaataggtttattaggacattataggatcttagaactggtgggaagctaaaaggctyggtggtttccaaactgttccaatctgttgtcttttgaagtaggatcctgtaagttcttactgtcctgaaaagatgtgactcaggaaacttctttccagtc

SEQ ID NO: 27741 - DNA, 201 bp, Homo sapiens
tctggcccaggtcatgtaagtagtggagctaggatttgaccacaggcggtttggctctagattttgtgttccaaaccatgttatttaaattccagcatctrgttggtagctatgtgattctccatctcagacaaaaattgtgtaactaagcctgaatgactgtgagccatgcatagcatattttgaatcatttaggtcaag

SEQ ID NO: 27742 - DNA, 201 bp, Homo sapiens
ctagaaatgccagaaaactgaatgtcagactttagaggaaagccagggaaggtttagagaagaggagacattggagtttggtgttaatgaattagttcccmcaagccaggcaagaacaattgaggtgtgctagcacatatgtacataaagactaaggatgtccgtgacattttcagaggctgctgtgtaaggccttcggga

SEQ ID NO: 27743 - DNA, 201 bp, Homo sapiens
catatcattgttgtttgttggtttattgagacagagtctcactctgtcacccaggctggagtgcaatggcaccgtcatagttcactgtagccttggacccygggctcaagcaatcctccagtctcagtctcccgagtagctaggactgcaggcatgtaccaccacacctggctaatttttatttattgtccatacaatccc

SEQ ID NO: 27744 - DNA, 201 bp, Homo sapiens
gtgtgtccacctgcttgatgggctgatcattttgaacagggggagagtcagaccacatccttttgagtccatctgcagtaaatgcccattcaggatcttaytgtatgtgccttttattaagctacttaacttgtactaatctgtgaaacagaataacagtacctgtcttccatgttacgagaattaaataagatgatgcat

SEQ ID NO: 27745 - DNA, 201 bp, Homo sapiens
cagtcccccttctcagggtgaacagaccttacagtggcttttatctgttccaccaagctgccagttaccgcaggaatagcctcctgtgtgtctggatcatrtatacccatatgcagttgttcaatagtgagctgtgggtcccatcaatccaaacatgtacttctactctgtagtgtttaaaaccaaagatactgcccctaa

SEQ ID NO: 27746 - DNA, 201 bp, Homo sapiens
tctgtttcttttgcccttcctgatcgaagtctaggagagtaagtcaatactttttatgagaatatattgtcctacttgtatgtctaaagaccatgttctcrttctgcagttcaacgttgttgattttatttcttacattttcgtaatgtaatggctgtttctagtcatgtagtccttagaaactatggttaaatgtcagtg

SEQ ID NO: 27747 - DNA, 201 bp, Homo sapiens
gattcatcatccaagaaatcatttaaaagcattaccagcatcatgatggcattttccaacctgtttttttaaattaaaagattgccaaaattcaactgccrtatgtcataactaatttttttttttaacactaaaagaaatcgcaaaacttaaaagcactgtgaaaagctcttcaggtcattcctactcattatacccctt

SEQ ID NO: 27748 - DNA, 201 bp, Homo sapiens
tcaaaagcaaaaattagcctgacatggtagcacacacctgtagtcccagctactcagaaggctgaggcgagagactcatttcagcttgggaggttcaggcygcagtgagctgtgatcacactattgcattcagcctgggcaacaaagcaagaccctgtctcaaaaataaatatatacatatgtattttttaaaaggaaata

SEQ ID NO: 27749 - DNA, 201 bp, Homo sapiens
ttagaaactatggttaaatgtcagtggaatgctaataataaatcaaccttttttacatctatgttgttggtttggcccttgtcaccctccacgacatcataacacttttcactgctgtagaattgtcttaatttaaaaaatgtggttataggtatattttacagagcactaattacaaaatgagagacataataattgtta

SEQ ID NO: 27750 - DNA, 201 bp, Homo sapiens
gggaagggagatcccagttgaaatcagcaatgaggagcgatgctgggcagaaaacccatagcgccgtgtccttggggagtccttggaccatctgtttgackgaagcctcggtttttttctgctccaccacacactggctggggtgagacaatgcgtgcgggaccctggcctccaggaagggtccctgccctggctgcaggg

SEQ ID NO: 27751 - DNA, 201 bp, Homo sapiens
tgtttttgagacagggtcttattctgtcacccaggctggagtgcagtggcgtgatcatagctcactgcagcctccacctcacaggctcaagctatcttccyacctcagtctcctgagtagctgggactacaggtgtgcaccaccatgcccagctaatttttgtattttttgtggagacggggtttcaccatattgcccagg

SEQ ID NO: 27752 - DNA, 201 bp, Homo sapiens
cagtggtgcagtcccagctcactgtaacctccaccttatgggttcaagcaattctcctgcctcagtctcccgaatagctgggattgcaggcacccgccacmatgtccagctgatttttgtatttttaatagagacggggtttcaccatgttggccaggctggtctcaaactcctgacctcaagtgatccacccatctcggc

SEQ ID NO: 27753 - DNA, 201 bp, Homo sapiens
agctgctggggccaggcagcgtgtggggctccactgggcagtggcctgttagcacattcagaaagtgtgccaaaatgcacacacatgctgggtgctgactygggtatatatgacatgattctacctgtctcttaagggaaaggaacattttgaaaaatatttaggccattaaaaactaaaaggtgctgagcacttcctaaa

SEQ ID NO: 27754 - DNA, 201 bp, Homo sapiens
cctcgcagcacacttttcagtgattcttcggaggaattcctcagaggtctgcaatttccctcaaacagcccagctgagatttttagctgtcatgccagttrtgtccagctacccatctgatatcagaaatcctgtctacagacttggatctgtttgtaattatgattgaggctgtctaacagttattcatttcttcagcaa

SEQ ID NO: 27755 - DNA, 201 bp, Homo sapiens
tctagtatgttctaaacacagtataagatgctttcatttcaaaataccagttccaacaaatctttggcaaacatttcagttagcctcaggccaggcgcggyggctcatgcctgtaatccgctcatgcctcattttgggaggctgagacaggcagatcacttgagcccaggagttcgagaccagcctgggcaacatggagaa

SEQ ID NO: 27756 - DNA, 201 bp, Homo sapiens
tgaccaacatggcgaaaccttgtctctactaaaatacaaaaattagctgggtgtggtagcatgtgactgtaatctcagctactcgggaggttgaggcagtrgaattgcttgaacccaggaggcaaaggttgcagtgagccaagattgcaccattgcactccagcctgggcaacagagtgagactccttctcaaaaataaaa

SEQ ID NO: 27757 - DNA, 201 bp, Homo sapiens
ctgtatgttgaaattcatggacatatttcaaatttcttttaatctgtggattcctccctctttttttcattgtaattcatttgccaaagaaagtggtggtktatcccgtagtttcccatagtatggatagtgttgactgcaaccctgcactgtcatttaacgtaagctacagtctactcttaacagacttttgttattaat

SEQ ID NO: 27758 - DNA, 201 bp, Homo sapiens
atttgacatttccactgacaatgtcttatttctgagatgaggggaaacgcttttttaagtgtctagtctatatttgaagttagatgaacatggactgaacyccaactctatcacgtagtagttttaaggccttgggaaagggacctaactgtaaaaggaggtgataataccacttcactggctatgagggggattaaccag

SEQ ID NO: 27759 - DNA, 201 bp, Homo sapiens
agacttcaaatagccaaagtaatactaagccaaaagaaaaaagctggagtcattacactacttgacttcaaaatatactacaaagctatagtaaccagaayagctttgtattggtgtaaaaacaaatgcatagaccagtggaacagaacatagaacccagaaataaatccacatatttatagccaactgatttttgataag

SEQ ID NO: 27760 - DNA, 201 bp, Homo sapiens
acatctctgtcctgcttattttcatttaacacatcatgaacatttccacttcattaaaaagtcttcaataatatttaaaaaggcatgtcattgtattaaaygtttccctccctcccttaagttgctcccaattgtgtgttttgtaccgttggcttagcagtttcaccaaagggaggacctgttgttcaccttggagcggtg

SEQ ID NO: 27761 - DNA, 201 bp, Homo sapiens
gtgtgatgcttcatgcctgtaatcccagcactttaggaggatgaggtgggtgcattgcttgagcttaggagttttgagaccagcctgggcaacatggtgaraccctatctctgcaaaaaaaaaaaaaaaaaaaattaaccaggtgtggtagcacatgcctgtagtccccagctagtagggaggctgaggtgaaaagatcgc

SEQ ID NO: 27762 - DNA, 201 bp, Homo sapiens
cacttcattaaaaagtcttcaataatatttaaaaaggcatgtcattgtattaaatgtttccctccctcccttaagttgctcccaattgtgtgttttgtacmgttggcttagcagtttcaccaaagggaggacctgttgttcaccttggagcggtgaatatttgtgtatatctgtcatattctgctctagtgttgatagatt

SEQ ID NO: 27763 - DNA, 201 bp, Homo sapiens
gtgggtggatcatttgaggtcaggagctcgaaaccagcctgaccaacatggcgaaaccttgtctctactaaaatacaaaaattagctgggtgtggtagcatgtgactgtaatctcagctactcgggaggttgaggcagtggaattgcttgaacccaggaggcaaaggttgcagtgagccaagattgcaccattgcactcca

SEQ ID NO: 27764 - DNA, 201 bp, Homo sapiens
gaattgattatggaggctgatctgccatctggaagctggacaaccaggaaagccagtggtgtaattcagtcctagcccgaaggtctaaaaaccaggggaamtgatggtgtaaatcccagtctatgtttgaagttctgagaaccaggagcgccagtgtccaaaaaagaagatgcatgtcccagctcaagcagagagcaaact

SEQ ID NO: 27765 - DNA, 201 bp, Homo sapiens
ctggacatggtggctcacgtctgtaatcccagcactttaggaggctgaggtgggtggatcatttgaggtcaggagctcgaaaccagcctgaccaacatggygaaaccttgtctctactaaaatacaaaaattagctgggtgtggtagcatgtgactgtaatctcagctactcgggaggttgaggcagtggaattgcttgaa

SEQ ID NO: 27766 - DNA, 201 bp, Homo sapiens
aatgcaaaattttatcaaacacaagcactggaatctaacagagactgtgtgcacgattgttattggagaacagatctctagcatttgtacaggtgtagacygcctactatgttttctgtcacattatccattgcctttatttataaggaaagttgtctgggtggtggtgcctataagaagtcaagagtagcaacaacagtg

SEQ ID NO: 27767 - DNA, 201 bp, Homo sapiens
aagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatctgg

SEQ ID NO: 27768 - DNA, 201 bp, Homo sapiens
tcttcagcctccaggctctccagtttttcgtcgagagattcactatggaatcggtgagtgatctctagcccatcctgtccagaaaactcggcgtgggagayacagcgggattcttcttgggagttgaaatgcaaaattttatcaaacacaagcactggaatctaacagagactgtgtgcacgattgttattggagaacaga

SEQ ID NO: 27769 - DNA, 201 bp, Homo sapiens
ggtgatgaggggagatcagttaggaggcagctgcagtggcccaggtaagaatgatggaggcttggtccagagctggaccagtggaggtggggagagataartggagagatctttaggaagtaaagtagacatgaattggggatggattggatatgggggtgagggagatggtggaactgagatgtctctcggtttttcgcc

SEQ ID NO: 27770 - DNA, 201 bp, Homo sapiens
tctcacaaaaaaaaaaaaaaaaagaaaaagaaaaagaaaatgtcttatggctacagcattgtgcctggtagacaggataaggtcagagaggtgaacaagastcagaacatgttcagtgatttggatttttattctaaagcactgagaagctgttgagggatgttaagctagtggtggagagttgagggatgacacaatcaa

SEQ ID NO: 27771 - DNA, 201 bp, Homo sapiens
gcctaaatcagggctgatcagggttggtagggaggcaggacttgttgcttgccagcagatatggaaactgaaagacctagcgattagtacaaaatccccaygaccaattcaaatggtctcagcatttacattcaagaatcaccacaggagaggaggttttttgtttttttttttgagacaccgtctcactctgtcacccag

SEQ ID NO: 27772 - DNA, 201 bp, Homo sapiens
tctccttttcttctatgaatgtgttttattttaatgagaagtgaaacctataaaaggacaagcctcagagtttgaaggaacagagttgtagaattgtcagytttgaaaagtgtcataactatatttagagaagctcttgtagcttttgaaagagatgctgctcaagacagccttcaggaacaatgtgtccctccattcacc

SEQ ID NO: 27773 - DNA, 201 bp, Homo sapiens
tagcaggagtccaaagttacctggcctgaggttacagatgcctaaatcagggctgatcagggttggtagggaggcaggacttgttgcttgccagcagatayggaaactgaaagacctagcgattagtacaaaatccccacgaccaattcaaatggtctcagcatttacattcaagaatcaccacaggagaggaggtttttt

SEQ ID NO: 27774 - DNA, 201 bp, Homo sapiens
atctcagtttggattttaaaaactcattaaattacagtatcctgtgccaagtgatgtccttggggcactgctcaatgaattgccagcagaatagtagaaawgagagatgagcatttattatgttggcaattttgtatgacttacagctgactttagatatctatcagggaggaaaggaagtaccacttaccttcataaact

SEQ ID NO: 27775 - DNA, 201 bp, Homo sapiens
ccaatgggccgggcacagaggctcacacctgtaatcccagcactttgggaggccaaggtgggcagatcacctgaggtcaggagttcgagaccagcctgctygacatggcgaaaccctgtctctactaaaaatgcaaaaaagtagctgggcgtggtggcggacacctgtaatcccagctacttgggaggctgagggaggaga

SEQ ID NO: 27776 - DNA, 201 bp, Homo sapiens
aaatgccttggtttttggacttctgtggaacataccactcccctctggtattcgtgggctcagccctgggtaagtcagctgcttagacagtcaaaacttaygcgtacttggctcctcaaagtcacatttgggatgatggccatttgtcaagtgcctcactggcagctcagtttggagaagagcactatgtttaggcaagat

SEQ ID NO: 27777 - DNA, 201 bp, Homo sapiens
gccgctgataaaatgcagtaatcagtcctgttgaacccaggttcttgatttgtttttaacaaaacaatttctagtttctaacttcagactgatataaaaawtactgttttaatcttctaaaaggtataaaatccccccattccttctgcatatgaattcctagactcttggttttgaaatgttcggttttctgcatcacag

SEQ ID NO: 27778 - DNA, 201 bp, Homo sapiens
gcggagattacgtcactgcactccagcctgggcgacagagcaagactctgtctcaaaaaacagaaaaagaagatgacacaggttcccagaagtgatttttyatcactcaagatcagccagaaattaggtgggagagcccgtgttggaatgtgtctttctgtcccaagggctctcctctttgctgtgcttgggaaattcccc

SEQ ID NO: 27779 - DNA, 201 bp, Homo sapiens
cttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaactga

SEQ ID NO: 27780 - DNA, 201 bp, Homo sapiens
ggattgggaacttggatatccatggcaagtggtaatgtctgccacaagagtcacaagatctgatgcacagtataacagtgttgcattggatgctgtgttgrtaccagactgctgggaggcaaaagtagcaacagagagaccatttcagaagcagagtgtatttgccattgccacagataggggactgtgagaaaaagaatg

SEQ ID NO: 27781 - DNA, 201 bp, Homo sapiens
ccttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaactg

SEQ ID NO: 27782 - DNA, 201 bp, Homo sapiens
gccttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaact

SEQ ID NO: 27783 - DNA, 201 bp, Homo sapiens
tgtgggtaatggcattccccatcagggtagcagtctgacagagagcagagattctctttctgcaccctacagaggactgtgagaagcctccagactgaatrcaataatggaaaaagtgactgaaagatttcacatctcctgagtgtggttaccaacatagcagtggggacctatctagacaggcacagcctatgcctgttc

SEQ ID NO: 27784 - DNA, 201 bp, Homo sapiens
cactgtcttggacacgttatttcatatcttgtgagttatgatttttttcatctataaatctggcccagtgtctcccttgcaggattgttgtgtgagtccarctggcaccaaggaggtgggaattctgcaagaacagctgtcagtggtcatcatacttgtgctgtctatgtgcatggctttattgatactcggtgttcataa

SEQ ID NO: 27785 - DNA, 201 bp, Homo sapiens
gagaccagcctgctcgacatggcgaaaccctgtctctactaaaaatgcaaaaaagtagctgggcgtggtggcggacacctgtaatcccagctacttgggargctgagggaggagaatcaattgaacccaggaggtggaggttgcaatgagccaagatcgcgccactgcactccagtctgggcaacgagtgaaactgtctca

SEQ ID NO: 27786 - DNA, 201 bp, Homo sapiens
aatggcttactctcctaacttctgattccctcctgctaatttgtgctattctgttccccacttttcactggctttggcccagaccttttttgctgccagtwacatcactcataatcacattgctgctcccacagaaaggtctctagccagttttagcgggcttttcctgactttgcaaacaccattgattagaattagatt

SEQ ID NO: 27787 - DNA, 201 bp, Homo sapiens
atttatatctatttaggtataagtgaatgaatttccaggacattttttctgggctaagtggagagattgccttgctgagtactgtttggggagatattctyaaaccaccttcatagtttaagaatatatcgatttcccataagggagcttcagtgagaagagaatgtcagttcctgggagagtctcaggagatcgctgcca

SEQ ID NO: 27788 - DNA, 201 bp, Homo sapiens
gtgggtggctactggttaagtgttgagtccaggtgagatgattcgtgtctatggcttttgccatgacaaagaccttttaaagtctctccaatgaagagtcrctgtatctgtatttaagtttccttaggattccttgagcttgagggttcattccccctctctcctcaggtgctgtcttcctgactgctgcacttcttaggt

SEQ ID NO: 27789 - DNA, 201 bp, Homo sapiens
caggagatcgctgccactttttgagagactaaattgttgggcccaggaatgtgggacaagagctttggcctgaaaactgcccgtgggcctgccagggtgarcatagtcacttctgcaatacactgcctgggtgcacttcctgagccctggctgtatgccgggcacacttctgacatagacctcagacagaggcatccccga

SEQ ID NO: 27790 - DNA, 201 bp, Homo sapiens
acctcccatgttcaagcaattctcctgcctcagcctcctgagtagctgggattacaggtgtgccgccatgcccagctaatttttgtatttttaatagaaaygaggtttcaccatgttggccaggctggtctcaaactcctggcctcaagtgatccgcccacctcagtttcccaaagtgctgggattgattttccatttttg

SEQ ID NO: 27791 - DNA, 201 bp, Homo sapiens
ctagaggtccaaaatccagcagggttttgctccctccagaggccctgtgggaagaatctgtttcttgcctctctcagcttctggtgactccaggtgatccrtggagtggtgcagcctctgccttcatggtcatctccccactgccgccgcctctctgtgttctcagaactgcctttgcctctctctcataagtgtacgtgt

SEQ ID NO: 27792 - DNA, 201 bp, Homo sapiens
ttctatacctgtccctgccccaccagactgtgagctctctatgggcaatgaccttgtgttactcaactcaccctcctcactgtcaggcccagtgcctgcartatactcagagtaggctataagacatgcagtcacagttgtcatgagtgtataatccagcaagacagtggttctggtcttttgggttgtgggtccttcaca

SEQ ID NO: 27793 - DNA, 201 bp, Homo sapiens
taactttttaaaatgctgaggatttattaatcgcttatagtaggtaggtcctatggtaccagtacgtgccctttttcttgttgtcggtgaggttttttgaygaaggtcttattccttaagcagagaccacgtctattttgctaaccaatacttccttgatatttagcttaatattttttcttcagtatattagtggatgaa

SEQ ID NO: 27794 - DNA, 201 bp, Homo sapiens
ttcacagaaggccacacttccttcattacaaagagtctgtctttccccctctcaaattccatttcatgccttcataaactcctttttctttgtttttgagrcagggtcttattctgtcacccaggctggagtgcagtggcgtgatcatagctcactgcagcctccacctcacaggctcaagctatcttcccacctcagtct

SEQ ID NO: 27795 - DNA, 201 bp, Homo sapiens
aaaatgtataatttgtggtggcccagactgggttgagcctgctcctgctggcatgaggattggattgcgtggctagttagtgagcctagcctccctccgartatagaataaacttgagaactctcaagtttatttcgttgttctcttcttgggggtcccgaggctgtttctctggcattcacttattctaagagtcacaaa

SEQ ID NO: 27796 - DNA, 201 bp, Homo sapiens
ttgcccaggctggtctcaaactcctgagttatgtgatccacctgccttggcctcccaaagtgctggagactaccggcatgagccaccacacccagcccatraattcttaatacaggtttatggcttgtaagacaaaagaaaatgacaattcattattttagaatcttcggataaaaaactacgtacgtaatattttataag

SEQ ID NO: 27797 - DNA, 201 bp, Homo sapiens
cacattccacacttgcacttcttcccaggggaaccctgaagaaaatgtataatttgtggtggcccagactgggttgagcctgctcctgctggcatgaggaktggattgcgtggctagttagtgagcctagcctccctccgagtatagaataaacttgagaactctcaagtttatttcgttgttctcttcttgggggtcccg

SEQ ID NO: 27798 - DNA, 201 bp, Homo sapiens
ttagaatcttcggataaaaaactacgtacgtaatattttataaggccatcacttgtaagtgcctcacagagtgctgggcattgtgttgagcacttcgcatrtgttaacgtacctcattcttaaccatggttacacagagagaaaatgctattatctcaacttcggggcgcagaaaggttaagtgatttacactgtttctca

SEQ ID NO: 27799 - DNA, 201 bp, Homo sapiens
ctcattcttaaccatggttacacagagagaaaatgctattatctcaacttcggggcgcagaaaggttaagtgatttacactgtttctcacagctagtacgkcggggccaggattcacctgcagcctgtgtggctgagagccagccctcctcaccctctccacgcaccactctgtgctcgcaaaatgcaggcccactggcca

SEQ ID NO: 27800 - DNA, 201 bp, Homo sapiens
tgccttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaac

SEQ ID NO: 27801 - DNA, 201 bp, Homo sapiens
acaagatcctgagccagtgggaacatcaccaagtttctatgctctttgaggccttgccacagagcagctgctcacctctttgatacactcctttaccagarataaaaaaccgcaaagcccaaaacagtgctcagttttgttttggtcttaggccagaaatgcatgccgttttggcttgggtcttttaaatgccgttctgga

SEQ ID NO: 27802 - DNA, 201 bp, Homo sapiens
ccgggtgtggtggcaggcgcctgtaatcccagctactcgggaggctgaggagggagaatcacttgaaccccggaagcagaggttgcagtgggccaagatcrcactgttgcactccagcctgggggtcaagaatgagacttcgtctcagaaaaaaaagaatttctacattcattttacgggtaaagaacttgcccagctaga

SEQ ID NO: 27803 - DNA, 201 bp, Homo sapiens
tttcccctgttggatccattgatgcaatggacagaattctagaaatgagttttcatgaatttcccagcgctgctcaaagctgtggtcagccaagtggggcwggccacaacaagaaaccagacgttcactcttggtttgcatgcacatcttgtgactggactgggcacaggtctgcagaccgttctctgagcagcaacgctg

SEQ ID NO: 27804 - DNA, 201 bp, Homo sapiens
gtgattagactggctggtgggttcagggggtatatgatacacttctctgtttttatgtctgtacacaattccctgtaataaaagattaaaaaaaaaaaaaacccacaaaagattattctgctttcagcatggaagactagatttcagagggagaaatggtgatgaggggagatcagttaggaggcagctgcagtggcccag

SEQ ID NO: 27805 - DNA, 201 bp, Homo sapiens
tgtgattagactggctggtgggttcagggggtatatgatacacttctctgtttttatgtctgtacacaattccctgtaataaaagattaaaaaaaaaaaaaacccacaaaagattattctgctttcagcatggaagactagatttcagagggagaaatggtgatgaggggagatcagttaggaggcagctgcagtggccca

SEQ ID NO: 27806 - DNA, 201 bp, Homo sapiens
atgtgattagactggctggtgggttcagggggtatatgatacacttctctgtttttatgtctgtacacaattccctgtaataaaagattaaaaaaaaaaaaaacccacaaaagattattctgctttcagcatggaagactagatttcagagggagaaatggtgatgaggggagatcagttaggaggcagctgcagtggccc

SEQ ID NO: 27807 - DNA, 201 bp, Homo sapiens
aatgtgattagactggctggtgggttcagggggtatatgatacacttctctgtttttatgtctgtacacaattccctgtaataaaagattaaaaaaaaaaaaaacccacaaaagattattctgctttcagcatggaagactagatttcagagggagaaatggtgatgaggggagatcagttaggaggcagctgcagtggcc

SEQ ID NO: 27808 - DNA, 201 bp, Homo sapiens
attatgggttaatgtgattagactggctggtgggttcagggggtatatgatacacttctctgtttttatgtctgtacacaattccctgtaataaaagattwaaaaaaaaaaaaacccacaaaagattattctgctttcagcatggaagactagatttcagagggagaaatggtgatgaggggagatcagttaggaggcagc

SEQ ID NO: 27809 - DNA, 201 bp, Homo sapiens
ctaatctcttgcagaaacaccctcacagacacaaccagaaatgctgttttaccagctatctgggcatcctttagcccagtcaagttgacacataaaacaamaataaggggttgctatggttattagcagtgctgttagagttcacaagtggatagattactgggctgggaaagtttgagagagcttcctggaagaggtgga

SEQ ID NO: 27810 - DNA, 201 bp, Homo sapiens
gagttctgagtctgccaccactaaccagctgtatgacttgggaaatgttatgtaactttggtgagcctcagtttccttatctaaaattcagacaatcacarttccttgcaaagttccttgtaggatttaatgaatgtgcctaggatggggtctgatatgtaaaagggttcttcagagaaacagaatttataggatatatgt

SEQ ID NO: 27811 - DNA, 201 bp, Homo sapiens
aaactgaaagacctagcgattagtacaaaatccccacgaccaattcaaatggtctcagcatttacattcaagaatcaccacaggagaggaggttttttgtktttttttttgagacaccgtctcactctgtcacccaggctggagtgcagtggcgcaatctcggctcactacaacctctgcctactgggttcaagctatttt

SEQ ID NO: 27812 - DNA, 201 bp, Homo sapiens
gtcactggttcccaaaccaaaggaagccattggtcttgttgagtggtgacgcttatcttcataaatcctggctgtactgggcgcatcccttttagtttatkttcagcccagccctcatagctcactttcccctgcttaaaaattttcatgggttttccctcacctttagagaaaagttgagttactacaatttgactcccg

SEQ ID NO: 27813 - DNA, 201 bp, Homo sapiens
agccatccatagtgcatacaaaattagatatatcaagctacagaaaaaaactgtggaaaaatcttttcttcctgcaaatgtttcatcctcacttatgtcaytgtggcttgaattctaaagaaccctgatgagaaagaaggaaaaccaaagaaaagccactctttaccaaacagtactgtatcaacctgctgttggggtata

SEQ ID NO: 27814 - DNA, 201 bp, Homo sapiens
tcatcttgtttggttgaaaatcacattggcaaaaccaaatccagaatgctagggtatgactaaatggtagaacaagctaagcaactatttctaggggggawaatttctgtgctaggctttgttactacagtggttgaacatgggctttagaatcagaaagatcagttcagatccccacattggaacataaaagttgtgcta

SEQ ID NO: 27815 - DNA, 201 bp, Homo sapiens
ttgggaaaatgactctggtagaatgcttctcatttgaccacttctgagataagccgttttcatatattcttagttggttcagcattttcatgggcccattrtataaattaggattagatttcaactctgtacaaacaaaaacccaaataacattagcaattatgtttgtttgtttgttttccctctctgaccagagaagtc

SEQ ID NO: 27816 - DNA, 201 bp, Homo sapiens
tttttcttatctataaagcaactgccttgagggagtatcgcatgagtttcaggatattcactgtgattgaatccctctacttagtcagtgcttaataagtmgcagccataattagagtcgctgagaatcaaaggttaggttggcaggcagtccagtccagaggttttgtgaatattgcccagtttggtaaggtataacaca

SEQ ID NO: 27817 - DNA, 201 bp, Homo sapiens
aacattagcaattatgtttgtttgtttgttttccctctctgaccagagaagtctggaggtagttcaaagctagtcagtgcctccatggttatcaggagccsaagccttttctgtttccctggttctactctctttatcatattgctttaggatcccaaatggttgctggagtgtcagccgtcacaaccacattacagtagg

SEQ ID NO: 27818 - DNA, 201 bp, Homo sapiens
gctctggagctacaccacctaaattcaattttcttttcttttcttttctttttttttttttttttgagagagtctctcactcaggctggaatgcagtgtggtgatctcggctcactgcaacctccgcctcccaggtttaaatgattctcctgcctcagcctcccaggtagctggaactacagttgtacaccaccatacctg

SEQ ID NO: 27819 - DNA, 201 bp, Homo sapiens
aagctctggagctacaccacctaaattcaattttcttttcttttcttttctttttttttttttttttgagagagtctctcactcaggctggaatgcagtgtggtgatctcggctcactgcaacctccgcctcccaggtttaaatgattctcctgcctcagcctcccaggtagctggaactacagttgtacaccaccatacc

SEQ ID NO: 27820 - DNA, 201 bp, Homo sapiens
ctttaaagctgcaaaatacctttaggagcatctagatcattccatccttctataagcctgcaaggccagcagggcccaccttggatacagacggaagctcsgaggagctcagggcctgctccttggattttcagtgccagcagcaagatttgtgaccccagtctagtgctccgttgcctagtttgagcagaagtcaaactg

SEQ ID NO: 27821 - DNA, 201 bp, Homo sapiens
gcagctgcccagatggctctgcgctcagcatactcgctgagagtgaattcaagattgtttgaaatgaccttgaagatatgatcacacaatgggcagcacarcagaccctaggctcccttggatttcacattccacacttgcacttcttcccaggggaaccctgaagaaaatgtataatttgtggtggcccagactgggttg

SEQ ID NO: 27822 - DNA, 201 bp, Homo sapiens
gtattggatgtggtttatttttcttctagtccacatgtcccccgcagttccttgctgatgcctcctgctactttgcttccttactttccccttctgcagaycttgagtggaagcaggcgtgaccctgccttgggagggaccgctgaacttcaaggttttcaattgattttgatgcttttctccttcctcagaaaggaaaga

SEQ ID NO: 27823 - DNA, 201 bp, Homo sapiens
ttatcccatccaacacccatgtttagcaatgaagacatggggattcaaagaagggaagtgatttgcctggactcccacagagaattgggactggaacccaratgtttcagctcccagttatgtgattctttgggccagacaatggcctctctggccaatttagctacaagagcatgtcactttgccagttttacttttccc

SEQ ID NO: 27824 - DNA, 201 bp, Homo sapiens
cagccctggctggtttccattgtgtttatttaatctttcaagaattttcttataaaagactggacaatcaatgcctttttactgattaaggtgaaaagttrtacatggtttttcaaatatttgtgcaaatgagagaatgtatgagtctttgcatgcatgcagatattatacctaatgttagactatagctgtaggcagatt

SEQ ID NO: 27825 - DNA, 201 bp, Homo sapiens
ttcagagttgcacagtcaattttagaacatttttatcatgcaaaaggaagtcctgtaactgtcagagtcactcctcattttcctccaaatcctttactaakctactttctgtttctgtggatttgcttattctggacatttccaagccatgctttttaatggctgcacaatattctgttatgtggatataccttactttag

SEQ ID NO: 27826 - DNA, 201 bp, Homo sapiens
taactccccgccttccccactactcctcaggacatcagatcacatggaaatgtatgttttcctgtttattattcatttctcaggcacatcagcaaaggtayggctgtagacagctgatgtagaaaacagtcctggctttgaaatcatgctttttagtatttaacctctctgtgcctcaatttccttgtgcataaggtgggg

SEQ ID NO: 27827 - DNA, 201 bp, Homo sapiens
ggatcctgaagaaataggccactgattgtctctgaatatattctataaggtcattttcagttctcagggctgggaaacacaatgtggagagaagcattaarttaatgctttgcttttaaatgttgggattctcatagaagaatccatttctgctcatttgctgtctggctgtcttaatgcattcaaagtgtagaacccttg

SEQ ID NO: 27828 - DNA, 201 bp, Homo sapiens
tgctgtggagtcaaaaagacctaggttcctaagccagctccgccatggcagtttacttaaattttctccattttctcatttgtgaattggggataatgatrgtacttaaaacatcattgtgaagacaatagaaaatttcatgtaaggtgcataacttaccaccgtttctggcatatttagtactccctaaagcttgtgatt

SEQ ID NO: 27829 - DNA, 201 bp, Homo sapiens
ttggtgggtgtgttatgtagattatttcattgaagacattacaacaatcctgtggttactgtacctttaatccagatgaggaaactgaggcaaattgagatatataacttgttcatttaccctattagtatgtgttacagacttgaacccaaacattctgtctctgaacccgttgcctttgctcttctacaatatcctgcc

SEQ ID NO: 27830 - DNA, 201 bp, Homo sapiens
ttattgagctcatcgtgtacgaggcacttggcatgcagtatcttgcttaaatttaataacatctctgtgaggtaaatgccattataatttccattttccakatggggaggatgaggtttagaaagataaagctgcttgaccaaggtaccacacagacagtaaatgatagacttgagatttgaacctaggcctgtcctactt

SEQ ID NO: 27831 - DNA, 201 bp, Homo sapiens
taatattgggatgtttcagcatttaaattaaaatggtgcacatttgctgttccttccagctttcccaggctaaatctggaaagttcaatccacacgtccaygtagaatatgagtggaatcttcgacaggaggagatagatgagagcgatgatgatctggatgacaaagtgagtgtaaattatgtcctcgaattctcaacaa

SEQ ID NO: 27832 - DNA, 201 bp, Homo sapiens
tgccatttgttgaatacctactctgtgccaggtagagtccattgtgcttttcagtcttcaattagttattttcactgtttacataaagattcagattaatractgttaaggaccacctttgagccttaaacagacccttcttgacaactacagtcaaaagattctatggctttacctatatcttgctgcctcctatttcaa

SEQ ID NO: 27833 - DNA, 201 bp, Homo sapiens
ccctccaagggcttttggcctcatccagagaaaccacaagaagctgaaccctgctatctgtttcccaatgcattttcataattttcttgttttctcacaawgcttaagtgatacaaaacccatgtgatattttttaaacatttaaaaaggatttctatatttctggttggagattaccaatcactcagcttcccaaagtga

SEQ ID NO: 27834 - DNA, 201 bp, Homo sapiens
aggtgggagagcccgtgttggaatgtgtctttctgtcccaagggctctcctctttgctgtgcttgggaaattcccccagccctgggctgcagcatgagggrgcagctgcccagatggctctgcgctcagcatactcgctgagagtgaattcaagattgtttgaaatgaccttgaagatatgatcacacaatgggcagcaca

SEQ ID NO: 27835 - DNA, 201 bp, Homo sapiens
aataatggaaagagagcccagctgaccccagctttgctctttacaggtactctgtatttgtcttctacctaacacatggtaggggctcaacaagggttgartgaatcgctacatgttggctggatgtgttactacctgggaagctctctgagaccagctattaatattcactaatcatgaatattcatgaatggatccatc

SEQ ID NO: 27836 - DNA, 201 bp, Homo sapiens
tttttctcttagcccttatttaattttacatatatgacatttcagaggatgtcactgcagttgttgtttggcatttatgggaataaaactttgtagcacayttagacttgtattatttctagagggagccttgtttgattgaaggacagtatcccctgtctctctaaaacatgaggctcttaaaagtgcattttatttagc

SEQ ID NO: 27837 - DNA, 201 bp, Homo sapiens
cgcacacgttttatcatacttctaatgatttgggaaagataatcttatagcctatattatctaccatttttctcttagcccttatttaattttacatataygacatttcagaggatgtcactgcagttgttgtttggcatttatgggaataaaactttgtagcacacttagacttgtattatttctagagggagccttgtt

SEQ ID NO: 27838 - DNA, 201 bp, Homo sapiens
acattctagggatttgacaaatgtgcgatgatatgtatcctctgttactgtatcagagtagttttagcagcactaaaaatctcctgtggtccacctagtcrtctctccttccctcatcctaaacccctggcaaccactgatctttttgctgtctacatagttttgcctttttcagaatgtcatatagtcagagtcataaag

SEQ ID NO: 27839 - DNA, 201 bp, Homo sapiens
atgatggcattttccaacctgtttttttaaattaaaagattgccaaaattcaactgccatatgtcataactaatttttttttttaacactaaaagaaatckcaaaacttaaaagcactgtgaaaagctcttcaggtcattcctactcattataccccttgaaatgtttttctggctaaaattaccatttaggtgataaagt

SEQ ID NO: 27840 - DNA, 201 bp, Homo sapiens
cttagttaaaacagtccttttaattttaattaatgcattgaagctacttcttcctcataattttctacttcataattctgttgtctgagcccataacaatrgttatttctattatttgtagagaattataaagctctttcatatttgttctaccatttaatccctctatctttatctcctcccctcccctcacccccctcc

SEQ ID NO: 27841 - DNA, 201 bp, Homo sapiens
tagtgaagactttatatagaacatgtaaataattgtatgaagtagttagtgtacaaaataatgtcatatatgcagctgcattttctgcctttttcacctaraaagtttttttgtcatgtcattaaaaacttttgccctctgttttcatgactacataatattctgttgtgtgggtgtacctgtcttactgcttcacctact

SEQ ID NO: 27842 - DNA, 201 bp, Homo sapiens
agacctgaaactgtgaacctaccagaagaaaactttgggggaaactctccagcacattgctctcagcaaagatgtcttgagaaagacctcaaaagcacagwcaaccaaagcaaaaatgagcaaacgcaagtgggatcatatgaagttaaaaagcttctgcaccacaaaggaaacaatcaacaaagtgaagagacaacccac

SEQ ID NO: 27843 - DNA, 201 bp, Homo sapiens
ttttgctaatcaatatctctttgataaaagagctggtctcaccctcacagccttaaggcaggtgaagttttcattatttttatttttatggttaacttttrctatacaagtaattctgataacaggagcttgtctttatactgtggtgactgtatgccaggcactggcactttgagtactttacatgttttattggttaag

SEQ ID NO: 27844 - DNA, 201 bp, Homo sapiens
aggtgccccacctcaagtctagtcaagagattaccaaccaaatggagtcagaacaggttttgctattaagtgagtttaagctaaaaaaaaaaaaaaaaaaagccgtgtattttatatatatatatgcaaatttgctctaacaggctgcatactgtttcattgtatatctgtaccataactgattatttgaattttctgttt

SEQ ID NO: 27845 - DNA, 201 bp, Homo sapiens
agagatggaaaactccccagcatattcaaggggctgcagacattttggggcaggatgggtggaggagtcagaaatgcagtttctgaggtaaaaactcagamctgactacggaggaccttgggtgttgtactaagggacgtagacttcatgataaggataaattaaacagtaagcaccatttgttttctgggagaaattaaa

SEQ ID NO: 27846 - DNA, 201 bp, Homo sapiens
gcctgcatgtctcaccttggcattgacctctcctgtcccctagtacctgcctaggtgcagcaggatagattgagaaccaaagtttttccaaagctattttytcaaagccatgaggactgatatattttctctggttggtagtagtgaatgctttttaaaaaatctttattttaaaatattttaattgtggtgaagtatgca

SEQ ID NO: 27847 - DNA, 201 bp, Homo sapiens
ggtactaagctttagtccctttcatctagtagctcattatctagtcagccatatgaacaatccatcatgcctaaagtggtatggatactattagagatacrttggaagatgactgcagccagacagaaacctacaagacccagagatggaaaactccccagcatattcaaggggctgcagacattttggggcaggatgggt

SEQ ID NO: 27848 - DNA, 201 bp, Homo sapiens
tcaagcaattctcccacctcggcctcccaaaattctgggattacagacatgagccactgtgcccagccccatgactatagattttcaatcctagttttgargacatgcacttcaggagcatatgctgaaacatagtacattctacaactttcctctttagaccacttctgtctttctgggcagccaaaacaggcatgtctc

SEQ ID NO: 27849 - DNA, 201 bp, Homo sapiens
cttttgcaatccaagattgtttttccaaggagaattttctactttttcaggtaatcatagtttctttcttccttttccctttcctttttccttttctttcytttcctttcctttttcctttcctttcctttttcctttcctttcctttcctttcctttcctttcctttcctttttctttttctttttctttcccctttccc

SEQ ID NO: 27850 - DNA, 201 bp, Homo sapiens
aggacacatgaatttttcttttgcaatccaagattgtttttccaaggagaattttctactttttcaggtaatcatagtttctttcttccttttccctttcytttttccttttctttcttttcctttcctttttcctttcctttcctttttcctttcctttcctttcctttcctttcctttcctttcctttttctttttctt

SEQ ID NO: 27851 - DNA, 201 bp, Homo sapiens
cagccataattagagtcgctgagaatcaaaggttaggttggcaggcagtccagtccagaggttttgtgaatattgcccagtttggtaaggtataacacatagtgtcagttagataaacccctcagggagagacctatttaataattgctgtggttctgaaagttttgaggaaggcctcattggatgaatatacaaagtatg

SEQ ID NO: 27852 - DNA, 201 bp, Homo sapiens
gcagccataattagagtcgctgagaatcaaaggttaggttggcaggcagtccagtccagaggttttgtgaatattgcccagtttggtaaggtataacacatagtgtcagttagataaacccctcagggagagacctatttaataattgctgtggttctgaaagttttgaggaaggcctcattggatgaatatacaaagtat

SEQ ID NO: 27853 - DNA, 201 bp, Homo sapiens
ttgttttttgagacagagtcttgctctgtcccctaggctgtagtgcagtggtgtgatcacacctcactgcagcctgatctcccaagctcaagcaatcctcytgtctcagcctccccagtatttgggactggagcttaccgcagccttttagtgacagtaagtctttttttaaatttatttttattttttatttcttcatca

SEQ ID NO: 27854 - DNA, 201 bp, Homo sapiens
ttcttcatagttcttaacaatttgtactactgttttagcttcctctgtagttggcacactaaaattagatgtcttttttgtttcattgtcttcaacattckttccacagaacccacctggctttcaaccaacttgggtattttgacctgtatagaatgttctggcatccatagggaaatgggggttcatatttctcgcatt

SEQ ID NO: 27855 - DNA, 201 bp, Homo sapiens
tgagcagtacttaatagaccttcagtccatcactgtcagaggtgatagtggcagtgagggaacatctctcacaggcctagaggtgttgcatagggtctctkaaggaaagcctttctcactttttcacaaggataaagtgcttaattttgttttcagttcagtatcaaagggaaacttttatggtagcccctaggctaaacc

SEQ ID NO: 27856 - DNA, 201 bp, Homo sapiens
ttttgatgaccaaataaaataaggaacatgtaagtgccagtttgaggtattcttaaacagtacaaagttgctgaatgagacacagactcaggtttctaacctggcacatagttgatgtttataaaagttagttcccatctcctctttttagttgtaggttttatattgattattggttcaagagaggcaaaaggttgtaaa

SEQ ID NO: 27857 - DNA, 201 bp, Homo sapiens
ccttacctaccctatcttatcttttattatcccccaacatccatccatcaagctgtcctgtcatccttctatactttcatccatctaactattatttgctwgttccaggcactgtgctttggacaggcaatatacaaaaatgtgtaaagttcagtccttgaactcttggtgatatgtagtcagctttgttcaattagagtc

SEQ ID NO: 27858 - DNA, 201 bp, Homo sapiens
tagtatcaccagctgttcacatagtgccacaacactcaaatccaaggacaactcttagaggaactggagtgcagggagaattattcattacatctgctcaraaagataaagtgccctaccaacacctttgcaaattgaaattcccttgctcttggcatgtgatcatcctgccaactctgtgaaagctcccttagctactca

SEQ ID NO: 27859 - DNA, 201 bp, Homo sapiens
aaagagccaagccaaagctgaagctttgttgtatcttcatcaagggaggttcccacccaatgtctgttccacaactggatgccatgttttgagaggagcamcagagaccaggatggaaacagaactggaaaacttatttagttaagtggcttagtgaaccgctgtgtcactcagagatgaggcagcagcagtggttgaggg

SEQ ID NO: 27860 - DNA, 201 bp, Homo sapiens
gagtactttacccacggtattttacagaaggcctctgttactggatgttctgaggagaaaatctggaaagtaaacaatattaacttcattttacagatgaraaaactgagggaaggagtgacttgacgaggatgtgcagtcaggggaagctggagtttgtgtctctgaggtctgtggtcttacatgatgagtgccaccctt

SEQ ID NO: 27861 - DNA, 201 bp, Homo sapiens
cctgtggggtgggtgctgtttcttcatttcacagatgatgaactaggtttagaaaggattcaactcaatttatgctctttctactcagactcatcctcaaraaaaaaaatgcagatatgcatgcaatgctaatgaaaaagaacaaacaggaaataggcttctgctgagacatgagatatgtaggttagactcaaaagaact

SEQ ID NO: 27862 - DNA, 201 bp, Homo sapiens
aatttggttttcacactttggctggtgcctgttgaagcgtctagcacactgagtggatgaataagtgcctaaatgatgtaaaaacccaagtttgatgatcrtcagaaaaaatctcagagaaattggttccaggatccccacagataccaaaatctatgcacatgcaagtcccacagttggcctgtggaacccacaggtatg

SEQ ID NO: 27863 - DNA, 201 bp, Homo sapiens
gaaaagatagttgcttttctctgttcttctgagacctcttgctggacccctcagtaaatctctgccttttgtgatcaaagacagtgctgcaagcaatcctycttggactgggcagatgtgaaaatgaccctgttgcttccagctccaccctggcatgcttagtctgggactgttgacccaacctgatttgcctatgagctg

SEQ ID NO: 27864 - DNA, 201 bp, Homo sapiens
taaaaatggcaagatataaggtattattttgtttttgaataatggtaatatcatttgatgccatcctgtgttctaagtttaaagttgttagattggttgttgctacttaagaaaaactcattcagagagttaggaaggaaaaaccaatagcttgaaaacctgtgtaccattttaagagttacttgatgtttggtaacttct

SEQ ID NO: 27865 - DNA, 201 bp, Homo sapiens
cccctccctttatagtataactcaatccacaaaatgtaatttaataaaagcttatatatatataaggatatatatatatatatatatatatatatatatatatatatataagaatgtgtatattcaggaagaagattttgaattttctttatccttcctgacttcaagctatatttttctttaaatatgttctaaaattta

SEQ ID NO: 27866 - DNA, 201 bp, Homo sapiens
gagcttttggggggaattttcaatggagcctattttataaatattttcaaaattctgttataccctttatcccaacatggatcatggaaagtaaggggttyttttagtctaaatattagttaaagacatttgaggagctaggaattccagttaacattcaaaggctactttcttcatacttgataattattttctacctca

SEQ ID NO: 27867 - DNA, 201 bp, Homo sapiens
tcacaggtgaacttgtggatgggaacagacagtagaaaagggacagcattctttgagaataggtcttgaggaaagggaataccttttaagctgaaaagacrgaagtgcttttctctcctagccatggaatagatgatgagttggtcctctgcagagaagggacccgaagggcacaggcgaagggagtggccaatgccagtg

SEQ ID NO: 27868 - DNA, 201 bp, Homo sapiens
ttttgtttttagatcatgtacaaaatgaagaaaactatgcacaagttcttgataagtttgggagtaattttttaagtcgagacaaccccgaccttggcacygcgtttgtcaagttttctactcttacaaaggaactgtccacactgctgaaaaatctggtaagacatttcatatgtgagtaaaaagaattacagcctttcc

SEQ ID NO: 27869 - DNA, 201 bp, Homo sapiens
tacttagaattgcagaaagaatgagacatccttagtggtaaacattaatgaaatctacgaatagatactctcaacaacaatgcatatgcatatctgttgayatggaaagacagtcgtgttgtattaactggaaaacagcatgatataaaacaacacagaaaggatgatcccattttatgtacctataaggaaatattgtag

SEQ ID NO: 27870 - DNA, 201 bp, Homo sapiens
cacctgcctcggcctcccaaagtggtgggattacaggtgtaagccaccatgccttgcctcttcatcatcattctacaggcccatttcttattagttgataygtactgagggagttgaaattatgttttatgtctgtcaaaaatatagatgttgaaaaattaaatctattgttgaaaaaactttaaaaatgatttccggatt

SEQ ID NO: 27871 - DNA, 201 bp, Homo sapiens
taggctggagtgtagtggtgctcgctgcaacctccacctcccgggctcaagccatcctctcacctcagcctaccaagtagctgggactacagacaagtacyaccacaccagctaatttttgtattttttatagagatggggttttgtcatgtcgctcaggctggtctcaaacccgtgagctcaggcaatcctcccacctcg

SEQ ID NO: 27872 - DNA, 201 bp, Homo sapiens
tgaattttctccatttttttttaatgtgatactagagaggaatgatacttcttcctggttgtgtggaaagctacatctaggttggttataattttcattttaactcttcctccttcatacagccctagacttctcagtgtttaaatctaggtgtcaggcctcattcatatgtatgtatgtattctttttctttttttttta

SEQ ID NO: 27873 - DNA, 201 bp, Homo sapiens
cagttataacacttcattctgttctatgtatggtaactagttgtttacgtattagtgtctcactaaactgtaaatagaggctatgctttcctctttgtatrtcccaaaacgccttcctcagcacaatagctgatcttcaactagtcattcagacaggtgtgtttgaacttttagatcacatagtttaagaacagatgtctc

SEQ ID NO: 27874 - DNA, 201 bp, Homo sapiens
ttaagttaatgctttgcttttaaatgttgggattctcatagaagaatccatttctgctcatttgctgtctggctgtcttaatgcattcaaagtgtagaacmcttgaacatttacatttatttgttgttgctggtgttttctctactctttgttggcctccggatggacaccctgttaatattctttgactagcgtggagcg

SEQ ID NO: 27875 - DNA, 201 bp, Homo sapiens
gcggagccattggaagacagacagggccatagtatcaccagctgttcacatagtgccacaacactcaaatccaaggacaactcttagaggaactggagtgmagggagaattattcattacatctgctcagaaagataaagtgccctaccaacacctttgcaaattgaaattcccttgctcttggcatgtgatcatcctgcc

SEQ ID NO: 27876 - DNA, 201 bp, Homo sapiens
atcgcttgaacccgggaggtggacattgcagtgagctaagatcatgccactgcactccagcctgggcaacaaagagcaaaacttcatctcaaaaaagtgtytaaagatgagaatgtggaagtgaagtgataactcagttatgtccctgaaagttctagccggaaaggatgtgatgccatttagaggaagggaagcaagctg

SEQ ID NO: 27877 - DNA, 201 bp, Homo sapiens
aaggtttcatcctggcgtgtgagtgttttccaagcaaaaagccagtgttttacttattcagcagtgaaagcacactgatgtgtgccattttactcttgacmatttttaagttatgagtaagtgactaggagagcataagcgttttccctaaacgggagcaggcaggcattttaggactgctgtgacccagacagtagaagg

SEQ ID NO: 27878 - DNA, 201 bp, Homo sapiens
tttccaaaatattacgtcatatagagaacatttcaataatccttccccctcaatccttggtcctaggggtgagaaagaaaaaacaaaaagctttttagtcmtaggtaacttccacacctcaactaaaaagctttttagtcgcctaggatttgcttaaagaaaatcccattgtgaaattcctggaatttgtacctttggccc

SEQ ID NO: 27879 - DNA, 201 bp, Homo sapiens
atgtgctaagttataaacagctgacttagggccatcattttaaagtatgaagccttccagtcttcgcctccccagtcttttccattcttaaagtttggacyagtctgcaaggtagctgcctccctaaggatttggggtattctctaaaatttgaatatatgatattcttgtgccctttgaatacgctgtttaaaaataaat

SEQ ID NO: 27880 - DNA, 201 bp, Homo sapiens
ttcctacagtttcaacaaaccctgatggtggcatttcagtttatcgtagaggtttcttttcccctacaagggtcattctctcttgcccaattttggctgaraagggaggaatatcatggccgttttggctgtatggtgttactgtataatgatatggggattggtgagtgaaaaataaaatgaaccctcacttgcttaggt

SEQ ID NO: 27881 - DNA, 201 bp, Homo sapiens
taagtttccatatcatttttattaacctcttgtttagattcaagcctacagagtagctactcctgttgtgttcacaggattttctcctgagctacattttyttaacctcagactatctctccctgaccaaagagcccagtagtccttagtggggtggtgtgggagacacagcctcagcagggctgctgtactcttgatcaa

SEQ ID NO: 27882 - DNA, 201 bp, Homo sapiens
taacaaggtccctaacactggagccaagctttggtaacaccctacactgaggtccagttggagctgttcagggaataacagcagcagcttgcccaacaatkttggtacaacagtttggtgggagaggatgagtgacttatttgagcggagccattggaagacagacagggccatagtatcaccagctgttcacatagtgcc

SEQ ID NO: 27883 - DNA, 201 bp, Homo sapiens
aagtactataagagaaataagtttccatatcatttttattaacctcttgtttagattcaagcctacagagtagctactcctgttgtgttcacaggattttytcctgagctacattttcttaacctcagactatctctccctgaccaaagagcccagtagtccttagtggggtggtgtgggagacacagcctcagcagggct

SEQ ID NO: 27884 - DNA, 201 bp, Homo sapiens
tttgagcacctactatgtgcctggtttttggtagatgactgagggaagggtaacagaatgaattagacatgctttctgtcccaaaggtgttcacaggtgartggggtggtggttgtggggtgccaggttagctgcaatatagcatagaccggtcagagctgtgataattcagattgctctgagagcacacatgaggtcatg

SEQ ID NO: 27885 - DNA, 201 bp, Homo sapiens
tgatgtgcattgtgtgtttgcatgtgtgtgtgtatgtgtttctagatatgtctgtgaattttggggtgtattttttaaatgctttgcttgtatttttaatrttgctaataaaatactagctacatgattttgagggcttggcacctcttgactaggtaacagtactgtgctaaactctttacatgtttatctaatactttt

SEQ ID NO: 27886 - DNA, 201 bp, Homo sapiens
ccttgggccgagacttcacacagaaatatttggggatctgctctatggttctctgggtttgggcctcagtttccccatttttcagcttttgtggattctgrtcattctccccacttgatgtgcattgtgtgtttgcatgtgtgtgtgtatgtgtttctagatatgtctgtgaattttggggtgtattttttaaatgctttg

SEQ ID NO: 27887 - DNA, 201 bp, Homo sapiens
ttgacacatattttatcctttgatcctcataacaaatctgtaatgttagtaatattttaattttcaagtaagggtcctgaggcttggcagtcagcagtttyctgtcccaggttttactgccgaagggaaagaaccgaggtttatacaaagatctgtctgaccctcaagtctccaagtctctgccattaactgctctgcttg

SEQ ID NO: 27888 - DNA, 201 bp, Homo sapiens
gtcaagttttctactcttacaaaggaactgtccacactgctgaaaaatctggtaagacatttcatatgtgagtaaaaagaattacagcctttccaaaataytacgtcatatagagaacatttcaataatccttccccctcaatccttggtcctaggggtgagaaagaaaaaacaaaaagctttttagtcctaggtaacttc

SEQ ID NO: 27889 - DNA, 201 bp, Homo sapiens
tcctcaagaaaaaaaatgcagatatgcatgcaatgctaatgaaaaagaacaaacaggaaataggcttctgctgagacatgagatatgtaggttagactcaraagaacttcctgacagtgtattaaataccaaccggatggccatggaagtaggatttttttcttcctgattttgggataattttgtcaatgataggctggt

SEQ ID NO: 27890 - DNA, 201 bp, Homo sapiens
aagaaaaagatttcaggagagaggtcagcaattctaaaagctttaaggcaggactagctcattggggttagaaagactgtaggtgtggctggaacataatragtagtggagggtgtgggaacagaggggagagggcagaaggctgggtcacgtagggccttgcaggcagtagcgaggacttagttttattggaagaacagt

SEQ ID NO: 27891 - DNA, 201 bp, Homo sapiens
gtgtaggagaggggtgtgtaaaatgaagacatctgtgtatattgttaattgggaaaaacagtttacaaaatagtatatacaagttgaaccaacatatgtcaaaaaaaaaaaaaacagacatctcacacacacatcttggtaaaattaaggtattaacagtgattattgctgcatgtgaaagtgagattccaacaactaatg

SEQ ID NO: 27892 - DNA, 201 bp, Homo sapiens
cagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagagaaac

SEQ ID NO: 27893 - DNA, 201 bp, Homo sapiens
atggttggattctggtgaggccctcttcccttgcaggctgctgacctctcattgtgtccttatatggctgaaaaatagctagagagctgctctctgttttktttgtttgtttgtttgtttttgagatggggtcttgctctgtcaccccccaggctggaatgcaacggtgtgatctcagctgactgcaacctccgcctcctg

SEQ ID NO: 27894 - DNA, 201 bp, Homo sapiens
ccagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagagaaa

SEQ ID NO: 27895 - DNA, 201 bp, Homo sapiens
gctgtggcaagcccattgctgtttgtctctttggcagggaacattattgtggaattttaaatgattgctctggagagattgggcagaacattgattttaaagcaaagaagtctttgagctttatcatcttccttcctgtgtggaatctgccttgtctcctctcccttagccaaattgtgcaagggttgtgtaaataaattt

SEQ ID NO: 27896 - DNA, 201 bp, Homo sapiens
cccagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagagaa

SEQ ID NO: 27897 - DNA, 201 bp, Homo sapiens
ccaggctgagagtggcaatatggagcagttaggaaaccggagccataaatgtgcaagtggacgaggtgaggcagccagtgatgagtccagttaggctaagmtcccaaagctgactttgctaagaggcagattcctgaagggggcccacaaatgattctttttgtggaatcctctttcacatgttaccttggaggtagtctt

SEQ ID NO: 27898 - DNA, 201 bp, Homo sapiens
tccatttcttgctggtaggacttcacttgcctaaactttctattaacacatttcaaagcactttccagtgaaaccagagggaggagaccttttttttttttccctcgagagtccaacttatactggagagcagtggcacaatcatagctcactgtaacctcgaactcctgggctcaagcagtccttcagcctcagcctctc

SEQ ID NO: 27899 - DNA, 201 bp, Homo sapiens
accattggtgattgagctctatctttagtccttcttcttcccccagacatctttttggccgtctcattagcgtacagaagacactcttaccactcaggagrctgcaagagttctgtgccagaagtcaaggacaaagaccaaatctattttttatgataccacaatgatctcataatattaatgagatcagatgagaaaaca

SEQ ID NO: 27900 - DNA, 201 bp, Homo sapiens
gaatctcgctctgtcactcatgctggagtgcagtggcgcaatctcggctcactgcaagctccgcctcctgggttcacaccattctcctgcctcagcctccygagtagctgggactacaggcgcctgccaccacgcccagctaattttttatatttttagtagagacggggtttcaccgtgttagccaggatggtcttgatc

SEQ ID NO: 27901 - DNA, 201 bp, Homo sapiens
ataggctatgtttcttccaagaggcaaaggttggacctcttaacaaatggtagttgatttctggaacattaatggtcacttagaactgtgggtactcataktaacttagtgccagatggtgtgggaccatcaaggattctactgattaggtgcagagaatgagcatcccagagaaaagcaaaacttagcttagccctcaga

SEQ ID NO: 27902 - DNA, 201 bp, Homo sapiens
agggttaccaggagcagctaatgagactgtgtgtaaaacgagccacctctgtggcctggaataaagtggagcttcattggtgtcagttcttttcttttctyttttcttttgagacagtctgttctgtctcaaaaggtctcattctgttgcccaggctggagcgcaatggcatgatctcagctcactgcagcctcaacctcc

SEQ ID NO: 27903 - DNA, 201 bp, Homo sapiens
tattttcagactagttaggttttaatttcatttgtggccactccacttaccctttcagatgaggagatagagctgctttggaagggtttattgtacccacrtggtcattttggattcttgcacagtctccaggaatgggcattcttgttttaatttcaagtaatcaggagattccgggaccatctgttcactagtatagga

SEQ ID NO: 27904 - DNA, 201 bp, Homo sapiens
taagtcaccagtattttaaagggcacctggaagctttcacaagcctgtgcatctccacgtggtgttgtggttggttatttatattaagcctattttctgtrtgcaggtacacatgccagcgatcagttttagtgaaaatgatgctcattgtcaagactagttttcaatttgtgaagtccacaaaagctgtggttcccaggg

SEQ ID NO: 27905 - DNA, 201 bp, Homo sapiens
ccccagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagaga

SEQ ID NO: 27906 - DNA, 201 bp, Homo sapiens
ttgactcacactttccaccttctcatagtttagggtctctcatgctgccatggagcttttttgttagaggagagagagagagagagagagagagagagagwgtgtgtgtgtgtgtgtgtgtgtgtgtgtgtgtgtgtgtgtgtttgcagtcttggctctcagttcacgtttggcctgcaaatcccaatcacaaatccattt

SEQ ID NO: 27907 - DNA, 201 bp, Homo sapiens
ttaataatgagtatccacgtggagtgcagatggtaacagtcgtattgcaattggtgaaccttaagcagtttcagatgaaatttcaaaaatattttgatttrtttttaccaatagactaataattaagccatttctaaaaggaggaattaatatacaaatgcaaaagcgatttgtagttttgactaaaacatctgcaagtgt

SEQ ID NO: 27908 - DNA, 201 bp, Homo sapiens
ttttcttgagcgttggtaaccacggcaacaaggacgtcacttccacggtgcaaacatgcttgccaagctgaagtgtggagtgacagtttttggctgagccrtgaacctaaaagtggaggtttacaaagttactgcagacaggtcattagcacgactggctgcagtgagctccctaagtcttcatcgctcctgccttttcat

SEQ ID NO: 27909 - DNA, 201 bp, Homo sapiens
catggaagtatattatcaagaaagtaaaagacaacccacagaataggagaaaatatttacaaaatatttttctgataagagtctgatatccagaatatatwaaaaaaactcaacaacagtccaggtgtgctggctcacacctataatcctagcactttaggaggccgatgcaggaggatcacttgagcccaggagttcgag

SEQ ID NO: 27910 - DNA, 201 bp, Homo sapiens
tatttccattgtaaagacaaactaaagctcacagaggtttggaaaattatttaaggccacattgctggtcagtggcagaagtggaacttggctgcagggartctggccctggagcctgcagttttcacttttactccgtgtgctactatattatccccaggctctaaggaaagcctgttaagatgatcctttcatcccctc

SEQ ID NO: 27911 - DNA, 201 bp, Homo sapiens
catggcctgatcactgtgaaattctgggaccttagaagccttttgtattgactgctcgctcgctcgctctctctctctctctctctctctctctctctctstgtgtgtgtgtgtgtgtgtgtgtgtgtgtgtgtgtgtgtatttttcttttacttcttgtttggccaagaaactgtatgtgttaatagcttgtttgttttt

SEQ ID NO: 27912 - DNA, 201 bp, Homo sapiens
acggcttcagctggtccctctgtttggggtccctgacttcccgcaacacagagtctcgctctgtcacccagtctggagtgcagtggtgagatcttggcccrctgcaatctctgcctcctgggttcaagtgattctcatgcctcagcctcccgagcagctgggattacaggtgtgtgccaccatgcctggctaatttttgta

SEQ ID NO: 27913 - DNA, 201 bp, Homo sapiens
taaggttgaaagccttatctgttgttccccattctcatggcctgatcactgtgaaattctgggaccttagaagccttttgtattgactgctcgctcgctckctctctctctctctctctctctctctctctctctgtgtgtgtgtgtgtgtgtgtgtgtgtgtgtgtgtgtgtgtatttttcttttacttcttgtttggcc

SEQ ID NO: 27914 - DNA, 201 bp, Homo sapiens
ttgcttgaacctgggaggcagaggttgcagtgagctgagatcgtgccattgcactccagtctgggcaacagaactagactctttcttaacaacaacaacawcaaaattctcataaatatgtgaatgaatgaatgaatgaataaaatcacagtccacagcaatgcggttgtcatccctgggaaaactcaagtccaagggaat

SEQ ID NO: 27915 - DNA, 201 bp, Homo sapiens
tctattatttgtagagaattataaagctctttcatatttgttctaccatttaatccctctatctttatctcctcccctcccctcacccccctccccccccmaaaaaaaactgtattagccccattttgtagatgaggaagctgagacaaagaaatcataggcaagtatgccaggtcggtatggttaatgtatggtagaact

SEQ ID NO: 27916 - DNA, 201 bp, Homo sapiens
ggccagaatttagttctctggctacattttgcggcaaagaaggctgggaagtgtaatctttattctgcaagactgtgtgcttaccaaattgagagttattrttatagaagaagagagcagatattggaggacaaatcttttcctccacactactcattcttgaaagatcgtgctgacaggataggctctgcagccagcctg

SEQ ID NO: 27917 - DNA, 201 bp, Homo sapiens
aagacacctgatttcagcagattgcagtaactccataatttatttgcatctaagagaaggaatcatgtttagttacagcattttcatttttttttttttttaaccacagatggcataaaattcatctccagagagacttctaactaaacctgagtatgaatttttatctctcagtttcttatgcaatttttcactgcatac

SEQ ID NO: 27918 - DNA, 201 bp, Homo sapiens
ctggccaccagagttcaagtgctcagtaaatgttagacagctgcagtagtggtgctagaagtagaagataataaaactcagtgtgtatatatatatttttyttttgcaaaagtgggatcctgttaaatcacctgtcttaaaaactgccatttccttttatattgagcatttctccatgtcattagtctaccaaaccatcat

SEQ ID NO: 27919 - DNA, 201 bp, Homo sapiens
catgtcccatcctttaaggatgtttcctggaagttgcacctcctgctcctacttatattctactggccagaatttagttctctggctacattttgcggcaragaaggctgggaagtgtaatctttattctgcaagactgtgtgcttaccaaattgagagttattattatagaagaagagagcagatattggaggacaaatc

SEQ ID NO: 27920 - DNA, 201 bp, Homo sapiens
cccaaagtgttaggattatagccatgagctgtaacattaagcatggtatgttctttgacatacacattgtctctctctccaagagagatgaagggtgtgaytgcctagcctagagtagtcacacaggaagtgctcaggatatgttagtttgacctgaatatattgagaaagagcttccctcatgtacatccagcccaaagt

SEQ ID NO: 27921 - DNA, 201 bp, Homo sapiens
ttctgctctagccatcacatctaacagcaggaggaaggaacgagacagagaaaggcatgtcccatcctttaaggatgtttcctggaagttgcacctcctgytcctacttatattctactggccagaatttagttctctggctacattttgcggcaaagaaggctgggaagtgtaatctttattctgcaagactgtgtgctt

SEQ ID NO: 27922 - DNA, 201 bp, Homo sapiens
aacctctattcccaaggtcacctcacagccccattttagctgcttctgctctagccatcacatctaacagcaggaggaaggaacgagacagagaaaggcaygtcccatcctttaaggatgtttcctggaagttgcacctcctgctcctacttatattctactggccagaatttagttctctggctacattttgcggcaaag

SEQ ID NO: 27923 - DNA, 201 bp, Homo sapiens; identical to SEQ ID NO: 5763

SEQ ID NO: 27924 - DNA, 201 bp, Homo sapiens
attttcaaaatttttctattataggattacccaaagtcatgtttattttgtttttttctttttttaagtcaagagtccagcacaaaatggcattcattttrcaggtatcttttcaggtgatattaattataattgcaataactcagtgcattattagaattaggttttgctgacaatgacataaaatctaaaagaacattg

SEQ ID NO: 27925 - DNA, 201 bp, Homo sapiens; identical to SEQ ID NO: 5764

SEQ ID NO: 27926 - DNA, 201 bp, Homo sapiens
attgtaattacttcaatttttaggttgaaaatagtttttaaaggatgattagataagcaaatgtgtcctgaatgggtggatgaagtgagaggctggaggcrgagaggccaacctgagaggcttttgatatgatcgagacatgatactgccttccagggtaaatgaagctttacttttattttcaaaatttttctattatag

SEQ ID NO: 27927 - DNA, 201 bp, Homo sapiens
actttgtgatgtgggaggctccacggcctccctcggtatcttggaagatggggatgatggtgatatccacatcgcggggctcttaggaagatgaagctacrtcatgcagcaggtctcaagaaggccagtctcctctctttccctgccctgtagtcccatctctctcctgcccagagttgagtcacctgggccagtgtaccc

SEQ ID NO: 27928 - DNA, 201 bp, Homo sapiens
cacagctgtgtatgcattttagacatttctccaactttccttggagatctgtggcagtagataggaagaagagtagaaagggtgaagacttgctcagtatrtgacagcacctgccaccatgaaagtacactactgcatgattcagactcgcatgggaaatattttcctatcagtggtgttattcatatattgatgacttta

SEQ ID NO: 27929 - DNA, 201 bp, Homo sapiens
ttatcttgggtgatatgattgttttcacagggctgtttctgaaacttcgttttgcattatcttaatcccaggtgtctatctctggtaggctgatgagacartttggagttgagtagtcttcattgcatgcagcctggtcttattctggggctctcttttcctgtctcacttggaaatttcatttcccagtaatcatacttc

SEQ ID NO: 27930 - DNA, 201 bp, Homo sapiens
gaggggtgtagggtggggggcaaccaggttcttggagcaacttgaggggaaggagaagaggaggaggagaaggtgccaaaagcaactttaacttgtcgtttctgagagttggcatcttttttaaaagtcaagttatatttcacattttgtccttgagctgtcctttggctagggaaccccatcactttgtcatgtgagttt

SEQ ID NO: 27931 - DNA, 201 bp, Homo sapiens
ttttatactaaggtcaagacattttttgcccttttctctcttattctttcataaatttatagtttatgagactggagctgtttgggagaagtagtttcttsaaatgttctctggtggtttcattgggagtttagtatctttttagcttttctgctaggtctgacatctatctggcttaccgtcttttagagacaatgcaaa

SEQ ID NO: 27932 - DNA, 201 bp, Homo sapiens
ctggaggggtgtagggtggggggcaaccaggttcttggagcaacttgaggggaaggagaagaggaggaggagaaggtgccaaaagcaactttaacttgtcgtttctgagagttggcatcttttttaaaagtcaagttatatttcacattttgtccttgagctgtcctttggctagggaaccccatcactttgtcatgtgag

SEQ ID NO: 27933 - DNA, 201 bp, Homo sapiens
cggtcattatcagtacctttacttctgcaaaaaaatgtgactggtattatcttctacttggttgtaacggtttacgttctcctccagttctgttgttctcygtgaggaatgtagttttttacatgccttttccattggagagttacaacaaaaaagcaaaataaatctatcttttctctgatatggcctccttatttgttt

SEQ ID NO: 27934 - DNA, 201 bp, Homo sapiens
cctggaggggtgtagggtggggggcaaccaggttcttggagcaacttgaggggaaggagaagaggaggaggagaaggtgccaaaagcaactttaacttgtcgtttctgagagttggcatcttttttaaaagtcaagttatatttcacattttgtccttgagctgtcctttggctagggaaccccatcactttgtcatgtga

SEQ ID NO: 27935 - DNA, 201 bp, Homo sapiens
tcctctggtgattcagctcctcctagccccagaaccaaaagcctcttttctccagagaaccgtttgtttaatgaagctaatgaaacttgagatgtccccaygtgcccctccccctcagctggtgtctctccagggcttggctgccacctttggccttctttctatggccattaatctagtgctcccagcagatggcagctg

SEQ ID NO: 27936 - DNA, 201 bp, Homo sapiens
gttgggagttcgagaccagcctaagcaacatggagaaactctgtctgtactaaaaaagacaaaattagctgggcatggtggcacatgcctgtaatcccagmtacttgggaggctgaggcaggagaatctcttgaacccgcgaggcagaggttttggtgagccaagattgcgccattgtactccagcctgggcaacaagagc

SEQ ID NO: 27937 - DNA, 201 bp, Homo sapiens
aactggatcttgctagcccagtctgctgtcattaagtcctggtctcagaagacacactgtgcgaggccgcagtagctttccctgatgttaggctagcagcctttcattagaagccatttgtggtgttggatgttcaaacactacccagacctttgccttcattgtctgtttgtccagggagcctcagagagatggtttcca

SEQ ID NO: 27938 - DNA, 201 bp, Homo sapiens
tagtaaatggccaaagccaggattcagacctggagcctctgtctccaggctcagcatacacaggcacctccaggtgtttgtggttttcccttctgccttargtatggattctttggtttttaaccaaacaaaaaccagagtactcttttttttcccgtggtgacttaaatttcttgtaattgtttttatttcagttctctt

SEQ ID NO: 27939 - DNA, 201 bp, Homo sapiens
ggcactgatttgctgtgtgatctcacacaagacaccggctttcggccaggcgcgatggctcacgcctgtaatcccagcactttgggaggccgaggtgggcrgatcacctgaggttgggagttcgagaccagcctaagcaacatggagaaactctgtctgtactaaaaaagacaaaattagctgggcatggtggcacatgcc

SEQ ID NO: 27940 - DNA, 201 bp, Homo sapiens
tcaagtttgggtctggcattagaggcttttcttaatgtattcacctggtgtgttcagttatttctgaagatatagaaatgtttgatgaaatgaatgaagakacagaatgtagattcagtatcaagctctatctcataacagtaacattcctactacatgcaaaccctatacatactattatttaataccttttttcaccct

SEQ ID NO: 27941 - DNA, 201 bp, Homo sapiens
tcatttaaaaatattttttaaaagattttaaactttctgaaaaatggcaagtacagtacacagaaccctcccccctacaaccacttatttgagattaagtmactgatatgattcccctcatccctgaatgtctagacccctgttgtatacaatcactttgcagcttgagagtggattccactcaggtggaatcactgacca

SEQ ID NO: 27942 - DNA, 201 bp, Homo sapiens
gccgggaaaacttgtagagtctgagaatcttaaaaagctggcagactgactggcacagggttgacctgttggggccagggtttctaagaagtccgcgtagyggaaagtgtgtgggtgctagaaggggtggttgaatcctggccctggcactgatttgctgtgtgatctcacacaagacaccggctttcggccaggcgcgat

SEQ ID NO: 27943 - DNA, 201 bp, Homo sapiens
gcgagcatattttccagcaaccctgtagtagagggttaatgttaaattacatgcagttgctgttgatgttagtttaaggttaataaatttaaaagcaaatatttttttttatgagaaatactgttgtaagattaggtagaaaaatagagttaactataatgcaagtgtagtcacttaggaacttggaaccaggctagaagt

SEQ ID NO: 27944 - DNA, 201 bp, Homo sapiens
actatctgtattctcaggacatcctgctaacaatttttttgtttgcttccttcgagctagaggtacagtcaggtcacagaatggctattttacttggaaaytgtatcacagaaatctgcattggccttctctctctgggtgtgtgggtaattctgcaaacctcggattttactttcaaatttatccacagctaaaccagac

SEQ ID NO: 27945 - DNA, 201 bp, Homo sapiens
ggccgggaaaacttgtagagtctgagaatcttaaaaagctggcagactgactggcacagggttgacctgttggggccagggtttctaagaagtccgcgtartggaaagtgtgtgggtgctagaaggggtggttgaatcctggccctggcactgatttgctgtgtgatctcacacaagacaccggctttcggccaggcgcga

SEQ ID NO: 27946 - DNA, 201 bp, Homo sapiens
ggaattatttgtacacatatacgtgtactgtagtatagtgtttaagaacacaagctctggagctacaccacctaaattcaattttcttttcttttcttttytttttttttttttttttgagagagtctctcactcaggctggaatgcagtgtggtgatctcggctcactgcaacctccgcctcccaggtttaaatgattct

SEQ ID NO: 27947 - DNA, 201 bp, Homo sapiens
tcatctaatagtgacccccttaggggtgaaagagacagtcacacatagttatcaaaacctagaaaacctaggtttgctacactaagctgagatgaccactmtgtcagtatgaaacttggagagggactttggtaggtggcatgtattactgggaggcagtttaatctgttgggacataagtttaacattcttgtttctttc

SEQ ID NO: 27948 - DNA, 201 bp, Homo sapiens
cttcagtgaaatatcatctcaagccagctaaaatggcttttataaaaaaaacagtaatggatgctagcaaggatgcagagaaaggggaactctcatacgcwgttggtggtaatataaattagtacaaccactatggagaatggtatagaggctcctcagaaaactaaaaagagaactaccataagatccaggaatcccagt

SEQ ID NO: 27949 - DNA, 201 bp, Homo sapiens
gggtaggatttagtccctgaatgctgtcagggattgatagtctgggactttgcggtataggatactcacttggaagatacaaggtgtttgtttgtttggcrtttgttttttgtgttttattttatttatttattttttgagactggattgctctgttgtccaggctggagtgctgaggtgcagtggtgcaatcatagctca

SEQ ID NO: 27950 - DNA, 201 bp, Homo sapiens
ttcctgagtggaagtgtgccacctgagacaagaaatcttcacttgctggtaaagagcgtggatcagaatctggcagacctggatctgaattccaccagctytgctgcttactagctgcaacttaaccaagttttatacatactctgtacctcagttttacaaatggagatgagattgaagtgctttaattcattagagttg

SEQ ID NO: 27951 - DNA, 201 bp, Homo sapiens
aacccacagaataggagaaaatatttgcaaattacccatctgacaagggactaataaccagaatatataaggatctcaaataactcataggaaaaaaatcyagttttaaactgggcaaaagatctgaatatatatttctcaaaagaagacctacaaatggcccacaggtttattaaaaaatgctcaacatcactaatcatc

SEQ ID NO: 27952 - DNA, 201 bp, Homo sapiens
cccgggaagcggagcttgcagtgagccgagattgcgccactgcagtccgcagtccggcctgggcgacagagcgagactccgtctcaaaaaaaaaaaaaaaacagtgcaagatggcagaagcccaatcccgggggtgaggggtagggcgcggtgggtgtgtgtcgcagaggacaggctcagccttccatcctaaggctatca

SEQ ID NO: 27953 - DNA, 201 bp, Homo sapiens
attagggtatcactttcaataacactttctacttcagcttcctcatctgtgaaatgggtttgagggttcctgccttgcttgtctgtaaggattgttttgartgaactaatggatgaggaagggctttgtaaacatgcctaacactctctaattgtgagggcctttatgaaaagacttaaaagtaagaggtaaaagccatgg

SEQ ID NO: 27954 - DNA, 201 bp, Homo sapiens
gcttcattcagtctgctttgtgttgggcccactgtgatagggagatgagacagtcctcatgctcaaggtcctcgttgtttgtagggagacagcaaaacagrtagtgttttgagaaatagtctgctgtagggacatggttagagaagcttccaatagggcagagaaaattctaaacacgttttctgaggcatattgtttatt

SEQ ID NO: 27955 - DNA, 201 bp, Homo sapiens
cctgggctcaagcaatcgtcctgccttggccccccaaagtgctggtattacaggcatgagccatgtgtgcagtagcccttgcatgtccactgaactaggaygagctaaaacagagagaagagagaaaggaggaacagagaagccactgccctctgtgaaatgttttggcaggtcgtggtggctctctgtctaccctgtcca

SEQ ID NO: 27956 - DNA, 201 bp, Homo sapiens
agtggctaagagatgaatgagacatcctcgaggtaattttcccttctatttggaagatttatgtgttaagtgtagtgataggtagtcagaactcacacatrtgcttcactttccagctaacaacacttttatctgtagtagctcatctgatgctccttgaaactagaaaatgtccactttggagatgagcattctgttatt

SEQ ID NO: 27957 - DNA, 201 bp, Homo sapiens
tggatccatcaaatggaaaatcccagcattgtaacctgtgggatgactttggtgtttcccagatgagaccaccaatagtagtttccatggtcatgtctcakaaatatagggacaaactcagatccctctgggttcctcacagactattgaggcctgatagggtttctgcagtcacgaacaagtatagtatagctgggtttg

SEQ ID NO: 27958 - DNA, 201 bp, Homo sapiens
ataatttatgcctacgtaggagagcagacttttgcgagctagttttatgcagtaccttttctttggcttgggaagttgatagcttggtggtgttttcttgsatggactaaatccttagaattgtttaggagatattggtcgaaggtggtatgttaaatttttgccaaggatctgaactgtgaagtaacttgtcaagtgggg

SEQ ID NO: 27959 - DNA, 201 bp, Homo sapiens
ggtaaaaatggcaagatataaggtattattttgtttttgaataatggtaatatcatttgatgccatcctgtgttctaagtttaaagttgttagattggttkttgctacttaagaaaaactcattcagagagttaggaaggaaaaaccaatagcttgaaaacctgtgtaccattttaagagttacttgatgtttggtaactt

SEQ ID NO: 27960 - DNA, 201 bp, Homo sapiens
cctgcagattggccacatcgaaggacagcctgaaaggaagggggtctttccagtgtcctttgttcatatcctgtctgactagcaaaacgcagaaccttaakattgtccacatccttcatgcaagactgctgccttcatgtaaccctgggcacagtgtgtatatagctgctgttacagagtaagaaactcatggaagggcca

SEQ ID NO: 27961 - DNA, 201 bp, Homo sapiens
cttttctgtagagcaaaggggtcagacttagatcatctttaaaccttttaaaaaattacttctttgcaagtggatacagctctccagttggttaatgataytcaaccttttcatccctacctgcttccaagacagccttagacagtttcggccatactcccagacctgctgtttccttacccatgatgtttaccttctcat

SEQ ID NO: 27962 - DNA, 201 bp, Homo sapiens
caagggaggttcccacccaatgtctgttccacaactggatgccatgttttgagaggagcaacagagaccaggatggaaacagaactggaaaacttatttakttaagtggcttagtgaaccgctgtgtcactcagagatgaggcagcagcagtggttgagggttaaggctggattttgaacagttggagggctctcataccc

SEQ ID NO: 27963 - DNA, 201 bp, Homo sapiens
tcagtttaccaaaccttcccagggtctctgctatatgctagactgagtgggaagggctaggggtatagaggtgacaaaacccaaacacagccctctgagcrttccctatgttaaagggcacaaatagttgctataataatgttctattaaatatgtaattatggcctttgacataatctgtgtctgatagtttgcacccaa

SEQ ID NO: 27964 - DNA, 201 bp, Homo sapiens
acatgagttaagtacagtttaacatgattctgccatttgagcacctactatgtgcctggtttttggtagatgactgagggaagggtaacagaatgaattaracatgctttctgtcccaaaggtgttcacaggtgagtggggtggtggttgtggggtgccaggttagctgcaatatagcatagaccggtcagagctgtgata

SEQ ID NO: 27965 - DNA, 201 bp, Homo sapiens
ctggcatgtgttggtccttcatacatgttaagtgaatgaatgcgtgtatgcatgattcagactttgttttttgcctttcttttctttttccctatagtctkctctttatagatttttaatagcatccaaaagggtagtaggggcaggaagctaaagggtaggaaataaaactcaaattcttcagtttcgagttcagttctc

SEQ ID NO: 27966 - DNA, 201 bp, Homo sapiens
gcctcgccagatgtaaagatggtgccacacacacatgctaactgtgatgtgaaattcacaaagacctcacacatgcatgatgccaactaagaccacacgcrgtgggtgggcaagccttcaggagagctgggcaggcctggttgactctgttccactcttaaaaccaccttcctctctatcgatttggcattggaagccaat

SEQ ID NO: 27967 - DNA, 201 bp, Homo sapiens
atcagtcacatgtaattaacagctacattgtgtgcttactttttgctagatgtttcataaacattatctcatataaacctcacaataactaggtattattrtcccgtatccctgttttacagctgtggaaagtgaagtgaaggatttttgtcatacagccagtaagtgccagaactgacttgaacctagctctctgtcttg

SEQ ID NO: 27968 - DNA, 201 bp, Homo sapiens
aaatactcagttacatgttagctgccattactgttactgttactggtttttgaagatcttgttatgttacagtaatttatagagaaagtggctaagagatraatgagacatcctcgaggtaattttcccttctatttggaagatttatgtgttaagtgtagtgataggtagtcagaactcacacatatgcttcactttcca

SEQ ID NO: 27969 - DNA, 201 bp, Homo sapiens
agacaacccacagaataggagaaaatatttacaaaatatttttctgataagagtctgatatccagaatatattaaaaaaactcaacaacagtccaggtgtrctggctcacacctataatcctagcactttaggaggccgatgcaggaggatcacttgagcccaggagttcgagaccagcctgggcaacacagggagactct

SEQ ID NO: 27970 - DNA, 201 bp, Homo sapiens
gaaaagaagggcttttaactgtttccaactcatttcagctcactcactaattactgctcaatttcagacatgaacattgtcgggaacatgctgctttccaracagacatatcctccagttcacctgctccttttacctcctcacaagtgtcattatgacctgcagagttaacagcatttataaacattgctttattatctg

SEQ ID NO: 27971 - DNA, 201 bp, Homo sapiens
taccaaagatcagctactgtgcccagttctgggacagagataaagcaaggcttttccgctcaggagttaattgtccaggtataggaagtaagtcagatccrttattaatcataatggggctggacagtgacgggtaccatggagcatcaagaggaagagagacggctgggcgcggtggctcacgcctgtaatccccgcact

SEQ ID NO: 27972 - DNA, 201 bp, Homo sapiens
gaatttttatttgtttggagttttgcctcttcatttttagcatttctctctcatctctttctgcctttgagatagctgttcacagtgccacattttctgtrtctgtgaaaaaacgagccccttaacctccagtacacaccatagacatactcacccccttctaaaatatttattcttttagcagccctggctggtttccat

SEQ ID NO: 27973 - DNA, 201 bp, Homo sapiens
ttcaactgaaacatttaaggaggtcagcattaatattatgtcaaaagcacaaagcttgggttagacaaattagatgagtcaacattttggctctgcagctrgttaactgtattcttaatcaggtacttcactaaacctcagtatactcactcgtcaagctgggttacgattctgtagcaaccaccttagggtttttgtaag

SEQ ID NO: 27974 - DNA, 201 bp, Homo sapiens
cttaaagtttaccctaaatatatgaatgaaatggcttcctagctcctttcatccttacatctgctaatttaaccttatgcagagagctgagtttgttccgyttgtgccctaaggttattaacatctgtcccttagtctctccagtaaaaagtttgagaggaaacaaagaaccagctctacttagacctttgaccaattgat

SEQ ID NO: 27975 - DNA, 201 bp, Homo sapiens
tctgaatttgggcattttgaaggtaagttttgtgatcaacacacgtaatcagacactatatgccaagtcaaagggagctattcatattagtaaattcataytcgtattagtaaaaatcaggtatttctggggatggatctttttctgtttccatgttgtacaaaagcagaaatattctcaacgtaaggggttaagggtaac

SEQ ID NO: 27976 - DNA, 201 bp, Homo sapiens
tcaaaaaagttaaattcataatttcctttgatctttcttattcttttcaatagttatatttagaaagatacctgtattcaactgaaacatttaaggaggtyagcattaatattatgtcaaaagcacaaagcttgggttagacaaattagatgagtcaacattttggctctgcagctggttaactgtattcttaatcaggta

SEQ ID NO: 27977 - DNA, 201 bp, Homo sapiens
gaacctcggtttcctcatctgtgaaatatgcccacttttcaaggcaaatttgttgtaaaacagatgtaaagtgtccctctgtgcatagttggtagaaggcrctggaagttgttattgtggaatgcatatagcatggtgaataagccctaggatgtagagcaagacattgctgagcttgattccctgatcttgctacttaat

SEQ ID NO: 27978 - DNA, 201 bp, Homo sapiens
gactagataaaatactctcaaaaaagttaaattcataatttcctttgatctttcttattcttttcaatagttatatttagaaagatacctgtattcaactraaacatttaaggaggtcagcattaatattatgtcaaaagcacaaagcttgggttagacaaattagatgagtcaacattttggctctgcagctggttaact

SEQ ID NO: 27979 - DNA, 201 bp, Homo sapiens
gattttatgtcatacctaatggtacagggttctttacaaatcatgacagggaaaatattaagtaggcaacaaatgtgcttctaatggaaacacagtggccktctgcctgcccctcttgatcctgttagtccctcccctttttccaactcttttacctgcttcctgacttatctacacgttcctcagtattttcttgctctt

SEQ ID NO: 27980 - DNA, 201 bp, Homo sapiens
atgtctaggtatgggttctgcaaattcggaccctccagcctgaccccttttcacaacaatctctgaaccgtgagaagggactgctctttccgcccgtatcwcttgtgtcagagcgagccaagaaaactgcttccacagaggaaacgggctgacaatggaatgtcccgacccagcacatgaagtcctttggaagggcccctg

SEQ ID NO: 27981 - DNA, 201 bp, Homo sapiens
ttccatgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttg

SEQ ID NO: 27982 - DNA, 201 bp, Homo sapiens
ctgttagatgatcacttgagaggtggaagggaaacatttaaattgtccagcactatgcagatgatgtgtatctttctctcatagaaaggtggttacctgtkgggtgttggggagaaaaaagtaagagaaaaactagaggcaggtggcaggtaaaattttaccactttgctctggattgctagacccatttgaatcactgga

SEQ ID NO: 27983 - DNA, 201 bp, Homo sapiens
aaaatcagtttaaaaggtgacttattttaacattataccatataatgagattcttatacattgggtggccatgtctaaatcaagagaatatgagagtgaaraggtgtgctccttataattacttgggggcaactgatatatatgaagcctcccttggcagagcatattattgacttacttatacttttctttcccttttta

SEQ ID NO: 27984 - DNA, 201 bp, Homo sapiens
tgggatgccctggggccacaggaggggcatggaagctaacccagccccacaggctcatctgctgaaataacacagatgtgcttctcaaccaacccctttgwtgggggaaaagttcccacatcagtgggtaagctgaccacaggagggctacatcaagaaatataaagcagttccccccatcctttgcttaactggcactaa

SEQ ID NO: 27985 - DNA, 201 bp, Homo sapiens
accatacctggctaatttttgtatttttagcagagacggtgtctccccatgttggccaggctggtctcgaactcctgacctccagtgatcctcctgcctcrgcctcccaaagtgctgggattacaggcgtaagccaccatgcccagcctacactgcctaaattcaaatcttagctcctcactcacatgctttatggttctg

SEQ ID NO: 27986 - DNA, 201 bp, Homo sapiens
aagttttttttttttttaaacggttatgttattttattttgttgaaggcagaggatatgttttattttagggacccaccagaattgcttagaaattatctkcaggctttagggatttttgcttatcagtatatttcatttgccccattgttcagcccatccaccacctccttccatttgttctcagaaactaaactaggag

SEQ ID NO: 27987 - DNA, 201 bp, Homo sapiens
agcctaggggtggactgcagcaaattgtgtgtgagggaagccagcagtctgcagggctgagctgaagtggggagaggagaagagcatgggacgtggtgtcragtgcagtggcattgactgcagacaggctgctgctttacactgggggattcattccctttcccccagtaaagactgttaaaatatcagaactgatagtat

SEQ ID NO: 27988 - DNA, 201 bp, Homo sapiens
taccccttaggagtttgtttgtttgttttgagacagagttatcagggaacctgcccctgatagtcacgtaggttcttttctgttttccctaagcgttggcygggttgagaaataaagagacagagtacaaaagagagaaattttaaagctgggtgtcctggggagacatcacatgtaggtaggttccgtgatgccccacaa

SEQ ID NO: 27989 - DNA, 201 bp, Homo sapiens
tcaaagctcacaatggaggtaactggtttccaggttaagtgcactaaactgtgtggaaggtgttatgatagtacctctacaggttctgatggaagcatcartgatggatttggcttttccatttgggagaggaggctataaaaaaccttcctggaggacgtgggctcattctgattcacagacaggtccagccccttcact

SEQ ID NO: 27990 - DNA, 201 bp, Homo sapiens
ttatatagaacatgtaaataattgtatgaagtagttagtgtacaaaataatgtcatatatgcagctgcattttctgcctttttcacctagaaagttttttygtcatgtcattaaaaacttttgccctctgttttcatgactacataatattctgttgtgtgggtgtacctgtcttactgcttcacctactttattcatatt

SEQ ID NO: 27991 - DNA, 201 bp, Homo sapiens
ggaaggaactggggtttcttggagtataatttgtacaactctaacctagcacaaccacatcactttattcatcttaaatcctgtgaaatgcaaaataagayttggttttgtaatacctataaacatgccagaaccaattacagaccaacaggcacctctggaaatgcaggttgaagcagaaacacaattagtgcattagtc

SEQ ID NO: 27992 - DNA, 201 bp, Homo sapiens
ataacccgtactctcatgttcatcggagcactattcacagtagccaagatacggaatcaacctaagtgtccatcaacagttgagtagataaagaaaatacrgtatatatacacaatggaatattattcagccataaaaaacaaagtcatgccacttgccacaaaatggatccaacattatgttaggtgaaataagccaagt

SEQ ID NO: 27993 - DNA, 201 bp, Homo sapiens
atttgataggcatgataaatttggttttgcattaaaatatagtgacttttctgattatgaaagtaatttcccttttttattttattttttaaagaacattrtaagtaatttctcattataaaaatgtggaaaatacagaaaagtacaaagaagattgtgtgctaattttgtgaatactaatagcattaactagacaggaat

SEQ ID NO: 27994 - DNA, 201 bp, Homo sapiens
tctgcgaatcatctgacccagttgatcactcccttcctctaaaaacacggttttcttttggcttctatgacaccaagccggcttggatttcttcttgtgaytctaccctctcagtctctcagttgggcaccccttgctccaacttacctctaaatatttttgaagatgtctgcatgcaaattatacagacatgcaaattat

SEQ ID NO: 27995 - DNA, 201 bp, Homo sapiens
gcgtgcgccatcatgcccagctcatctttttttttttttttttttttttcctaaagagatggtggagtcttgctatacttcccaggctgttcttgaactcmtgggctcaagcagttcccacaccttggccccccccaattgcttggattacaggcatgagccaccattcctcgtcctgaaatgattttaaatgtgttgttt

SEQ ID NO: 27996 - DNA, 201 bp, Homo sapiens
gacttgatgatctgaaatgcctaattaatatccccatttggaagtctagcaggcctctcaaacttaatatgtccaacatggattattctcctcactcctcytgcagctcatgctgcacccctgcttacagccaccgctgatctccaagacccctgcccattttacttagaatgaaattcagatttcttaccgtggcctaca

SEQ ID NO: 27997 - DNA, 201 bp, Homo sapiens
agacagggtcacactctatcactcaggcagtggcaggatcatagctcactgtaatcttgcagtccttgcctcagcctcctgagtagctgaaactacaggcrtgcgccatcatgcccagctcatctttttttttttttttttttttttcctaaagagatggtggagtcttgctatacttcccaggctgttcttgaactcatg

SEQ ID NO: 27998 - DNA, 201 bp, Homo sapiens
tccatgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgt

SEQ ID NO: 27999 - DNA, 201 bp, Homo sapiens
cagtgactaggataacgggctatttgtatactgctggcagtgttgaagcaattgtaaggaataaacggctatttttgtccagtttaatattaattacagtyacttgcttccttaagccccttttgcataatgaaagatagacctcggcctccctctgtttgatttactccaaatttctggttaggcttgatgtatgtacta

SEQ ID NO: 28000 - DNA, 201 bp, Homo sapiens
ccatgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgta

SEQ ID NO: 28001 - DNA, 201 bp, Homo sapiens
ggcgagttacttaacctctctaagcctgtttcctcgttaacctagtgagactaagacccatcttacagaggtgttgtgagcaatatctttagataatataygttagatacagtaccctctgtcatttaaataaaattcatgctgttctgcctagattagaacacagtataatgggctgcattatcttacagtttatggaga

SEQ ID NO: 28002 - DNA, 201 bp, Homo sapiens
catgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtat

SEQ ID NO: 28003 - DNA, 201 bp, Homo sapiens
acctacccatttttctttctagcatttccagtaaaatgtactttatgagtaaattcagtcttgtcagtcccgagtgcctttagcacatggtgtaatttgtyttgcatttttccttgggcctttcccagatcttccagagcagtacctctgttcttcattgtaattatgccttagaccataggcaagtgatttctgctctct

SEQ ID NO: 28004 - DNA, 201 bp, Homo sapiens
tggttatacacagtttcattctgtgaatttatcataatttgcttaaccatctcccatcattggacattgttatttgtccttccctcccttctttccttctwtaagtaatgctgctgtgaacatcttgcattgaccagattactggggcagattacctgtgcttccacagtggttttaccatagtacagatgccatcttctt

SEQ ID NO: 28005 - DNA, 201 bp, Homo sapiens
acagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtatttctgtgtgcagttgt

SEQ ID NO: 28006 - DNA, 201 bp, Homo sapiens
agccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtatttctgtgtgcagttgtac

SEQ ID NO: 28007 - DNA, 201 bp, Homo sapiens
gccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtatttctgtgtgcagttgtaca

SEQ ID NO: 28008 - DNA, 201 bp, Homo sapiens
ccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtatttctgtgtgcagttgtacat

SEQ ID NO: 28009 - DNA, 201 bp, Homo sapiens
caagcaagcttgaagtaatttgcccaaggtcacacagctagtaagggatggagctgagattcgggtccaacaagctggtaacagagcctgcctgcttagtrgctatactgtatgttcctcattggagcccgatacccattctaccaagtaggtattattattgccagtgagggaagactcataattttgtgttaagaggaa

SEQ ID NO: 28010 - DNA, 201 bp, Homo sapiens
tttgacttttccaaagtagctgaaccattttgcactcccaccagcaatgtatgagggttccagtttctctacatcctcgccaagacttgttattgctattktgtgtgtgtgtgtgtgtgtgtgtgtgtgtgtgtgtatttcattatggccagcctagtgggtgtgaggttttatcttactgtggttttgatttgcatttcc

SEQ ID NO: 28011 - DNA, 201 bp, Homo sapiens
gaacggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcc

SEQ ID NO: 28012 - DNA, 201 bp, Homo sapiens
ttatctgtaaaagcggttattattagtatttaccccatcatatagttgtaaagattcaatgaactaatacatgtaaatgttaagaaacagtgtctgtcccrtaggacctggcactctaaataaatactgcctgttatcactgtattgcttataaatctaggttagaaacatcataattttctctattataataattaggtc

SEQ ID NO: 28013 - DNA, 201 bp, Homo sapiens
tgagtggaatcttcgacaggaggagatagatgagagcgatgatgatctggatgacaaagtgagtgtaaattatgtcctcgaattctcaacaactaccccarcttttctagtctgtgtagacaagatccatttttggtgagattgattgattgtggttttatgatccaatgtatcagggccatttatgttgttcagtcctta

SEQ ID NO: 28014 - DNA, 201 bp, Homo sapiens
agagcaattcagtaagatgatgggaggaaataatttcatttctgggtactaattccagtagcagctgttttctgctaactgagaaatatgcctgtgctaayaactttacacttccagcaaaaacactggaaccatggtgcacactaagctgtctaaagacaaatgtgcggtgtttattttcttttaggaaacacagaaaca

SEQ ID NO: 28015 - DNA, 201 bp, Homo sapiens
catcgctcctgccttttcatcagcagcgagataattgactgttagactcccgagccacagaccacggcagaggtgagtccgcttctaactgtttctgcagrgtgaggtacagttgtcagaagttcccaaacaatgtgagtttggtaagaggagactggaaatggagttttcaccagtaaagcgacgcgtggcgattgtgta

SEQ ID NO: 28016 - DNA, 201 bp, Homo sapiens
gaagttcccaaacaatgtgagtttggtaagaggagactggaaatggagttttcaccagtaaagcgacgcgtggcgattgtgtatctacagggtggagagcrcagcgcttagccctgtgtcgacagccctgtgggctgaggccacagtctgaatttgctgtgcccagctgtgttttttcatcaggacagggtgtgggagcgg

SEQ ID NO: 28017 - DNA, 201 bp, Homo sapiens
caagcagacagggcagggctttccaagcaaagggagcagagatggctttgacctcctgtcagttaaatgaagacaataatgtctactatgagacattactrtgtcaccctagtacgtggtaagccctgtgtgcttgcatatgtttgttgaattttttaaattgtgttaagaaggtgtgtcctgagtaaaagatattgcaaa

SEQ ID NO: 28018 - DNA, 201 bp, Homo sapiens
tgagttagtgagggcagagccaccctgatgagcactggcctcttgtgtcactgtggcagtagggcccggggagtgtctcagcaggaatggcacaggcagcrtccagcatctctggtgaagtagagtgtttccaggtgcaatgtcttctttctgacaccacttctgactccaaatgtttggggttttctctataccaagcaa

SEQ ID NO: 28019 - DNA, 201 bp, Homo sapiens
ggcaacccccacaattctgtgggctcagtcccatagaacagctcccacttcagatgccagtcacaattcccagaggctgcgtgtgtctgaccaaccagctrtaaattgagaggtttccacaatttccttctcaagtgtgatgattggctagaactcacagaactcaggaaaatacatctacagccataccaccctgaacac

SEQ ID NO: 28020 - DNA, 201 bp, Homo sapiens
attgcttcagagctgttgaagcaaagcaaagatttctccatctgcatagcatttcctgtttgcaatctctgactgtagggtattgtggtttgtgttaaagwtgtttttttttttatttttcttcttttctttcccctcaaataagaatatctgataatgtacaggttggatctagatttgtagccagcagattatttctca

SEQ ID NO: 28021 - DNA, 201 bp, Homo sapiens
cacctcaactgagatcagagggatagaggtgggagagaacctgccacttttgaggaagtaaaagatgtatgttatagctaaaggataatggggaacaagamcggtaatgagcctggaaagatggggggcttatcttggaaaggcatggaaagcctttagggtttgaagcaaaggattggcatgctctgatttgctttttag

SEQ ID NO: 28022 - DNA, 201 bp, Homo sapiens
aaataatattcatgaaaataatatgatattgaaaataagttctctgctgtctatgtaaatatagcaattttataaatttgtttgtataatgcctctcaacmtctaaggccagagcaaaaaacctaattttttaaaaacaaaaaaccagaaaatattagggaacagaagctggatgctgtctcagaaggtttgctagcaatt

SEQ ID NO: 28023 - DNA, 201 bp, Homo sapiens
cactggattattatagtattaataggctacattaatattagtattactatggtattaatagccactataggggactttgtattataaaaagaacacatgcytacaggggaattgcaatttctctttcatattccccctaatcaaagataactataattgacacttggagtttatctttctagtccttttgtctgtacctct

SEQ ID NO: 28024 - DNA, 201 bp, Homo sapiens
tccagcctagaggaaggaaggccttcttggagtgaagcctaagtgccgtgtgttgtcagtgctccatggggtaactgagtctcagagagcttaattagctyaactagcatgggccatatttgttccaagtcacagaattttccagatgcagagtgacttggttagtatgtggggaaggatggtaggattttctcctgggta

SEQ ID NO: 28025 - DNA, 201 bp, Homo sapiens
aacggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcct

SEQ ID NO: 28026 - DNA, 201 bp, Homo sapiens
ccagaactcattctcaagatgtccttaacctaggtcagttattcatgtatcacataggcttctgtggccttaggtgataatttgtcataatccattagatrcaaaaggttagtttacagatgaagataacctatttgaaaaatgaaaactacctttctacactccattaacctatttggccagttacaatattctttttct

SEQ ID NO: 28027 - DNA, 201 bp, Homo sapiens
ccgtgcctcatcttatgatgtgtccattcatgtcagcccagctatctacttgttcatctcattgattctgcccattgttgaggacttagtctaagtgtcawagcacccaaagtcttctctgataccttgccacccatcacctctctgttagtcaggatgagttagtttttctcctctgttgttttataggaaattgtgtac

SEQ ID NO: 28028 - DNA, 201 bp, Homo sapiens
acggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcctg

SEQ ID NO: 28029 - DNA, 201 bp, Homo sapiens
ggaggcagacccagggatgggggtggtggaggaaactgtttgccaggcagtcgtgtgtgggcatccccatgttgtgctgcaaccccctccccagccctcayaccatgtgcacacttagaaaggttctgggtaacaccacctggacggatcatttggattttgttggttttgggggatgaaattatttctctaagagccacc

SEQ ID NO: 28030 - DNA, 201 bp, Homo sapiens
cggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcctga

SEQ ID NO: 28031 - DNA, 201 bp, Homo sapiens
cacaggcaggatgtaaggaatggccaaagaggtcctcaagccttaacaactttaagaggaaataaattataatacaatgtgataatcattataagagtatrgaaaaattcctgagagctattcagaggaccaagcagctgcctcagtctgccttctcaaggacattggagatgggtttctaaggataggtggaagcttgcc

SEQ ID NO: 28032 - DNA, 201 bp, Homo sapiens
cagactgatataaaaaatactgttttaatcttctaaaaggtataaaatccccccattccttctgcatatgaattcctagactcttggttttgaaatgttcrgttttctgcatcacagaagttaagctgtgtatatgcgtttctcccaacatactgaaggtgagcgccacctagagtcaaaggtgtgacttgcatagttcac

SEQ ID NO: 28033 - DNA, 201 bp, Homo sapiens
agagggaagagccccttataaaaccatcagatctcaactcactcactatcatgagaacagcatgggggaaaccgccaccttgatccaatcacctcctacaygggtctctccccagacacgtggggattatggggataacaattcaagatgagatttgggtgaggacacaaatccaaaccatatcaatcatataataggttt

SEQ ID NO: 28034 - DNA, 201 bp, Homo sapiens
ccatgtttttgtaaatcttagattatataaacctcatttattcagaagagcaccctcggttttccttcactctgagcattgcctgcactttcactggaggycttgctcaaagtgtggtgtggtagaaagagaggaagcaaaacaagactgacagttcactttggtaatagctggtaaaggacttgcttgggcaggaagatc

SEQ ID NO: 28035 - DNA, 201 bp, Homo sapiens
ttagatctccaagattggagccccaaattaatccatactctttcttttactatgtctccttggtagagattgtggtgtgttgtgcagatgttgatgctttyagttaaatctctgtgatgagcactcttggaagtagatgagaaatatatggtaagaaggctgggcgtggtgggtcatacctgtaatcccagcactttggga

SEQ ID NO: 28036 - DNA, 201 bp, Homo sapiens
gaataggaattaatttgggtaacttggaattctcatttaaaaaaaacattttcctagttctagtaagtaccttcctgttgatgacctttttttgctctttrgatcactaatgcacatacatagagcgcaactgaaaaactgttagatctccaagattggagccccaaattaatccatactctttcttttactatgtctcct

SEQ ID NO: 28037 - DNA, 201 bp, Homo sapiens
aacacccatgaggcttcacggggttccctgatggctgtgagtctcttctgtaatctcagcttctgggggataggcatggtgttccattctgcatgctgctygtcacataataggccctccagaaatactactgaatgaataaatgcatctaatagtctgataattttatctgtatgattggcgaaaatattaatcttctgg

SEQ ID NO: 28038 - DNA, 201 bp, Homo sapiens
acaaggatacttgtggtgtggttaccaaattcacacgaggcaagcatagtgtagcactggtcttttctcactgtgcactgtttgaagttggcctcagtgckagaaatctgtattacctgagcaaatgtttaggaattctctttgcttttgaatacgttgaaagaaaggaattctttctccaatttgttcagctctcctcct

SEQ ID NO: 28039 - DNA, 201 bp, Homo sapiens
taattttatctgtatgattggcgaaaatattaatcttctggtgttgtgacttgtatatgaacctttctgtttcatgatggcaatatgccctgccatacttkaaaaaaattgttacagccatgccgtttgttttttgttttgttttgttttgtttttgagacggagtttcactctggttggccaggctggagtgcaatggca

SEQ ID NO: 28040 - DNA, 201 bp, Homo sapiens
attgtctccggtcggcatattttaattcttgaggttgcactctcttgagtggttactttttgcatagatgtgaaaagtatgctttaggtttttttactgawggatagccaccatagttgaattttaatttttcccccatgcttacatatgtggaagtagtgcattattataaatatcttaggtgggtcacaattcagttct

SEQ ID NO: 28041 - DNA, 201 bp, Homo sapiens
gtgagactctggagtgtgggatggtacttagcattttataaacacccactgtataccagatactagatgaggcacttcatagtctttctcatctatttccyttaataaccccatcaagtaggtattactatggctaagaagacaagagtctgagatgatgtataaattgccctagatcacagtttataaacagaaaacctg

SEQ ID NO: 28042 - DNA, 201 bp, Homo sapiens
ggaaattataattttatctttatatttctctgtaatagcatatgaattacttatataattttaaaaacaaatagaattaaatattttataagtgtgattartgctacaaagtatgcataggataatataaaaagaatttgtcacttccccttttatggcagtgctatgatttatgtcacatattacatggctttattatta

SEQ ID NO: 28043 - DNA, 201 bp, Homo sapiens
tgttccacacccaacataaattattgcccagggtgagttaatttgtgtttatttctgaagtggcagtggttgcttcctgagggtctaaccttgtttgactsttttgtaggctaaatttctgcaggccttctgcagagccctgtcttcttcctctcagagacaacccaggtgtttttcattccctagaaagttcccctttgc

SEQ ID NO: 28044 - DNA, 201 bp, Homo sapiens
aattaggttcggtgtcttaccatggtgtcatgtaatgcttattttaatcctgcggttttcagtggggagaaaagttttcttaacaagcatatgtaagagayataatagattagaataaaatgtcacaaggtgtacaaaagcagcttgtctctaggaaattttacctttttttgctgtttttcaagtttgtggatagccaga

SEQ ID NO: 28045 - DNA, 201 bp, Homo sapiens
cataaatttaaaaaataatatctaatgtgcaggggattgtatggacaaaaggagagaccatctaaggcccctaatacactgcctgccacatagtaggtgcytaacaaatggtagatgggggaaaaggacagctagatgaattcttgagtgccttctctattttaattcagtgattccacatacaacatttgaccagcctga

SEQ ID NO: 28046 - DNA, 201 bp, Homo sapiens
tccttgctaatccacttcttattagcaaggtgaccttgagctggttatttctccttcttgagcctccatttttcttctgtaacgtgaggatagtggtattwaaaaaagttgttgaagggatttaatgatctcatatctgtaaagggtctgccaggttatgggagttcagtaaatgcatgttcctcttaattttatcatcat

SEQ ID NO: 28047 - DNA, 201 bp, Homo sapiens
acttctctaggaaatcagtggtctgtaacttaacagaaaacctggaagggaaggcagcagactataatagaaagagcgcaggccgtgaagttggacagatrtgggctttcgtccttgctaatccacttcttattagcaaggtgaccttgagctggttatttctccttcttgagcctccatttttcttctgtaacgtgagga

SEQ ID NO: 28048 - DNA, 201 bp, Homo sapiens
cagctcactacaacctcccaattcctgggcacaagcgattctaccacctcagcctcctgagtagctgggactataggcacatgccaccatgcctggatacttttttttttttttttttaaatataagcagggtccctctttgttgcccaggctggtcttgaactcctggcctcaagaaattctcccaccttggtcccccaa

SEQ ID NO: 28049 - DNA, 201 bp, Homo sapiens
ctcatggcctgatcactgtgaaattctgggaccttagaagccttttgtattgactgctcgctcgctcgctctctctctctctctctctctctctctctctstgtgtgtgtgtgtgtgtgtgtgtgtgtgtgtgtgtgtgtgtatttttcttttacttcttgtttggccaagaaactgtatgtgttaatagcttgtttgttt

SEQ ID NO: 28050 - DNA, 201 bp, Homo sapiens
accagctcacctaccaataggttacttctctaggaaatcagtggtctgtaacttaacagaaaacctggaagggaaggcagcagactataatagaaagagcrcaggccgtgaagttggacagatgtgggctttcgtccttgctaatccacttcttattagcaaggtgaccttgagctggttatttctccttcttgagcctcc

SEQ ID NO: 28051 - DNA, 201 bp, Homo sapiens
tctttcctgtctgcacccttactcccattccttcctggcttgttccaagaggagtgtcagatagaatgccatgggcgtcttctcctccaggattgcagggrttaaagatggagatgacctaggacagcacctggcccacaggggacactcttagttagctcccttcttctctgcttaattactttccaaccttctttttgt

SEQ ID NO: 28052 - DNA, 201 bp, Homo sapiens
tctggctgcagtgtggagaatggactggaggaaggaaactggagaaggggccattctggaggctagagctgcagtgggagctggtgagcacctgtactagraggggcttcaagggatatttccaaggggaatgcaggaaccagggactccaggtgacactgaggtttctaacctgggcagttgagtggatcctaatgccat

SEQ ID NO: 28053 - DNA, 201 bp, Homo sapiens
tggaggaaggaaactggagaaggggccattctggaggctagagctgcagtgggagctggtgagcacctgtactaggaggggcttcaagggatatttccaargggaatgcaggaaccagggactccaggtgacactgaggtttctaacctgggcagttgagtggatcctaatgccatcaccacaagcgcaaataccagagat

SEQ ID NO: 28054 - DNA, 201 bp, Homo sapiens
aaaaccatcagatctcaactcactcactatcatgagaacagcatgggggaaaccgccaccttgatccaatcacctcctacatgggtctctccccagacacstggggattatggggataacaattcaagatgagatttgggtgaggacacaaatccaaaccatatcaatcatataataggtttttttgttgttgatttcaca

SEQ ID NO: 28055 - DNA, 201 bp, Homo sapiens
gattcccacctgagcccgccctgcggaggccctctgtacacatgaagggtggtccttgattattatctcaccttcttatttcatctgccagccaagccctrtcaagaaagagcgctcacccagacctcagagcttctgccactcctccagcatctccccccaggacaagctggcactgccaggattcagcactccaaggga

SEQ ID NO: 28056 - DNA, 201 bp, Homo sapiens
gtggtacaaatctcgctcactgcagcctctgcctcccaggttcaagtgattctcgtgcctcagcctcccaagtagctgggactacaggcatgtaccaccaygcctggctaatttttatgtttttagtagagaccggggtttcaccatgttggccaggctggtctcgaactcctcaagtgacctcaagtgatctgcccgcct

SEQ ID NO: 28057 - DNA, 201 bp, Homo sapiens
gatgaaatactctatggtagagccacacaacagaacactatgcagatggaaaaaaaaagcacaaattacactgaaaaggcttttcaaaagttaatttgatygtaaaactaccatgaacaaataagacctaagttttactttaccagcttgataacagcaagtgctcaagcacatacacagtgcactcttgtccacaccagc

SEQ ID NO: 28058 - DNA, 201 bp, Homo sapiens
catattggaaaacacagatgtagagcattctcattgaaactcacctttaaaaaaaaaaattgggaagagatttaattagtgttctcttatttttaaaaaawgtttatttcagtagtttctggagtacaggtggtttttggttacatggataagttatttagtggtgatttctgggatcttggtgtacctgtcacccgagca

SEQ ID NO: 28059 - DNA, 201 bp, Homo sapiens
gaatccaggaggcagaggttgcagtgagccgagatcacgccattgcactccagcctggacaacaagagcaaaactctgtctcaaaagaaaaaaaaaaaaaacaggaagagagacatctgaccaggaggactgaggagaaggtattagcaccttgaaggaggtggtgggacttgtcattgaacttggaggatagctaggatt

SEQ ID NO: 28060 - DNA, 201 bp, Homo sapiens
caggtcgtaagccctcataaatgattataaaatgatttcattattgatacgtgatgtgactgacttttgaaaggcaagatgaggcttgggaaccactgtarcctccaagagtcccggggcgattagatagtgaatatttttacgtgtgctacccaaacaaaaaatatgtgttgcaatatttaccttagttaagatggtgct

SEQ ID NO: 28061 - DNA, 201 bp, Homo sapiens
tttgagtggggacacagagccaaaccatatcaagggttttgaaggggatctgttttcctttctctgtacacattgctgaattctgccattggtacaaaagrcagagtggtttaatgaaaaggttgttgatatgataggaggcccatacttcactcatctcccttcactcatctagtctctctcggagtctgcttttcccat

SEQ ID NO: 28062 - DNA, 201 bp, Homo sapiens
gagaaaatggtgagaggcagaagtattgttcagaaaagagaaaattttagctactagaattagcatctccagagtcataaaggccagaaaggagcctggcrtgttaggacatcatgaacttggagaaccaggaatataaagtggacagtcacagtgacaagggtgggttggctgcaaaggcgagtctgtgaaagtagattg

SEQ ID NO: 28063 - DNA, 201 bp, Homo sapiens
ttagatggtaggttccagtttctgtacactgggcacatctagatcttctcctacaccctggggtgcagggccagcaagatggctctacaactgggaggaartaatatataaataaacacatacatatgtgtgtctggtatcttaaaagattaataactgttctttgtcaagataaaaatgtgaggaaaatgtcattataac

SEQ ID NO: 28064 - DNA, 201 bp, Homo sapiens
gtagaataaaacatgttttttagttggagaagcagtcagacatggcagaaagcacagactttggagttaagctttccagggttaaaatcctgatttttccrtttactagttttttggccctggatccctactttctgacttaatttcttcatctccaaaaaggcattattaatgcatgtcttcttagattgatgaagtctt

SEQ ID NO: 28065 - DNA, 201 bp, Homo sapiens
ccattcaccaaatttcttttttctatttcttacagctttagaaggataaaaaatgcattttattattgttccatgtggaattttaaacttatcagtgcaaytgaaattacttgcatatgtttgctattttcggtttcttgtgttaatgttttttgtccctctgttcttctgggtctttatagcagcaacataagaattcta

SEQ ID NO: 28066 - DNA, 201 bp, Homo sapiens
ctatcttgggtcacgtggtcagccctgtaccagtcactgtggacaaggccatggactattctgattggacaagcccatgtcacctgatcattcccagactycagggagaggttgaaagtgagacccacaggaaccaaaggatgtggggggactccccagtgggaatttgaaatgcattcaccggcaggagtactgggtgct

SEQ ID NO: 28067 - DNA, 201 bp, Homo sapiens
ggcactttatatggatttcttcacttaatccttataactctatgagattaattactataaatttccctgttttatagagggaggaaactgaggcacagccsggttaagtttctggcccaggtcatgtaagtagtggagctaggatttgaccacaggcggtttggctctagattttgtgttccaaaccatgttatttaaatt

SEQ ID NO: 28068 - DNA, 201 bp, Homo sapiens
catgcacatgcaggaaaaaaaatatgcaaaggttatttgcagtttaatattaagtgaaaaaagcagaatacaggttgcacataaaacatttattaggtacrtagagaaaatgtacatgaacaagttaggaagccaacaaaaaagaaaatagcgttttagagtggtagagttctggctaaagtttaagctttttgtctttag

SEQ ID NO: 28069 - DNA, 201 bp, Homo sapiens
agtgaaagcatgtcccagaaataggtggccaggataaggaggggacatttataaaactaaaccagatgtccacaggtgtgatagttgacttgctgaaaatytaataaatgcagcagttgtgcccagacacagctgtgtatgcattttagacatttctccaactttccttggagatctgtggcagtagataggaagaagagt

SEQ ID NO: 28070 - DNA, 201 bp, Homo sapiens
acttaatggcttgaaacaacacacatttattatcttaaaattctggaagtatcgtcattgtgccttggacatggcagatgggtcagcaaacattcgtccartgaaaggtctttctaagactgtgcctttgaacctactgttctgtccattcagaattccctcttcctacctttctgtctggtgtactcctgttcatcctca

SEQ ID NO: 28071 - DNA, 201 bp, Homo sapiens
gcacagacttaatggcttgaaacaacacacatttattatcttaaaattctggaagtatcgtcattgtgccttggacatggcagatgggtcagcaaacattygtccaatgaaaggtctttctaagactgtgcctttgaacctactgttctgtccattcagaattccctcttcctacctttctgtctggtgtactcctgttca

SEQ ID NO: 28072 - DNA, 201 bp, Homo sapiens
atcacaccactgcactccagcctgggtgacagagcaagaccctgtctcaatcaatcaatcaaatagtaaagaaaaactagcaccaattcttaaactgttcyaaaaaaattgaagacaaaggaatttttcctaactcttccaatgaggccagcattgccctaataccaaaaccagacaaggacacaacaaaaaaagaaaact

SEQ ID NO: 28073 - DNA, 201 bp, Homo sapiens
ctcaatgagatacactgaccagcccaaggtcacaccactggtaagaggtaaagttgagattcaatctgaggtccacgtggctccagaacctgtactttttrtaatgtggagtggagtttcagttctctggaaagttacttttctctacattaaaatgccactcttttgaagacgctagtaataatagtggtagttaatagt

SEQ ID NO: 28074 - DNA, 201 bp, Homo sapiens
ttatggagcacttgccttatgagaggctctacgcctagtacttcttttgtaatcatctcaaaatgaggtaggtgctattatgcagttactggcatcatgtraattaggggatttgttcagagatactgagtaattggcctgtagttctcagcctgggattctaacccaggttctgtgtgaccaaagcccattctcttgtac

SEQ ID NO: 28075 - DNA, 201 bp, Homo sapiens
gaaaatagcactgtcataccactgagcaattctactactgggtatttatccagtgcaaaggaaatcagtatattaaagggatacctgcaccccatgtttaytgcagtgctatttacagtagccaagatatggaatcagtctaaatgtccatcagcaggtgaatggatgaagaaaatgtgtatatatacatatggaatatta

SEQ ID NO: 28076 - DNA, 201 bp, Homo sapiens
atttgtgtgtggtagtttctcgtttgtgatcagtagcttccccctgcccccaccccacttctactgtacgtttattaacactggttcttggaccgggtgcrgtggcttacgcctataatcccaacactttgggagaccgaggtggccggatcacctgacgtcgggagttcgagaccaccctgaccaacatggagaaacccc

SEQ ID NO: 28077 - DNA, 201 bp, Homo sapiens
atttcactctcattgcctaggctggagtgcagtgatgcgatctttgctcactgcaacctccacctcccgggttcaagtgattctcctgtcgcagcctcccraatagctgggattacaggcatgcgccactatgcccgactagttttttgtatttttagtagagaaggagttttctccatgttgatcaggctggtctcaaac

SEQ ID NO: 28078 - DNA, 201 bp, Homo sapiens
tatgcccgactagttttttgtatttttagtagagaaggagttttctccatgttgatcaggctggtctcaaactcccgacctcaggtgattcacccacctcrgcctcccagtgtgctgggattacaggcatgagccactgcacccagcctcttaaactgatcatatgatattggttctcaaccaagggtgactttgccctca

SEQ ID NO: 28079 - DNA, 201 bp, Homo sapiens
tcggcctcccagtgtgctgggattacaggcatgagccactgcacccagcctcttaaactgatcatatgatattggttctcaaccaagggtgactttgcccycagaggatacttggcaatgtctggagatactcagttgtcatgacttggacaggtgctactgtcacccagtgggtagaggtcagggatggtgctaaacata

SEQ ID NO: 28080 - DNA, 201 bp, Homo sapiens
tattatagttactgctctgggcccacacaggctccaaagacataccctctaaatatgtgactttactgtattatcagcgtggacatttggaaaacagttayattagtttttataaaattatgggttataagaaggtacattgatatagtgtgggaaattttaaaaaagggaagaaatgatgcttctttaccacctttagca

SEQ ID NO: 28081 - DNA, 201 bp, Homo sapiens
attttttaaaaaacagaaatgtaatgaattttagtatattaatgctttttgaattttcgaaaggagatacagcttggagtatttcccaaatttaccgactrtagatccctttttttcgcaacagcattaattgggctagttgggcacagattttgagaaatactgatctcaatgaatattactcaaatttaagtattttct

SEQ ID NO: 28082 - DNA, 201 bp, Homo sapiens
gaggcgcctcctaggaggcgggtgggcaaacggagacctacgcctcggggtctcccggtgccccggctgggtcccgcccgccggcggaggggcgcgtcctyactcaccggttccggtggcgccgctctcccggggcgcccagcacagcgcgagcagcagccagagcgcccagagcgcggacgtgcccatggtgcccgcctg

SEQ ID NO: 28083 - DNA, 201 bp, Homo sapiens
ggcgcccagcacagcgcgagcagcagccagagcgcccagagcgcggacgtgcccatggtgcccgcctggatggtgccgccgccgccgccgccgccgccgtycgctccgcacgacaagttaccagtccttccgaaaggaggaagaaggtgggggcggggaggggaaagggggagaaggaggggaaggagttggcgggggaag

SEQ ID NO: 28084 - DNA, 201 bp, Homo sapiens
cctcactgcacgtccctcaccaggtgtgcaacaaggccccggcccagcatcagtacagcagccagaatctgatggagatggtgcactgcttcgtagccctyggtgaggctctgcggcagggtgctccctgcctgccccgaggcctgcaggaggcctctaggagtcccggcccctctgagcgctgggcctgggactgccttg

SEQ ID NO: 28085 - DNA, 201 bp, Homo sapiens
gtaagatgtgcccttgctcctccttcaccttctgccatgattgtgaggcctccccagccatgtggaactgtgagtccatgaaacctctttttctttataarttacccagtcctgggtatttcttcatagcagtatgaaaatggactaatacagtcagcttctgcacaatatttccattttcccacattatgtcttgggcct

SEQ ID NO: 28086 - DNA, 201 bp, Homo sapiens
aggccagcaagctcagctggacaagggcattctctgggtggatcagcaggaagctggcggcgggaggtggcctggcccacaactcactcgcgtgcttcctktatcctgatggggtatgaggctgtggtgcccatgcagccccaggtatggtcagctgggctgcccctgcacctgtgtccctgtgatctcctccagcctcac

SEQ ID NO: 28087 - DNA, 201 bp, Homo sapiens
gtgaacaaggataatttgacttcttcctttctattttgtatgccctttgtttctttctcttgcctaactgctctggccaggacttccagtattatgttgargagcagtggtaaaagtgggcatttttatcttgttccagattttaggaacaaggctttcgatttcttccatctggtacaatgttagctgtgggtttgtcat

SEQ ID NO: 28088 - DNA, 201 bp, Homo sapiens
acaaaaccttattgatggacactggaatttaaacttcatggaattttcatgtgccatagaattttcttttctatatttcttttccccaacacttaaaaatgggaaaatgagttttggcagtgggctgtacaaaagctcctggaagtacaagaccagtctgggaggtactcaccaagcttttataggttcttcaggcccctc

SEQ ID NO: 28089 - DNA, 201 bp, Homo sapiens
tttctattttgtatgccctttgtttctttctcttgcctaactgctctggccaggacttccagtattatgttgaagagcagtggtaaaagtgggcatttttrtcttgttccagattttaggaacaaggctttcgatttcttccatctggtacaatgttagctgtgggtttgtcatatatggcttttattatcgtgaggtatg

SEQ ID NO: 28090 - DNA, 201 bp, Homo sapiens
ttgtcatatatggcttttattatcgtgaggtatgctctttctatgcccagcttgttgagtttttaaaaaatcataaagggctgctgaatttatcaaatactttttttagcatatattgaaatgatcatatgattgttgttcttggctctgttaatgtgatgtatcacatttattgatttgtgtgtattggaccatccttac

SEQ ID NO: 28091 - DNA, 201 bp, Homo sapiens
ggtatgaggctgtggtgcccatgcagccccaggtatggtcagctgggctgcccctgcacctgtgtccctgtgatctcctccagcctcactgcacgtccctyaccaggtgtgcaacaaggccccggcccagcatcagtacagcagccagaatctgatggagatggtgcactgcttcgtagcccttggtgaggctctgcggca

SEQ ID NO: 28092 - DNA, 201 bp, Homo sapiens; identical to SEQ ID NO: 6353

SEQ ID NO: 28093 - DNA, 201 bp, Homo sapiens
atccagaaaagtgcagaggtgaaactaattttcatgtattttatttcactcaaataactaaaacatgatcatttcaacatgtaatcagtataaaaactatkattgtgatattttacaatttttggggtaccatcttaaaacccagggggcactttaccttaattcagaccagccacacttgaagtgctgcagggttacaca

SEQ ID NO: 28094 - DNA, 201 bp, Homo sapiens; identical to SEQ ID NO: 6355

SEQ ID NO: 28095 - DNA, 201 bp, Homo sapiens
ccgaatcagggtaattagtatatccaacactgcaaacatttatcatttctttgtgttgcaagcattcaaaactgtttcttctagttttttgaaaatatacratcaatcattgttgactatattcacaacctacagtgctatagaacacaagagcttattccttctctccagctgtaattttgtatcttttaatcaacttct

SEQ ID NO: 28096 - DNA, 201 bp, Homo sapiens
gaaggcttttgctatgctcaggccatcagaatagtctaggtgtccccagagcaggtaaaccaggacttccaaactgttcccagtccaactgccaaaggaawtcaccatccggggtcccatcaacaggagagagctgctatgctgtccaaaatccaacccgtgctaaagccttctctggaacagtggtcttcaaactgtttt

SEQ ID NO: 28097 - DNA, 201 bp, Homo sapiens
gggcccctgagtagcgagggtctagagtttgaccttgagttggtagaaggtcacctgccaccatttgccaatccactgcaggtcttgaggcagatcctggractgtcagtcaccaccaacacccctgtcccccaaatgcagctacacaccattttcacagaactgcacgtccaggtgaggccagcaagctcagctggacaa

SEQ ID NO: 28098 - DNA, 201 bp, Homo sapiens
gtggaaagggatgtgactgatttaggagccatctgtagatcattctggctaaataatgggattcacttttaagtgaaggaggccttgaatgccacactcakgggcctagcgcagcacttcccaagccttgctgtggttaggaacaacctgggggctgggtgaaatgcaggcttggattcagcaggaccggggtagggcctg

SEQ ID NO: 28099 - DNA, 201 bp, Homo sapiens
cctcttccagcttctggtggccccacatgttctgtgactgtggcagcatcactccaatttctcccttcctcattgcgtggcctttccctgtgtgtccctcygtgtcctcttcttacaaggacacctacccaaaatccaggatgatctcacttcgaaatcctgaactaattccatcacaaagaccctatttccaaataaggt

SEQ ID NO: 28100 - DNA, 201 bp, Homo sapiens
acagaggggttaagtacctgctcaaggtcatgtggctgctaagtgggagggactcaaacccggccgcctgtgcaggaaagaccttgctctgcttctgaggygccttctgtcctgtgtccttggattctgtggctggggctgaggtcactggccttgctggagggtggtgagacaatgcgtcccagagctggtttctggtgg

SEQ ID NO: 28101 - DNA, 201 bp, Homo sapiens
tgccaaggggtccagtgagataaggctggagaaggcgggaggtggaagagcttcacggcttgctggggataaaggcctggatggagtgggaggggaggaasggaaggcaggcctggaaagaggacaagggacagcagcgagggggattattatgaagtctgaagatgggggtgcactcagggtgggtgaagtggaggggcc

SEQ ID NO: 28102 - DNA, 201 bp, Homo sapiens
ccagcccggaggggtcctggcattggcaaggctcgggaggagtcgtaagagacagcgtggaatgtgaggcctggcacagggagaacaatctcaaggggtgmaggcccccgtgatgcccatcctgccaaggggtccagtgagataaggctggagaaggcgggaggtggaagagcttcacggcttgctggggataaaggcctg

SEQ ID NO: 28103 - DNA, 201 bp, Homo sapiens
aagaagaccctaaggaaaggtcagtatttaggtcccagagtagctctttaaaatcctttaaaggaaaagagagtatgggatagtaaagggccatgggatgratctttgaggatcaaggaacttgggacaggaggagaaaggatctgagagcctttcttccaccatctcgacatctatgttggtgtttctcaatttttaaga

SEQ ID NO: 28104 - DNA, 201 bp, Homo sapiens
gagagcctttcttccaccatctcgacatctatgttggtgtttctcaatttttaagaagctgtggatgttgagagaaccccttaaaggagttatgagagatrctgatatgaatttctcattagccattaattatcagtgtgtagaagagagggcgagagggctctattaaactaaggatattatctattgctgtgtaacaaa

SEQ ID NO: 28105 - DNA, 201 bp, Homo sapiens
tgactcatttcacttgacataatgtcctccagttttattcatgttacggtaaatgacagggtttcttttttttatggttgaataatattccgttgtctgtytataccacattttctttatcccttcatacattgatgggtacttacgttgattccatatcttggctattgtgaatagtactgcaataaacatgaaaatgca

SEQ ID NO: 28106 - DNA, 201 bp, Homo sapiens
accagctccatggccaggatgtggatgtcagcgtggctggcaagagcaggcaaggtgggcaaagttcctgtccagctgattggattgggcaggtgggctgkctccttgtctgggaatgcccacccctctccacattcctcccaccctcattcccccttctcctggaaacatccaagtccaaattaatactattaatgccta

SEQ ID NO: 28107 - DNA, 201 bp, Homo sapiens
ctgagacatggtgggggccttttagaagatcccggcttagagggaagaagctgcaacggtgactccatttagcttgctttgtaattaagcacttcagttcrtgagaccacagaacagcaatgagcattcacaggagagggagaccggggaaaacggctccatgtggagcttgacggggactggtcttagatgctatttcaa

SEQ ID NO: 28108 - DNA, 201 bp, Homo sapiens
agcagccagaatctgatggagatggtgcactgcttcgtagcccttggtgaggctctgcggcagggtgctccctgcctgccccgaggcctgcaggaggcctstaggagtcccggcccctctgagcgctgggcctgggactgccttgctgggcctgctctggacccggtgagcatgactaaagctgtccttccaccctgcagc

SEQ ID NO: 28109 - DNA, 201 bp, Homo sapiens
gacccagacacccccgagtgctcagttctcacacacacaggcacgcagagtaaaaatgaaggtgctgtggggggttggaagggcagggtgcagcctgctcsctacggcaaggcatgagcacttccactcgggaagctgggctgggaaggcttggttctgcttccagcccctctggcgccaagtgcattcccctgttgctgt

SEQ ID NO: 28110 - DNA, 201 bp, Homo sapiens
atttctgccagtctcagttatgtatcctttcatttctgattttatttatttgggtcttcactcttttttttttatttatttactctagctaaatatttatyaattttgtttgttttttcaaaaactcaacttttcttttgttctcctgtattgttttattactcttgattttgtttatgtctgcactgatctcttgccctt

SEQ ID NO: 28111 - DNA, 201 bp, Homo sapiens
aagcccatgctcggcctccttctgcccaacgatgacctgcgggagcaggtctacgactacatccccctgctgctggcggagtaccagggcagtctggaggygctcttcgtcacgcaggcgagtggccaggcagccacggctctgggcaggaggcttagggaattgggggctcccaagtgtttaaaggggatgagtgggagc

SEQ ID NO: 28112 - DNA, 201 bp, Homo sapiens
cctaggtggtccaaacataagacgtaaactgtcttcttagtgccaaatgcaagccctttttaatttagtttgtaagaagtttagtttgtaggaaaaacacyattgtaaaataactagtatccttttgtttccttccgttgaaataaacctccactgtcgttggagtagacttgtgactgtaaggtggtgacagcccagaac

SEQ ID NO: 28113 - DNA, 201 bp, Homo sapiens
ggcttggattcagcaggaccggggtagggcctgagagtctgcatttctaatcagctcccagggaatgctggtgctcagtgggtcagtgggcccctgagtarcgagggtctagagtttgaccttgagttggtagaaggtcacctgccaccatttgccaatccactgcaggtcttgaggcagatcctgggactgtcagtcacc

SEQ ID NO: 28114 - DNA, 201 bp, Homo sapiens
gagagtgttagatgttgagtccacgactcaccaactcactaggggagcttagagaaactgcttcaagggaagagccagaggaccctttgctgtggggtttygggggggtgggagtgcaaccagggcagagagatgcacctggggaggcctttccaggacgacagctattgatgggtggagtccctttcattccctgggctg

SEQ ID NO: 28115 - DNA, 201 bp, Homo sapiens
caggacactaaagagctcgtaggcagagatcttgccctcaaggcgagttcacctgggttcaaatgagatacacacaaagcagtggccaagggaacgaggcrtggaaacaacagaggggagggagatggccagggagagcatggccagggaggctcctaagaaagtgcccctgagcttggagaatgtgggaggagacagaac

SEQ ID NO: 28116 - DNA, 201 bp, Homo sapiens
gcaggtgagcagagagacgtctcctgactcaagatagactttgaaggccctctagtccaccccggcactcgggggaagggtggatcatgagtgggaggcaygtggcaagctgagaccagagctcaggtctaagccctgcactgtgctttctatcccgttttgattttggcttcctccctgccaacgtgggctcaacaaaat

SEQ ID NO: 28117 - DNA, 201 bp, Homo sapiens
ttgggagttacaaagtctatagctgtgtccatccccaggggagaactgagagaaccttccatcccgagagccaggtggccaggagggcagcagggagtgayaccccttctgctagccgccagagccacagccattcctcagacccacagatcattattagcactggatcagggatctatggacttagtgatctggagatgt

SEQ ID NO: 28118 - DNA, 201 bp, Homo sapiens
acttgtcaagaatcagaatcgctgcttgcaacttggcaggtgagcagagagacgtctcctgactcaagatagactttgaaggccctctagtccaccccggsactcgggggaagggtggatcatgagtgggaggcatgtggcaagctgagaccagagctcaggtctaagccctgcactgtgctttctatcccgttttgattt

SEQ ID NO: 28119 - DNA, 201 bp, Homo sapiens
cagccttacccactccctctgcccttgcctctggccctctctgacactgacccagaccctttcataaggaacaagaggtggggttgtcttcatagacatgyaaaggaactggctattttcttggaatggcaaggaggggaaaacacagagaataaagcaaaaactgtttttattttttaaaactatggcaaaatacaccta

SEQ ID NO: 28120 - DNA, 201 bp, Homo sapiens
taacttgtcaagaatcagaatcgctgcttgcaacttggcaggtgagcagagagacgtctcctgactcaagatagactttgaaggccctctagtccaccccrgcactcgggggaagggtggatcatgagtgggaggcatgtggcaagctgagaccagagctcaggtctaagccctgcactgtgctttctatcccgttttgat

SEQ ID NO: 28121 - DNA, 201 bp, Homo sapiens
tgcaaaggaactggctattttcttggaatggcaaggaggggaaaacacagagaataaagcaaaaactgtttttattttttaaaactatggcaaaatacacmtaacataaagtttatcatcataaccatttttaagtatatatatatagttcagtggcatgaggtacattcacgttattgtgcaactgtcactgccatctgt

SEQ ID NO: 28122 - DNA, 201 bp, Homo sapiens
ggtcctgagagtaatgagctccctcgtattggaggtgtccaagcacaggctgaggaactcccatttggctggatgggcaaacttggagtggaaattccacwtaagcaaccttggccctagatgtctctgagttttgttcctgttgtcttgcagtgcatagaaagatttcccaaaggccaatatttcattgttgtacctatg

SEQ ID NO: 28123 - DNA, 201 bp, Homo sapiens
actaaggggtactcctctacccatcctcaaaaggctgaaaaccacagtcccaggctccatggcagccacatccaccttggagtggagcttggttctggccrtgggctggggaagggaggtccggcatagtgaggggtctgcacagcagttttgaggaacatcagagagggaatggaggagaatgggggctagagatttagg

SEQ ID NO: 28124 - DNA, 201 bp, Homo sapiens
tgtgacgctgggatgggcgcttgccctctctgatgcatcttggtgatgggaacacgcttggtgaatgacagcccattgtcagggtctcatcctccaaagcwaaaagtgtgtatcacttactttttgcagactcggaaaaagccggctgttctctaccgcttcttgctagaaacaatggcctatgttaaaaataacttgtca

SEQ ID NO: 28125 - DNA, 201 bp, Homo sapiens
actgtcactgccatctgtctccagaattcttcattttacaaaaccaaaatcctatatccattcaacaccaactctccattcccttctcctcccagccctgrcaaccacctttactcttcctgtctgtgtggctttgactagtccaggtacctcatctaagtgcaatcatatgatagttgtccttgtgtgtctggcttattt

SEQ ID NO: 28126 - DNA, 201 bp, Homo sapiens
ctacagtgctatagaacacaagagcttattccttctctccagctgtaattttgtatcttttaatcaacttctccctatcctcccctgcccttacctttccyataccctaataccgaaattctactcttgacttctatgagctcaccatttttatagctcccatatatgagtgagaacatgtggtatttatctatctgtgcc

SEQ ID NO: 28127 - DNA, 201 bp, Homo sapiens
tggctaccaggagagaatcaaaggctggggcctgaagtacctgtctgtgcagctgaccttatccacctacaaactggtgagtggccctgatacgcagaccrcagagcagctggacttggaaatggtttccacagtgctgaggggagaatgccactcagcgtacctgtgttcaaacctgcgtatccattcatgacaggagtt

SEQ ID NO: 28128 - DNA, 201 bp, Homo sapiens
gtggccagtggtccttcacttgccagctactcacctgctgtgtgacgctgggatgggcgcttgccctctctgatgcatcttggtgatgggaacacgcttgrtgaatgacagcccattgtcagggtctcatcctccaaagcaaaaagtgtgtatcacttactttttgcagactcggaaaaagccggctgttctctaccgctt

SEQ ID NO: 28129 - DNA, 201 bp, Homo sapiens
ctccagaattcttcattttacaaaaccaaaatcctatatccattcaacaccaactctccattcccttctcctcccagccctggcaaccacctttactcttyctgtctgtgtggctttgactagtccaggtacctcatctaagtgcaatcatatgatagttgtccttgtgtgtctggcttatttcatttatcataatgttct

SEQ ID NO: 28130 - DNA, 201 bp, Homo sapiens
tatccacctacaaactggtgagtggccctgatacgcagaccgcagagcagctggacttggaaatggtttccacagtgctgaggggagaatgccactcagcrtacctgtgttcaaacctgcgtatccattcatgacaggagttcatagacacagtgaacctgcaggtgacaatgtgtggggtcctagatataggcacagctc

SEQ ID NO: 28131 - DNA, 201 bp, Homo sapiens
gggtcgagattgccacagctctttcttggggccctatgtttaccttccacacatgccatgtcgagaccggcactgtgcagcagaaatagaaggcaagtcaygtgcctatttcagctgtctgatgtttcttttagtaggcacatccagaaaagtgcagaggtgaaactaattttcatgtattttatttcactcaaataacta

SEQ ID NO: 28132 - DNA, 201 bp, Homo sapiens
ccactcagcgtacctgtgttcaaacctgcgtatccattcatgacaggagttcatagacacagtgaacctgcaggtgacaatgtgtggggtcctagatatakgcacagctctgagcattctgtagactcagtatctgggcatggagcccctggggagtgaggagaccacacctgagaccacgacaaacctctgctaggccac

SEQ ID NO: 28133 - DNA, 201 bp, Homo sapiens
agcccgtcccaggtggccacacgctggcttggagctggggggtcgagattgccacagctctttcttggggccctatgtttaccttccacacatgccatgtygagaccggcactgtgcagcagaaatagaaggcaagtcatgtgcctatttcagctgtctgatgtttcttttagtaggcacatccagaaaagtgcagaggtg

SEQ ID NO: 28134 - DNA, 201 bp, Homo sapiens
catcttaaggtgtgtgtcacaccccgtattttacaaattctgttgatctcaaaagagcttgaggaagagatgactgaagccattacagaagcagcagtagmctcaagtgaggaggtgtcagaggaaagagacgacctggggcctcttgaattacatgacagtggtaagaatgtcatccacatttctgctttcctgccccat

SEQ ID NO: 28135 - DNA, 201 bp, Homo sapiens
tgctgggcaccacccccagagtttctgattcagtaagtctggggtggagcctgagaatcagcatttctaacaagttcccaggtgatgccaaggctgatctrgagagcctactttgagaactgttggattttagactacccttttgtcttggagtgggtagcaaaggggtgctatgagcagaggagcttatttataaaaagt

SEQ ID NO: 28136 - DNA, 201 bp, Homo sapiens
tggagagcctactttgagaactgttggattttagactacccttttgtcttggagtgggtagcaaaggggtgctatgagcagaggagcttatttataaaaakttttattatttttgttggatttggatttgcatttgcgttttcccccttttatttttagttgacacataacaattgtacatatttatagaatacaaagtga

SEQ ID NO: 28137 - DNA, 201 bp, Homo sapiens
tttgggaggccgaggccggcagatcacgaggtcaggagatggagaccatcttggctaacacggtgaaaccccgtctctactaaaaatacaaaaaaaattasccgggcgtggtggcgggcgcctgtagtcccagctactcgggaggctgaggcaggagaatggcgtgaacccgggaggcagagcttgcagtgaggcgaaatc

SEQ ID NO: 28138 - DNA, 201 bp, Homo sapiens
gggcagtgcacgacctcagcatggctggcagtatcagtctgtatcatttgagcaagtacctgaaatgtgtccattactttaaggcccgtgtgtgtgtgtatgtgtgtgtgtgtgtgtgtgtgtgtgtctgtgtgtagaccaatgattttcatggtttaattttgtaaacattcattgagttctaactctgtgaaagacagg

SEQ ID NO: 28139 - DNA, 201 bp, Homo sapiens
ggcagtgcacgacctcagcatggctggcagtatcagtctgtatcatttgagcaagtacctgaaatgtgtccattactttaaggcccgtgtgtgtgtgtatgtgtgtgtgtgtgtgtgtgtgtgtgtctgtgtgtagaccaatgattttcatggtttaattttgtaaacattcattgagttctaactctgtgaaagacagga

SEQ ID NO: 28140 - DNA, 201 bp, Homo sapiens
aatactatgttgagtaggagtggtgagagagggcatccttgtcttgtgccgattttcaaagggaatgcttccggcttttgcccattcagtatgatattggytgtgggtttgtcataaatggctcttattattttgaggtacttcaatacctagtttgttgggagtttttaacatgaagggatgttgaattttattgaaggc

SEQ ID NO: 28141 - DNA, 201 bp, Homo sapiens
cctagtaagccttgggacgcagctggcctaacatgaaagaaatgcaatggtcattttcagcaggtgccttggactccagctctggggtcacaggacaagtmctgtcactatgagggcagcagtttccaggtggggtggagcgggtggcccagatggcctgggtggcccaggtgggatggcccaggtggcccaggtgggatg

SEQ ID NO: 28142 - DNA, 201 bp, Homo sapiens
ctttcccacacaggagtttccccgtctgcccctgcccaccttctgcggcccttgcctgccatcactgcccagggcatgcagcatgtggtcctgactgggcrgggcctgaaccttccctctttgtgttctctctcagccctccaggaactacagctggacccggatcccggggtcaggagggcagccctggagacgctcaca

SEQ ID NO: 28143 - DNA, 201 bp, Homo sapiens
ggcctgggtggcccaggtgggatggcccaggtggcccaggtgggatggccctggtggcccaggtgggatggcccaggtggcccttacaggcagtgaggggkattgagatgcacactccctagacctgggctttgcactcaccaccccagcttctggactttgccacatccctctgccacaccatccctggccaccctgggc

SEQ ID NO: 28144 - DNA, 201 bp, Homo sapiens
aggtgaggacacgtgcccagtcttgcctgctcaagcccggctcccgcctctgatcccatggagggctgggtcccaggcagggctgctgagggcacgaaggkgctggctgagggggcgggtggggctgcatctgcccccaaggggctttctataaatgtacctgcagccatgttcaagctggcaggggcccaggtcccaggt

SEQ ID NO: 28145 - DNA, 201 bp, Homo sapiens
gtgacgctgggatgggcgcttgccctctctgatgcatcttggtgatgggaacacgcttggtgaatgacagcccattgtcagggtctcatcctccaaagcaaaaagtgtgtatcacttactttttgcagactcggaaaaagccggctgttctctaccgcttcttgctagaaacaatggcctatgttaaaaataacttgtcaa

SEQ ID NO: 28146 - DNA, 201 bp, Homo sapiens
cagtgtgcccttctggtctctgcctctctctgcccctcccatctatccctatgttcacctcttcctcttacctttcatttctctctttttccctctaaaaytgattcattttgtgtctgcagtccttttgtctcttagctgttaagattctgtgtgttctgtctctcatccttcttccccctctctcctgctcccctccac

SEQ ID NO: 28147 - DNA, 201 bp, Homo sapiens
tggggtctaactccctgcggtgagaggttttcaaagttcctgagggcatctgcagagctctctgaagtccttccctgtcttggctctgctttgtcctaacygtaggagttctgagaatgatttttgtatctgataaagagtttcacagccagtcaactgtttggaaaccagggtgggagattctggctgtcctgggtcctg

SEQ ID NO: 28148 - DNA, 201 bp, Homo sapiens
ggtagtctgtatatgtccaagaatttatctgtttcctataggttttcaaatttgttggcatgtagttgtttgtaactctaataactctaataattctttgwatttatttatttattttggtgacaagagtctcacactgttgcccaggctggagtgaagtggcacaatcttggctcactgcaacctctgcctcccgggttc

SEQ ID NO: 28149 - DNA, 201 bp, Homo sapiens
ttgattggggatattttgagcaaaataacagtgataacactgaagagcattgcaagcatccttcaagatgagtcaggctcagtgagtgagttgaagggctyagtcaactatttgttgataccactggtacaaaatgatctaaagcccaagacttaccttcctggagatgccaatccattggtggggagggggaaaggggaa

SEQ ID NO: 28150 - DNA, 201 bp, Homo sapiens
gcatcaaacaggcagattttaaaataaatgtcatgaacatcaactaagcacaatgatatgctgagtactgaagggacacagagatacataagacctagtcmcagccttttaaggacttagagataagacagacacatacaaacaggattataggtcaaagctgactaacaggactgtgtttacaggtaaacccacacacac

SEQ ID NO: 28151 - DNA, 201 bp, Homo sapiens
gcacaaagaccagagcaatgcccagccccttgagggctacgtgatccctgccaaaggagagactacaccctgacggaatgatccagaaggctctgcagggrccaaggcattgggtattccttggagaatggctggggttttgctgggcttcctgctgcctgcatgtcagcctgtgtccatcctggccacaggagagcgagc

SEQ ID NO: 28152 - DNA, 201 bp, Homo sapiens
tgcagacaggaaacatgagactgagaggcagagtaccctgcctggactgctcagctagtgagcaggaagctctgatttgatccccagggttcgttacaggwacaactgggcccaagttcagagctgtgaactgagcagagctgagtcagagggagtcctgatccagggcccacagatccaggctgctcagcctccaggggc

SEQ ID NO: 28153 - DNA, 201 bp, Homo sapiens
tattcttctaagttccagagaatcagtgctgtcaagtgacggctcctgggcctctgcagccctgctaggagggaagggtctcccccttttattccttgcasctacaaatacccccagggcacctgtgtcaccctgggcctctgctaggcagggctgtgcactcagatcctgcacaagccctcacccagggaagaggcgggc

SEQ ID NO: 28154 - DNA, 201 bp, Homo sapiens
ccctccccttccccaaatgggtgtttcagagcagggtttgccctatcaagttgtcctttacactgcccctgggcagccccaggtgtgcatgagagcacagwggtgtgagccccacggtctcctgtccctcagatccacctaaagctggggcagtttggcacaatggtcggactcattgccccgtgcacctgtgatgcccat

SEQ ID NO: 28155 - DNA, 201 bp, Homo sapiens
gttgggagtggggtgggggaagagagagtattaggaaaaacagctaatgcatgctgggcttaataactcggtgatgggtcgataggtgcagcaaaccactrtgacacacgtctacctatgtaacaagcttgcacttcctgcacatgtaccccagaactaaaaataaaaattaaaaaaaaaattaggttcaggtttaagaag

SEQ ID NO: 28156 - DNA, 201 bp, Homo sapiens
gggagcttagagaaactgcttcaagggaagagccagaggaccctttgctgtggggtttcgggggggtgggagtgcaaccagggcagagagatgcacctggrgaggcctttccaggacgacagctattgatgggtggagtccctttcattccctgggctgtttctcccattcatagcttcttatgaaatgcttttggcctga

SEQ ID NO: 28157 - DNA, 201 bp, Homo sapiens
gtggagaagatcttctgtgcatcctccagaatcgccaaggtgacagccggggagcctgcctgggctgccaggctggtctcagggcccttggccgtctctcrgggagggaggccttcctgggctggcctcacagcccaagttttctggggtctcagcttccacggcctttggcccaactgctgccctctgtgttgaaagggc

SEQ ID NO: 28158 - DNA, 201 bp, Homo sapiens
agttttctggggtctcagcttccacggcctttggcccaactgctgccctctgtgttgaaagggcctgcagtatgtcatgtccctactttgtctctggcacrcagtaggtgcttaatctgctttgctgtcttctccctgtccctgtgatgtgccacactgagtgctgaaagggccatgggaatgatctggacaggccctgca

SEQ ID NO: 28159 - DNA, 201 bp, Homo sapiens
gcacctggaggagagcgtgtaccccgtgatgactgaggaggagtttgccctgaaggtgttccccatgtatcgctacttcgtgacagtgtggctgaggcacyacaaccccgaggtgagatgcacccctcttaggagggcctggtggtccccaggccacagctccccagcctgtggggccgggaggtgctgagggaccgtcgg

SEQ ID NO: 28160 - DNA, 201 bp, Homo sapiens
atgtcaggctaagtaagaggcttggaacagagaaaagagttttaaaaataggccccggctccagagccacaagggctgacctgcccgaaatgcaggcatgrctcccctgtggagctgcttctcataagggcagccctgccgtgggtccagctgggagggtggtgcaggtgtcatgatttaatgaggctcagtggctcatga

SEQ ID NO: 28161 - DNA, 201 bp, Homo sapiens
gattcttacctgccagggcacatgccaggaaactcacagtccttgtgccctgactttggttagccacctggcagaggtgtggctggcagtgtcggagaacrtgcccttcgcccggaccatgctccacagcctgatgggccggctgcagtcacggctcagccccagaatcagtgccacctccaaggctgacatctggcgcct

SEQ ID NO: 28162 - DNA, 201 bp, Homo sapiens
ggatccccctcatgctgcactcccaggacccctgctccaatgcagcccaagtaagatacatcctgggctttgtgtcccagtctggggcccgctgttccccraggaaacaggtccttgggtctgctggctcggtgagctgcaagcttttctctgcctcagttggttttctctgagatcccagaggccacagcctgctccctg

SEQ ID NO: 28163 - DNA, 201 bp, Homo sapiens
tttttgtgcctttctgttcagatgcaggtgggcgtggctcttgcatttggcagtggctgttatgttacctgaaaaaataaatgacgaatttatatatataygtaacacttatctagcattccccccatatttccttattaaatccccacacagaccctgaggcaggtactagcatcacccgctttttatagagaggaaacg

SEQ ID NO: 28164 - DNA, 201 bp, Homo sapiens
actgccacgccaacctgtgactctaggatggcagtggtgtgcaagagaatgagaaccttttattcgaacccttcctgctcagagcagatatgagggcagaragaggaggggctcgcccccagggccacacagggtctagagtaggccagggatgggagttacttctggggtcctagtcactccggagccgccctcactcta

SEQ ID NO: 28165 - DNA, 201 bp, Homo sapiens
aaagtgtgtagtcaatccactttttgtggaaaagctgccctctttctattgagtgtattaagtgtagcaatacaacgtggggcagtatttatagcatgacyttagtgatgtggaagaaatctatgttcatttatgcataaacaggtctgaaggacaaaatctattaaaaagtggttattttttattttaattttgcaatga

SEQ ID NO: 28166 - DNA, 201 bp, Homo sapiens
tgtggaataaacaatatatctgcataatggaatattatgcagctattaaaaagtgtgtagtcaatccactttttgtggaaaagctgccctctttctattgrgtgtattaagtgtagcaatacaacgtggggcagtatttatagcatgaccttagtgatgtggaagaaatctatgttcatttatgcataaacaggtctgaag

SEQ ID NO: 28167 - DNA, 201 bp, Homo sapiens; identical to SEQ ID NO: 6366

SEQ ID NO: 28168 - DNA, 201 bp, Homo sapiens
cccaaggggtagggaaaagttcaagaccattcctcggtgctccttcaggggttgtgcctcctttttcctctcctccctctgtagcaggggtctcacttggmggctccccagggcaatgggccagcctagatgatgggggtcggcctcagccactcttttctataattctcagccagatttcaagttgggtgcttctccttg

SEQ ID NO: 28169 - DNA, 201 bp, Homo sapiens
tgacgctgggatgggcgcttgccctctctgatgcatcttggtgatgggaacacgcttggtgaatgacagcccattgtcagggtctcatcctccaaagcaaaaagtgtgtatcacttactttttgcagactcggaaaaagccggctgttctctaccgcttcttgctagaaacaatggcctatgttaaaaataacttgtcaag

SEQ ID NO: 28170 - DNA, 201 bp, Homo sapiens
ttttgtgcctttctgttcagatgcaggtgggcgtggctcttgcatttggcagtggctgttatgttacctgaaaaaataaatgacgaatttatatatatacktaacacttatctagcattccccccatatttccttattaaatccccacacagaccctgaggcaggtactagcatcacccgctttttatagagaggaaacgg

SEQ ID NO: 28171 - DNA, 201 bp, Homo sapiens
aatgccacactcaggggcctagcgcagcacttcccaagccttgctgtggttaggaacaacctgggggctgggtgaaatgcaggcttggattcagcaggacyggggtagggcctgagagtctgcatttctaatcagctcccagggaatgctggtgctcagtgggtcagtgggcccctgagtagcgagggtctagagtttgac

SEQ ID NO: 28172 - DNA, 201 bp, Homo sapiens
gacgctgggatgggcgcttgccctctctgatgcatcttggtgatgggaacacgcttggtgaatgacagcccattgtcagggtctcatcctccaaagcaaaaagtgtgtatcacttactttttgcagactcggaaaaagccggctgttctctaccgcttcttgctagaaacaatggcctatgttaaaaataacttgtcaaga

SEQ ID NO: 28173 - DNA, 201 bp, Homo sapiens
ccagttcatgagcggcccagttctgtaccaggagaagctgctgaagccggcagctttgctgctggagaagggtgccgaccaggaggaagacgaggccctgmgggtgctgtccctgcgcgccctcggcaacatggccctgggcgcccccaagaaggtactgtgcctggccctgggcccaggtcccgggagctgagggtgcag

SEQ ID NO: 28174 - DNA, 201 bp, Homo sapiens
aaaaattaggttcagcttttttggttccatatgaattttaaaataatttttttctaattctgtgaagaatgtcaatggtagtttaatgggaatagcattgmatctatacattactttgggcagtatggtcatttgcatgatactgattcttcctatccatgagcatggaatatttttccatttgtttgtgtactctctggt

SEQ ID NO: 28175 - DNA, 201 bp, Homo sapiens
acgctgggatgggcgcttgccctctctgatgcatcttggtgatgggaacacgcttggtgaatgacagcccattgtcagggtctcatcctccaaagcaaaaagtgtgtatcacttactttttgcagactcggaaaaagccggctgttctctaccgcttcttgctagaaacaatggcctatgttaaaaataacttgtcaagaa

SEQ ID NO: 28176 - DNA, 201 bp, Homo sapiens
taaatgctagctaattatggcagtttaaaaattaggttcagcttttttggttccatatgaattttaaaataatttttttctaattctgtgaagaatgtcamtggtagtttaatgggaatagcattgcatctatacattactttgggcagtatggtcatttgcatgatactgattcttcctatccatgagcatggaatattt

SEQ ID NO: 28177 - DNA, 201 bp, Homo sapiens
agttcatccacacgcatgctgacagcgtgcctaaggccaggcactgtgccaagcggtgaggggaggcctagagtgtcccatctgtctccagggactcttcttttttttttttttttttttttgagatggagtcttgccctgtcgcccaggctggagtgtagtggcgcaatctcggctcattgcaacctccacctcctgggt

SEQ ID NO: 28178 - DNA, 201 bp, Homo sapiens
tgcccaatgcaccctaggaaccaaccacagcccaggccagaggccggccagtgttttctgtaaaggactgcagagtaaatttttggctttgtggccaactmagctgtagcaggaaaacagccacagccaataagtcaaccagtgggcatgacggtgtcaacaaaaccttattgatggacactggaatttaaacttcatgga

SEQ ID NO: 28179 - DNA, 201 bp, Homo sapiens
tgagccaagattgtgccaccgcactccagcctgggcgatagagagagactgtctcaaaaacaaacaaacaaacaaacaaacaaacaaataacccccccccmaaaaaaacacacacatcagaaaaacaggcctatcaaagagaaccctaaaaattctaattgagcaactttattcacataatttctacaccaagaactcgag

SEQ ID NO: 28180 - DNA, 201 bp, Homo sapiens
cactgtttggttttctgttcctgggctaatttgctgaagatgatggtttccagcttagactggataaagaaaatgtggcacttatacaccttggaatactrtgcagccatatactatttttataatcagaaacagtttgcatcttcaagatgaaaactctcaattgtctcatgctcacttggtgcctgactgccaccttgt

SEQ ID NO: 28181 - DNA, 201 bp, Homo sapiens
cgtggagggccacaggcagaggctggccgagctggtgctcaggggcatggactcagaagtcctgagctgccgcatcagcagcacagcggtctgcgtggaartgaggcaccgggtgtgggcggggtgcaagcggaggggatggggtccctggattcttctggggatggcttgtctccaaggcatgggagtcggggggacagg

SEQ ID NO: 28182 - DNA, 201 bp, Homo sapiens
aacagaggggagggagatggccagggagagcatggccagggaggctcctaagaaagtgcccctgagcttggagaatgtgggaggagacagaacgtgaggcmctgatgtgggacgagccacctgacctctccctgagccacagccctccagcccacccagttttcctctttcagagcccaggatgagtatcagggccatcta

SEQ ID NO: 28183 - DNA, 201 bp, Homo sapiens
agatctctctctgggccggacagttgtttttggtgaaattctcccctttcaactgagaaggagactcttgagaggtcatctgttaaacagaacgcataaaytttgcctcaaagcagcctccatgaagtgtctgccatgaagatgtggctgagattcttgaaggcttcactaactgtggctgaaagtcacccggctggtggt

SEQ ID NO: 28184 - DNA, 201 bp, Homo sapiens
ttgtgacttcattcaaccctaattacctttcgaagggctcatctccaaatactatcccactgggggttagggcttcaacataggaatttttagggtacatkattcaatctgtaacagttgttttgtacttaaaaagcatgctgatggacaacttgttactatctctaggaactggctagctctgggaggagtagtctctct

SEQ ID NO: 28185 - DNA, 201 bp, Homo sapiens
cataattcccacatgttgtgggacggaacaattgggagataattgaatcatggggtggtttccctcatactgttctcatagtagtgaataagtctcacgaratctgatggttttataaggggtttcccctttctcttggctctcattctctcttgcttgctgccatgtagaacatgactgtgttccccctttgtctcctac

SEQ ID NO: 28186 - DNA, 201 bp, Homo sapiens
gcagcacgtggagggccacaggcagaggctggccgagctggtgctcaggggcatggactcagaagtcctgagctgccgcatcagcagcacagcggtctgcrtggaagtgaggcaccgggtgtgggcggggtgcaagcggaggggatggggtccctggattcttctggggatggcttgtctccaaggcatgggagtcggggg

SEQ ID NO: 28187 - DNA, 201 bp, Homo sapiens
tactctagcctgggtgacagagcgagactttgtctcaaaaaaaaaaaaaaaaaaaggagaaaagacagtttgttacattcccaagagagggggccaaccaygccatgcagggtcacacaggggaagcactagggtctgtgaggaggcagagggagtcaggggaaattataggcaacaggctttattgtggtttctgtagaa

SEQ ID NO: 28188 - DNA, 201 bp, Homo sapiens
tttagctgcgatgaggtggtctcgctcatccagaagctctgcgagaacactggggccatgaacctgcagcatgacaaggcctctgtcacctggatagcctycttcctccagatgcgggccaaggagctggaggacaaggtggcagagccgcggcagggccaccagagagaggggctggggctgcctggtgtgcccagatga

SEQ ID NO: 28189 - DNA, 201 bp, Homo sapiens
cttccctgttatactgcttttgctgtatccaatagatttttgtatgttatatttctatttccattcatttcagtaaaattttaaatttccttcttaatttmtttattgaaccagtggtcatccagcaatatattacataatttctatgtgtttgtgtattttccaaagtttttttgtggttgatttctagttttattccat

SEQ ID NO: 28190 - DNA, 201 bp, Homo sapiens
tgggacaggggaggagagagtgtcagcagtcatggagtggcaggggagggcaggggagtcacccgctctgctcctaggtggtctgcatggagtttagctgygatgaggtggtctcgctcatccagaagctctgcgagaacactggggccatgaacctgcagcatgacaaggcctctgtcacctggatagccttcttcctcc

SEQ ID NO: 28191 - DNA, 201 bp, Homo sapiens
cacgaagggggggtggctgggccttttgtccctgctggtcatttctgaagttgtattcccgacagcaagccagacctgctccttgtggggcccttccaagsagaaggagcttgagaaatgtaagggggacctccagagcacagatgtggagaagatcttctgtgcatcctccagaatcgccaaggtgacagccggggagcc

SEQ ID NO: 28192 - DNA, 201 bp, Homo sapiens
attaatttttctatcagtgagcatgaaatagctttccattttttggtgtcttcttcaattcttttcatcagtgttttatagtttcccttgcatagatcttycacttctttggttaaatttattcctaggtattttatatttttgtggctattgtaaatgaaatggatttcttggtttctttttcaaaatgggtgaagtgtt

SEQ ID NO: 28193 - DNA, 201 bp, Homo sapiens
tattttctagtagtttcatagtttcaggtcttggatttaagtctttaatccattttgatttgatttttgcgtatggtgagagataggggtttagtttcatycttctgcatatggttatccagttttcccagcaccatttattgaagagactgtcctttcaccattatatgtgcctagcacctttgtcaaaaatgagttgac

SEQ ID NO: 28194 - DNA, 201 bp, Homo sapiens
cagtgagagcaaaggtcagaacgcctgggacgttcacatgctggagggtggctcaggcctgcaaagccagggcaggaggtagccacgaagggggggtggckgggccttttgtccctgctggtcatttctgaagttgtattcccgacagcaagccagacctgctccttgtggggcccttccaagcagaaggagcttgagaaa

SEQ ID NO: 28195 - DNA, 201 bp, Homo sapiens
accaatttcctggagcatttccccaatgattattttctagtagtttcatagtttcaggtcttggatttaagtctttaatccattttgatttgatttttgcrtatggtgagagataggggtttagtttcattcttctgcatatggttatccagttttcccagcaccatttattgaagagactgtcctttcaccattatatgt

SEQ ID NO: 28196 - DNA, 201 bp, Homo sapiens
tgcaaagaaaccaagaaagacgagggaaaagaggtaaattttatagatattaacattttttgtgtgcttctactacttcctgtttgttttctcatctccaraaacaataatatttaccttatggagtcgtggtgaggatttaatgaaatatggatggttgctcttattatgtctccaaatataaaacaaaattcttacaaa

SEQ ID NO: 28197 - DNA, 201 bp, Homo sapiens
catgctgtttgactgtcttgtcctcaggatggctgtggcaggaggatgatggagtcagggtctggggcgcagggatggtcgtctggtgcagggagagaagygggctgggcaggaggaccctggtcctgggcacctggatggaggtggggatgaaggctcagcaaaatgaggcaggggccaagtccaacactcagtaacatg

SEQ ID NO: 28198 - DNA, 201 bp, Homo sapiens
atcagatatgtgatttgcaaatattttcttctagtctgtggcctttttattgatttcccaatatcttttaatgagcagaagtttttggttttgacgaagtmgaatttatctttttttcttttatggatcatgcttttggtgtcaaatctaagaaaccgtccaaagattttctcctatgttttcttccagaagttttgtatt

SEQ ID NO: 28199 - DNA, 201 bp, Homo sapiens
gcagagctccaggctttgtggggcctgtggcttctgtagcggtgagagccctttttaagaaaaaagatacatagttatgaaccccacattggctaggaaartgaatatttactttgagaaaatcaagtgctgcaaaatcataaattttgcaaagcttgacaagtaccgcaacccttaaaatgtctagaacgacgtagtgtt

SEQ ID NO: 28200 - DNA, 201 bp, Homo sapiens
tgcagggtgcggctccaaggcatgagcaagccctggatatattccaggctgtccctatttctttcaaaatgtgtcctaagaggggaagcgacttgtcccaktctccaaggggagaatggcccaacctccagccccagaggtggccatgagtgatgcagagccaccccatctttattggtgtttctctgcagacagtgcaga

SEQ ID NO: 28201 - DNA, 201 bp, Homo sapiens
attagttcaaccattgtggaagacggtgtggtgattcctcaaagatctagaaccaaaaataccatctgacccagcaatcccattactgggcatatacccaraggaatataatcattctattacaaagatatatgcatgtgtatgttcattgtagcactattcacaataacaaagacatggaatcaacccaaatgcccatca

SEQ ID NO: 28202 - DNA, 201 bp, Homo sapiens
taatgcctacctggatattaatgcctacctgatcatatctaggtcatgttagaattgtgtaaacttcctttggatagctcactcctcatgtcctgtccccycagcccacagccctggtccagatcccatccttgggagctcctggcccagcctttcccatgcatgaccttactgggcctctgctctgcctggcttctctga

SEQ ID NO: 28203 - DNA, 201 bp, Homo sapiens
cttaccaacaatgtgtgaggtttcccctttctccacatccttgctagcatctgttattttctatattttggataaaagtctttttaactggagtgagatartatctcattgtggttttgatttgcatttctctgatgattagtgaggttgagcatttttttatatccctgttggccacttgtatgccttcttttgagaaat

SEQ ID NO: 28204 - DNA, 201 bp, Homo sapiens
ttcccaggtgatgccaaggctgatctggagagcctactttgagaactgttggattttagactacccttttgtcttggagtgggtagcaaaggggtgctatragcagaggagcttatttataaaaagttttattatttttgttggatttggatttgcatttgcgttttcccccttttatttttagttgacacataacaattg

SEQ ID NO: 28205 - DNA, 201 bp, Homo sapiens
catccattgattatctcacggttccactggccaggagtctaggcatggctttccttggtcctttgtttagggtctcagagactgcagtcctttctggagtycagcttcctcttccaagctcatgtgcttattggagaattcagtttcttatggttgtaggactgaggccctcagttccttgctacgtggccctcaccacag

SEQ ID NO: 28206 - DNA, 201 bp, Homo sapiens
atgttgagagaaccccttaaaggagttatgagagatactgatatgaatttctcattagccattaattatcagtgtgtagaagagagggcgagagggctctwttaaactaaggatattatctattgctgtgtaacaaattatcataaactcagtggcttaaaagaacatccattgattatctcacggttccactggccagga

SEQ ID NO: 28207 - DNA, 201 bp, Homo sapiens
ttggtgttctgggctctacccatagctcctggaaaagtggatcttgtcggagaaagaatgggagcgggaaaaggccgtgagcctccatctctatctcatgyggatttatgtccacagcactgctgtctgtgtgagtccaggagtccccagcccccagcctgctgctctgacatgcacagaaaaattcctgtgtctatctgg

SEQ ID NO: 28208 - DNA, 201 bp, Homo sapiens
tggtttaggaaatcagggtgcctcctctcctacctgtctttgatgttctttatcttgtaagtattgtgctagtggaaatccaatttcttatcctgcaagtyatccagtccccgggaaggaggagtgctctccccagggcctctcagtctgcccctcctctcctctccaactgtcctgaccacacctccccacccagggctc

SEQ ID NO: 28209 - DNA, 201 bp, Homo sapiens
tctggatacaacccatcagatatgtgatttgcaaatattttcttctagtctgtggcctttttattgatttcccaatatcttttaatgagcagaagtttttrgttttgacgaagtcgaatttatctttttttcttttatggatcatgcttttggtgtcaaatctaagaaaccgtccaaagattttctcctatgttttcttcc

SEQ ID NO: 28210 - DNA, 201 bp, Homo sapiens
aagctgactaacaggactgtgtttacaggtaaacccacacacacatcagcaaaaaaatatctgagaacaaaaaaaaaggggctactaacaaaagcaactcrgtttatacaaaaggagctatcaagaggcttggtgcaaagttggcatttggcttttgacctgggcttaggcagaacgactggacttggcgcttcctaggag

SEQ ID NO: 28211 - DNA, 201 bp, Homo sapiens
gagtattaggactcaaaataccccaaagtggtcttgtccactgcctgcaggcccatgttgggatgggagcgggcctggcttctccctctccacagcccagytcctctgttgctttggggcaggaggagagggagagacagatttgttagtaaatgtgccttctcatttgagttgctgcctctcaggctaaccccggctggc

SEQ ID NO: 28212 - DNA, 201 bp, Homo sapiens
tggggtcacaggacaagtactgtcactatgagggcagcagtttccaggtggggtggagcgggtggcccagatggcctgggtggcccaggtgggatggcccwggtggcccaggtgggatggccctggtggcccaggtgggatggcccaggtggcccttacaggcagtgagggggattgagatgcacactccctagacctggg

SEQ ID NO: 28213 - DNA, 201 bp, Homo sapiens
ccatagtctacacatctgattccaattcctaagcccaaactctaaacctagccctgagatttaaagagaacccctgtccctaaccaaggcactagctcacrctctgcctttgtgtgaatttgaagaaggcccctgttgacagcatgcagccctacaggtacataatggttagaagagcatgggcagctcccgctcagccct

SEQ ID NO: 28214 - DNA, 201 bp, Homo sapiens
gctgaacaaccagattgcgagctttgacagcccctctctggagaaggtttgtcttcatagggacaggagagtttggacaaggagtagactccaggggtgakggagtggagaggataacaccgtgtgtgtgagatcagctggacctgtggctgtttacagggtcctgggaggagaggagcgtggtctggattggtggtttta

SEQ ID NO: 28215 - DNA, 201 bp, Homo sapiens
tgaaggcctttggcccttctcaccaacgtcttgtgcctccccagtttctgcgaaactccctcaagaagacccgggggtctagctggagcctgcgcttgagyaaagagctgaacaaccagattgcgagctttgacagcccctctctggagaaggtttgtcttcatagggacaggagagtttggacaaggagtagactccagg

SEQ ID NO: 28216 - DNA, 201 bp, Homo sapiens
gagggctgggtcccaggcagggctgctgagggcacgaaggtgctggctgagggggcgggtggggctgcatctgcccccaaggggctttctataaatgtacmtgcagccatgttcaagctggcaggggcccaggtcccaggtggcctcccaggagccaccagccctgcctttctttggcttggtgaggcttttctggggctg

SEQ ID NO: 28217 - DNA, 201 bp, Homo sapiens
atgcccctctcactcttgactctggttgagtcctctccaggtcccctgcactggcatcttctcagcaggcctggccgtgcccttgtccatttgtttgtgcsctgttggtttgcttttcctgggctcattggctcccaaagcctgtggagagagtcaggagtgggtagaatggcagtgtctaattacttttggctcaacaga

SEQ ID NO: 28218 - DNA, 201 bp, Homo sapiens
ccgtcctgtgtccctgcaggcctgtatggctaccatgtttcagtgtgtgcacttctggggctggaagtccctggagcatccctcagggccaagtgataccrctactgatgacaagatgaccgttttccagacaaccatgtgctccatcctggtgaggaagccaaagggggaaccagcccgtcccaggtggccacacgctgg

SEQ ID NO: 28219 - DNA, 201 bp, Homo sapiens
ttctcctggaaacatccaagtccaaattaatactattaatgcctacctggatattaatgcctacctgatcatatctaggtcatgttagaattgtgtaaacytcctttggatagctcactcctcatgtcctgtccccccagcccacagccctggtccagatcccatccttgggagctcctggcccagcctttcccatgcatg

SEQ ID NO: 28220 - DNA, 201 bp, Homo sapiens
ctgtatggctaccatgtttcagtgtgtgcacttctggggctggaagtccctggagcatccctcagggccaagtgataccgctactgatgacaagatgaccrttttccagacaaccatgtgctccatcctggtgaggaagccaaagggggaaccagcccgtcccaggtggccacacgctggcttggagctggggggtcgaga

SEQ ID NO: 28221 - DNA, 201 bp, Homo sapiens
cccaggtggccacacgctggcttggagctggggggtcgagattgccacagctctttcttggggccctatgtttaccttccacacatgccatgtcgagaccrgcactgtgcagcagaaatagaaggcaagtcatgtgcctatttcagctgtctgatgtttcttttagtaggcacatccagaaaagtgcagaggtgaaactaa

SEQ ID NO: 28222 - DNA, 201 bp, Homo sapiens
atcactgcccagggcatgcagcatgtggtcctgactgggcggggcctgaaccttccctctttgtgttctctctcagccctccaggaactacagctggaccyggatcccggggtcaggagggcagccctggagacgctcacagtcttggatagctgtagtcagcatgggtttctggcttcaccccaaggaatgtcctaggtg

SEQ ID NO: 28223 - DNA, 201 bp, Homo sapiens
ctatgggagaaacaaatgtgtcaacttttaattgcaacaaaatgtgacgtagcaataagaggaaaaatgtaccatgagaacatcaaggagggaatgattaytcactgaggctgcaggctagatgatccctgtccagcgacagctttttttaattgcagaaataataataatcatcatcatcatcatagctacagtccatgt

SEQ ID NO: 28224 - DNA, 201 bp, Homo sapiens
gcccagagcacccccaattcctagctctctatgtcacaggattgggtgccttggagcccaccccaacccccagcatgtccacggtcctgtcccctcaggtraggatggctattctccacatcattgggcagttggctctctgtggctaccaggagagaatcaaaggctggggcctgaagtacctgtctgtgcagctgacct

SEQ ID NO: 28225 - DNA, 201 bp, Homo sapiens
gagggaagcgagaagaggctcgttctgcatctccttcacatagtgattctcatcaatggagcaagccccagggggtccaggataacagatgggctccccayggcaagggctgctagaatggagcagccgaggttggaagggagggagggagctttgtgtctctccaaggctcaattaggctcccaggtgggcatgctgcag

SEQ ID NO: 28226 - DNA, 201 bp, Homo sapiens
ggaaacaacagaggggagggagatggccagggagagcatggccagggaggctcctaagaaagtgcccctgagcttggagaatgtgggaggagacagaacgygaggccctgatgtgggacgagccacctgacctctccctgagccacagccctccagcccacccagttttcctctttcagagcccaggatgagtatcagggc

SEQ ID NO: 28227 - DNA, 201 bp, Homo sapiens
ccaacagcccagaagagaaaagaatattccggtcagatgaattaattcctcccactgtcagctagaagccatccctggctgagccctgcactggccagagrcaactgagtgtgagccagtccagggtcagatcctgggctgatgccacctgagggcggggtgggggcgtggcctccgtgcacatgggagactccaggtgca

SEQ ID NO: 28228 - DNA, 201 bp, Homo sapiens
agagtctcctccaggtaagatttccagagcctctgagtatggctggggtagcagggttgggcctgaggctgaggagatggaaatctgttgccgtgaacatyactccacacagccagtatacgggaagccagctcactttatgtcctccaaactcaccctaacttctcgtttgggtctcatcccgcggggctgctgggaaat

SEQ ID NO: 28229 - DNA, 201 bp, Homo sapiens
gagtctcctccaggtaagatttccagagcctctgagtatggctggggtagcagggttgggcctgaggctgaggagatggaaatctgttgccgtgaacattrctccacacagccagtatacgggaagccagctcactttatgtcctccaaactcaccctaacttctcgtttgggtctcatcccgcggggctgctgggaaata

SEQ ID NO: 28230 - DNA, 201 bp, Homo sapiens
cctgagggcggggtgggggcgtggcctccgtgcacatgggagactccaggtgcaggagagggggaggtggacttcctcttggtcttcccaagccatgaaayttcctggcttggtggtaacagaagagtctcctccaggtaagatttccagagcctctgagtatggctggggtagcagggttgggcctgaggctgaggagat

SEQ ID NO: 28231 - DNA, 201 bp, Homo sapiens
agcagggttgggcctgaggctgaggagatggaaatctgttgccgtgaacattactccacacagccagtatacgggaagccagctcactttatgtcctccaractcaccctaacttctcgtttgggtctcatcccgcggggctgctgggaaataagctccgccaccacagtggttcctccgccctgtgggagtggggggctc

SEQ ID NO: 28232 - DNA, 201 bp, Homo sapiens
acagtggttcctccgccctgtgggagtggggggctcttatgctggaggggggacactggcctggacttctgctgaggctctgcccctcatccctgcaggayggactagccagtcctaacacaggactagcgttgctctaccacgtccaagcctcctctgagattcttcctccatgcaaccacttcccctggggcgtggcca

SEQ ID NO: 28233 - DNA, 201 bp, Homo sapiens
cttggagctgtatggaatctttgttgcacttgaaaaaccaacagcccagaagagaaaagaatattccggtcagatgaattaattcctcccactgtcagctrgaagccatccctggctgagccctgcactggccagaggcaactgagtgtgagccagtccagggtcagatcctgggctgatgccacctgagggcggggtggg

SEQ ID NO: 28234 - DNA, 201 bp, Homo sapiens
ccctgtgaaacgggagtgtaaacaccttcctggagtggcctctccatgaaaggttgctgtcaccctgggtggcttaaggtcaccaaggccggccctgtccraggggtcagccttcaggaggattgactcaggtccctggggccctcccgagggtctggttcagtcgacaggtgtgtggggtggggcccacagcaggacatg

SEQ ID NO: 28235 - DNA, 201 bp, Homo sapiens
gctttttacctctccttgcattagatactttggggacaagtaatagatttgtaaaaactgaaagtaatggaaggaggacaacaagccctgagaccgtcacmtgtaatcattgcttttcagggtctgcaatgacccgtgcccggagctttccaagcaaagctccttttgttccttaccacagacctaaaaatggacctaaaa

SEQ ID NO: 28236 - DNA, 201 bp, Homo sapiens; identical to SEQ ID NO: 5808

SEQ ID NO: 28237 - DNA, 201 bp, Homo sapiens; identical to SEQ ID NO: 5809

SEQ ID NO: 28238 - DNA, 201 bp, Homo sapiens
tcagcaagttgagatagttgtagaaatgttatatgtccattaaacatgattttgaagcaatgtgtgagactgcctttggtattaagtatttcttacccatmggataataattttatgttaaaactatgggttttggtttgtttttaggagtcatagaaaaaaactagaagtaggcaaaaataccatttgtggttgtattac

SEQ ID NO: 28239 - DNA, 201 bp, Homo sapiens; identical to SEQ ID NO: 5810

SEQ ID NO: 28240 - DNA, 201 bp, Homo sapiens
gattttgaagcaatgtgtgagactgcctttggtattaagtatttcttacccatcggataataattttatgttaaaactatgggttttggtttgtttttagragtcatagaaaaaaactagaagtaggcaaaaataccatttgtggttgtattacgggggtggagttatgggtagctgcttcttttatattgacacttgtat

SEQ ID NO: 28241 - DNA, 201 bp, Homo sapiens; identical to SEQ ID NO: 5811

SEQ ID NO: 28242 - DNA, 201 bp, Homo sapiens
ctgcccctgatgggtttcatattttttgtggggagcttctcttcctagataataaacacaaagtgataacattagaacattattagaatgtcaccattttkcaaccccttagtaaaatagtgggtcgaagtaatagtcttcagtgactgccaacatcacagaaagacaactggacattatttgccttctgtgggaagtgca

SEQ ID NO: 28243 - DNA, 201 bp, Homo sapiens
caaagatttgtttcttatggttctggaggctgggaagtccaaggccaaggggtctacatctgttgagggccttcttgctgtgtcatcccacagtggaaggygaaagggcaagagaacacgcaggcttgtggatgtgcaagacgcagcagtgttaatctgtgctgggcgtggattaacgagggcagagtcctcatgacccaa

SEQ ID NO: 28244 - DNA, 201 bp, Homo sapiens
agctccaaggaaaacagaattctagcagtgattcctagtcttggctgcatactgagatcacctggagagcttttctttttctttttctttctttttctttycttttttttttttttaagaaacacagatggaaaacttaatgttatgttttttatccgtctctgaagccagcatcatacttgatggtgaaacttgagtatt

SEQ ID NO: 28245 - DNA, 201 bp, Homo sapiens; identical to SEQ ID NO: 5813

SEQ ID NO: 28246 - DNA, 201 bp, Homo sapiens
tccgatgttccacttgcttcagacggttgtgattctttgcagggcatggcacaggcacacaggaccccccagcccagggctgcccccagccagccccgtgygttcaagctggttctcctgggaagtggctccgtgggtaagtccagcttggctcttcggtacgtgaagaacgacttcaagagtatcctgcctacggtgggc

SEQ ID NO: 28247 - DNA, 201 bp, Homo sapiens
taaacctctgtgccctttgtggagtgtctgcctgtgtgtgtgtgtgtctctgcttctctgtgtgtgagtctctgtgtgtctgtgtgtgtgctcacgtgttygtacccatgtctgtatttgtttgtgtctgtgcatgtgcccatgtgtgtataatcaaaggacaaagctggggcggagacttcctagttcagatttctgatg

SEQ ID NO: 28248 - DNA, 201 bp, Homo sapiens
cctcttccagggagcacaccccgcccctccctggtcctggctgctcaggagtgccaagaaacacaacttggacacgaaacgtggaggagtgcgggctccayggctgcagctttctcggatcttactgttggaagtgaaccaggtgtccttaggaaactctcttataaacagcgctggattttgtggctgtttccttcagga

SEQ ID NO: 28249 - DNA, 201 bp, Homo sapiens
gggggaggtgcttgtccctgaccaacttccctgggtccctgttgctggtgacgtggtatcccatagaatgtctttagggactggatggtgaccaggagggkcaggaggcccttgttctatggttcagggtaaacacaggaggggcgggtcctggggtggctggtctgcagggctgtgctgggctgggcgacttccctccct

SEQ ID NO: 28250 - DNA, 201 bp, Homo sapiens
ttgtgagtaaggttctgtggagacacaactctacctcttcaggtacttaccctctgtaaatgatattcttgctgttcctcctcctctattcactctaaaayggcagcagggttgagtggttgcagcagtgaccccatggccagtaaaacctaaagtatctgctacagggccttttacagaaggactccatgacgccaccct

SEQ ID NO: 28251 - DNA, 201 bp, Homo sapiens
ctggggtggctggtctgcagggctgtgctgggctgggcgacttccctccctagccagccccctcctcttgctgttcacagcccaagagctactgcagagargcgacgaggagggccaggctctacggggggatgcagctgtggctctgaacaaggggcccgcgaggcaggccaaatgctgcgcccactaggtgcagccact

SEQ ID NO: 28252 - DNA, 201 bp, Homo sapiens
ggggatggatctcactctgacacggaggtctgcacactgtggctctctggctgttcttgttgttttgtgagtaaggttctgtggagacacaactctacctsttcaggtacttaccctctgtaaatgatattcttgctgttcctcctcctctattcactctaaaatggcagcagggttgagtggttgcagcagtgaccccat

SEQ ID NO: 28253 - DNA, 201 bp, Homo sapiens
gtggtcccacctgagccgcatgtggcaacctcgtcctctgagtaagccctctgggcctccctgtttcaggtgcgttcttcacaaaggtggtggatgtgggygccacctctctgaagcttgagatctgggacacagctggccaggagaagtaccacagcgtctgccacctctacttcaggggtgccaacgctgcgcttctgg

SEQ ID NO: 28254 - DNA, 201 bp, Homo sapiens
tgcttccaaccactcctgcttttcttctttccttttcaaaattcctccccttccccctttagggagcctccctcttgcccactgtggtgaggaagggagawgagactctgttcccaggaccagctgcccctgatgggtttcatattttttgtggggagcttctcttcctagataataaacacaaagtgataacattagaac

SEQ ID NO: 28255 - DNA, 201 bp, Homo sapiens; identical to SEQ ID NO: 5819

SEQ ID NO: 28256 - DNA, 201 bp, Homo sapiens
tgcattccttcagagtccacctgtttcagttaattcagacatgtttcgggctacagattttttgacttaggaaaggttttattaacctatgcaaataaatrgcaaagagaacttgaaggggtatctctgtttattttaaattattttttatttcaatagattttaggggaacaggtggtatttggttacagggatatgttc

SEQ ID NO: 28257 - DNA, 201 bp, Homo sapiens; identical to SEQ ID NO: 5821

SEQ ID NO: 28258 - DNA, 201 bp, Homo sapiens
tggggtgcagggaggcttccgtggaggcagggggcccagcagcccttccggggttgccgctggaagatctcagaggatgcctaagagttttctaggtgaasaagaggaaggataccatgcagaggggacagtagagaagggtgttggtggggagcagcattgggaaagtggggaggttagcaggaggcgaggaaggccttg

SEQ ID NO: 28259 - DNA, 201 bp, Homo sapiens
gccaggagaagtaccacagcgtctgccacctctacttcaggggtgccaacgctgcgcttctggtgtacgacatcaccaggaaggtagggcccgccttgagkcacgtcccaccctccttcccaagcacctgccttctggtttctccagtgcaatgatgccatggcgtaatcacaaggaacagagactccattagtgagcaac

SEQ ID NO: 28260 - DNA, 201 bp, Homo sapiens
ttcccagctccaaggaaaacagaattctagcagtgattcctagtcttggctgcatactgagatcacctggagagcttttctttttctttttctttctttttcttttcttttttttttttttaagaaacacagatggaaaacttaatgttatgttttttatccgtctctgaagccagcatcatacttgatggtgaaacttga

SEQ ID NO: 28261 - DNA, 201 bp, Homo sapiens
ggcatggggtgcagagggaagcaggagtgtggacctaggtggcctctgagttgggagctctgtattgggccatctgctcctgaccgagaagcagccccggsgttgagcttgctgagatgatgtggctccgatgttccacttgcttcagacggttgtgattctttgcagggcatggcacaggcacacaggaccccccagccc

SEQ ID NO: 28262 - DNA, 201 bp, Homo sapiens
gttcccagctccaaggaaaacagaattctagcagtgattcctagtcttggctgcatactgagatcacctggagagcttttctttttctttttctttctttttcttttcttttttttttttttaagaaacacagatggaaaacttaatgttatgttttttatccgtctctgaagccagcatcatacttgatggtgaaacttg

SEQ ID NO: 28263 - DNA, 201 bp, Homo sapiens
cccggagctttccaagcaaagctccttttgttccttaccacagacctaaaaatggacctaaaaattgcagatggggagatggggcatggggtgcagagggragcaggagtgtggacctaggtggcctctgagttgggagctctgtattgggccatctgctcctgaccgagaagcagccccggggttgagcttgctgagatg

SEQ ID NO: 28264 - DNA, 201 bp, Homo sapiens
gaacaaccacccaagaaatgctcagatgctttttacctctccttgcattagatactttggggacaagtaatagatttgtaaaaactgaaagtaatggaagraggacaacaagccctgagaccgtcacatgtaatcattgcttttcagggtctgcaatgacccgtgcccggagctttccaagcaaagctccttttgttcctt

SEQ ID NO: 28265 - DNA, 201 bp, Homo sapiens; identical to SEQ ID NO: 5823

SEQ ID NO: 28266 - DNA, 201 bp, Homo sapiens; identical to SEQ ID NO: 5824

SEQ ID NO: 28267 - DNA, 201 bp, Homo sapiens
ctgtgctgggctgggcgacttccctccctagccagccccctcctcttgctgttcacagcccaagagctactgcagagaagcgacgaggagggccaggctcyacggggggatgcagctgtggctctgaacaaggggcccgcgaggcaggccaaatgctgcgcccactaggtgcagccactcctgggggctgtggggaagaca

SEQ ID NO: 28268 - DNA, 201 bp, Homo sapiens
tggcactcacactttcatacacgcacacccacacacgcacacacttacacatgtgcacacacacctctacacgcccacatgcatttacacacatgcacacyccccacattcactctcacttgcacccacacacatttacaagtgaacacacacacacgcacacacacacagctttccacctgagtttctcttttagtcaaa

SEQ ID NO: 28269 - DNA, 201 bp, Homo sapiens; identical to SEQ ID NO: 5807

SEQ ID NO: 28270 - DNA, 201 bp, Homo sapiens
gtttcatattttttgtggggagcttctcttcctagataataaacacaaagtgataacattagaacattattagaatgtcaccattttgcaaccccttagtraaatagtgggtcgaagtaatagtcttcagtgactgccaacatcacagaaagacaactggacattatttgccttctgtgggaagtgcacgcacactctcat

SEQ ID NO: 28271 - DNA, 201 bp, Homo sapiens
ggtcctggctgctcaggagtgccaagaaacacaacttggacacgaaacgtggaggagtgcgggctccacggctgcagctttctcggatcttactgttggargtgaaccaggtgtccttaggaaactctcttataaacagcgctggattttgtggctgtttccttcaggaagggaaggagtttgccgacagccagaagttgc

SEQ ID NO: 28272 - DNA, 201 bp, Homo sapiens
tgcccagcatcaaagcccacaggtgccaacaggcatgatgggaggggaacctgggggtggggacttggctttccaggccctgcaggaggaggaaggccgcmccccgccagctagaggaagagcctcttccagggagcacaccccgcccctccctggtcctggctgctcaggagtgccaagaaacacaacttggacacgaaa

SEQ ID NO: 28273 - DNA, 201 bp, Homo sapiens
tcctagataataaacacaaagtgataacattagaacattattagaatgtcaccattttgcaaccccttagtaaaatagtgggtcgaagtaatagtcttcartgactgccaacatcacagaaagacaactggacattatttgccttctgtgggaagtgcacgcacactctcatggcaatcttgccaaaaaatagcctgtatc

SEQ ID NO: 28274 - DNA, 201 bp, Homo sapiens
ttcttcaacacatgaactgcaaagaaaaaaaaatacctgtatctctactgagatttgcagatgatagaatgcctgggatctgctttacacagtaccctgcrgggggaggtttgggagtgtgagtgatacaaatggctgagctgattactggggaagcgggaggtgggtctatgggcccatcggaccgttctctctattgtg

SEQ ID NO: 28275 - DNA, 201 bp, Homo sapiens
cctgggcctggtcagggtgaaggatctgatgtgtgtcctagcagttttctgcctggccgcacaggtcacccaggacaggaacgtgccctcctcagaggaayggagcagccctgcaggtgcgcccatggccagttggattctgtgacattttacacaacgtgatcagcaacactggcttccccctcccggaatagctaatga

SEQ ID NO: 28276 - DNA, 201 bp, Homo sapiens
tctgaaacaccaactttaatccatgaacaaccacccaagaaatgctcagatgctttttacctctccttgcattagatactttggggacaagtaatagattkgtaaaaactgaaagtaatggaaggaggacaacaagccctgagaccgtcacatgtaatcattgcttttcagggtctgcaatgacccgtgcccggagctttc

SEQ ID NO: 28277 - DNA, 201 bp, Homo sapiens
caggactgtgactgcccctttcccctcctccctcaccactaggcaggtggggctcaaccctgtgctggagtcacctgcggagcttcggaaagccccacacyggggcagggtgcggtggctcatgcctgtaatcctggcacttcgggaggccgaagcgggaggaccacttgaggccaggagtttgtgaccagcctgggcaac

SEQ ID NO: 28278 - DNA, 201 bp, Homo sapiens
atacacgcacacccacacacgcacacacttacacatgtgcacacacacctctacacgcccacatgcatttacacacatgcacaccccccacattcactctyacttgcacccacacacatttacaagtgaacacacacacacgcacacacacacagctttccacctgagtttctcttttagtcaaagatttccggtctttcc

SEQ ID NO: 28279 - DNA, 201 bp, Homo sapiens
cccaccccgccctcaggtggcatcagcccaggatctgaccctggactggctcacactcagttgcctctggccagtgcagggctcagccagggatggcttcyagctgacagtgggaggaattaattcatctgaccggaatattcttttctcttctgggctgttggtttttcaagtgcaacaaagattccatacagctccaag

SEQ ID NO: 28280 - DNA, 201 bp, Homo sapiens
gctccaaggaaaacagaattctagcagtgattcctagtcttggctgcatactgagatcacctggagagcttttctttttctttttctttctttttcttttyttttttttttttttaagaaacacagatggaaaacttaatgttatgttttttatccgtctctgaagccagcatcatacttgatggtgaaacttgagtattt

SEQ ID NO: 28281 - DNA, 201 bp, Homo sapiens
tgggcaacaagacggacctcagccaggagcgggaggtgaccttccaggtaccgcccaggagaccctgctctgctcttccacagcaggagagagccctgccygcctgtgtcaagaccttggcactcacactttcatacacgcacacccacacacgcacacacttacacatgtgcacacacacctctacacgcccacatgcat

SEQ ID NO: 28282 - DNA, 201 bp, Homo sapiens
ctgctcccttgctttatttaccccaacagcatcttccttcctgcctggacttggtttaccagcttggcctggattgggggtgggaagatcattttgggggkgggcggggagggagaccttctctctgtgtttcttaaaaaggctaacctgtcatgaagctcaggagtaactgtatggggcatctgcaggctgctggcctcc

SEQ ID NO: 28283 - DNA, 201 bp, Homo sapiens
tgcacctggagtctcccatgtgcacggaggccacgcccccaccccgccctcaggtggcatcagcccaggatctgaccctggactggctcacactcagttgyctctggccagtgcagggctcagccagggatggcttctagctgacagtgggaggaattaattcatctgaccggaatattcttttctcttctgggctgttgg

SEQ ID NO: 28284 - DNA, 201 bp, Homo sapiens
ttttggtgagacaagatctcgctctgttgcccaggctggagtgcagtggtatgatcatggcccactgcagtctcaacctcccaggctcaagcaatcctccygcctcagcctccctagtagctgggaccacaggcatgcaccaccatgcccagctaattttttaacttttttttagagatgagggtctcactatgttgccct

SEQ ID NO: 28285 - DNA, 201 bp, Homo sapiens
ggaccccccagcccagggctgcccccagccagccccgtgtgttcaagctggttctcctgggaagtggctccgtgggtaagtccagcttggctcttcggtaygtgaagaacgacttcaagagtatcctgcctacggtgggctgtaagtgagggcagagcacccctttgttggtcttcagtgcagaagtctgggctgctgacc

SEQ ID NO: 28286 - DNA, 201 bp, Homo sapiens
atgcaccaaacacagaaacacaattgcaagatgtggcacatgacgttagctatttagggagcccttccattttctcaggggggtggttcctgaaggatccycaggggatacaggggaattggcaggggtctgcctggcccgactcccagagctagtggtgagaagggccagggtgatggtgagaggctgtctgcagagggg

SEQ ID NO: 28287 - DNA, 201 bp, Homo sapiens
ggagaagtaccacagcgtctgccacctctacttcaggggtgccaacgctgcgcttctggtgtacgacatcaccaggaaggtagggcccgccttgaggcacrtcccaccctccttcccaagcacctgccttctggtttctccagtgcaatgatgccatggcgtaatcacaaggaacagagactccattagtgagcaacagtc

SEQ ID NO: 28288 - DNA, 201 bp, Homo sapiens
cagcatcaaagcccacaggtgccaacaggcatgatgggaggggaacctgggggtggggacttggctttccaggccctgcaggaggaggaaggccgcacccygccagctagaggaagagcctcttccagggagcacaccccgcccctccctggtcctggctgctcaggagtgccaagaaacacaacttggacacgaaacgtg

SEQ ID NO: 28289 - DNA, 201 bp, Homo sapiens; identical to SEQ ID NO: 5820

SEQ ID NO: 28290 - DNA, 201 bp, Homo sapiens
ctgggaagggcagctgggggcagtggcgccagttcccttccatggtctcccggctggcaatgtggtgaagctgagtttctgtccaatgagcaggaagattytgagacatttcgcctgagatataagttgtactgcgtatgcagtttttcctccaaaaattaaattgcttttgacaatctggcttttagaagtttttgagga

SEQ ID NO: 28291 - DNA, 201 bp, Homo sapiens
taggaatccccatgctgggaccttgagctgcctgtgtccagtgcgtgaggggagggggtgaggtccaagagggcagccacagaatctacaaagacaggaartgcccttggctctgggtcaggtttcagctcagctggagtctgcagggggtggagattctggggtaggacctctggccccaaagggtcgggctgggtgcga

SEQ ID NO: 28292 - DNA, 201 bp, Homo sapiens
tagatttgtaaaaactgaaagtaatggaaggaggacaacaagccctgagaccgtcacatgtaatcattgcttttcagggtctgcaatgacccgtgcccggrgctttccaagcaaagctccttttgttccttaccacagacctaaaaatggacctaaaaattgcagatggggagatggggcatggggtgcagagggaagcag

SEQ ID NO: 28293 - DNA, 201 bp, Homo sapiens
aaggcccgtggggacttttttctgggttggtcaggctgccagcactggaccagtgaccagtcctcgtgtcactcgagtgggacttggacacatcacaggcygcctgggctggctgggggtgcacacgcatccctgggcagcagccctgcaaagaccatctgaacctaaatcctatcaagcacctctctctagtgagagttc

SEQ ID NO: 28294 - DNA, 201 bp, Homo sapiens
ccggcatgaaatggggaggagctactgaagggttctgagcagaagagtgacatgttcgattacactactttggatgctctgtggagaatgggatgtagacrggcaagggtagaagcttcattagagcttggacatgaagccaggtgtaatatgtagcaggaacacatatgagatactaatctgtgttgggatttgggaagc

SEQ ID NO: 28295 - DNA, 201 bp, Homo sapiens
gtctttgacatttcacattttatttttagtaccatatcctttgtcagtgctcatcagaatgcacattaaaatgggtttattttatgcatattactgtaccrcaataaatttattacaaatcacatgacctttatgttagacattttaatacatcaataggaggtcacgtttcattcagaaaatagcagtttttccctcaaa

SEQ ID NO: 28296 - DNA, 201 bp, Homo sapiens
taggaccaccctgaggcccttcatgggccctgcccagagctgactctggccctactccagctcacacctgccagtggtatgaagtccactgtacccaaggkgggggtcctaccagagcccacatctcctcactagaccagactgctggtacccagtgtccctgccccaaaggttctgtgcccgccccaggaactgcacagc

SEQ ID NO: 28297 - DNA, 201 bp, Homo sapiens; identical to SEQ ID NO: 5846

SEQ ID NO: 28298 - DNA, 201 bp, Homo sapiens; identical to SEQ ID NO: 5848

SEQ ID NO: 28299 - DNA, 201 bp, Homo sapiens
gacccctcagagagcagcggccagcgagggtagatggtagcagccccgagctctcccaggagtcccacagtggacccctgtgatttggtcgccaaccaaaragaaagcttccgaatcgtgctcagcgcaggcaggggtgcaggaaaagatcggagagcgagtgggaaggaagactccagccagcagcttcctggggctggg

SEQ ID NO: 28300 - DNA, 201 bp, Homo sapiens
ctgctgctcccgccccactaccacagagctgctgggaagtggggggcgactgcccagccccgggatctcagagtgccgctgcctgcttactcagcactgcwaaaggaagcgcggtcctgtgctgctgtgttacagactcccgggcaggaaggttcagaagtccccaaggggaaacagacatgaacctggtctagccactga

SEQ ID NO: 28301 - DNA, 201 bp, Homo sapiens
atccgggggcacactttccacacagatcatgagagtgacttggcccctcagagagcagcggccagcgagggtagatggtagcagccccgagctctcccagkagtcccacagtggacccctcagagagcagcggccagcgagggtagatggtagcagccccgagctctcccaggagtcccacagtggacccctgtgatttgg

SEQ ID NO: 28302 - DNA, 201 bp, Homo sapiens
ataaaccgtgttttctacagaataatgatgcaagtagagtgaataataagaaacagactggccgggtgtggtggcttatgcctgtaatcccagcactttgrgaggctgaggcgggcggatcacttgaggtcaggagttcaagaccagcctggccaacgtggtgaaaccccatctgtaccaaaaatacaaaagttagccaga

SEQ ID NO: 28303 - DNA, 201 bp, Homo sapiens
gtgttttaaagtgtccaaaaagagcaggaaaagctcagaaaatccgggggcacactttccacacagatcatgagagtgacttggcccctcagagagcagcrgccagcgagggtagatggtagcagccccgagctctcccaggagtcccacagtggacccctcagagagcagcggccagcgagggtagatggtagcagcccc

SEQ ID NO: 28304 - DNA, 201 bp, Homo sapiens
gaagggacacccagagcatggggctggggtgaaggcaggggtgggggctcggggacacggggcccaggtctcgggcacattctccgtgtgtggactgtaccacctgccgctcctcacctgagcggagacaaaggtctcaggtgagccagcctcagaccctggaggcttcactcccgcctcacctcatcagggctgccaaga

SEQ ID NO: 28305 - DNA, 201 bp, Homo sapiens
taactgggagtccatcgtcctgtctacacctcctcactctagcccaatccccctgtgacaccaaagagtgtcaacatggtggccagtgccaggtggagaayggctctgcggtgtgtgtgtgccaggccggatacaccggagcagcctgcgagatgggtgagtggcctggcttcggattggagaggggctcctgcccgtggc

SEQ ID NO: 28306 - DNA, 201 bp, Homo sapiens
ttaatcgtggccacattgctttattcttgggctctctcctctcagaaatcgatgagtgccggtctcagccgtgcctgcatgggggctcttgtcaggaccgygttgctgggtacctgtgcctctgcagcacaggctatgagggcgcccactgtgagctgggtaagaggggccctggccccgctggggtgacagctgcagcac

SEQ ID NO: 28307 - DNA, 201 bp, Homo sapiens
gccaccctcgaggagtggaggagcccagatgcccagggaaaggcccatatctgggtagggggcaggagccatgaccagtcacacaggcttcctagaccatrgcattcggaccagggatggggcctcagaacaggccagtgcccaggtcccaaaccaggccaggatcagggtcagacaggcaccagagcccggatgggagcc

SEQ ID NO: 28308 - DNA, 201 bp, Homo sapiens
acctgaaatattaatgtatctttttaaatgcttgcctagcacatccactcccataaaaacaaatcagaaacccccaactaattatcaaatactgacttatwgaatacctattcttgaaataatggagacaacacacaaaaaagcaggaaacagaaacacacgcacccagacacccatccaagaacaacacgagaattcatt

SEQ ID NO: 28309 - DNA, 201 bp, Homo sapiens
gatcttcagcaacctgcagaacgatattagggtaataggatccacgtatctggagtctgcgaaggaggatggagaacagtatcaagcagcctgggatccaygtatttggagtctgtgaaggaggatgaagaacagtatcaagcagcctgggatccatgtatgtgcagtctgcaaaggaggatggagaacaatattaagcag

SEQ ID NO: 28310 - DNA, 201 bp, Homo sapiens
gactctgtcggtcacacagtccatttagtcaacagatgacttactgagcacctgctgtgtgccgggcactgtccatttagtcaacagatgacttactgagyacctgctgtgtgccgggcactgttctagatactcagcacacatcagaacagagcagaccaaagccctgccttcaggacccgttcattgcagatgagggga

SEQ ID NO: 28311 - DNA, 201 bp, Homo sapiens
gcagacacctttaaatatgtgcttgcctcaagcacaggcccggccgtctgagctcctcgggttccaggaactgttaggacccagggaaaatgtggcaatgycaatgcaggtacagaacacacagaaatccagattgactgctggggaccctgatgtcacggcagatgagactcagctgcttcctgtcagatggggaatgcc

SEQ ID NO: 28312 - DNA, 201 bp, Homo sapiens; identical to SEQ ID NO: 5850

SEQ ID NO: 28313 - DNA, 201 bp, Homo sapiens
aggcaagcaaagggcccacctgtgactgagttggggtctccagcctgtgagccccaccccagcccccaccatgtgtgcggacctgcttggcccctgctgcrgccaggccccagggcttcgtcgagaaggccccaccagcaccagaggactgaggagatgccaggagggtatagtggctctgtggggccagcagcctggccc

SEQ ID NO: 28314 - DNA, 201 bp, Homo sapiens
catcagagtcagcctctacttactgcccttcccccggcacctctttaggcccctcacccatgcccttcacccacctggtaaagaaaggtggacccccccccaattcctgctctccatctcaccatagggctctgctcagggagctttgcaaagggagcccctaaaatcaaagcaccgtgacctgctgctccccacccagct

SEQ ID NO: 28315 - DNA, 201 bp, Homo sapiens
gcaggctcctggtccccaggcccccaggccttccttcccacacatcagcccagtccccactggatggcagagccaactgatgtgaccttcctctcttctcytcctcagagccccctggaaaaacaaacagctcatgagaatgccggccccagttctgccattaactcatgatgtggccttaggccccccatctccaaaatg

SEQ ID NO: 28316 - DNA, 201 bp, Homo sapiens
catgggataccagtgccaggcaggtgagatggccagggcccaagcagggtacatgggataccagtgccaggcaggtgagagggccagggggccaagcaggrtatatgggataccagtgccaggcaggtgagagggccagggggccaagcagggtacatgggacaccggtgccaggcaggtgagagggtcggcggggggggg

SEQ ID NO: 28317 - DNA, 201 bp, Homo sapiens
taggcagctgaggcagaaaaaccgaataactgccccaagtccatgcagctcaggagcaggggctgagaagaacgcaggctcctggtccccaggcccccagrccttccttcccacacatcagcccagtccccactggatggcagagccaactgatgtgaccttcctctcttctcttcctcagagccccctggaaaaacaaac

SEQ ID NO: 28318 - DNA, 201 bp, Homo sapiens
gcccaagcagggtacatgggataccagtgccaggcaggtgagagggccagggggccaagcagggtatatgggataccagtgccaggcaggtgagagggccrgggggccaagcagggtacatgggacaccggtgccaggcaggtgagagggtcggcggggggggggggggtcaagcagggtacatgggataccagtgccagg

SEQ ID NO: 28319 - DNA, 201 bp, Homo sapiens
gaaatgatgctgaaaaaagtagaaggaaagaggaataaaggtaaaagccataattaatgaagtagagatccaagatacaaaagaaaggacaagccaaaatyagttctttgaaaagcctaatgtaacatgtttagtggatatagattacaacaaaattaattatgtgcttatgtatcagcaaccaacaattagaaaatgtaa

SEQ ID NO: 28320 - DNA, 201 bp, Homo sapiens
ataaaaaagacagatacagagaaagatcaatgaaaccaaaagctatttccttgaaaagatcattaaaattgggccgggcgcggtggctcatgcctgtaatygcagcactttaggaggccgaggcaggcacatcacaaggtcaggagatggataccatcctggctaacacggtgaaaccccgtctctactaaaaatacaaaa

SEQ ID NO: 28321 - DNA, 201 bp, Homo sapiens
atgagacattttctgtcaaacccctgaggcctttgtcctgtcggcctgaaccactggaattaagtcccacagcgtcttctgggagccctggggtggtttcragcccgccctgctgcttcacagacacagccaggcactgagccccaggcccactgccctgccccgactccaaggatatccagccctggtctctggcctttc

SEQ ID NO: 28322 - DNA, 201 bp, Homo sapiens; identical to SEQ ID NO: 5844

SEQ ID NO: 28323 - DNA, 201 bp, Homo sapiens
ctgacatccaagacaaagattttacaaatatcccttcctgcacctccccaggggagactgagagcccagctgagaaatgctggcctggcttcagggcgcasagaaggtgggcgtcggagagggcaggtcacagtctctgacacctggtcggtgcttccagccagtggagggaggggaggcctgccccatgagccctgcaca

SEQ ID NO: 28324 - DNA, 201 bp, Homo sapiens
gggcaaggccgcagcctgcagctcaccagccgtgctgctcggcctgtgcacgtcaccggctcttccctagggtagcttttgcttgctttctcccacgtccrtcctctctctctctgactcacagccagccaggtttctagccttgtcattcctaaactactgcctcaagccaggcgggcgcacacaaactaaaatgctaat

SEQ ID NO: 28325 - DNA, 201 bp, Homo sapiens
gctttgctcttcctgccccttataggagccctcacagttcatcttcctggtggcgcagatgagtgaggcacccttgggtaacaagccacttcaaaacaggyctatgttttgttacgtgcctaaaaaaataaaggagaaatgtcattcaggaacctttaaaaacaaacagaagcaaaacagcttttcagatataggctcaca

SEQ ID NO: 28326 - DNA, 201 bp, Homo sapiens
tccagagccagaggacagttaccagggccccaagtcaggagtgtccctggcatgttgggggagaagtggagagtggtgagaggtgagggacagggaacccwcggggccatggagacccacagaaggactctggtgtttgtccggcatgaaatggggaggagctactgaagggttctgagcagaagagtgacatgttcgatt

SEQ ID NO: 28327 - DNA, 201 bp, Homo sapiens; identical to SEQ ID NO: 5845

SEQ ID NO: 28328 - DNA, 201 bp, Homo sapiens
gtgtaagttggtttctgtcctccgccttaccgcatttgtcgtgtgttcttgactcctcaaagtgctgtctcaaagctacccagctaaccctgaggagggaygatggctgcagtcacagaagggacttgctttgaccatcgattccctccatgtcacaaattaggcagctgaggcagaaaaaccgaataactgccccaagtc

SEQ ID NO: 28329 - DNA, 201 bp, Homo sapiens
cttgcccaggccccttccctgaggaacagggaggggataaaatcccccggtgggcttgaaacacggtcacacattcaaaagtgtgaccctcctggaggtaygtggccagggacaaagaaggactctgccagcgatggctgtgtcaggcccaagagccagacccggctgagccgccgacgggagccaggcatgcatagctaa

SEQ ID NO: 28330 - DNA, 201 bp, Homo sapiens
ggccctgttcagccccctctccccggcaggtcaacacattccagactgtgctcatcacagacggcaagctctccttcaccatcttcaactatgagtccatygtgtggaccacaggcacacacgccagcagcgggggcaacgccactggcctcgggggcatcgcagcccaggtaggcgagtgcagtcggtgctctgtgttca

SEQ ID NO: 28331 - DNA, 201 bp, Homo sapiens
tccaatcctgggtggtctctccggtgcttcttgttctgtccaatcctgggtggtttctctggtgcttcttgttctgtcgaggaaggagctgggagatgctragctccatggggtgcagcgcagctacaaatccatttccagaaataagcttctggcttaaattccacttgggaatgacaacagaggtgaaaacccaaaggt

SEQ ID NO: 28332 - DNA, 201 bp, Homo sapiens; identical to SEQ ID NO: 5843

SEQ ID NO: 28333 - DNA, 201 bp, Homo sapiens
gcgaaggaggatggagaacagtatcaagcagcctgggatccacgtatttggagtctgtgaaggaggatgaagaacagtatcaagcagcctgggatccatgyatgtgcagtctgcaaaggaggatggagaacaatattaagcagcctgggatccacgtatttggagtctgcgaaggaggatggagatgggtgtggaaaggag

SEQ ID NO: 28334 - DNA, 201 bp, Homo sapiens
tcaaactgatcctaagtcattgagccatgtgccagaataaaatcctatactcctcaacaggagtatatcaataatacaacagaatccagaactccaaaatrcccagtcaaaaattatcaggtctacaaagaagtaacatataactcacagtcaggagaaaaatagatcaatagaaacaggcaccagaaatgacagaattag

SEQ ID NO: 28335 - DNA, 201 bp, Homo sapiens
gtcttcccacagccagtgtcggagcaagctccattcataggagcctttcttcatccagaaactcctgccctgcttgcccacgtgctctcaacgtgagacgkgtgggagtcgggcttctgtggcattggtgccgtggcagactcagccctgcaggcgtctgtcccttggtaaaggccagggaggctggcaggatctccttcc

SEQ ID NO: 28336 - DNA, 201 bp, Homo sapiens
caggggagactgagagcccagctgagaaatgctggcctggcttcagggcgcagagaaggtgggcgtcggagagggcaggtcacagtctctgacacctggtsggtgcttccagccagtggagggaggggaggcctgccccatgagccctgcacactcttgtacctcgctagggctctaagcctgagaaacgcagggtccagg

SEQ ID NO: 28337 - DNA, 201 bp, Homo sapiens; identical to SEQ ID NO: 5853

SEQ ID NO: 28338 - DNA, 201 bp, Homo sapiens
cgtgcccagtcgtggccctggggagcctcccattgcggagtggcctggaggaaggcatggcctggaggtggggctttgccagcaggcagtggaggtggcaygcctcccgaggaggggtgggtttggggctgatggaagaaaaagcacatgtcctgagtagttgctcccagctgggaaaggggtaactgaagccccaggaaa

SEQ ID NO: 28339 - DNA, 201 bp, Homo sapiens; identical to SEQ ID NO: 5856

SEQ ID NO: 28340 - DNA, 201 bp, Homo sapiens
gatacaggcatgggattggggcgcatagaatcgagccaagagtgggagcagcacaacccccaggcatggagctaggaagtgggactggggaggaatggggscttcccaaaagggtccctagaaggagccagtgtgggagacaggggccgcgggggtgggcttgggggggctgggactctggggtgctctgaaggcctgggg

SEQ ID NO: 28341 - DNA, 201 bp, Homo sapiens
ccagacacaggagcaagaatggggaaggggtgctagaggctcgaggaaagaggaaaaggtgctgagagcacagactgctgcgaagtggcgtgatggatggrtgggtgggtgggtggccagggcttcagggaggcctaagcatccagcagggccctgcggggcggccacgtgagtttggtgaaacctatgggtagcatggcg

SEQ ID NO: 28342 - DNA, 201 bp, Homo sapiens
agactccagccagcagcttcctggggctggggtggcattggcctcacgttgtcctgtggtttcctgagaatttacatcaactcacctgtgctgagggcccrtcccccatccctgcacagtgaccacttcccccttctctggcctctcccagctgaacaccggccctctgaccatactgtagcagccccaagcgcacccgat

SEQ ID NO: 28343 - DNA, 201 bp, Homo sapiens
acaccttatacaaagattaactcaaaatggatcatagacctaaatggaaaaacataaactataagatttttagaagaaaacataggcaaaaaaaaaaaaaatttatgacctggtcttaagcaaagtgttcttagataagacagcaaaagcatgattcattaaaaagaaaaagataaattagacttcatcaaaatttaaaac

SEQ ID NO: 28344 - DNA, 201 bp, Homo sapiens; identical to SEQ ID NO: 5855

SEQ ID NO: 28345 - DNA, 201 bp, Homo sapiens; identical to SEQ ID NO: 5854

SEQ ID NO: 28346 - DNA, 201 bp, Homo sapiens
ggaggagccgtcaggagcacctggtgagccactgcccttctttgtcgcagcctgtataaaggtgtcccgcccctgcacaaggctgttctccgagacaaagkcctttccagtctgggagggaggcgtctgtcaccacgtgtaagttggtttctgtcctccgccttaccgcatttgtcgtgtgttcttgactcctcaaagtgc

SEQ ID NO: 28347 - DNA, 201 bp, Homo sapiens
catatgggtaaactggatttttcatctcttcatgctaaaaagtccctttttcccccactgtcagtatcaaaattccacatataaaagtagaattctggcgrcgtcaatttgatacatctgtgccaatactgccctgtgttcactctaactttgtaagtcctggaactgattggcaaagttcctttcctttactcttcatct

SEQ ID NO: 28348 - DNA, 201 bp, Homo sapiens
tacatgtgtgttcctcaccctgagtcagactctacctttctcctggttctaatcctttggggctgtgtcctctatggacagctctcctagcacccggtgayctgttctcccctgagtcataccatagactcagattgggatcacccctcaacccaaccccaaagaagtcctagtacttggtaaaggtgtgagctgctgagc

SEQ ID NO: 28349 - DNA, 201 bp, Homo sapiens
cctaataaacactttttaagagcaccttccaagtgacaggcaagtgttctaggcactgggcagacagccctggacgaagcagacaagacgcatctgccccrtggggtcactctagcaaggcatcaggaagtgctcagaagcataacccagccaggggcacttccaggagcaggttcattgacagaaagtggacagttcagc

SEQ ID NO: 28350 - DNA, 201 bp, Homo sapiens
gggctccctgacccagccagagcggtgtcaggagaagggactctccacccccacaataccaacccaccccggccttagaggaagccagctgcagacccccrggccctctcccaccatcccgccttggaggaagccagcctaaggacccccgggccctctcccttgggcaaggcctctcaagaggggcaggaggagccgtca

SEQ ID NO: 28351 - DNA, 201 bp, Homo sapiens
acccctgtcagaacggaggcacttgtgtgccgggcgcagacgcccacagctgtgactgcgggccagggttcaaaggcagacgctgcgagctcggtaagtcrgggcttggcctcagggcgccccttccaacacagcctgtgcctcagcctaggactgctgggccacagctgggtttgccacgggagcctccaaacgatgagg

SEQ ID NO: 28352 - DNA, 201 bp, Homo sapiens
ggcccttcccaccgggtttactgggtgagtgccgctctgggaatctgcctgtgattctgacacagaagccctgagacatgttggcaggagtgaggcaggcrcgaccctgccccagaggggacctctctggcccttgcctctcacctggaaggccaggtggtcatcctcatggaactccccaacagagcctagtcaccagtt

SEQ ID NO: 28353 - DNA, 201 bp, Homo sapiens
ggccatgagggtctaacccgccactccgagtgtggtccggcaaatcctccgccactgtcctggcaagatcttcccggtggcagcaaggctgatgggcccargtgccttgggcccttcccaccgggtttactgggtgagtgccgctctgggaatctgcctgtgattctgacacagaagccctgagacatgttggcaggagtg

SEQ ID NO: 28354 - DNA, 201 bp, Homo sapiens
cagcatggaggccggtgtgagagcggcggcggggcctacctgtgcgtctgcccagagagcttcttcggctaccactgcgagacaggtagggcggcaggccygcctgctccccgccctctgcccgcctgctccccgccctctgcccgcctgctgcccgccctctgcccgcctgctccccgccctctgcccgcctgctccccg

SEQ ID NO: 28355 - DNA, 201 bp, Homo sapiens
cccagctactcgggaggcggaggttgtggtgagccaagatcatgccactgcactccagcctgggcaacgagcgaaactccatccccccaaaaaaaaaaaaagaaaaaaagaaaacaaaaaaaggaaaaagtctagaaccaacccaaagacccagccagtgagaatgggtgaagtatgatataaccacactgtgtaatgtta

SEQ ID NO: 28356 - DNA, 201 bp, Homo sapiens
ccaaccaaagagaaagcttccgaatcgtgctcagcgcaggcaggggtgcaggaaaagatcggagagcgagtgggaaggaagactccagccagcagcttccwggggctggggtggcattggcctcacgttgtcctgtggtttcctgagaatttacatcaactcacctgtgctgagggcccgtcccccatccctgcacagtga

SEQ ID NO: 28357 - DNA, 201 bp, Homo sapiens
tcagggcacatgctggggtggggactcccagctgaagcgtcccatcaggaggccactggggagaagcactgtgtctccagggcagcctgggacctgagtcygagcccgagtgcccagccccttgagaacttgagtgacgggcaggggcctagactcagccctgcctcatgactcccaggccagtgcacgcctgtgtcatgg

SEQ ID NO: 28358 - DNA, 201 bp, Homo sapiens
ttgagcccagcctgtgcagcatagagagacccccaactctacaaaaataaactaaaattaaccaggcgtagtggcatgcacctgtagtcccagctactcargaggctagggtgggaagatcacttgaaaccggagttcaaagctgcagtgaactgtgattgcaccgctgcattccagcttgggggacagggtgagaccctg

SEQ ID NO: 28359 - DNA, 201 bp, Homo sapiens
cccgggaggcagaggttgcagtgagccgagatcatgccactgcactccggcctgggtgacagagggagattccatctcaaataaaaaaaaaaaatctacaygttcatactcggagccacatttagaagtgccagtttccattgttcagttcccacctatgagtgagaacgcttggacacaggaaggggaacatcacacacc

SEQ ID NO: 28360 - DNA, 201 bp, Homo sapiens
tcagggccgagcacactgcggcctgtctcctcacctctgctctctctcaacacctgaactgggaccacgctctagggcccagaggcgtttgggaggccacygcagcacaccacagaggagtgcacggccaccctgcatcaggtcatcaaggaagggacagcaacatgtccatgaggcaggcctgtcctggggttccagtga

SEQ ID NO: 28361 - DNA, 201 bp, Homo sapiens
ctgcactccggcctgggtgacagagggagattccatctcaaataaaaaaaaaaaatctacacgttcatactcggagccacatttagaagtgccagtttccrttgttcagttcccacctatgagtgagaacgcttggacacaggaaggggaacatcacacaccagggcctgtcgtggggtgggggggtcgggggagggatag

SEQ ID NO: 28362 - DNA, 201 bp, Homo sapiens
gcagggaaaataggaagcaaaagatggatgctgcctccagggtgctgtgtgaggctgagcaaccccttcccctctctgggccttggtttccatctgtgaartgccaggagggatgacaaagttcacaagtctcctcttccagcctgggtgactcttgacttttttaacatcttcctctcctactctagaaccctcagcaca

SEQ ID NO: 28363 - DNA, 201 bp, Homo sapiens
ggaagggggttgatggcagaggagaggtggagacgaagggggctggatgctgacggggagagcaggagcacttgggtgtccagcccagcccacctcaggcrtgtgaaactaaggaaagcctggctggtcctgcagcctcagcttcccctagagaagaccccacacacacactgctctgggttggagggaaccctctggaga

SEQ ID NO: 28364 - DNA, 201 bp, Homo sapiens
cccgcacacacactgctgtgggttggagggaaccctctggagactgcgggtttcgggggtaaagagttctgggtcctcaggggaggaggagcccagggacrcctctccctgggaccatgtggtccctactctccccttattcccacccagcctcctgcctgggctgggggaggagcagcatgtggtctctgaccctcaggg

SEQ ID NO: 28365 - DNA, 201 bp, Homo sapiens
catgtggtctctgaccctcagggccacccatgaggcaggtcctcttaccacccaggtcctcatttttgccagcgggcttgctgcttggtgggatttggtgwctgcttgacaaacccaagcatcacgtctacaggggagttccaggggtccttccagcccacagtgcacaaacggacggggtgggtgtccctcccaggggtg

SEQ ID NO: 28366 - DNA, 201 bp, Homo sapiens
gcttgctcctcctccgtccccggcccaacccgagcccttagagaaaactcctcatccgggttcccgccgctgaggcctcagcctgccccatgtttcagacrtgaacgaatgtgcctcccagccctgtcagaatggtgggacctgtactcacggcatcaacagtttccgctgccagtgcccggctggctttgggggacccac

SEQ ID NO: 28367 - DNA, 201 bp, Homo sapiens
aagattgtgctgtacgtgccagcccacaccccgcctcggcactgtaccattctccataataaagaatctggcttccagcaaggctgcggcagcccatgtcsggttctcaaaccttgttcttgccagaagaccctgtgggcaccccctcacctctccctgctcctgcctcatccagggcccctgcctccagcaaacctgacc

SEQ ID NO: 28368 - DNA, 201 bp, Homo sapiens; identical to SEQ ID NO: 5857

SEQ ID NO: 28369 - DNA, 201 bp, Homo sapiens
acgtgccagcccacaccccgcctcggcactgtaccattctccataataaagaatctggcttccagcaaggctgcggcagcccatgtccggttctcaaaccktgttcttgccagaagaccctgtgggcaccccctcacctctccctgctcctgcctcatccagggcccctgcctccagcaaacctgaccgccgcccgagtca

SEQ ID NO: 28370 - DNA, 201 bp, Homo sapiens
agaaggagcagtgggaaaatgcaggagcagaacagggagagaagaaagagacggagacaagcagggaggagaggccacggcgggacagagcagagcagtgygcggctccccagggaagagagggctctgaccccaggctcctccccaacccgtgaggctgtgctggggacacgaagtgcataagcttgccgagttctcaga

SEQ ID NO: 28371 - DNA, 201 bp, Homo sapiens
aggccagcacgtccctgcagggcaccaagcatctgctgagcacctgcagtaagagttcccagacgctcacgaggcagttccccttcgggcagcaccaatayatgtgtgttcctcaccctgagtcagactctacctttctcctggttctaatcctttggggctgtgtcctctatggacagctctcctagcacccggtgacct

SEQ ID NO: 28372 - DNA, 201 bp, Homo sapiens
cccctcaacccaaccccaaagaagtcctagtacttggtaaaggtgtgagctgctgagcgtggtctcacccgcaaggccttgcccccagcttctcaaggacrtgtgtacacatcaagggcacctgcggtggggtgtgtttgcaagtggcggtttcgctgaaccctaagttcaccatcccccccccgccctcaccatacaagg

SEQ ID NO: 28373 - DNA, 201 bp, Homo sapiens
ccatcatactccctgttctctcccctcagttaaccatgatcctgaactttgtgcctagaattcctttgttttttcagagtggaaggtgcggggagtgattytatggtacatatatgtatggcagaacaataagtgagttttctttgcaagataattatcttgccatgtgtgatcgttagacctgtgttttcactccgcatt

SEQ ID NO: 28374 - DNA, 201 bp, Homo sapiens; identical to SEQ ID NO: 5847

SEQ ID NO: 28375 - DNA, 201 bp, Homo sapiens
acagagcgagactccgtctcaaaaaaaaaaaaaaagaattgagagtctggaaataaaccacacgtcaatggccaactgacttctacaagggggctgaaacyattcaatgtggaaagaatagtctcagcaaatggtgctgggacagctggatatccacatgcaaaaagaatgaggccggagccctcgtaccatatacctcat

SEQ ID NO: 28376 - DNA, 201 bp, Homo sapiens
cagcctgtataaaggtgtcccgcccctgcacaaggctgttctccgagacaaaggcctttccagtctgggagggaggcgtctgtcaccacgtgtaagttggyttctgtcctccgccttaccgcatttgtcgtgtgttcttgactcctcaaagtgctgtctcaaagctacccagctaaccctgaggagggacgatggctgcag

SEQ ID NO: 28377 - DNA, 201 bp, Homo sapiens
gcagtggaggtggcagaaccgaagggaggcagtagctgtcctgtgccccccgcccctccacacccacgcaggagggacccagtgccccaggagcaagggcsgggctggagcagggacccctggccacgccccaacatacactgccactttttctcccctcagtgagtgacccctgcttctccagcccctgtgggggccgtg

SEQ ID NO: 28378 - DNA, 201 bp, Homo sapiens
acccacagcctcggcgcagctcgagaacatggaggaagcccccaagcgggtcagcctggccctccagctccctgaacacggcagcaaggacatcggaagtragtcagcagcgctggtggggactttgggactgactgactgctctcaggggccttagaggctgcaggcaggagggaccacccacggtgaggaatcaggagg

SEQ ID NO: 28379 - DNA, 201 bp, Homo sapiens
gtcaccgcctggcttctcctagaacccacagcctcggcgcagctcgagaacatggaggaagcccccaagcgggtcagcctggccctccagctccctgaacrcggcagcaaggacatcggaagtgagtcagcagcgctggtggggactttgggactgactgactgctctcaggggccttagaggctgcaggcaggagggacc

SEQ ID NO: 28380 - DNA, 201 bp, Homo sapiens
atcccgggtgcaaagcagctgcgccgtgtggtcaccgcctggcttctcctagaacccacagcctcggcgcagctcgagaacatggaggaagcccccaagcrggtcagcctggccctccagctccctgaacacggcagcaaggacatcggaagtgagtcagcagcgctggtggggactttgggactgactgactgctctcag

SEQ ID NO: 28381 - DNA, 201 bp, Homo sapiens
ggcagaggaagagtgagcgccaggttcggtggctcacccagcaaagcagccaccgtgagatcacgtgagtgccagggcctccccacccaccttggtggccmaccctcgtcctcactgccactctcaccaggtcctgtcccctacatgatgagcccacccccaccgccagcgcagtctccagccagtgacccccaccccgac

SEQ ID NO: 28382 - DNA, 201 bp, Homo sapiens
agcgtcatgaagcttttgccctattgtttcttctaagagttttacagtcttagctcttatgtttaggttttggctctatattgagttaatttttgtatatrgtgttaggtaagggcccaacttcatccttttgtatgtggatgtccagttttgctggcaccatttgttaaaaagactgtcctttcctcactgaatgctctt

SEQ ID NO: 28383 - DNA, 201 bp, Homo sapiens
gggcaggggcctagactcagccctgcctcatgactcccaggccagtgcacgcctgtgtcatggctgcgcatggctcctcctcagaagggatgcggcgggtrggctggaagggaacccagggcatctggggaagccacaagcaccttggatgaccacggcccacgcacatgccccccttcccttctccaagcacggctgagt

SEQ ID NO: 28384 - DNA, 201 bp, Homo sapiens
ccctctgggctctgcctggtgcatcagcagtggcactggagcttcggaggagactggctgggcgggaagcggagctcacaagtggccccttccctgcagtygctgggagttctgtatgtctgtcctcctaagacagcgttgcccagaccaggcccggatgtgtgctcttagaccaaaatagtcaactggcacagaaaaggg

SEQ ID NO: 28385 - DNA, 201 bp, Homo sapiens
ccgtgcctgtgtggaccagtccagggtgaccacggggtaggtgagggaaagcctgtcttcacagaccactctccagctggtgagggcaggagcgacagggwcagacacaggtctgtgagaggacagcccttggatcagggatctcgatgtcttgctcgagccatcaggtgcaaggcccgtggggacttttttctgggttgg

SEQ ID NO: 28386 - DNA, 201 bp, Homo sapiens
cggtcacacattcaaaagtgtgaccctcctggaggtacgtggccagggacaaagaaggactctgccagcgatggctgtgtcaggcccaagagccagacccrgctgagccgccgacgggagccaggcatgcatagctaacggctgaccagtcccctccccttgttttgacccaaaccctgaagagctcttcccaccgacggc

SEQ ID NO: 28387 - DNA, 201 bp, Homo sapiens
tctctacaaaaaaatttaaaaactagcccggcgtggtggcacatgcctgtagtcccagctacttgggagactgaggcaggagatcacttgaacctgggaggtcaaggctgcagtgagccatgagcctgccactgtactccagcctgggtagcagagcaagaccccacctcatacaaaaaaagaaaatggattaacggtata

SEQ ID NO: 28388 - DNA, 201 bp, Homo sapiens
cagtcaactttgctctggggcattcactaaaggcttccccatcctcagagcagcccggagcaggaggtcaaacacccaaatacccactctgcagatgcagyagctgaggccaagaggtagcccaggggcagagtcctaaagagccagatacggattcaggacctacctcttactcctggccccttgaagacttgtggaatc

SEQ ID NO: 28389 - DNA, 201 bp, Homo sapiens
ttacattaatagcatcaaaaacatgataaatttttaaatgcgtaaaaggaactataaacataaatgtaaaagctaaaactataaactttttttttttttttgagacagaatctcactcttgcccaggctggagtgcagtggcacaatctcggctcactgcaacctccgcctccctggttcaagcgattctcctgcctcagt

SEQ ID NO: 28390 - DNA, 201 bp, Homo sapiens
tgaataataagaaacagactggccgggtgtggtggcttatgcctgtaatcccagcactttgggaggctgaggcgggcggatcacttgaggtcaggagttcragaccagcctggccaacgtggtgaaaccccatctgtaccaaaaatacaaaagttagccagacgtggtgctgcatgcctgtaatcccagctactcgggagg

SEQ ID NO: 28391 - DNA, 201 bp, Homo sapiens
ttatctaaactgcagatcagagagaaaaaataatttaaaaatgaattaggaattctgaataagtgaaattttttttttttttttttttttttttttgagayggagtctcgctctgtcttccaggctggagtgcagtggcacgatctcggctcactgcaatctccgcctcctgggttcacgccattctcctgcctcagcctc

SEQ ID NO: 28392 - DNA, 201 bp, Homo sapiens
actgaaaatatatccgaaatgaataaattgttttatttgttatttatttttgtagaaacaggatctcatggtgttgcccaggttggtcttgaactcctgarctcaagagatcctcctgcctctgcctcccaagctgctgggattacaggcatgaaccactgtgcccagctgaaatgaataaattggataggcttaacaaaa

SEQ ID NO: 28393 - DNA, 201 bp, Homo sapiens
ccgcaaagccaaggccaacctgcgtggtctcaggcgaagggttctgggaacacctggcttcaagcatccctcctttccttctgggatttcaagccccagggtgagctcctgactgtcttggagatgaccccccctcccaatgctacttccccacctatatgttgccagaagatgagaagccgatatcctcagagaatatga

SEQ ID NO: 28394 - DNA, 201 bp, Homo sapiens
ttggaggttgcagtgagccgagatcgcgccactgcactgcactccagcctggcaagagagcgagactctgtcaaaaaaaaaaaaaaaaaaaaaaagtaaattaggtaaactaatcaagataatgctgcagtggctatattaatatcgaataaattaaactttagaatggggaatactgctgggaattaggagggacctttt

SEQ ID NO: 28395 - DNA, 201 bp, Homo sapiens
gtctctcggttggaagattgtgctgtacgtgccagcccacaccccgcctcggcactgtaccattctccataataaagaatctggcttccagcaaggctgcrgcagcccatgtccggttctcaaaccttgttcttgccagaagaccctgtgggcaccccctcacctctccctgctcctgcctcatccagggcccctgcctcc

SEQ ID NO: 28396 - DNA, 201 bp, Homo sapiens
gttggaggttgcagtgagccgagatcgcgccactgcactgcactccagcctggcaagagagcgagactctgtcaaaaaaaaaaaaaaaaaaaaaaagtaaattaggtaaactaatcaagataatgctgcagtggctatattaatatcgaataaattaaactttagaatggggaatactgctgggaattaggagggaccttt

SEQ ID NO: 28397 - DNA, 201 bp, Homo sapiens
agttggaggttgcagtgagccgagatcgcgccactgcactgcactccagcctggcaagagagcgagactctgtcaaaaaaaaaaaaaaaaaaaaaaagtaaattaggtaaactaatcaagataatgctgcagtggctatattaatatcgaataaattaaactttagaatggggaatactgctgggaattaggagggacctt

SEQ ID NO: 28398 - DNA, 201 bp, Homo sapiens
agcaccgtgacctgctgctccccacccagctcagccaggtgtgcgtgtcctgtgtgacagtcgcttacaaaaacatgtaatagattgtttagatcaatgcrttcaaatagtgactatatcaatatctcaatctagaaaaaaacaattcttatcagatatttatggtcatgggaggttttttaaagtacttccttcctgtgt

SEQ ID NO: 28399 - DNA, 201 bp, Homo sapiens
gagttggaggttgcagtgagccgagatcgcgccactgcactgcactccagcctggcaagagagcgagactctgtcaaaaaaaaaaaaaaaaaaaaaaagtaaattaggtaaactaatcaagataatgctgcagtggctatattaatatcgaataaattaaactttagaatggggaatactgctgggaattaggagggacct

SEQ ID NO: 28400 - DNA, 201 bp, Homo sapiens
tgggcttgccagtgtgtttacagatcacacataggtgacagcacagtgaccccagttatcccttgctccccgagccctgccactgtcttcccacagccagygtcggagcaagctccattcataggagcctttcttcatccagaaactcctgccctgcttgcccacgtgctctcaacgtgagacgggtgggagtcgggcttc

SEQ ID NO: 28401 - DNA, 201 bp, Homo sapiens
ggagttggaggttgcagtgagccgagatcgcgccactgcactgcactccagcctggcaagagagcgagactctgtcaaaaaaaaaaaaaaaaaaaaaaagtaaattaggtaaactaatcaagataatgctgcagtggctatattaatatcgaataaattaaactttagaatggggaatactgctgggaattaggagggacc

SEQ ID NO: 28402 - DNA, 201 bp, Homo sapiens
cgtgagacgggtgggagtcgggcttctgtggcattggtgccgtggcagactcagccctgcaggcgtctgtcccttggtaaaggccagggaggctggcaggwtctccttcctcttgctcagtgctctccctgtgcggtgctggccaggggcctggctgcgggaggacccaggcctatgatgagggtccccaagggtgactgg

SEQ ID NO: 28403 - DNA, 201 bp, Homo sapiens
ggtcccctaagagggcttgaggcttggcgccaggaggctggttcaggtcttgggtctgcagcatgtcagttgtacgtgtggcctcggaccgtgagccttcrctttctcagtgcagctgtggcacaagccttgggtacaagccttcccgcctcgaccccccacaggggctccctgatcttggaagccaccttggcccccaga

SEQ ID NO: 28404 - DNA, 201 bp, Homo sapiens
tggatctacacaaaagaatgaagagtgttaaaaatgataaatatgtgggttgaagactttttaatccctttaaagaaaaattttaaaataataaaacttayatgcagaaataaaatagatgactccaataacataaaccaagctgtgcaaactttttctgtaaagggccagaaagtaaatacttttggctttgtgagccat

SEQ ID NO: 28405 - DNA, 201 bp, Homo sapiens
aagatatacattgtaaacccaaaacaagtgaaaaataataataaagaattacagctaataaaccaattgtggagatagaaattgaatcctaaaaatactcratccagaaggcaggaagagaggaaaaaaagaaagaagtgggacaagtaaaagccgatagcaagatgataggttcagtctagtcatattggtagttacatt

SEQ ID NO: 28406 - DNA, 201 bp, Homo sapiens
ttcaggggcaaagccagcaagggtcggggtggggaggggccacaggccagtgggggctcagcactgaaggccccgctcctccctccctctccctcctcctyctcctcctccttgtttttgtttgtcttccttccttccagtaatgaggtcagggccgagcacactgcggcctgtctcctcacctctgctctctctcaacac

SEQ ID NO: 28407 - DNA, 201 bp, Homo sapiens
atctctggttggcctaggacagctttgctcttcctgccccttataggagccctcacagttcatcttcctggtggcgcagatgagtgaggcacccttgggtracaagccacttcaaaacaggtctatgttttgttacgtgcctaaaaaaataaaggagaaatgtcattcaggaacctttaaaaacaaacagaagcaaaacag

SEQ ID NO: 28408 - DNA, 201 bp, Homo sapiens; identical to SEQ ID NO: 5860

SEQ ID NO: 28409 - DNA, 201 bp, Homo sapiens; identical to SEQ ID NO: 5861

SEQ ID NO: 28410 - DNA, 201 bp, Homo sapiens; identical to SEQ ID NO: 5862

SEQ ID NO: 28411 - DNA, 201 bp, Homo sapiens; identical to SEQ ID NO: 5863

SEQ ID NO: 28412 - DNA, 201 bp, Homo sapiens; identical to SEQ ID NO: 5864

SEQ ID NO: 28413 - DNA, 201 bp, Homo sapiens; identical to SEQ ID NO: 5865

SEQ ID NO: 28414 - DNA, 201 bp, Homo sapiens
tcttgcacgtgtccctccttcactttctgctccaccctgcacccccaaggattgcgttgggcaccccccaactcccaggccctttggatgtatttccccasttgctacatggccttcaccactgcttcacatctgtctgctacctctgtgcccgacttccactgcactgctcactgcaaagaaactcacttcccgacccca

SEQ ID NO: 28415 - DNA, 201 bp, Homo sapiens
ggtcgcccagcttggtccaagccttcccctgtatgctgctttcaaggtggggctggcgggggcctctgaggggactggggaagaggactagcccttgggcmtagagtggcctgtagctccagagttctggggacccagaccccacagtgtccttgtcatctccaccacccgagctccaagccctgctccttgctgctctag

SEQ ID NO: 28416 - DNA, 201 bp, Homo sapiens
tttagcagtctgttagtccacacaggtttcactccagtttggactgatcttctgaatttattttttaaatctttgatttgatttacaaatgaataaaatamaatgatttgggcttctaaacccataatatgttatactgtggttaatcaagaatgtcctattctccattagtagaacattaacttctctggggctagctct

SEQ ID NO: 28417 - DNA, 201 bp, Homo sapiens
ccagactagaatacttatatcttacttgtccaaagactcaacgcagggttctgaactgagacaagaacttgggcagggtcctaagatggagacgccatcamtcttttggggttgtgcttttaattccataaggtgtgaccttttacctaaccaggccggcctgaggacccttgggttaacccacactcaccaggaaagagc

SEQ ID NO: 28418 - DNA, 201 bp, Homo sapiens
cttttggggttgtgcttttaattccataaggtgtgaccttttacctaaccaggccggcctgaggacccttgggttaacccacactcaccaggaaagagccractccatcactcatggattcagcagaccggcctgcactctctccaccacgctgtgggtactcgtaggtctcacaggaagaagctgacagaggaaggagga

SEQ ID NO: 28419 - DNA, 201 bp, Homo sapiens
tcatggcattgtggtttttgtccagagtgaatgtcctagggatctggtaggctgagagtggggtggccggaacatccatattgtctaccaggaggtccccraactccctgcacagggtgttgctgggcgtcttgaaggtgtacacatcctcattatctgtctcggagcctgtgaggctgcccttggtgtggccatgggagg

SEQ ID NO: 28420 - DNA, 201 bp, Homo sapiens; identical to SEQ ID NO: 5869

SEQ ID NO: 28421 - DNA, 201 bp, Homo sapiens; identical to SEQ ID NO: 5868

SEQ ID NO: 28422 - DNA, 201 bp, Homo sapiens
tttcatatctctttgtcccttttctgcatttataacttttgtgtgtataagctaacaaattaacttggccagaatccagaggacctgatgaaaatgtccarattctacacgttgctgtgtggttattggaaaggcatttattctagtttgggtactgattattcataattttgggcatttggtcttcctcagcatttaagg

SEQ ID NO: 28423 - DNA, 201 bp, Homo sapiens
taatctttccctttccttgtgggttgatgtgtgaggattgaaggtgatacatatataaaagcaccttaaaagttataaattttatataaatatagtcaggrgtattagtatagaaggtactactgctggcctgacgagtttcattttatttcgtaaactgcccaagggtattaattttctctagagaaaccattgaatatt

SEQ ID NO: 28424 - DNA, 201 bp, Homo sapiens
atgattgcaaatatattgtaggacacataaaaataaaaatggttgtgttagggctgtagaattttaggcaagttttcatctttctgaacttacatgttgcttttttttttttttataagctgttcgtgtgattctgtatgacttaatgactctaacctttctttattctgcagagtggagactgctgcacggactctggaa

SEQ ID NO: 28425 - DNA, 201 bp, Homo sapiens
taaaaatgtttgcaaaacatttgaattagaacagcttgttctgagtgacagtctaatatacgtaggagaaattttagaaaggaagagatttagggattaaratttttgcatcagggcaagctagtttttgaaggcattaaggggtggaattatcagaaggaaagaggaaagtaattagaacgaaagaaatgttagagctgg

SEQ ID NO: 28426 - DNA, 201 bp, Homo sapiens
cctcatgatccgcccgtctcggcctcctaaaatgctaggattacaggcatgagccaccgtgcctggccctttttttcctttttttttgagacagtgtctcygtctgtcacccaggctagagagtgcagtggcgtgatcttggctcactgcaaactctgccttccgggttcaagcgattctcctgcctcagcctcccaaata

SEQ ID NO: 28427 - DNA, 201 bp, Homo sapiens
tcccaggaagggaaagagagaaatgattcttcttagcttaaatatgagattgatctgggactgattgctcttattcacattcttttcttagaaccccgtcracgcagcagcacctgaagaaggtctatgcaagttttgccctttgtatgtttgtggcggctgcaggggcctatgtccatatggtcactcatttcattcagg

SEQ ID NO: 28428 - DNA, 201 bp, Homo sapiens
actttgctgattctcaaaaaaagaaaggcacagctcttctagaattgtcataaaggaaacaagactcaagctatgtaataaaaatgtttgcaaaacatttraattagaacagcttgttctgagtgacagtctaatatacgtaggagaaattttagaaaggaagagatttagggattaaaatttttgcatcagggcaagcta

SEQ ID NO: 28429 - DNA, 201 bp, Homo sapiens
cgtgatcttggctcactgcaaactctgccttccgggttcaagcgattctcctgcctcagcctcccaaatagctgggattacaggcatgtgccaccatgccyggctaatttttgtatttttagtagagatggggttttaccatgttggccaggatggtgttgatctcttgacctagtgatccacccaccttagcctcccaaa

SEQ ID NO: 28430 - DNA, 201 bp, Homo sapiens
cggcaactgctttgctaacagaaaaaagtaaaaaaaaacttacaggaaacctcattctgagcacacctcaccagttcagaagcatcctaaggaataaaagggggggggggggcggaatttatgtaaaaagagtattatatggtaaatttttgtcctgaattaaattaactggttgtttaaagaaagaaatatttgtaataa

SEQ ID NO: 28431 - DNA, 201 bp, Homo sapiens; identical to SEQ ID NO: 5879

SEQ ID NO: 28432 - DNA, 201 bp, Homo sapiens
tgtactgcatttcttttcatatctctttgtcccttttctgcatttataacttttgtgtgtataagctaacaaattaacttggccagaatccagaggacctratgaaaatgtccagattctacacgttgctgtgtggttattggaaaggcatttattctagtttgggtactgattattcataattttgggcatttggtcttc

SEQ ID NO: 28433 - DNA, 201 bp, Homo sapiens
cttccctggggaatgttttctttggatccatttggcttttccaggtaagacttagcctggaactttccagcagccatttgcctcacacttctttctttccytttttttttttttttgcacttctttctgtactactttgggcagtgctctctaagccttcccattatccttcataggatggagccttctgccacaagtgaa

SEQ ID NO: 28434 - DNA, 201 bp, Homo sapiens
tttgtcttccctggggaatgttttctttggatccatttggcttttccaggtaagacttagcctggaactttccagcagccatttgcctcacacttctttcyttccttttttttttttttttgcacttctttctgtactactttgggcagtgctctctaagccttcccattatccttcataggatggagccttctgccacaa

SEQ ID NO: 28435 - DNA, 201 bp, Homo sapiens
aggcagcccacctcggcactcctggggtgggggtggggacagctgcttaacctttattcttggtcggtctgtcggcaactttgggaaccaccagtaggatrtggttaagattcagttcttgctgagctaaggaagcatttctcatttctttttaattgtctggctcacttctagtccctaactaaatgctcactcaagagt

SEQ ID NO: 28436 - DNA, 201 bp, Homo sapiens
ttgtggataaaaaagtctgaagtacagatcctaatctggttcttgcctttcaggcactgcattgatctcttcttagatttcattactgtcttcagaaaacycatgatgatcctggccatgaatgaaaaggttagttagcctacaacccaaagatgagacaataatggctcctgagcttggcatgtgtgtatacttcagatt

SEQ ID NO: 28437 - DNA, 201 bp, Homo sapiens
tttctcatatgtaagtgttttgaccttgactggttttgtactgcatttcttttcatatctctttgtcccttttctgcatttataacttttgtgtgtataasctaacaaattaacttggccagaatccagaggacctgatgaaaatgtccagattctacacgttgctgtgtggttattggaaaggcatttattctagtttgg

SEQ ID NO: 28438 - DNA, 201 bp, Homo sapiens
actcatttcattcaggtaagaacgattttctctcctggttgctgtggtacaaattacattaggaaaaaaccagctcagcaaggtggtccaagggaccctgytcctctctttaatctttatcagtagtttaggatttaaactcagacattaaatcaggacatgtaaagccattttaattttctggcaactgtgccccctcta

SEQ ID NO: 28439 - DNA, 201 bp, Homo sapiens
ttactgccttttaaagtggcaaatcacctgaaagaatagaaatcagatgatagtaacaaaatagtttgagggagaagaagatgcattcaattcctctgtcstctttaagatggttgactatgattgcaaatatattgtaggacacataaaaataaaaatggttgtgttagggctgtagaattttaggcaagttttcatctt

SEQ ID NO: 28440 - DNA, 201 bp, Homo sapiens
aagctatgtttaaaaatggttcccagtgctaggaggatttaaaactcttataataaaaattatagtagtaatagcctgcttactgatcccttatttactayctgtactcattcaaatggtaaaaggtttcatcactactctagttcaccagaatgcttcagcacaagtgtactacataaatcactatcgatctgtcatgca

SEQ ID NO: 28441 - DNA, 201 bp, Homo sapiens
ctaatttttgtatttttagtagagacgggcttttgccaagttgtccagcctggtctcgaactccacacctcaagcgattcgcccgccttgacctcccaaawtgctaggattacaggtgtaatcctttcctaaagaaaaagagtcatctctcctgaagaataagaaaaggtaaaattaatctagatacttagcattttcaag

SEQ ID NO: 28442 - DNA, 201 bp, Homo sapiens
caggcacctgccaccacacccggctaatattttgcatttttagtagagacggggtttcatcgtgttagccaggatggtcttgatctcctgacctcatgatycgcccgtctcggcctcctaaaatgctaggattacaggcatgagccaccgtgcctggccctttttttcctttttttttgagacagtgtctccgtctgtcac

SEQ ID NO: 28443 - DNA, 201 bp, Homo sapiens
catttctttttaattgtctggctcacttctagtccctaactaaatgctcactcaagagttttagcttgaatgtcaaatgtcaaaaaattaattgggtgatytttctccatttctaggataagaagaaagagaagaaatgaagtgaccatccagcctttcccaattagacttcctctccttccacccctcatttcctttttg

SEQ ID NO: 28444 - DNA, 201 bp, Homo sapiens
taaatgtagaccgtatacctgtagcccttaatctaatggtctttttttctaacagcatccttcccactgctttcatgggcacggcaatgatctttacctgyttcaccctcagtgcactctatgccaggcgccgtagctacctctttctgggaggtaagtgtgaactgggaaacagggaatgggggctcctttttagccaga

SEQ ID NO: 28445 - DNA, 201 bp, Homo sapiens
cttagcctcccaaagtgttaggatgacaggcgtgagccatagtaccctgcctcctggcttttttttttttttttttttttaagatggagtctcaccctgtkgccaggctggagtgcagtggcgagatctcagctcattgcaatctctgcctcccaggttcaagcgattccccttcctcagcctcccaagtagctgggacta

SEQ ID NO: 28446 - DNA, 201 bp, Homo sapiens
atggggtcttaccatatgcccagattggtctcaagcagtcctcttgccttggtttcccaaagtgttgggattacaggcttaagccaccatgcccagccacttttttttttttttttttttttttgagacagttttgctttgtcacccaggctggagtgcggtggcaacatctcagctcactgcaacctccgcctcctgggt

SEQ ID NO: 28447 - DNA, 201 bp, Homo sapiens; identical to SEQ ID NO: 5875

SEQ ID NO: 28448 - DNA, 201 bp, Homo sapiens; identical to SEQ ID NO: 5874

SEQ ID NO: 28449 - DNA, 201 bp, Homo sapiens
gccctgccctggagttttgtattgctgtcaaccccaggtaactcttttggtagtgtcttatgtgcttttatctttatgaatataccttctaaatgtagacsgtatacctgtagcccttaatctaatggtctttttttctaacagcatccttcccactgctttcatgggcacggcaatgatctttacctgcttcaccctcag

SEQ ID NO: 28450 - DNA, 201 bp, Homo sapiens; identical to SEQ ID NO: 5877

SEQ ID NO: 28451 - DNA, 201 bp, Homo sapiens
gtgatcttggctcaccgcagcctccgtctcccggcttcaggtgtttctcctgccttaacatcctgagtagctgggattacaggcatgcaccaccatgcccrgctaattttgtatttttagtagagatggggtttctccatgttggtcaggctggtctcaaactcctgactcaggtgatgcccgcctcagccttccaaagtg

SEQ ID NO: 28452 - DNA, 201 bp, Homo sapiens; identical to SEQ ID NO: 5880

SEQ ID NO: 28453 - DNA, 201 bp, Homo sapiens
gctgggattacaggtgtgagccactgtgctcggcactttttttttaatgtagtgattctctcagtctcatgactaattagtggtagttaagggttcagacktggacctctgcagagttcagagcgcttgagacagggcttgctctgtcacccaagctgcagtaggagagtggcactgtcatggcttactgtagactcaagc

SEQ ID NO: 28454 - DNA, 201 bp, Homo sapiens; identical to SEQ ID NO: 5881

SEQ ID NO: 28455 - DNA, 201 bp, Homo sapiens
tctatgctgcatgacttcgatgagtctaaaggatctcagacaccagagttttacttccttagttgggggtaaagtgtgggagaagctggctcgtgggggtrggggtggggtttatattctgcatctttgtgggcttgtggataaaaaagtctgaagtacagatcctaatctggttcttgcctttcaggcactgcattgatc

SEQ ID NO: 28456 - DNA, 201 bp, Homo sapiens; identical to SEQ ID NO: 5871

SEQ ID NO: 28457 - DNA, 201 bp, Homo sapiens; identical to SEQ ID NO: 5872

SEQ ID NO: 28458 - DNA, 201 bp, Homo sapiens
ggagagagatttaattctttagtccacgtttgttaagagcatgagtatgcctatatttcgggatcagcttttggatgaggatcctattcaagaattgatcrtaatactgtgttctgggttttctgttttctaggagttggcctgggccctgccctggagttttgtattgctgtcaaccccaggtaactcttttggtagtgt

SEQ ID NO: 28459 - DNA, 201 bp, Homo sapiens
cttttgtcttccctggggaatgttttctttggatccatttggcttttccaggtaagacttagcctggaactttccagcagccatttgcctcacacttcttyctttccttttttttttttttttgcacttctttctgtactactttgggcagtgctctctaagccttcccattatccttcataggatggagccttctgccac

SEQ ID NO: 28460 - DNA, 201 bp, Homo sapiens
tttgctctttatcctttttttctaattcctgatctggcctatattaccatcttacatcactctagctctgaaatgtttggcatgcctactttattttcttstaatctctgtaccctccctgaggtcatccatgattttcagctaagaggacaattttgcagctatttctataaaaaaaaaaaaaacaacgcagtcaggtat

SEQ ID NO: 28461 - DNA, 201 bp, Homo sapiens
ctttatgaatataccttctaaatgtagaccgtatacctgtagcccttaatctaatggtctttttttctaacagcatccttcccactgctttcatgggcacrgcaatgatctttacctgcttcaccctcagtgcactctatgccaggcgccgtagctacctctttctgggaggtaagtgtgaactgggaaacagggaatggg

SEQ ID NO: 28462 - DNA, 201 bp, Homo sapiens
taacctgtgactgtattgtcagtataaggagttttctgaatcatagtgaggaagcagatttctaaaacctcaagtttctaaacatgacctatatattcagkttatgtttaaagtttggatgtgtagagggagttatggaaaatatataaagtggctgttggggggtgctttttaacttacagtattaaaaaaatgcaaggc

SEQ ID NO: 28463 - DNA, 201 bp, Homo sapiens
agcaggctgtgtgcagcttgacctgaaggctactgcggtctactgatatgtctagggtccctggaggcctctggagccataggtaccactcacacaggagrggtcactctggagcacacactcagaggccagcagccctgcaagtcttctgagatcaacctgactgtctctgggcctgtgccaggggacatgaaatacttt

SEQ ID NO: 28464 - DNA, 201 bp, Homo sapiens
ccagcccgcccaggccgggaatggaataaagggacgcggggcgccggaggctgcacagaagcgagtccgactgtgctcgctgctcagcgccgcacccggargatgaggctcgccgtgggagccctgctggtctgcgccgtcctgggtgagtgcgggcacggggtagcaccgcagagtcgctggcccgcgcgttccctgcaa

SEQ ID NO: 28465 - DNA, 201 bp, Homo sapiens
tatcgcccagtccagtaaaagcatggcctctccgctcccctccctcctcaagagtccggtggtgatgagccatgtttccctgcaccaggctgagggccttscattcacactgtgcctttgcagatccacagactttctattatgctgttgctgtggtgaagaaggatagtggcttccagatgaaccagcttcgaggcaaga

SEQ ID NO: 28466 - DNA, 201 bp, Homo sapiens
gtctcaaccctcagttattacttctccttctggtgtgtccaacaatttctctcaacatgtaaacacaccgaatgttttccatctttaaaattggccccccyacaacattctcctgcagctcctgccttccttccctcctcctctttaaggccagagtgatcaaagtgttgttggaaccactccccttccactcactcctca

SEQ ID NO: 28467 - DNA, 201 bp, Homo sapiens
tccttctggtgtgtccaacaatttctctcaacatgtaaacacaccgaatgttttccatctttaaaattggcccccccacaacattctcctgcagctcctgycttccttccctcctcctctttaaggccagagtgatcaaagtgttgttggaaccactccccttccactcactcctcaactccctgccgcctggctcctctg

SEQ ID NO: 28468 - DNA, 201 bp, Homo sapiens
ccccacaacattctcctgcagctcctgccttccttccctcctcctctttaaggccagagtgatcaaagtgttgttggaaccactccccttccactcactcytcaactccctgccgcctggctcctctgcatcactcctcaggaaggattctggtcaagccaccagtggcctccatactgctcagttggaacgatgtgcttc

SEQ ID NO: 28469 - DNA, 201 bp, Homo sapiens
ttcagaggcccactgctttcttacccacctcctgctggtcagcttttccagctttcctgcacgtacacacaagcgcagctatttctttaagggccaactcrtggttgaaatttgagagttttgccctgtttgcggtgaaagatttggctcatgcttgggttggtctagaactggaagcttcctttatgtcctctatcaatc

SEQ ID NO: 28470 - DNA, 201 bp, Homo sapiens
gtagttaagtaacttgtccggtatgatgcagctactcagtggtctaacatccaaacccaagagtctttgactccaatcccatgcccattttattactgtayggattgcatgtgacaatactcagtgaatgaatggacaggtgactgttaatagaaggtgggcatagggaactagtatacagagaaaaagtcctgctaggat

SEQ ID NO: 28471 - DNA, 201 bp, Homo sapiens
tgtcttcagtcagggagaaccagggccaggatcttctcttgtcctaattcgtgcagttatgatcttgtcctgtgtttactgaatgccacttctaccaacgytatgttcctgccttgcagtgtgaagattatttccaaattcagatctaggaataaaccccacttctgggggcccattcatctatcagaatttattcttttg

SEQ ID NO: 28472 - DNA, 201 bp, Homo sapiens
ctggggtgaatcccacttgattatagtgaatgatctttttaatgtgccatttgattgcatttactagtatcttcttgaaatgtttgcatctatattcattraaggtgttgatctgtagttttcttttattgttgtgtccttgtctggttttggaatcaggataattctggccgtataaaatgagttttaaaatattctctc

SEQ ID NO: 28473 - DNA, 201 bp, Homo sapiens
tcttgaaatgtttgcatctatattcattgaaggtgttgatctgtagttttcttttattgttgtgtccttgtctggttttggaatcaggataattctggccrtataaaatgagttttaaaatattctctcctcttcaattttctgaaatagttggaggataattaatgttagttcttctttaaatgtttagtggaatttagc

SEQ ID NO: 28474 - DNA, 201 bp, Homo sapiens
tcacaaggtccccatttcccaatctagttaagaaacgtttgcgttgctaaatgaaactctttttcccaatctcaacggaatccccaagcactcacatccaygcccacagcctcaattgccatccaaaggggtgttacacaaacaaagctaggcacatgataagcactaggtaaatgctttttatctatctctgtgttgata

SEQ ID NO: 28475 - DNA, 201 bp, Homo sapiens
acagatttttgctgaaatatgttaattctactttttgagcacttatgaataaccatgtatcttcagaactatctaccatgaagcaaaaagggaccatcaasctcattattttatatttcatacaatttatagatatcactttatgctattttaacatatattccattttaatttttgtctgagtcaagacaagaaaaacca

SEQ ID NO: 28476 - DNA, 201 bp, Homo sapiens
atgccactgccctgtgctgggatggagtagacccctgtgagctcacagacccttgatccaacttgagtcagttcccctttacttagctccagctggaaccttttttttttaattccataaagtcttgcttttaataatatgttacaaataactgaatgtgtctttatcaggcaattttggggacagaatctgaggctttct

SEQ ID NO: 28477 - DNA, 201 bp, Homo sapiens
gatgtagatgtttattgctaaaaatttccctcttagaactgcttttgctgtgtctcataggttttagtacgatgtgcttccattctcatttgtcttaaggaatttttaaattttcctttttaatttcttcattgactcaccagtggtttagaagcatgatgtttaatatatatgtaaagattctgaagtttttcttactgt

SEQ ID NO: 28478 - DNA, 201 bp, Homo sapiens
tgttatatcttcttgttgaattgatcccttcatcattatcatcatcatataatgaccttctttgtctctttttataggttgtttttgttgttgttgctgtygttcgagacagggtctggctgtgtcacccatgctggagtgcagtgatacgaacttggctcactgcaacctctgcctcctggggtcaagccatcctcccac

SEQ ID NO: 28479 - DNA, 201 bp, Homo sapiens
tttgtataaggtgtaaggaagggatccaagttcagctttctacatatggctagccagttttcccagcaccatttattagatagggaatcctttccccattkcttgtttttctcaggtttgtcaaagatcagatagttgtagatatgtggcgttatttctgagggctctgttctgttccattgatctatatctctgttttgg

SEQ ID NO: 28480 - DNA, 201 bp, Homo sapiens
gccagtattttattgaggatttttgcatcaatgttcattaaggatattggtctaaaattctcttttttgattgtgtctctgcccggctttgatatcaggaygatgctggcctcataaaatgagtaagggaggattccctctttttctattgattggaatagtctcagaaggaatggtaccagttcctccttgtacctctgg

SEQ ID NO: 28481 - DNA, 201 bp, Homo sapiens
ctataagcagcccccagtgaagggcaatgaagtggggaagagaggtcagagtaggcaggcatgggtgtgggtgggagggacttatcagaggaaggtgggamcagggaccctatagatgattttgggggcatcatgaaagcatgcagctggggccctaagtggataaatggcagataaaggaggtggaaaattcccaagaca

SEQ ID NO: 28482 - DNA, 201 bp, Homo sapiens
ttgggactaggaatctgcctttctgctccccctaaccttgttcaggggtaccctcatttcccctactcctgtccttcccgaaaatgaagaagacagctccygtttcccagcgcttgttgatacgagtcatgaagagtggatttctgttcctcttgcctaggcagactgagcactgttctcaacagtctgaaaaacacagga

SEQ ID NO: 28483 - DNA, 201 bp, Homo sapiens
taacatgagtattaagtgaagacatgcacccaaacggcataggaaaattccatttcctataggacgtgctcaaaatatgttagctgtgtaattatggaacyagacctctcaggcccagctctgcttctagctcctggtcactggtgattagatctgatccatgtactcttgggactaggaatctgcctttctgctccccct

SEQ ID NO: 28484 - DNA, 201 bp, Homo sapiens
gcttgcgtccacaagatattacgtcaacagcaggtatggaccagccaggtcctcccaccttttcttcctagatggccataggctattcggggggagtttamaacaaagtgcagccatgactccagcactttctttttgaaaactagaattccatgcattgtgcatttcatgccatgcattgtggactagagtatcagggtt

SEQ ID NO: 28485 - DNA, 201 bp, Homo sapiens
aatacagaaaagaagaggcaaaggggccgagatgggatacagacctgtatcacacaggtgtgtgcacattctcatttagaactggaacaagggagtcagayttaaaattctggtgcagattccaaaggtgttctctgaggaaaagttcttttgtttggagatgccatgtgttacagcacagaaattgatcaacctggctta

SEQ ID NO: 28486 - DNA, 201 bp, Homo sapiens
ctttactaaaaggaaccagaactccttggaaaaatagctgacttcagggctggggcaggaaaaatagatgctgagcctagaacaacacactgaagtgctcmaacagtgatgggacactcaaagcatacaagaaccaatttgaaggatctcctgttgccaagtctgggaattttgagcattaaaataaataatgatagcagt

SEQ ID NO: 28487 - DNA, 201 bp, Homo sapiens
tagcaattccttgagagaggaccccacgttacttgcctttatccccgcacagagcacttcacaggctgtgcaaggtaatgctccactgaggacacattctygcctatgggaactctggaggcagggctttgtggaggggctgccacaggcttatgttgcctcctaggatttcccatgggccaagagggaaaatgggggtcg

SEQ ID NO: 28488 - DNA, 201 bp, Homo sapiens
tcgtgaatgtcggttctcaggctgccaggctgctgcttctcaaggatgacccagactcagagaagtctctggtgtcaggcagaggacactgggtgggggayaggaggaactgctcaaaacagacagaggctctttgtttgctttgcttctgtgtcaactgggcaacatttggaaacaacaaatattggttcagaggcccac

SEQ ID NO: 28489 - DNA, 201 bp, Homo sapiens
tgtccttctgcacagatgaatttttcagtgaaggttgtgcccctgggtctaagaaagactccagtctctgtaagctgtgtatgggctcaggcctaaacctstgtgaacccaacaacaaagagggatactacggctacacaggcgctttcaggtgagtcttttaaccctgaaacaaatagaataatatacaagccctggcca

SEQ ID NO: 28490 - DNA, 201 bp, Homo sapiens
aaggagctctctaggaagtctaaccagttatttcagcaaacttctcattgcccagaacttaggtacatcaccatacctagctgtaaaaaagaaatgtaatygttcatctggaaatgtccctaccccagataaaaccagatttttgttacaaagtacaaggagaaacagatattgggtagacaggtagcaatccctgccaca

SEQ ID NO: 28491 - DNA, 201 bp, Homo sapiens
agatttggtgagtgaatattgggaaggagggctggtgagggccatgccagaaagcagggtcctgccttagggaagaggagtgtggcataaggtgctgtggsctctggttctagagaagtagaatttggtcaaagaacagtagaatttgctgtcctcaaggacatagcaacaagggctggaagggctggaactgggttgctg

SEQ ID NO: 28492 - DNA, 201 bp, Homo sapiens
gctgctgaaaatggaagctgacttgatattgacattttccattttgcatatttattttggtataaaactatattctccttatcagaaaatgtttggctcarttttttctcttttgcttattgatcttttactactatatctcaacatatgttaatttatgaaagtttgtggttacattagctgtttcagtatccattcctc

SEQ ID NO: 28493 - DNA, 201 bp, Homo sapiens
tcttgaactaggcacctggagttgatgatcagttcatgatggttgggtgaaaatgagagtacatttgattttctctgctgagtgtgcctggctgatctttkgggggttcagtatcagcatctgctatctccctggcattcatgtgctggaaaggctgcttcaaggaaacagctggaaaagtgggtggcacaggaaacagcc

SEQ ID NO: 28494 - DNA, 201 bp, Homo sapiens
ttcaaatgcttatgaatcaaatcattattgaggataatatttgctgatgtgtaattactatcttgcatgaattaagagaaataaatatagccatacttacrttttaaagaaaaaaatgatattttaagactgatatctattccatagcatggatgtgcttccacttatttagctatttctctgtcattgagcatttagttt

SEQ ID NO: 28495 - DNA, 201 bp, Homo sapiens
aggcttgtatgtataggaaataaacattgtatagggtttcaggttccaagactgggggtcttggaacatatcccttgaggataagaggggactaccatacktaaagtactttctgaagctgctatttgggcgtgtctgaaaaagtttgaaaatctattaaaaattggtttgagccctgacccatgaatcctgaaactggtc

SEQ ID NO: 28496 - DNA, 201 bp, Homo sapiens
tgaggcttctgcattcttcacgtagttcttgagccttggctttcagctccatcagctcctttaagcacttctctgtattggttattctagttatacattcrtctaaatttttttcaaagtttataacttctttgcctttggtttgaatttcctcctgtagcttggagtagtttgattgtctgaagccttcttctctcaact

SEQ ID NO: 28497 - DNA, 201 bp, Homo sapiens
caactctgaagaatctcccagtaatagatgacgtttgtgcatttgcaaacagttaattgttcttatgtcattggatttgttgtgccaaatcaaaaggaacyaacagaactaacttgaaagaaaggacttacaggaacttgagagtagctctctaacagttgtgaaacagaagatgaggtgcagtagtccccctttatgtga

SEQ ID NO: 28498 - DNA, 201 bp, Homo sapiens
atacattcgtctaaatttttttcaaagtttataacttctttgcctttggtttgaatttcctcctgtagcttggagtagtttgattgtctgaagccttcttstctcaacttgtcaaagtccttttccatccagctttgttccgttgctggtgaggaactgcattcctttggaggaggagaggcactctgctttttagagttt

SEQ ID NO: 28499 - DNA, 201 bp, Homo sapiens
attgtctgaagccttcttctctcaacttgtcaaagtccttttccatccagctttgttccgttgctggtgaggaactgcattcctttggaggaggagaggcrctctgctttttagagtttccagtttttctgttctgttttttccccatctttgtggttttatctacttttggtctttgatgatggtgatgtacagatgggt

SEQ ID NO: 28500 - DNA, 201 bp, Homo sapiens
ctacaaaggcaggcaggcctccttgagctgtggtgggctccacccagtttgagcttcccagctgctttgtttacctaagcaagcctgggcaatggcgggcrcccctcccccagcctcgctgctgccttgcagtttgatctcagactgctgtgctagcaatcagtgagactccgtgggcgtaggaccctctgagccaggtgt

SEQ ID NO: 28501 - DNA, 201 bp, Homo sapiens
tggtgggctccacccagtttgagcttcccagctgctttgtttacctaagcaagcctgggcaatggcgggcgcccctcccccagcctcgctgctgccttgcrgtttgatctcagactgctgtgctagcaatcagtgagactccgtgggcgtaggaccctctgagccaggtgtgggatataatctcctggtgcgccgtttttt

SEQ ID NO: 28502 - DNA, 201 bp, Homo sapiens
gccttgcagtttgatctcagactgctgtgctagcaatcagtgagactccgtgggcgtaggaccctctgagccaggtgtgggatataatctcctggtgcgcygttttttaagcccgtcggaaaagcgcagtattcgggtggaagtgacccgattttccaggtgctgtctgtcacccctttccttgaccaggaaagagaactc

SEQ ID NO: 28503 - DNA, 201 bp, Homo sapiens
gaatctcctggaggtcttgttaaggcacaggtccctgggccccacctccagagccccagaatttgcatttccaacaagtttccagccaacactgatgctgstggttcctcacctccaactttgagaaccattagtctagagtagagaaaggaaagcaggaacgctgaggtgaagttaaggatcaggaaggtttctttttgt

SEQ ID NO: 28504 - DNA, 201 bp, Homo sapiens
gggctccagggtcagtggcccttctagctgtcagcctggggggtcaagtggaactgggtgagattgaaaatatggtgatgagaaaaggggtttcttagccrggtacatctctgtcttaaaatgagaacagacagctcctggtctgtcccagttgtagaagaaggactgagttaaggagaaggagcccttggctttgtaaca

SEQ ID NO: 28505 - DNA, 201 bp, Homo sapiens
cacaaaaaaaaacccttaaaaaaatcaatgaatccaggagctggttttttgaaaagattaacaaaatggaccgctagccagactaataagaaaagagagargagtcaaatagacacaataaaaaatgataaaggggatatcaccactgatcccacagaaatacaaacaaccatcagagaatactataaacacctctatgaa

SEQ ID NO: 28506 - DNA, 201 bp, Homo sapiens
actactaattccaaaatgtggggatgtacaatggagggaaaaaggagagtgttctgacagggactcacagaaaaacctgctttgtcctgggtggtcagagrccatctctctgagagagatgtaatgaaggactgagcctgggtgggctccagtgtaaaatacaccaggcagcaaacaagagcatatgcaaagggcctgagg

SEQ ID NO: 28507 - DNA, 201 bp, Homo sapiens
gtttgtggcatgggctcaaccttccgtaactgcacttcctgctctctggcagaccctgcaagcttactacagggcctgtccatgcatcagctgtatgtgtrcatgctgctctgctgggtgccttccagttagccttgcccctgacttttcctgctcatctcacatccttacctcaaggtctccaaatgaatccagaccact

SEQ ID NO: 28508 - DNA, 201 bp, Homo sapiens
atgaatccagaccactgcctagagcctgctgcaggggcagtaggaatatggccctcatgctaacagtcttctttccctatggctcaagcacaaggggcccrtggacgggcaaggggggagtaagacagggcagcagtggtcactctccctcgctggtgaggctgatgtgttgggaaagccagacttgacttctgtcctcac

SEQ ID NO: 28509 - DNA, 201 bp, Homo sapiens
cagggatgcctttgtggaagtattatgtacactgtcagacttcaaagctctgattctcagtctgtctgctcagtgaagagagacatgttcacctgagtgcrcagaatgatcaggattatggggcccccaatggccctaaatcctccccaacacacactcccacagctgcaagccttgtgctcctttcccctaaatacttca

SEQ ID NO: 28510 - DNA, 201 bp, Homo sapiens
ccacacccagagatatgtggcctgggagttagtagagtcaggtgcctttatgccatgttttgccatattctctgcatttctcaaaaacaaaaacaaaaaamcccacaacatagcaaatgctccataaatgttaaaattctttttcaaaggaatgaaggacagcacaaattgcaatttgtgatggagtttcagtctctcaca

SEQ ID NO: 28511 - DNA, 201 bp, Homo sapiens
acacacatgcttgcacatacccttgccaatacttcatatccccctttcttgctttatgttttctttagcacttattactctctagcttgctatatattttktctacttaccttgcttcgtgtctcttttcttctgtagaatgaacaaggaccccgttggttgtaagtgagaaaacctcatgtgaagcagcttacaccaagg

SEQ ID NO: 28512 - DNA, 201 bp, Homo sapiens
accacagcccatggctctcctgtgttaagctcacctgggctttccctccccagagaacttggcaaacaaggctgacagggaccagtatgagctgctttgcytggacaacacccggaagccggtagatgaatacaaggactgccacttggcccaggtcccttctcataccgtcgtggcccgaagtatgggcggcaaggagga

SEQ ID NO: 28513 - DNA, 201 bp, Homo sapiens
tctctctgagctgttccagcctctgacaaagcagggagaaggtgctctgagaaagacccgagataggccttggttagtgggaagcataggcctgtttcctstgatggatggtggccagacagaggtcaacttgttcctattagaaatccttgatcttgatgagttagcataagggcaagctggggctgcatgtgctggttt

SEQ ID NO: 28514 - DNA, 201 bp, Homo sapiens
ccatttctctgtgctgagcagcagtggccaatttcttctcgggcagctgtgccccttgtgcggatgggacggacttcccccagctgtgtcaactgtgtccrgggtgtggctgctccacccttaaccaatacttcggctactcgggagccttcaagtgagtgagatgtctgctgctccatggtggccaaagtgccaaatgtc

SEQ ID NO: 28515 - DNA, 201 bp, Homo sapiens
tctttttttatgccataggcccagaagccccaacagatgaatgcaagcctgtgaagtggtgtgcgctgagccaccacgagaggctcaagtgtgatgagtgsagtgttaacagtgtagggaaaatagagtgtgtatcagcagagaccaccgaagactgcatcgccaagatcatggtatgtcactccagccttcctagggcag

SEQ ID NO: 28516 - DNA, 201 bp, Homo sapiens
ctcatctggaaatacagaatagtacatgattcctaaattcctaactacaattgtactttatggagtgcctatcattcattttcatagagatacctgtgtascttgctatttttttttttttttttttttttggagacaggagctctctctgttgcccaggctggagtgtagtggcacactcatggttcactgcagcctcaa

SEQ ID NO: 28517 - DNA, 201 bp, Homo sapiens
gctgctttgcctggacaacacccggaagccggtagatgaatacaaggactgccacttggcccaggtcccttctcataccgtcgtggcccgaagtatgggcrgcaaggaggacttgatctgggagcttctcaaccaggcccaggtatccccacctgccatcctcccctccagcttagtgctccctgcttggatttgggggtt

SEQ ID NO: 28518 - DNA, 201 bp, Homo sapiens
gcagctgtgccccttgtgcggatgggacggacttcccccagctgtgtcaactgtgtccagggtgtggctgctccacccttaaccaatacttcggctactcrggagccttcaagtgagtgagatgtctgctgctccatggtggccaaagtgccaaatgtcctcagggtgagagttctttgctggtccaaagccgagccctgc

SEQ ID NO: 28519 - DNA, 201 bp, Homo sapiens
cacagcccatggctctcctgtgttaagctcacctgggctttccctccccagagaacttggcaaacaaggctgacagggaccagtatgagctgctttgcctrgacaacacccggaagccggtagatgaatacaaggactgccacttggcccaggtcccttctcataccgtcgtggcccgaagtatgggcggcaaggaggact

SEQ ID NO: 28520 - DNA, 201 bp, Homo sapiens
ccgaagggaaaaggtggaagaaacatccagatgcagcctggcttccctcaatccccgcgctggggttttcctcctctacccgtgtctttctgctggcttcsccttggcttccctccagccttctctctgtagctttccctcttctgggtttggttattttgacttgtgagagcttgcttgattataatcctgtccctccca

SEQ ID NO: 28521 - DNA, 201 bp, Homo sapiens
cgcaggttcccctgggaaccctgcagctctagggctggacgctgtgttttaggccttagctctttggctccctgagcccccgaggcaccagtgatttcttrgtgtcttggcaaagaaagaccaggttcctgaccactctcccaaccccactgcaatgggcaaagctctcgtttgtttgcttcattttttaaaaaatatata

SEQ ID NO: 28522 - DNA, 201 bp, Homo sapiens
gtggcccctcctcatgcatcctggagagctgtgggcctcctctccacaggctttgtggatcttcttcagagccagtgagtcagccttgctgtggtggcccrcaaggagtggagatgacagagggccttggggacagggcaaaagctcatgtgatagggatgctgtctctgcaaccacatggattttaatagttacccatgg

SEQ ID NO: 28523 - DNA, 201 bp, Homo sapiens
gttgatgtcagggaaattatgtcatctctcagagaaacagtacaaaaaattaagatttagtatgtggaactgagattgtaaaactacaatcaattcagagkgttttgtttttgttctctttattccttacattgcttactgttagaatggaagttacagttgctgttttcagatggctgtcctgaatctataaggtagccc

SEQ ID NO: 28524 - DNA, 201 bp, Homo sapiens
aaaaaggcatcattctctgagtctcactccctcttctcaaaaagatggcaattcctcccccgctggttttccatagttgaggtagcaagccaatgtgttgrggtagctgaaaacgccctgtgcatactgaggcttatgttccatggggggccaggggccaggacagtgatgggaggagacaaggcggatacagaggagcag

SEQ ID NO: 28525 - DNA, 201 bp, Homo sapiens
ggagaatcacttgaaccggggaggcagaggttgcagtgagccaagatcctgccactgcactccagcctaggtgacagagtgaggctccatctcaaaataartaaataaataagaatgcccactatcaaaattattatataaccttctttggcagcttttgatacacaactgggaagatgagtgatgcatgcagggggaaga

SEQ ID NO: 28526 - DNA, 201 bp, Homo sapiens
ctttgcttccctagggaaattgattggaagcagacactctggaagccccagaggtgttaatacatccttttctggtgtctttcttgtagggtattttgctrtagcagtggtgaagaaatcagcttctgacctcacctgggacaatctgaaaggcaagaagtcctgccatacggcagttggcagaaccgctggctggaacat

SEQ ID NO: 28527 - DNA, 201 bp, Homo sapiens
ggcataaggtgctgtggcctctggttctagagaagtagaatttggtcaaagaacagtagaatttgctgtcctcaaggacatagcaacaagggctggaaggrctggaactgggttgctgagttgggacggttcatttaggttgaacatattagcatgagtgaatatacatttatctctcaggagaaagaccagaggtgagca

SEQ ID NO: 28528 - DNA, 201 bp, Homo sapiens
ccaagtccctacccagctcctaggacccttctaagcagtagaaatcacctcattttctatgtcctctgaataccaccaggtatgagcttatttctaccccrcttaaacttttaagtgtaagttctcctacagacagatgttttccagtggttctgatttacattagcttcctaagtactttgtccctgccacctccaaatt

SEQ ID NO: 28529 - DNA, 201 bp, Homo sapiens
acttcctcttgtccttctgcacagatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgagtcttttaaccctgaaacaaatagaataatatacaag

SEQ ID NO: 28530 - DNA, 201 bp, Homo sapiens
aattatccagccccaagtgtcactagtgcctcggcaatgataccctactgtagttgaataaacactgagtggagtggagagtttggctcaagcttttccaygcacctctggataatccagaacaatactcatctggaaatacagaatagtacatgattcctaaattcctaactacaattgtactttatggagtgcctatca

SEQ ID NO: 28531 - DNA, 201 bp, Homo sapiens
ccccgtctctactaaaaatacaaaaaattagccgggcgcggtggtgggcgcctgtagtcccagctactcgggaggctgaggcaggagaatggcgtgaaccygggaagcggagcttgcagtgagccgagattgcgccactgcagtccgcagtccggcctgggcgacagagcgagactccgtctcaaaaaaaaaaaaaaaaaa

SEQ ID NO: 28532 - DNA, 201 bp, Homo sapiens
aaagccctgggggctgtgtgcttttggagaaatggcaaggctgggagtctcatgtctgtccctctctcggtgtgaccccagatgagctccttggcccctgyatgtcctggtttcctgggagaggcagtgtccctggtggatgtgtacactctggaaccagactgccttcttttgtattctgactttgcagctgaccttgaa

SEQ ID NO: 28533 - DNA, 201 bp, Homo sapiens
ctacgaatgtagatgggctccagaaaaggagaatcactgaccatcttctttccatgccctgcgttgagcttccctgagtttgtggcatgggctcaaccttycgtaactgcacttcctgctctctggcagaccctgcaagcttactacagggcctgtccatgcatcagctgtatgtgtacatgctgctctgctgggtgcctt

SEQ ID NO: 28534 - DNA, 201 bp, Homo sapiens
gaagaaacagagcaggagcaagtcaggaagtcttacaccaaggtgagcactggccccctatgctcaggcccctgcaggtcacattccagacagccattacygtacaagtctgtccttgccacttccactgattataacctcccagcctctccccatcacttggggagctaagcccttcagcagatatagaaaaagccattc

SEQ ID NO: 28535 - DNA, 201 bp, Homo sapiens
gagagttctttgctggtccaaagccgagccctgcctgcctacaggggcatcgaggtggcctaatcccctcccagtgagtcagaagcacaacctgggactcytaggccaagccagcccatgttccctttcatctgaccctgacaagtaggtccttttcctggggacccttcctttctccccagagccctcaagcctggtcag

SEQ ID NO: 28536 - DNA, 201 bp, Homo sapiens
catgacatgaggcctgcacattttcagataagagtaagcaccaaccaaggaactttgcttatttattccttacagggctcaatagagagcctcacacaggyagatatcaaggaacataaaattatctgaccttctagccagggctgggtccaggaacccaggccaacctggcttctcacccagggctctgggtaagggtac

SEQ ID NO: 28537 - DNA, 201 bp, Homo sapiens
tgcctgcacagcggctttacttcccaagagctgtgtgatttgggctcagccagcttcctcttgccgagccgtcccatctgtccactgagagtttgactggyaaccacacagggcagcctctggattagccacgtttcttgttctcaccgatgtctcaacccgttccgggagacaggcacagaagcaggttcagggaaatcg

SEQ ID NO: 28538 - DNA, 201 bp, Homo sapiens
gactggcaaccacacagggcagcctctggattagccacgtttcttgttctcaccgatgtctcaacccgttccgggagacaggcacagaagcaggttcaggsaaatcgcggacccacgagggctacaggcagaggaagtgctgggtgagcaggagcaggtccgactgccctctctcctggcatcttgaactttttcatgttg

SEQ ID NO: 28539 - DNA, 201 bp, Homo sapiens
ccctaaccctgaggatgccctggtgaacaagacaggcagggccctttctgtgttggagcttctgttctcctgcagaaaacctgacaataaacaatgaacakataaataagaacacctccagtagttaagtgctatctgaaaaacaagaaggaaaaaaacagccagaggtcatatagtgcccagaggctggagaggaaagtt

SEQ ID NO: 28540 - DNA, 201 bp, Homo sapiens
cccatcaccgtctctatctgggaagctgatttcttgctttctctttttaccttgattatatcctaaagttttacaaccagccaaaggcacattttcacccycaggagacactataccattatcttctattccagaagtttaaaagctcttttcacatgaaaatatcttcagttgcattttgcttctttgggttatgagggc

SEQ ID NO: 28541 - DNA, 201 bp, Homo sapiens
attgactttgctttctaaggtgattaattccttgaatggggtctgtttgtttattgctggcaaatcccagcatttgcatgaagacagtgagtagtgctgayaaacaccaggcaacagctagggccgcttctgatctttgttctttttttatgccataggcccagaagccccaacagatgaatgcaagcctgtgaagtggtg

SEQ ID NO: 28542 - DNA, 201 bp, Homo sapiens
actaagttctctaaaagctgggactccccacagagcagcagggagcctgctgtggtgctaccgtctgccgcccttgcctttctggctggtgacacctgaaraggctctgtattgctctgttgcattcctttctacctaaacttcaaggcccaaagctaaacccctccccaaggaggctttccatgaccctcccagaaggaa

SEQ ID NO: 28543 - DNA, 201 bp, Homo sapiens
gaccagtggtgtgccacgatcactgagataagatcctgagtacatggtaggatccaatcaggtacaaatttgctttgttgatcaaaagagtatcctagcckggcatggtggcatgcacctgtagtcccagctacttcgaaagctgaggcaggaggattgcttgagcccaggagttcagggctagcaacttagcaggacctt

SEQ ID NO: 28544 - DNA, 201 bp, Homo sapiens
atgacatgtatagataattttctctgactttctttattcttagctgcagcataaaaaaaaggcatggtttcccaatctataaatcagggtttaatgccttyttcattttcttttctcctgcagagagcgataattgtgaggatacaccagaggcaggtgagtttgaattggtaacctctggagttaaaagataaattccca

SEQ ID NO: 28545 - DNA, 201 bp, Homo sapiens
gctaaaacacaaagaatttaatacacattaccaggcagactctgagcgaatgtgtggaagaaatgatttttctcttttggcatcagtttgctacagtgagytcaaatcaaataggaaattatttgaaatgcatgtttcaaactgtgaggcaaactccattcttcatattcaacctagatttttacttcttaagacatcacc

SEQ ID NO: 28546 - DNA, 201 bp, Homo sapiens
agatccacagactttctattatgctgttgctgtggtgaagaaggatagtggcttccagatgaaccagcttcgaggcaagaagtcctgccacacgggtctargcaggtccgctgggtggaacatccccataggcttactttactgtgacttacctgagccacgtaaacctcttgagaaaggtaagctggcaggagtctgggt

SEQ ID NO: 28547 - DNA, 201 bp, Homo sapiens
ctgggaatgatgcaaaaacctggctcccaggaaccttgccctgactatgtgagcacagccccaccggaggttcagaatctttgagcttgtggatctgaagrgtgcccacagggctcagtttcctccttgtatgagtgtatggtgaaagggcaggctgagcagtgcctgcttagggaggctggaccatggtgtgggtgtcct

SEQ ID NO: 28548 - DNA, 201 bp, Homo sapiens
gttcactgcagcctcaacctgctgagctcaagcgatcctcccacctcagcctccctagtagctgggattacaggcatgcaccatcacacccagctaatttytgtatttttttgtagagacagggttttgccatgttgcctaggctggtctcaaactcctgggctcaagcaatcctcctgtcttggcctcccaaagtgctgg

SEQ ID NO: 28549 - DNA, 201 bp, Homo sapiens
aaccaccttcttcctgtccctaggaaaaaaccctgatccatgggctaagaatctgaatgaaaaagactatgagttgctgtgccttgatggtaccaggaaayctgtggaggagtatgcgaactgccacctggccagagccccgaatcacgctgtggtcacacggaaagataaggaagcttgcgtccacaagatattacgtca

SEQ ID NO: 28550 - DNA, 201 bp, Homo sapiens
gtctgtcacccctttccttgaccaggaaagagaactccctgaccccttgcacttcccgagtgaggcaatgcctcgccctgtttcggctcgtgcacagtgcrctgcacccagtgtcctgcacccactgtctggcactccctagtgagatgaacctggtacctcagatggaaatgcagaaatcacccgtcttctgcatcgctc

SEQ ID NO: 28551 - DNA, 201 bp, Homo sapiens
agaccacaaggtcctcacggactttctgttcacttgacagcacctatttggaagcaacgtaactgactgctcgggcaacttttgtttgttccggtcggaamccaaggaccttctgttcagagatgacacagtatgtttggccaaacttcatgacagaaacacatatgaaaaatacttaggagaagaatatgtcaaggctgt

SEQ ID NO: 28552 - DNA, 201 bp, Homo sapiens
ctactaaaaatacaaaaaattagccgggcgcggtggtgggcgcctgtagtcccagctactcgggaggctgaggcaggagaatggcgtgaacccgggaagcrgagcttgcagtgagccgagattgcgccactgcagtccgcagtccggcctgggcgacagagcgagactccgtctcaaaaaaaaaaaaaaaaaaaaaaaaga

SEQ ID NO: 28553 - DNA, 201 bp, Homo sapiens
agtgagccgagattgcgccactgcagtccgcagtccggcctgggcgacagagcgagactccgtctcaaaaaaaaaaaaaaaaaaaaaaaagaatcaatggktgttaacttgtgggtgaacgttggacagccataatattaataaaaacaaacaaaacaaagcaaaacaaacattggccagactgagcactccacacctgac

SEQ ID NO: 28554 - DNA, 201 bp, Homo sapiens
gcctcatgatccgcccacctcggcctctcaaaagtgctgggattacaggtgtgacccaccgcgctcagcccacatgggctcttttatcacaatttgtgtgkgtgtgtgtgtgtgtgtgtgtgtgtatgtgcatattataggtgtgtgtaggaaaaagaatgttagaaatgtaccaattttgaaggcgtagactatgaaatt

SEQ ID NO: 28555 - DNA, 201 bp, Homo sapiens
tttgatcttctttttccatggaccctgaggacattaaacaagggagtttgctctggaggcagtagaaggatcagtgatcagtttactttggccctaggagyactggactctgttcagcttaaccagctgaacagagctgattcagctcatgggcctatctgaaggtcttgggacttgacctgtcttggtgaaggagcaatg

SEQ ID NO: 28556 - DNA, 201 bp, Homo sapiens
ccttcttgttggagggagttcatcttcccctatgactctgtccctagtctaaggtgtcccacaggaagcttgagggcgggaagttttccagcccaggagcytgagctcagcggggcaggaagagggagcagctcctccgtgggagacctttgagagcccaggagcaggatttcgagggacacctggtggggagcaaaaggt

SEQ ID NO: 28557 - DNA, 201 bp, Homo sapiens; identical to SEQ ID NO: 5942

SEQ ID NO: 28558 - DNA, 201 bp, Homo sapiens
gctatatggaaagttcaacattttgcagtcatcatttcacttacaacctttggagatctggagaagctgagtggcttgcccaagaaaggattcaaaatgcrgtcaaacatgaacttttaagaactacctctgccactcctctgggagggttcacatttaacatcttctttgacaataacatctgaagggacatgttattgt

SEQ ID NO: 28559 - DNA, 201 bp, Homo sapiens
tttttgtgaatggcagccaaaaagtgtggtgaaaatggagggatagttcagtggagacagaggggagactgttgaatttgtggagtttttagttcttcctraacagagagcaacagacaagagttacagacaaattaattcttttcgttaatttaccctcaactactggccaagaaggggtgtaactcagaatgttttctt

SEQ ID NO: 28560 - DNA, 201 bp, Homo sapiens
tcagaatctcctggaggtcttgttaaggcacaggtccctgggccccacctccagagccccagaatttgcatttccaacaagtttccagccaacactgatgytgctggttcctcacctccaactttgagaaccattagtctagagtagagaaaggaaagcaggaacgctgaggtgaagttaaggatcaggaaggtttctttt

SEQ ID NO: 28561 - DNA, 201 bp, Homo sapiens
aaaattaaactaaataaaagatgtatttcttcaatcccacctagctgcatttcaagtgctcaacagccacatgtggctccatattggtcagcaaagagaaygtttgcatcatcacagaaagctctttcagacagtgctgctctagacagcttcaacaatgataggttctggtaaccataaagttgctatgcatactactca

SEQ ID NO: 28562 - DNA, 201 bp, Homo sapiens
cacatctcctgggtacagttcaaggagacatcttttctaaaagggtctgcgtgatcattaaaatataatcaaatgtatactggtgtgtgtgtgcacgtgcrcgtgcgtgtgtcatgctaaggaaggggcaagaaggaggatgcagagtgagttacagagatcaagtactcaagtgagtacagaaagactacagaagactta

SEQ ID NO: 28563 - DNA, 201 bp, Homo sapiens
atactgtactaggtgatttacagtaattactaatttagatctcacaataactctatgaagcaggcattattgagaggtgaagctggctgggcttctgggtygggtggggacttggagaacttttctgtctagctaaaggatcataaatgcaccaatcagtgctctgtgtctagctaaatgtttgtaaatgcaccaatcagc

SEQ ID NO: 28564 - DNA, 201 bp, Homo sapiens
aatctcctggaggtcttgttaaggcacaggtccctgggccccacctccagagccccagaatttgcatttccaacaagtttccagccaacactgatgctgcwggttcctcacctccaactttgagaaccattagtctagagtagagaaaggaaagcaggaacgctgaggtgaagttaaggatcaggaaggtttctttttgtt

SEQ ID NO: 28565 - DNA, 201 bp, Homo sapiens
cacactggggcctctcagggggttgggggctaagggagggatagcattaggagaaatacctaatgtggcatgatctcagctcactgcaacctctgcctccygggtttaagtgattctcgattctcatgcctcagcctcccgagtaggtaggactacaggtacatgctaccatgcccggctaatttttgtatttttagtata

SEQ ID NO: 28566 - DNA, 201 bp, Homo sapiens
ctttgcagctgaccttgaacaagatatcatcctctcttgtcctcagtttccttgtctcatctgtaagatacagatgctaaagcaccaaagtcagaggggtrtggtaagtgctcagtgaagctcccagtaaatctcagccatcattaagctattaaaagggacagtgattctccaactccagaacatctctggtatagaatt

SEQ ID NO: 28567 - DNA, 201 bp, Homo sapiens
ctagtctaaggtgtcccacaggaagcttgagggcgggaagttttccagcccaggagcctgagctcagcggggcaggaagagggagcagctcctccgtgggrgacctttgagagcccaggagcaggatttcgagggacacctggtggggagcaaaaggtgctgagtctgtctttgaccttgagcccagcttgtttctcctgc

SEQ ID NO: 28568 - DNA, 201 bp, Homo sapiens
tgaggggccctgtcagctgccacagccacacatcaaggcctctgggggctttgggctggctgaggactggtgctcctaaaactgagccctgggccaggggsatatgcttatcagagaaacacagcaggctgtgtgcagcttgacctgaaggctactgcggtctactgatatgtctagggtccctggaggcctctggagcca

SEQ ID NO: 28569 - DNA, 201 bp, Homo sapiens
aaggttgtgcccctgggtctaagaaagactccagtctctgtaagctgtgtatgggctcaggcctaaacctgtgtgaacccaacaacaaagagggatactayggctacacaggcgctttcaggtgagtcttttaaccctgaaacaaatagaataatatacaagccctggccagatttcttttaggaactaaggtaagattct

SEQ ID NO: 28570 - DNA, 201 bp, Homo sapiens
aaccacgtgggctttttttttttcttttttttctttttgagatggagtctcactttgttgctaggctggagtgcagtgatgtgatctcagctcactgcaamctccgcctcccagatttaagtgattctcctgcctcagcctcccaagtagctgggactacaggcgtgcaccaccacgaccagctaatttttgtatttttag

SEQ ID NO: 28571 - DNA, 201 bp, Homo sapiens
ctaggaataaaccccacttctgggggcccattcatctatcagaatttattcttttgtttaaaatccaaattatttgacacctgttgtcccagcccactttrtgccatgctgtcaaaatttcacagccttcctttccactcccgagcatctactatctcacctgggagaggggcctgtggaggaaggggctgaagcagctgc

SEQ ID NO: 28572 - DNA, 201 bp, Homo sapiens
agcctagtatcaatgattctgcaacaagaattaccacacctggcacccagaatttgctttctaaataccgttctccactaaaaggttacgtccgtcacctyagagaaggagattctagaaatagagatcccagagctggtacagggaaggtacaaagtaggcttgaatgtcttgttctatcagaaagtgaagtgcttaaaa

SEQ ID NO: 28573 - DNA, 201 bp, Homo sapiens
tggaatgaggagcaatcactgctacatgggcatcagaagcctttacctggctgtgggctcttgagcgagtcattctcccgcatgttctctggccttcagtkctcactccagacctctcagctcatactttctatgatcaattgaatttcaaggatgggcaccacagcccatggctctcctgtgttaagctcacctgggctt

SEQ ID NO: 28574 - DNA, 201 bp, Homo sapiens
ggttatcaaaaccctttgctgctgcctcttgtcaagtccgaactccttagcatggcattcaaggcctcccgggtctgaccattcccctttcagaggctgaygtcccctgggtgccctgggagctgtagatgtcctgccaaggaagcggtgccatcgagcggtcagagcatggggtttgaagccagacttcttggatccaag

SEQ ID NO: 28575 - DNA, 201 bp, Homo sapiens
agccctgcacctctcttaagcagttctcatgtctggggcatggatcccagaggggacctctctctgagctgttccagcctctgacaaagcagggagaaggkgctctgagaaagacccgagataggccttggttagtgggaagcataggcctgtttcctctgatggatggtggccagacagaggtcaacttgttcctattag

SEQ ID NO: 28576 - DNA, 201 bp, Homo sapiens
gacagcctaccagttatgtcctccagctgagctcagcttttgtctctgtaaaaccacttctctatactaaatggtctctcagggtgtattttgccaaaggkcccagcagcaatggagggagacataaagcagtcacacagaataacttcattagttcactgagtgtgtatttggtatgtagtctatgttgggtgttctgta

SEQ ID NO: 28577 - DNA, 201 bp, Homo sapiens
cagagatttcttttctcttcagtcccatttctcagcctcctttcttctgtgttgccatccactattctgtttttctatgaacaggaacattttggcaaagrcaaatcaaaagaattccaactattcagctctcctcatgggaaggacctgctgtttaaggactctgcccacgggtttttaaaagtcccccccaggatggat

SEQ ID NO: 28578 - DNA, 201 bp, Homo sapiens
agggtattttgctgtagcagtggtgaagaaatcagcttctgacctcacctgggacaatctgaaaggcaagaagtcctgccatacggcagttggcagaaccsctggctggaacatccccatgggcctgctctacaataagatcaaccactgcagatttggtgagtgaatattgggaaggagggctggtgagggccatgccag

SEQ ID NO: 28579 - DNA, 201 bp, Homo sapiens
tgcccctgggtctaatccggattcccctctctgtgctctgtgtggtggcaggtgcaatcctgcccacatatgggcttacaacagccaggagagatactacrgctccagtggggctttcaggcaagtaatgtctgtgcaccacctttatctttgcaccaagccagtacatttcttgtcctgtcacttcttccatcatcccag

SEQ ID NO: 28580 - DNA, 201 bp, Homo sapiens
cagttataaaggagcagtcaaacaaagaccatagtgtattcgtcccaatgctcaggaagggggattgacacaacagtctgggcgaaagcttcctgttcacwcaactcatgcagtgaagtcacattgtaaggtgacagctgcctccactgtgaccacatggattgaggcggctggggtggggggagttggttctcaaaaaag

SEQ ID NO: 28581 - DNA, 201 bp, Homo sapiens
ctctgctctgctccacagcactcctggaagcctgcactttccgtagaccttaaaatctcagaggtagggctgccaccaaggtgaagatgggaacgcagatkatccatgagtttgccctggtttcactggcccaagtggtttgtgctaaccacgtctgtcttcacagctctgtgttgccatgtgtgctgaacaaaaaataaa

SEQ ID NO: 28582 - DNA, 201 bp, Homo sapiens
cttgcacacaggatttttcatttaatgctataaggtaggttttggcatcctctgaggatacacaagtggaccctaagctgagggagtttacagacagatcrtctaggattatacatctaggaagggaaatccaggtctttcccactgatcctcacctgacatgacatgaggcctgcacattttcagataagagtaagcacc

SEQ ID NO: 28583 - DNA, 201 bp, Homo sapiens
agcccatgttccctttcatctgaccctgacaagtaggtccttttcctggggacccttcctttctccccagagccctcaagcctggtcagtgtctcctctcrgtggatcgggcagagcctgaaaggacaatcatgcctctagtgtctgggcccactgtccagggactggccctcttccctcaatctcagcagtgttacctgc

SEQ ID NO: 28584 - DNA, 201 bp, Homo sapiens
cgaaaggccagttcttggtccttgtgttgttgcaggatttttaaggaatcagcttacacactctttaatttcttttaattcctgttccagtgttaattgawctaccagcatcactggcagcccccatcacttcctcctcttggatttcttccctggcttctggaataccacactctcttggattctcccttccccctcctg

SEQ ID NO: 28585 - DNA, 201 bp, Homo sapiens
ataggtggtctttattgtgttgaggtacatactttctgtacttaatttgttcagtttttatcatgaagtgaggttgaattttatcaatgccttttttgtgyctattcaaataatcatatggtttttgtcttttattctattaatgtggtgtatcccatttgttgatttgtctatgttaaatcatccttgcatttctggggt

SEQ ID NO: 28586 - DNA, 201 bp, Homo sapiens
aattagtatttaaaataaggacccaaacaatggttgtccatagtagaaataagtaagcagttttctttgtccatgacattttcccctataattcccagggrttgtgtgggcattgcaggtgttggtgtggaagtgttgggcatgtggggaaggggtatgaggctcaaagtgtgttccttgcggtgtctccctcccactcct

SEQ ID NO: 28587 - DNA, 201 bp, Homo sapiens
tgttggagcttatgcccaggaatatgggaggcaacacaagagagagagaattttctggctggctccccagagggtgttgaaaaggaagttgtaaaggggcygcggtgagaaaggagtgatgtctaggaatgtagaggcagggaacttttagcacctccacagtttgatgacatgcttcttcatgcatcgcttgtcttataa

SEQ ID NO: 28588 - DNA, 201 bp, Homo sapiens
aagaatgtaccttgaacccagagaaacatttttcatgggattaggggaacaaatgtatagtgatatacattcacttcattaatcctgagtagacatatagragtgtgataaaattcctgcaaaatcacctttcatgctgattttaatctccgatattgtgagtttggatccaatcagagagtcaccccttgcacatccctg

SEQ ID NO: 28589 - DNA, 201 bp, Homo sapiens
gccctgaaatagagacacatgtaagacaagggatcatgctcattcaggactgggattctatgaaggggcatgaaggaaagacatagggtggtggagcttargaaatgtgaatgggagtgattgatcctagctaggtatagagggacctgaagataggagagaaaactggagaggtgctcctgacaattgctagccatttcc

SEQ ID NO: 28590 - DNA, 201 bp, Homo sapiens
gaagctggctgggcttctgggtcgggtggggacttggagaacttttctgtctagctaaaggatcataaatgcaccaatcagtgctctgtgtctagctaaakgtttgtaaatgcaccaatcagcatgctgtcaaaacggaccaatcagcactctgtaaaacggaccaatcagcactctataaaatggaccaatcagctctct

SEQ ID NO: 28591 - DNA, 201 bp, Homo sapiens
ccctttgttttggcatttttatttccatactttgtggtttgtatgtgcccagttaaacggatgtacagattagataatctggctttaactccaaccttcaygagatgcacacatgccttaaaaagattcttacaaagaaactagaattaggagacaattctgacaacacaaaaacaagtgaacaaaaatcaaatgactgac

SEQ ID NO: 28592 - DNA, 201 bp, Homo sapiens
gtgcaaggtaatgctccactgaggacacattctcgcctatgggaactctggaggcagggctttgtggaggggctgccacaggcttatgttgcctcctaggrtttcccatgggccaagagggaaaatgggggtcgctggggtggccatccctggtggcccctcctcatgcatcctggagagctgtgggcctcctctccacag

SEQ ID NO: 28593 - DNA, 201 bp, Homo sapiens
tggtatattaaaaatatgttttacaacccaaatatccattgatgagtgaatagataaataaaatgtggtaaacacaaatgatgaaatatttttagccttaraaataaatgaaactctgatatatgctacactgagatgaaccttgaaaacataagtgaagcaagctagatacaaaaggacaaatattgtaagattccactt

SEQ ID NO: 28594 - DNA, 201 bp, Homo sapiens
ccttgctgtggtggcccacaaggagtggagatgacagagggccttggggacagggcaaaagctcatgtgatagggatgctgtctctgcaaccacatggatwttaatagttacccatggctggcttcagctttttttgtgaatggcagccaaaaagtgtggtgaaaatggagggatagttcagtggagacagaggggagact

SEQ ID NO: 28595 - DNA, 201 bp, Homo sapiens
aacgcagggctctgtagagtcagagaagtaaaaaggtagaaagggctggtcagtgtaaatgtgaggaggccagctgtgtctgatagctggcagttctctckattaggactctattctcccgcagagactgcgagacagacactctatccatcctgatgattgtgttgcaaaggaatggctctcagtccttgagagagatgc

SEQ ID NO: 28596 - DNA, 201 bp, Homo sapiens
agtatgtcactgccatccggaatctacgggaaggcacatgtgagtacctgggaagaaccaggtgaccacaagcacttgggaaacctggtgagcacaggggycagagattgagtcttttcagggacctgcacgcctctcctgatgctcctttttctgacctgtctgtgagcccagtgttagactgatgctgaatggcgttag

SEQ ID NO: 28597 - DNA, 201 bp, Homo sapiens
cttccctccagccttctctctgtagctttccctcttctgggtttggttattttgacttgtgagagcttgcttgattataatcctgtccctcccagctggcrcaggttcccctgggaaccctgcagctctagggctggacgctgtgttttaggccttagctctttggctccctgagcccccgaggcaccagtgatttcttag

SEQ ID NO: 28598 - DNA, 201 bp, Homo sapiens
tctcccctgcaaccctaggaaggttttcctgattccccactccttatcgcccagtccagtaaaagcatggcctctccgctcccctccctcctcaagagtcyggtggtgatgagccatgtttccctgcaccaggctgagggccttccattcacactgtgcctttgcagatccacagactttctattatgctgttgctgtggt

SEQ ID NO: 28599 - DNA, 201 bp, Homo sapiens
tgagatgaaccttgaaaacataagtgaagcaagctagatacaaaaggacaaatattgtaagattccacttttttttttttttttttttgagacggagtttygctctgtcgcccaggctggagtgcagtggcgcgatctcgactcactgcaagctccgcctcccgggttcacgccattctcctgcctcagcctcccgtgtag

SEQ ID NO: 28600 - DNA, 201 bp, Homo sapiens
tgtgggctcttgagcgagtcattctcccgcatgttctctggccttcagttctcactccagacctctcagctcatactttctatgatcaattgaatttcaasgatgggcaccacagcccatggctctcctgtgttaagctcacctgggctttccctccccagagaacttggcaaacaaggctgacagggaccagtatgagct

SEQ ID NO: 28601 - DNA, 201 bp, Homo sapiens
gggcagatctcagggaaatagctctatttttgatgtctcacaaatggctcagggaacaagcctgggttcgcaaagcaagaccagcctggatgcgttggtgmgcgcgagtgtgttgttttcacatataaaccgaaatggctgccttcttaattggaaaccttccaccagtaagtcctggagtgctgtttttcatgttcatcc

SEQ ID NO: 28602 - DNA, 201 bp, Homo sapiens
tagccatacagcccgacccagcgggcttgcagggtgactgatttcgtgaatgtcggttctcaggctgccaggctgctgcttctcaaggatgacccagactyagagaagtctctggtgtcaggcagaggacactgggtgggggacaggaggaactgctcaaaacagacagaggctctttgtttgctttgcttctgtgtcaac

SEQ ID NO: 28603 - DNA, 201 bp, Homo sapiens
ggaaacagaactactgcaaactttgaatggctccaatgactcaagtcctgctcttctctagggcactctcctgcagacccagatgatttagggcaccttasggcacctagggagaagcaagaatgatggcggcagagtcacaactctagttctacttttgccactttcttctgtgtgactgtggacaagtcaagaatccat

SEQ ID NO: 28604 - DNA, 201 bp, Homo sapiens
ggttgtaagtgagaaaacctcatgtgaagcagcttacaccaagggcactgtcttgacaggtgctctgggtgctccctccttgaaagggctgatacctgagmctaggaggccaacgaaaattctttaagggtagggttgccacatacaattcaggatgtccagttaaattagaattccaaatagacaacacatgatttttta

SEQ ID NO: 28605 - DNA, 201 bp, Homo sapiens
tgcctcagcctcccgtgtagctgggactacaggcgcgcgccaccatgcccggctaatttttgtatttttagtagagacggggtttcaccgtgttagccagkatggtctcgatctcctgacctcgtgatccgcccgtctcggcctcccaaagttccacttttatgaagtatctagaatagtcaaatttatagaaacagaaag

SEQ ID NO: 28606 - DNA, 201 bp, Homo sapiens
actggcagaagtgagagtcccattagtttgctgtgaaattaaattaaagaactgggaggaaggtggatactttaatactgaaaaaccacatcccagaggtrgaattcttatcggtggctaaaatgtgacaatgggatgctacagaaatgaagcagaaacaaaagctgatttatttgaagatggaaatggacagaagtgatt

SEQ ID NO: 28607 - DNA, 201 bp, Homo sapiens
atgcctgtcatttgcagccatgctcccttgtgttcctaagtcccaagagacagtaaatgagggcataagctattgcactgctgcccaccagcctggttccragctaggattaaagagagccagagcctgtgacacacccgcccacctctccacttatgcagctctgagcttcaccacctgcaccttgccctgtctttgtct

SEQ ID NO: 28608 - DNA, 201 bp, Homo sapiens
aaaaggagacagcagaccctggtcttcccagagctcaggcctcctggccactgcagtgacccaggcaagagacaggctggggtcagagcaaggtggtaccygcggacagggtgatacatggtcaaattctggatgtgtttttaaggcagaccccatggaaattcctgatggattggaggtgagatagaaggatcattaaat

SEQ ID NO: 28609 - DNA, 201 bp, Homo sapiens
ctagcaacatggcaaaaccccatctctacaaaaactacagaaatcagcttgtggtattcacctgtaatcccagctacttgaaaggctgaggtgggagaatygcttgagcttgggaggtcgaggctgcagtgagctgtaatcccaccactgtactccagcctgggtgacagagtaagacctcatctctaaaacaaaactatg

SEQ ID NO: 28610 - DNA, 201 bp, Homo sapiens
cttagctcagaatccttttgaaaatagtgctccaggctagaagccattattctcagcaaactaacgcaggaacagaaaaccaaatactgcatgtcctcacrttagaaatggaagccgaatgatgagaacacatgaacatatggagggaaacaacacacactggggcctgtcagagggtgggaggtagggggagggggagca

SEQ ID NO: 28611 - DNA, 201 bp, Homo sapiens
ggtattcacctgtaatcccagctacttgaaaggctgaggtgggagaattgcttgagcttgggaggtcgaggctgcagtgagctgtaatcccaccactgtaytccagcctgggtgacagagtaagacctcatctctaaaacaaaactatgtgtgctttgacccaattgtcccacttttggggatttattccacacaggttac

SEQ ID NO: 28612 - DNA, 201 bp, Homo sapiens
acaggttgaagttgtttatgcttcagagactaagtttttccttcttgaattgttcgtttttgggttgtgagcatgtgaaaatggtttagaagagcccttgsagaggagctgtgactggatccatctgaggtggatgaaagcaccatgaagaaatggtgatgggatagcacgaacttacagcaggacacaccagccctgttt

SEQ ID NO: 28613 - DNA, 201 bp, Homo sapiens
ggctcatttgttctctctgcgtggaggtcaaaaattgttccccagtgtcctgtgtgtcccctgctcagatgcttgacaggttgaagttgtttatgcttcasagactaagtttttccttcttgaattgttcgtttttgggttgtgagcatgtgaaaatggtttagaagagcccttggagaggagctgtgactggatccatct

SEQ ID NO: 28614 - DNA, 201 bp, Homo sapiens
cgcggtgctggtcctcatttctgggagaacactgctgtgctcagacttcctgaggtcccagcaacatggaaacgcggaaggtgcggctcaggttcctgtasaggctcatttgttctctctgcgtggaggtcaaaaattgttccccagtgtcctgtgtgtcccctgctcagatgcttgacaggttgaagttgtttatgcttc

SEQ ID NO: 28615 - DNA, 201 bp, Homo sapiens
gtggattctccaaaacctgtggatccattgaaagagtctggaaatctgtgtccatcacatcctgcctccctccccacctctaccttagatgaggctcagartccttgtcaggggagcagatatcaaagggtcaccctgcgactgcttggccttgaggcaaacactgggaaggactccatagctttccttctgaagtggagg

SEQ ID NO: 28616 - DNA, 201 bp, Homo sapiens
tggcttctaaagagcagaaatgaatttctttcagttctggatgctgggaagtccaaaatcaaggtacaatcagctttggcgtctagtgaggacccatttcytattttataaccagccatcttctcactgtgtcctcatatggcaacagaggcaaggcagccctctggggcctcttttattttatatttaaacatattttaa

SEQ ID NO: 28617 - DNA, 201 bp, Homo sapiens
catggtgtatatgtaccacatattcttcatccagtctaccgttgatgggcatttaggttgattccatatctttgctattgtgaatagcgctgcagtgaacrtatgcatgcatgtgtctttatagtagaacagtttgtattctttgggtatatacctagtaatgggattgctgggtcaaatgatagttctgtttttagttat

SEQ ID NO: 28618 - DNA, 201 bp, Homo sapiens
agcaaagttgttctgaggctgccctccccggggcctgctctcccagccctggaggagccggcgcgagacgcgcgggggcggggccgcgcgggggggcgggrctcaccaaggctccaccccgccgcggccactgttcgcacacacctggtgctgatcaacgccgaggccgactcgtcgccacccagcgcgccgcaggccggg

SEQ ID NO: 28619 - DNA, 201 bp, Homo sapiens
aggctgccctccccggggcctgctctcccagccctggaggagccggcgcgagacgcgcgggggcggggccgcgcgggggggcggggctcaccaaggctccwccccgccgcggccactgttcgcacacacctggtgctgatcaacgccgaggccgactcgtcgccacccagcgcgccgcaggccggggcggagaggcgcagg

SEQ ID NO: 28620 - DNA, 201 bp, Homo sapiens
cagcctcccaagtagctgggactacaggcatgcaccacctggctaatttttgtatttttagtaaagatggggtttcaccattgttggccaggctggtctcraactcctggcctcaactgatccacccacctcagcctcccaaagtggtgagattacaggcgtgagccactgtgcccggccccttggtgttttttaaaatct

SEQ ID NO: 28621 - DNA, 201 bp, Homo sapiens
ttggccaccaggaccagtggagacatgacattgtctccagcagggatggctcacttctgtagatctgggcgccctctagagggctttccccctgggtaccrggactcacctggacagggtctgagtcaagtgctgactctgggaggaagggactcttgggaaaaagacacagataccctgtcatccccacagaaatcagaa

SEQ ID NO: 28622 - DNA, 201 bp, Homo sapiens
ttgtatgtattggtcttgcaatgaatgacccagatgttatggtaaccaagggtgacactagctgaggtagacagatgagcaggtaccctgcttatatgatyataacttggttcaatttttaataagttgacattttgaacatttttcatgcttagaaaaatgatcaaacagcaagccagcaagctcttccaacatgatcta

SEQ ID NO: 28623 - DNA, 201 bp, Homo sapiens
cagtctaccgttgatgggcatttaggttgattccatatctttgctattgtgaatagcgctgcagtgaacgtatgcatgcatgtgtctttatagtagaacartttgtattctttgggtatatacctagtaatgggattgctgggtcaaatgatagttctgtttttagttatttgaggaattgtcacaccactttccacagta

SEQ ID NO: 28624 - DNA, 201 bp, Homo sapiens
ggtaatgtaacagcgtggcagtgagcactgcttaacatctctttgaaataaacaacaaaaggcaggtggccgtcattgccagccctccaaagtaaggcttytgcagggaaagtggtggacagcttgtaggccagtgtagactgttttacaactcgaggtctcaattctgtcactgtcgcagtgaatgaaaatcacttcacg

SEQ ID NO: 28625 - DNA, 201 bp, Homo sapiens
gggtcacctgggtgggcttggtaagtgtagaatcctgggtcctgctctcctgaccaacccactgactctgactctctgaggctgggacctggaaatccatwccttagctaaagtggcataacatatgacaaccacggtaatctcattatatctaaatgattgtaaagcatcctatgggtgtgtatatgtaatgttgacaaa

SEQ ID NO: 28626 - DNA, 201 bp, Homo sapiens
tcaggcagctttccgggctccagaggtaaattgccagctgtaaatttctggcccttctccaagatgataataaactgtatttgaagtagcagagagtggtrtgtgaatcatttttgattactcagtggccgcttgagtataggtcttgtgtgggtaactttatatggaaaataaaaaggaattggtgaagtactaactgct

SEQ ID NO: 28627 - DNA, 201 bp, Homo sapiens
tatttgctagttgtgaccttgagagcagtatggttcaatggaaaactgctttggatcagtcctgggttctaattccagcaccaccaattactagctactargtaatcaacttctctaaacttcatttccttacctgtaagaggataataatctcagctgggcacggtggctcatgcctgtaattccagcactttgggaggc

SEQ ID NO: 28628 - DNA, 201 bp, Homo sapiens; identical to SEQ ID NO: 6015

SEQ ID NO: 28629 - DNA, 201 bp, Homo sapiens
aaacagaaacaaaaacttcaggttactatgagaagtttctgggttgtttttcctcttgcttgcttcgttgcccttcctttccccaggggagtttgtctagraattgttttgtagatgtttgggatgaaaataggcgagcgcggtgctggtcctcatttctgggagaacactgctgtgctcagacttcctgaggtcccagca

SEQ ID NO: 28630 - DNA, 201 bp, Homo sapiens
cgcagtgagtacagattgcgccactgcactccagcctgggcaacagagggagacactgcctcagaaacagaaacaaaaacttcaggttactatgagaagtktctgggttgtttttcctcttgcttgcttcgttgcccttcctttccccaggggagtttgtctaggaattgttttgtagatgtttgggatgaaaataggcga

SEQ ID NO: 28631 - DNA, 201 bp, Homo sapiens
gacattttgaacatttttcatgcttagaaaaatgatcaaacagcaagccagcaagctcttccaacatgatctaactcagcagtctccaaacaggatgcccytgagttgttcaagacatttttagggtgagaaagaagacagcagagtttatatttttgctgatttttaatttttttccttaaaatttgagtatattttata

SEQ ID NO: 28632 - DNA, 201 bp, Homo sapiens
ttttaatttttttccttaaaatttgagtatattttataagatacaccccatgttagtacagtagtatgcacgtattatttataaataaaccggactagccrgatgtggtgggacacgcctgtaatcccagctactcaggaggctgagacatgagagtcagttgagcctgggagctggaggctgcagtgagctgagattgtg

SEQ ID NO: 28633 - DNA, 201 bp, Homo sapiens
tgtcaaatttttagtattgcttatgtttttaatttttttcaattttccaggttctttctatcctaaaaatgctgcatgtcatgtgctttcttaaaaactgmagtgatttgatgctttgttttgataattttttaaagaaaatttgcgatacaccagggtgtggctaagtcagagctgtaaatcagtcttataatatcatac

SEQ ID NO: 28634 - DNA, 201 bp, Homo sapiens
aagaatttggccagaaaggcggggggaaatcttgacatttgcactaatttgtagtaagggacacttactaaatacactcatgtacctactccagagacacyaatacatttatttgtaaatacattaacacttagcttacgtaaaccaatacccaaagtgttaaattttaggttgttttgagatgaaacagcataaccatta

SEQ ID NO: 28635 - DNA, 201 bp, Homo sapiens
tttattttctttctcagaaaaggatgcgcctccacttagcaaggctgggcaggatgtggttctgcatctgcccacagacggggtggttctagacggccgcsagagcacagatgaccacgccatcgtccagtatgagtgggcactgctgcagggggacccgtcagtggacatgaaggtaacgcatgttgtcactgctaacaa

SEQ ID NO: 28636 - DNA, 201 bp, Homo sapiens
agatacagtaagagggccagttaaacatggatttttttttttttttttgagatggagtcttgctctgtcagcagattggaatgcagtgggtgatcttggcwcactacaacctctgtctcccagttttaagcgattctcctgcctcagcctcccgagtacctgggactacaggcgcacgccaccatgcccagctgatttttg

SEQ ID NO: 28637 - DNA, 201 bp, Homo sapiens
cgtagggcctgttctctgtgtggtccatgtcattcattaacaattccaccctcttgtatccaagctaccccgaggaaagaaatctggtttccagccctacraagggctagaaaagtggtgctacatccacattcacgtggaatctgctttttgaaacttgagaattcctgggcatgttaaagtatttcttccggatcatgc

SEQ ID NO: 28638 - DNA, 201 bp, Homo sapiens
aggctgaggcaggagaattgcttgaacccaggaggtggacgttgcagtgagccaagatcgtgccactgcactccaatctgggcaacagagactctgtctcaaaaaaaaaaaaaagtaaataaataataataatttccccctcagtattataacttaatagttaagtaatatatcattaaattagaagtactggtctctacc

SEQ ID NO: 28639 - DNA, 201 bp, Homo sapiens
cgtaagatgaggatagtaacaatacctgcctcatagggttgctgagaagaatatatgggataattaatctcaagcattgaatgcactgtgtggctcatatsatgagccaaatatagaaacgatggcagttattactcagttatttacgatgaaagaagagtaaaggtcttagaatacctagttctctttccaagtgcccta

SEQ ID NO: 28640 - DNA, 201 bp, Homo sapiens
accgtgcctggccctcacttcattgttgatgccttagctccctcatttgtaaaatggggataataatagcaccaacttatgtggtggttgtgagaattcartgatttaagctataaagctggtattcttggccttagcttatcttgaggggggtggtatttatttacaaataaaaggattatcagcacttagctcagtgtc

SEQ ID NO: 28641 - DNA, 201 bp, Homo sapiens
ttacaaataaaaggattatcagcacttagctcagtgtctggcacatggaagaaggcttttaatgaatgcagaatgaatgaataaatgagagcaaatggtayagaatgagcctacacaaaggagatgtttctcctctagttctaccagttggcaagatccctacagctaaaaacagttccaccatataatctccagacctgg

SEQ ID NO: 28642 - DNA, 201 bp, Homo sapiens
aggtttactcatattggcatgcatatgggagacttcatatacacttctgtgctcaccgatggtgtaaattgctacttccctcttggaaaccagttgggaartatgtggcagagaccattaaaatattcatttcatacttctggaatattttttaggaaaaggaaccatgctgaagagaacatatgagcaaaaaagtgtttt

SEQ ID NO: 28643 - DNA, 201 bp, Homo sapiens
aacatattttaacttttaggttaaggggtacatgtgcaggtttgttatatagataaacttatgacttaggggcttggtgtacagattatatcctcacctgrgtattaagcatattacccagcagttttgttttttttctaaacctctccctccttccatcctccaccctcaagtaggtcccagcgttgtgctgttcccctt

SEQ ID NO: 28644 - DNA, 201 bp, Homo sapiens
aaagacacatgcacatgtatgtttattgtggcactattcacaatagcaaagacttggaaccaacccagatgtccattaataatagactggattaagaaaaygtggcacatatactccatggactactgtgcagccataaaaaaaggatgagttcatgtcctttgcagggacatgggtgaagctggaaaccattctcagcaa

SEQ ID NO: 28645 - DNA, 201 bp, Homo sapiens
agtgactcactgacttttgcagggagctctggcacagggtgacgccagcagcctcatggatggtacacccagctccctggcctcagtgcttccttggttthttctattctattctattctattctattctattctattctattctattctattctattctattattttattttattttatattgagataggatctcgctct

SEQ ID NO: 28646 - DNA, 201 bp, Homo sapiens
agctgtaatgtataactgctgagttataagatgctttccagaattataaagtcataaaccattgtgtggaaacaatgaacctttcagaaccaaagaaaagrtcaacactatgaaaggactatcaaaataatgcaagtgtcctatctctccttacctggcagaagcagcataaagacatcagacactccgtgtttgttcaga

SEQ ID NO: 28647 - DNA, 201 bp, Homo sapiens
actcttaagtgactggaaaaatgggacacgtcttctccatagttagcaatagcatgtaaaaagcaattgtgcttaattcctcataatgtgttttttttttwaaaaaaaaaaaaaaggcatcttccctttgtggctggcagcagcattctcattcagaaaagccgcatctctaagagccccagacccctcacataaatcccc

SEQ ID NO: 28648 - DNA, 201 bp, Homo sapiens
cccctgtggaggaaagtgatgggctcgaaagcaggaggagaggcggtgccttgcagcactgtgcagggtgagccaaagaggggcaagcccagccagcactygaaccagagctttggcactgaaggaatggggaagtggatgccaaagagggcgtggtacacaaacctgtagagtttttccagttctgttgctgtttcttta

SEQ ID NO: 28649 - DNA, 201 bp, Homo sapiens
gctccctaaatgtctgtacgctagcagaaggcataaaatggagactgtataaaactgattatgccaaaatggtttattatctcaatgtgcttttctgctgagagtgagcagcaatctcgatcatttgtcttggagcctaccctccttctagctgctgtttgtgacttgtctagaggacaaagacacttcaaggaagaaggc

SEQ ID NO: 28650 - DNA, 201 bp, Homo sapiens
aagaaagaagaaaaactgaagaaaatgtaatgaagtatggatttgaggaaggacgaagagtctcaaaaccttaagtttacgtttagtctttgtccatttcttttttcttttctttcttttttttatgagaccagttctcactctgtcacccaggctggagtgcagtggcataatcatggctcactgcagcctcgacttccc

SEQ ID NO: 28651 - DNA, 201 bp, Homo sapiens
  misc_feature (1)...(201): n = A,T,C or G, or insertion/deletion polymorphism (see Tables 1-2)
attgtcagtcaaggccttggccacctaaataaactagaacttatgagttcaaggtgggccagctgccaacagtgtgtgatgtagttcagcagcctcgggcnggagtgcagaggcaggtcctggggctgctctgaggacatggactttcggttgaggatggtgttgggctcggagctcaagtctgctgctcgacgtgatgtg

SEQ ID NO: 28652 - DNA, 201 bp, Homo sapiens
tgatggtgtaaattggtacttccctcttggaaagtaattggaaaatatgtggcagaaaccattaaaatattcatacttctggaatattttttaggaaaatsatctatgctgaagagaacgtatgagcaaaacatgtttattatggcattatttataatggtgaaaaagtaacaaagtaaatgtccagtagtacagattagg

SEQ ID NO: 28653 - DNA, 201 bp, Homo sapiens
tgtctcaatcagtcaatcaataagtattacaggattccatcattttttacacacttattatttgcatgattatgtgacatgagacagaaatagagattatyacatttccaaaagcttttctaatgtcttttcagactctgcataagttgtattgaaataacctgacatgattttagtaagtttattaagaaaaatttttgt

SEQ ID NO: 28654 - DNA, 201 bp, Homo sapiens; identical to SEQ ID NO: 6014

SEQ ID NO: 28655 - DNA, 201 bp, Homo sapiens; identical to SEQ ID NO: 6008

SEQ ID NO: 28656 - DNA, 201 bp, Homo sapiens
gagagaccaggtggaggttactgaattatggaggcagtcacccccatgctattctcatgatagtgagtgagttctcgcaagatctgctggttttataagtrtttggttgtttctcctgccaccttgtgaagaaggtgccttgcttcccctttgccttctgcggtgattatactagtaagtttcctgaggcctccccagcca

SEQ ID NO: 28657 - DNA, 201 bp, Homo sapiens
ctattcagcaaacaagatacctctccataaattagaaaaaataagaaatcatcttttatgaattatttattttctttctcagaaaaggatgcgcctccacktagcaaggctgggcaggatgtggttctgcatctgcccacagacggggtggttctagacggccgcgagagcacagatgaccacgccatcgtccagtatgag

SEQ ID NO: 28658 - DNA, 201 bp, Homo sapiens
gtgattttaaaattaagtgaaaaatccactctagaaaataaaactgcttctccatatttacacattggtgggacctcgtatgctgccttgtacccaaaatygctaccagccaacactccacacagcctcttctgcgcatattatagctaaattccacgatcataaaataaatagaaaaataatttccatttaatatggatt

SEQ ID NO: 28659 - DNA, 201 bp, Homo sapiens; identical to SEQ ID NO: 6009

SEQ ID NO: 28660 - DNA, 201 bp, Homo sapiens
gtctaagaaagattaggtcatcaaattttttaaaatatccattgcatggaacttagcgacactaaagatattgtagtattgtagagggaacccctcaccayacacacaattcacttctggagaggtgctaaggtcttgtacatttaaatatcctgttactcggtcatcgtgtattttcttagtgtatgcagtgtgcagggt

SEQ ID NO: 28661 - DNA, 201 bp, Homo sapiens
ctgcactccagcctgggcgacagagcaagactccgtctcaaaaataaaataaaaaaataaaaataaaaatacaaaaaattagccgggcatggtggcgggcrcctgtagtcccagctacttaggaggctgaggcaggagaatggtgtgaacccaggaggcagagctttcagtgagctgagattgcgccactgcactccagcc

SEQ ID NO: 28662 - DNA, 201 bp, Homo sapiens
tgaggtgggaggatcacttgagcctgggaagtcgaggctgcagtgagctgagattgcaccactgcactctagcctgggcaacaaagggagaccctgtctcaaaaaaaaaaaagaaaataaaacatactcatattttcaatatggatatcaacaccatgagatttgcaccataaaagcagtggttaaatatgtacctattaa

SEQ ID NO: 28663 - DNA, 201 bp, Homo sapiens
ggctctacctttagaaccttgaataagtcacttcatatctctggacctcagttgcctcatctgttaataagggacttcaaccagatgtcctccaaggtgcygtccagcactgaggaatgataaataggctgacattcatactttaccccatcagcccttacccatgctaggtgtcactcattggtcccagcactgtcccat

SEQ ID NO: 28664 - DNA, 201 bp, Homo sapiens
tcatgtattattaactattcatcaaaaacacactttttgaaagtcctggggtgaagaaagtgggaagaaaaaaacaaaactgaaaatgttagaaagagccmtcacatcctgtagtttctgttcagacagtagctgtccctgccctccccctctgctgtccctaagaccaccagagtagagtcctcagcctctgatttcatg

SEQ ID NO: 28665 - DNA, 201 bp, Homo sapiens
gctgaggtgggaggatcacttgagcctgggaggtcgaggctgcagtgagataagattgtgccactgcactccagcctgggtgacagagtgagaccgtctcaaaaaaaaaaaaaaaaaattctcacttacccactaaactgtatgaccttgagcaggctatcttatctctctggatctcagtttcctcattcgtaagatgag

SEQ ID NO: 28666 - DNA, 201 bp, Homo sapiens
ctgaggtgggaggatcacttgagcctgggaggtcgaggctgcagtgagataagattgtgccactgcactccagcctgggtgacagagtgagaccgtctcaaaaaaaaaaaaaaaaaattctcacttacccactaaactgtatgaccttgagcaggctatcttatctctctggatctcagtttcctcattcgtaagatgagg

SEQ ID NO: 28667 - DNA, 201 bp, Homo sapiens
aggtagggaaggcgggaggatgcaggaatgagtgagagatgctggagagaggtgtcttgtagtgactgagcctgcctgctagaatctgtagaacagaggarggtgcttgaagttctggggcctggcgtctccacaaacaagtccctgctcatgcccccaggacttggtgtctgcttgtcctccatcccaggctgtcgtgag

SEQ ID NO: 28668 - DNA, 201 bp, Homo sapiens
tgggtttattacatttttttgacaaaaattcaaaattacatatattttgttcttcattagcaagtcacacattttaaaatggcacactcccttcctcttcstgttgttatttgtttattttaaggactgtttctgggtagataagctctgggttattttaaaatacattttacaatggaaatggcctggacttgaactgaa

SEQ ID NO: 28669 - DNA, 201 bp, Homo sapiens
aaaaggaaacattatctgtgttatttcagacacatcagtgatcagtttagaagataggatgatttcactaagcttataattcatcttaaagctcacctaawtaaaagtaagtgactaaaatgatctttttcttccaggagaggtaggattaattaattgtataatgtgtggaatatttcagcgcttatctgattcttccat

SEQ ID NO: 28670 - DNA, 201 bp, Homo sapiens
ttcaaggtgggccagctgccaacagtgtgtgatgtagttcagcagcctcgggccggagtgcagaggcaggtcctggggctgctctgaggacatggactttyggttgaggatggtgttgggctcggagctcaagtctgctgctcgacgtgatgtgtcccatctgtgtggcaggtgcctcaatcaggaaccctgaagctgtcc

SEQ ID NO: 28671 - DNA, 201 bp, Homo sapiens
ttcatctagagctagtttttgtgtgtgctgtaaggaaggggcccgcctcattcttctgcatgcagcatccagttgtcccagcaccattcactgtagtgtasaatgcacctgcccaacctcctgtccctccctcctgcactcagcatcagaagtgcgtcctgctgaatggttctcccagggtttccaccaatgaattcccct

SEQ ID NO: 28672 - DNA, 201 bp, Homo sapiens
aacatcccagggatcctcttcctcacgtcatccttaagagcaggcacccacttgtctgaagcctgcatgaagccccattcgcctaccccctacctttctcyctcctccttgtcctcagccagttcttgtgctcaggacactcaccaaccatgatctccaaggctattagtagcaacagcagaaacaaaagaaggcgcacag

SEQ ID NO: 28673 - DNA, 201 bp, Homo sapiens
gccttcgtgtgggagccagctttggtatggatcaatgccctggcagtggcctcttaggctgtgtgcctgattgtgtctgtggatgaaaccatcaagaatcygattgactgtggatgctcccccagcagctagctggggccgtggtcgtggccgcccccattgagaggcaccccgcctatcacatgactggctggcaggctg

SEQ ID NO: 28674 - DNA, 201 bp, Homo sapiens
aggccttcgtgtgggagccagctttggtatggatcaatgccctggcagtggcctcttaggctgtgtgcctgattgtgtctgtggatgaaaccatcaagaayccgattgactgtggatgctcccccagcagctagctggggccgtggtcgtggccgcccccattgagaggcaccccgcctatcacatgactggctggcaggc

SEQ ID NO: 28675 - DNA, 201 bp, Homo sapiens
cccggcctgcggcgcgctgggtggcgacgagtcggcctcggcgttgatcagcaccaggtgtgtgcgaacagtggccgcggcggggtggagccttggtgagycccgcccccccgcgcggccccgcccccgcgcgtctcgcgccggctcctccagggctgggagagcaggccccggggagggcagcctcagaacaactttgct

SEQ ID NO: 28676 - DNA, 201 bp, Homo sapiens
cctgcgcctctccgccccggcctgcggcgcgctgggtggcgacgagtcggcctcggcgttgatcagcaccaggtgtgtgcgaacagtggccgcggcggggwggagccttggtgagccccgcccccccgcgcggccccgcccccgcgcgtctcgcgccggctcctccagggctgggagagcaggccccggggagggcagcct

SEQ ID NO: 28677 - DNA, 201 bp, Homo sapiens
cactcccaaacatgcacacgttccctctgcacgggtgtttggaacaccagccatcccccaccccctaccttgtgccagcaggagatgtttgtccttctgcygtctctaggatggagaggcctgaggtgactgcttcctcagagtctctgtgcaaactctctgaggagcagaaaccagttcagtctctctgggtgtggagag

SEQ ID NO: 28678 - DNA, 201 bp, Homo sapiens
ccaaccccacttttacttcattatctgcccctggttctctcaccactcgagcccctgctttcctccttcactcccaaacatgcacacgttccctctgcackggtgtttggaacaccagccatcccccaccccctaccttgtgccagcaggagatgtttgtccttctgccgtctctaggatggagaggcctgaggtgactgc

SEQ ID NO: 28679 - DNA, 201 bp, Homo sapiens
aatgcccccaggatgatccatctatctggtagactagaagaagaccagtggatatctgaagcatttactggtgacactaaaaaaaaaaaaaaaaaaagaaraaaaagcacaagccctgtcacataaaaaaaaaaagcataaaaatatgctttccttagcccctgctttccccaggaacacatggtgccccacataatcact

SEQ ID NO: 28680 - DNA, 201 bp, Homo sapiens
ctggtctttatctggggtttgatgtcacaaaggagcatcctgaggtctcgccccacttctcccagcgtttgggtcaattctccccaagtgctggtggcatwtaccttcttccccaggaggcccagaggtttgaccatgttgttgtcactgttgtactgaaggaaaagatttttattcaagaagacctgcgcttcacaccag

SEQ ID NO: 28681 - DNA, 201 bp, Homo sapiens
gtgacagagaggcctctagcggttatatcacgtaaaatctcgggagttgtgctttaaatgacataaggaataagaaaatgtccaacccagtgggggcttcmccttggcgttctagacttctgtgagcagcatctgcatcttgtttgtttctgaatcagtttctgttgattcatttttctcctgattgtggatcgcattttc

SEQ ID NO: 28682 - DNA, 201 bp, Homo sapiens
tgtctctgcctctactatctctgtttcaaccccatagcagtggttctctggcaaacttcaggaggtctcactctgagcaagcactactcggccaaggactycccccacagacttctgcccctcctctccacttggcaatcccctctttggtgacctgtcctgcaaattccagtcactttagctgccccaatctctgatctc

SEQ ID NO: 28683 - DNA, 201 bp, Homo sapiens
cactgaataagcttccaaaatgatgcccacactagttatcctgttgaaagaggggactgatagctcccaaggcatcccccagcttgtgaataacctcagtrcctgccaggtgattgccaaggctgtaagagccaccctgggtgcctgtggcatggacaagcttattgtggatggcggaggcaaagcaacaatatctaacga

SEQ ID NO: 28684 - DNA, 201 bp, Homo sapiens
ggaggctgaggcgggcaaatcacgaggtcaggagttcaagaccagcctggccaacatagtgaaacccgcatctctactaaaaatacaaaaaaaaaaaaaaatagctgagcataatggctggcacctgtaatcccagctactcgggaggctgaggcaggagaatcgcttgaacctgggaggcccaggttgcagtgagctgag

SEQ ID NO: 28685 - DNA, 201 bp, Homo sapiens
tcatcacattaggtttcaacataggaattttggggggttacaaacatccaatctacagcaacaccctagtgacatcgttttttgttgccctcccctccccwctactgcccatctaagtacttttacaggcatcgaataagttaagtcagtgcatgtgaagtgcttagaagggcatctgacacattatagaagttcaataaa

SEQ ID NO: 28686 - DNA, 201 bp, Homo sapiens
ttttgggaggtcagggaggctggatcacctgaggttgagtttgagaccagcctggccaacatgttgaaaccctgtctctactaaaaataagagaattagcygggtgtggtggccagtgcctgtaatcccatctactcagcttattgagtcaggagaatcacttgaagccaggaggcggaggttgcagtgagccgagatcac

SEQ ID NO: 28687 - DNA, 201 bp, Homo sapiens
ttgtgctcaggacactcaccaaccatgatctccaaggctattagtagcaacagcagaaacaaaagaaggcgcacagggctagaagtcagggatattcttcrcatactgtggagagtaacaggcaggaagctgggcgtgtacacattcaccctcactggtatggtgaagaaatgttatccaacagcgtgggtgtgggcactg

SEQ ID NO: 28688 - DNA, 201 bp, Homo sapiens
ttcataatgggagacctctgcctgcccaggccatcctggaccttcttcacctgaacttgttcccctaaagcaatgaccactttaaaacataccttagtaarccgcgcacagtggcttacacctgtaatcccagcattttgggaggtcagggaggctggatcacctgaggttgagtttgagaccagcctggccaacatgttg

SEQ ID NO: 28689 - DNA, 201 bp, Homo sapiens
tttgtaccagtaccattctgttttgatcactgtagccttatattatagtttgaagtctggcagtgagatgcccctggctttttttttttttttttttttttgcgtatgattgttttggctatttgggctctgttttaattccaaataacttttagattagatttttctaatgttgtgaaaaatgatgttggttcgataggg

SEQ ID NO: 28690 - DNA, 201 bp, Homo sapiens
ctcattttggttgacacaataatccataaaaacaagtaaagtgcccactctgatctggaaggggtaaggaggtgaaagcattgataagccaaagtgacagmctcttttgtagacatgatcctgcctaaatttctcatgccctacaaaagagggccctgaactccccgcttctccagagcttcatgcagtccttgaagcact

SEQ ID NO: 28691 - DNA, 201 bp, Homo sapiens
tcccctctcttactgcctgcctctgtttgcccaccccattccacacttaccactggtctttatctggggtttgatgtcacaaaggagcatcctgaggtctygccccacttctcccagcgtttgggtcaattctccccaagtgctggtggcatttaccttcttccccaggaggcccagaggtttgaccatgttgttgtcact

SEQ ID NO: 28692 - DNA, 201 bp, Homo sapiens
tacatttgaaaacggttgaaatggctcctggctgtggcagggcagcaggctggggccatggcaggccaagtgcaggcccaaatcagactgcaggagcttchcatacactctgggcaggcacctgcctctcagtagctcactgagagatgagggcacccagcaggggtccccaagggaaggcacaaagagggagccagcctg

SEQ ID NO: 28693 - DNA, 201 bp, Homo sapiens
gggagccagcctgagattaaggggctgtgaaaacaatgcttttccagaagtcctagctggttaccttcacagctgcttgcaaaacagagaaattctacatycactcacagcagccatgtccacagggtgctccagacggccaggaagttaaagtcacgccacctggctgtggagatcaatgaggctgaagtgcaacaggag

SEQ ID NO: 28694 - DNA, 201 bp, Homo sapiens
catggactgcccttcaggcatctgcccggctcactcccactcctgctcccaggtggcacacccttccacgcctggttctccctgcccctcgcatttggaayccttgtatttctttctttctttctttttttaaaattgtggtatgattcatgtaacgtgatttttcatcttaaccactgttaaatgtaaaggcctctattt

SEQ ID NO: 28695 - DNA, 201 bp, Homo sapiens
aacaggcaggaagctgggcgtgtacacattcaccctcactggtatggtgaagaaatgttatccaacagcgtgggtgtgggcactgcccaaattctttaccytggaacaactgaggtcaggcctgtagagacccaattaaagaacaattttgtgaagagagtgttttccaagtattcagaatataatcatttattgaaaaat

SEQ ID NO: 28696 - DNA, 201 bp, Homo sapiens
tttctccctcctccttgtcctcagccagttcttgtgctcaggacactcaccaaccatgatctccaaggctattagtagcaacagcagaaacaaaagaaggygcacagggctagaagtcagggatattcttcgcatactgtggagagtaacaggcaggaagctgggcgtgtacacattcaccctcactggtatggtgaagaa

SEQ ID NO: 28697 - DNA, 201 bp, Homo sapiens
ggggtagcattgtagaactgccctctgtgagccagtgccttgcctagggcctcaggctgtggtctcccatgaactgggtgtaacatcccagggatcctctycctcacgtcatccttaagagcaggcacccacttgtctgaagcctgcatgaagccccattcgcctaccccctacctttctccctcctccttgtcctcagcc

SEQ ID NO: 28698 - DNA, 201 bp, Homo sapiens
agataaacagatatagatatatatgtggttaagatggaacattttgtgttacatcaattatatcaaaatttaaaaattaaacaaagaaaataataaataaaaggattccaaagtgggagggtggtggcagcaggtgtggaagggtgtatcacttaggaacaggtgtggaagtgagctgggtagacttctgagggaagaaca

SEQ ID NO: 28699 - DNA, 201 bp, Homo sapiens
atgacattcaatagaaaggaaaaagaggcatttatcacaggacacacgctgaattcctgtggggtcccagatgttcaggaaagtgacctggagtagaaggyggggggtagcattgtagaactgccctctgtgagccagtgccttgcctagggcctcaggctgtggtctcccatgaactgggtgtaacatcccagggatcct

SEQ ID NO: 28700 - DNA, 201 bp, Homo sapiens
tagataaacagatatagatatatatgtggttaagatggaacattttgtgttacatcaattatatcaaaatttaaaaattaaacaaagaaaataataaataaaaggattccaaagtgggagggtggtggcagcaggtgtggaagggtgtatcacttaggaacaggtgtggaagtgagctgggtagacttctgagggaagaac

SEQ ID NO: 28701 - DNA, 201 bp, Homo sapiens
agtgtatgacctcctgagacttaaactctagctgaacacacatgacattcaatagaaaggaaaaagaggcatttatcacaggacacacgctgaattcctgyggggtcccagatgttcaggaaagtgacctggagtagaaggcggggggtagcattgtagaactgccctctgtgagccagtgccttgcctagggcctcaggc

SEQ ID NO: 28702 - DNA, 201 bp, Homo sapiens
atagataaacagatatagatatatatgtggttaagatggaacattttgtgttacatcaattatatcaaaatttaaaaattaaacaaagaaaataataaataaaaggattccaaagtgggagggtggtggcagcaggtgtggaagggtgtatcacttaggaacaggtgtggaagtgagctgggtagacttctgagggaagaa

SEQ ID NO: 28703 - DNA, 201 bp, Homo sapiens
tataatcatttattgaaaaataaaagaagacatttaaaaacaaaattaactttgaataaactctctctcctctcctgtccctgctgcccctgcaaaaaaamccccctctggtgtgagcaggatggttggaggttatgtgagctccttctcctttcctccagtttcctcttcccttctcctccctgcctcttttgcttttcc

SEQ ID NO: 28704 - DNA, 201 bp, Homo sapiens
attaattactgtccaggtcatgttcattgcgtcaaagaggagggatttctctccattggtggcgaactgccaggatgcaccagtgcaccgttctgcttcaygttgacaaaacatctcgacttgcagagtggaaggatctgcaatccaaacacaaagccatcatcctccactctttgagaagtccatcatcctccaataggt

SEQ ID NO: 28705 - DNA, 201 bp, Homo sapiens
gatagataaacagatatagatatatatgtggttaagatggaacattttgtgttacatcaattatatcaaaatttaaaaattaaacaaagaaaataataaataaaaggattccaaagtgggagggtggtggcagcaggtgtggaagggtgtatcacttaggaacaggtgtggaagtgagctgggtagacttctgagggaaga

SEQ ID NO: 28706 - DNA, 201 bp, Homo sapiens
tctttcttccatgtctccttgatcttactggcttcatgattaattactgtccaggtcatgttcattgcgtcaaagaggagggatttctctccattggtggygaactgccaggatgcaccagtgcaccgttctgcttcacgttgacaaaacatctcgacttgcagagtggaaggatctgcaatccaaacacaaagccatcat

SEQ ID NO: 28707 - DNA, 201 bp, Homo sapiens
tctgtctttcttccatgtctccttgatcttactggcttcatgattaattactgtccaggtcatgttcattgcgtcaaagaggagggatttctctccattgrtggcgaactgccaggatgcaccagtgcaccgttctgcttcacgttgacaaaacatctcgacttgcagagtggaaggatctgcaatccaaacacaaagcca

SEQ ID NO: 28708 - DNA, 201 bp, Homo sapiens
tgattttcatgaaaaaaacaaacaaacaggagtttattatctatctatctatctatctatctatctatctatctatctatctatctatctatctatctatcgtctcttgtatatacacaggaaacacctggagaaaacaagtaatccttaaagtgctggcttagagctccagcatcttcaacagaaaacaataaacgtcta

SEQ ID NO: 28709 - DNA, 201 bp, Homo sapiens
atgattttcatgaaaaaaacaaacaaacaggagtttattatctatctatctatctatctatctatctatctatctatctatctatctatctatctatctatcgtctcttgtatatacacaggaaacacctggagaaaacaagtaatccttaaagtgctggcttagagctccagcatcttcaacagaaaacaataaacgtct

SEQ ID NO: 28710 - DNA, 201 bp, Homo sapiens
ctggtgttgcatttaagaagactttctcttatgctgggtttaaaatgcaaccctcccaaaaataccaaaatccctagattgcccttttgaatgttgagctygagttgaaagctgagaaagataatgcttagataaaagtccacacggttgaggattatcaggcgattgttgatgccgagtggaacattctctatgacaagt

SEQ ID NO: 28711 - DNA, 201 bp, Homo sapiens
aatgattttcatgaaaaaaacaaacaaacaggagtttattatctatctatctatctatctatctatctatctatctatctatctatctatctatctatctatcgtctcttgtatatacacaggaaacacctggagaaaacaagtaatccttaaagtgctggcttagagctccagcatcttcaacagaaaacaataaacgtc

SEQ ID NO: 28712 - DNA, 201 bp, Homo sapiens
aaatgattttcatgaaaaaaacaaacaaacaggagtttattatctatctatctatctatctatctatctatctatctatctatctatctatctatctatctatcgtctcttgtatatacacaggaaacacctggagaaaacaagtaatccttaaagtgctggcttagagctccagcatcttcaacagaaaacaataaacgt

SEQ ID NO: 28713 - DNA, 201 bp, Homo sapiens
gagttcatcggttggaggagcccaatcagctgctcattagtgtgcctttgacaagcctttgtacggcggggaggaaaaatgattttcatgaaaaaaacaaacaaacaggagtttattatctatctatctatctatctatctatctatctatctatctatctatctatctatctatctatcgtctcttgtatatacacagga

SEQ ID NO: 28714 - DNA, 201 bp, Homo sapiens
acagagttcatcggttggaggagcccaatcagctgctcattagtgtgcctttgacaagcctttgtacggcggggaggaaaaatgattttcatgaaaaaaamaaacaaacaggagtttattatctatctatctatctatctatctatctatctatctatctatctatctatctatctatctatcgtctcttgtatatacaca

SEQ ID NO: 28715 - DNA, 201 bp, Homo sapiens
ctgagggtggtggccatggctttgggtcagactgtgcctggagcatatgaggagacacatgatgaggaggcagcaaaggatgagggtggtggccgtggccytgggttgggctgtgcctgaggacatggtgggtggtgctgaaatggaagcacaagagtgacaacccttgtccaggccccaaatctgaggagatgcctcctc

SEQ ID NO: 28716 - DNA, 201 bp, Homo sapiens
cttccttacaaagcccccaccaaagtgacaccagctacttgtgaatgtagccaactttactgaagatttagaggttatgttataaggctgtgaataatttwaaaaaaaaatcacctatttgctcgacctctttcttatctcttctttggactagaaataaaatatctatgatttgaccacactgtcatctagtactcgacc

SEQ ID NO: 28717 - DNA, 201 bp, Homo sapiens
acttccttacaaagcccccaccaaagtgacaccagctacttgtgaatgtagccaactttactgaagatttagaggttatgttataaggctgtgaataattwaaaaaaaaaatcacctatttgctcgacctctttcttatctcttctttggactagaaataaaatatctatgatttgaccacactgtcatctagtactcgac

SEQ ID NO: 28718 - DNA, 201 bp, Homo sapiens
cgccctgccaatactgctgctgtggggacaccagcgggggtgggccaagaacagagtgtatgtgtgtgtttgtgtgtgtgtgtgtgtgtgtgcatgggtgyttgtgtgtgtgtgcgtgcatatgtgtgatatgaccactgagtagctccttagcagggccaatattttctacaagtctgatgactcacaggaaggagcaca

SEQ ID NO: 28719 - DNA, 201 bp, Homo sapiens
tgtgcctctatggttgggccaatgatcaatacacagatatacctaaagcccctccccatctgtgttcttccctcccctctcttactgcctgcctctgtttscccaccccattccacacttaccactggtctttatctggggtttgatgtcacaaaggagcatcctgaggtctcgccccacttctcccagcgtttgggtcaa

SEQ ID NO: 28720 - DNA, 201 bp, Homo sapiens
ttttgtatcctgagactttgctgaagttgcttgtcagcttaaggagattttgggctgagatgatggagttttctaaatatacaatcatgtcatctgcaaayagagacaatttgacttcctcttctcttgtttgaatgtactttattgctttctcttgcctgattgccctggccagaagttccaatactatgttgaatagga

SEQ ID NO: 28721 - DNA, 201 bp, Homo sapiens
agaggtcctttacatcccttgtaagttgtattcctaggtattttattctctttgtagcaattgtgaatgggacttcactcatgatttggctgtctgtttgtctgttattgttgcataggaatgcttgtgatttttgcacattgattttgtatcctgagactttgctgaagttgcttgtcagcttaaggagattttgggctg

SEQ ID NO: 28722 - DNA, 201 bp, Homo sapiens
gtggcagtgtgccctgggcttctaaccgtcctctccctgccccagctgccttgaggtcccggccaatggtttcaacactcaggctaggaatgccaaggccmggcagagcgaggctgtggaagccttggcataagcggaagggaggatctgagggagaatgggacaagagaagtcggaaagaaggagttagggcaggagaac

SEQ ID NO: 28723 - DNA, 201 bp, Homo sapiens
cattgtgactggatcattggttaatgggaaggggtttctacactgaggaagaaacagtgggaggtgggatgggaaagggaggatggtgggaaatccttatrgccatcactgactctccagacaggaagcccacggagaagtcaatcaaattttctatcgcacacacacactgacacccacacagggaaggcttttgacctt

SEQ ID NO: 28724 - DNA, 201 bp, Homo sapiens
ggagccaaagttgtcttgtctgaactccccactggagatgtggccgcccagtactttgctgacaggaacatgttctgtgctggccaagtacctgaggagamtctgaagaggacaatgatggcctgtggaggctcaatccagaccagtacgaatgctttcttagcagatgtgctgggtcgacgccaggtgtttgaagagacc

SEQ ID NO: 28725 - DNA, 201 bp, Homo sapiens
ttttcttttcttttttgagacaaagtctcgctctgttgcccaggctggagttcagaggcacaatctctgcttactgcaacctctgcctcctgggttcaaaygattcttctgcctcagcctcctgagtggctgggattacaggcgcacaccaccacgcctggctaatttttgtatttttagtagagactgggtttcaccatg

SEQ ID NO: 28726 - DNA, 201 bp, Homo sapiens
aagaggtcctttacatcccttgtaagttgtattcctaggtattttattctctttgtagcaattgtgaatgggacttcactcatgatttggctgtctgtttgtctgttattgttgcataggaatgcttgtgatttttgcacattgattttgtatcctgagactttgctgaagttgcttgtcagcttaaggagattttgggct

SEQ ID NO: 28727 - DNA, 201 bp, Homo sapiens
gaagaggtcctttacatcccttgtaagttgtattcctaggtattttattctctttgtagcaattgtgaatgggacttcactcatgatttggctgtctgtttgtctgttattgttgcataggaatgcttgtgatttttgcacattgattttgtatcctgagactttgctgaagttgcttgtcagcttaaggagattttgggc

SEQ ID NO: 28728 - DNA, 201 bp, Homo sapiens
tgaagaggtcctttacatcccttgtaagttgtattcctaggtattttattctctttgtagcaattgtgaatgggacttcactcatgatttggctgtctgtttgtctgttattgttgcataggaatgcttgtgatttttgcacattgattttgtatcctgagactttgctgaagttgcttgtcagcttaaggagattttggg

SEQ ID NO: 28729 - DNA, 201 bp, Homo sapiens
ccttgagcagtggtttgtagatctccttgaagaggtcctttacatcccttgtaagttgtattcctaggtattttattctctttgtagcaattgtgaatggkacttcactcatgatttggctgtctgtttgtctgttattgttgcataggaatgcttgtgatttttgcacattgattttgtatcctgagactttgctgaagt

SEQ ID NO: 28730 - DNA, 201 bp, Homo sapiens
gatggctgcgggcaggcttgactgatgtcaggccttccacaagaggtggtggagcagagtcttctctaactcccccggggaaagggaaactccttttcccrgtctgctaagtaacaagtgccttcccaggcactggcgctactgctagactgaggagcccactactggccctgtctgggcatgacagagggctcacactct

SEQ ID NO: 28731 - DNA, 201 bp, Homo sapiens
gcatctgcttctcagaggacctggaccgaggagtggattcactggaggaaattatatttcataagatagaacattctgagaatagtaacacttggcatacmccttactacatcaaaagtaagaaattggcctggcacggtggctcatgcctgtaattccagcactttgggaggctgaggcggcagatcacgaggtcagtag

SEQ ID NO: 28732 - DNA, 201 bp, Homo sapiens
tcttatttccttgagcagtggtttgtagatctccttgaagaggtcctttacatcccttgtaagttgtattcctaggtattttattctctttgtagcaattktgaatgggacttcactcatgatttggctgtctgtttgtctgttattgttgcataggaatgcttgtgatttttgcacattgattttgtatcctgagacttt

SEQ ID NO: 28733 - DNA, 201 bp, Homo sapiens
tgaaacactcagacacctcctcactctgaccttccttcctggtttccttggctctgggatgaaacagtgtcctgctagttttcactgcatcagaagagaawcctctcccgtggggcagaactgctgggccaccagagcgcaccgctctgctctttgccctcagggcatcttgatctgcatggtgggaggaacttccccaat

SEQ ID NO: 28734 - DNA, 201 bp, Homo sapiens
tctggaaatctatcaaaactacctccaatgccagccctgagaccctcccctcccccaccctggggcatcacctcctcttctgccacagcgggagggtggggtgtgctgtcatcttgcttccctcagcagctgtgtgagctccctgaggacaggggacaccccctctccctaccccaaaacctgtcccaggggctaccccat

SEQ ID NO: 28735 - DNA, 201 bp, Homo sapiens
agaagcttgtggtgcctctgctgctgtccctaggcctgacaagagtctgaaattgtctttggtgatcaacctttgtcctttctggtagagaagggaggatrcaatcaaaagtggctcaataataactggaaaataaatggaaaagaaagatgttcatttcatccaggttcttgaattcattgacatacggttgtacatagt

SEQ ID NO: 28736 - DNA, 201 bp, Homo sapiens
accccctctccctaccccaaaacctgtcccaggggctaccccatagcgagggggaggggacaaaacctctgccttccaggatgacctggctcggcaggagmtgaggaggcgtctcctcagatttggggcctggacaagggctgtcactcctgtgtttccctttcggcaccacccaccgtggccccaggcacagctcaacct

SEQ ID NO: 28737 - DNA, 201 bp, Homo sapiens
tgctggcttagagctccagcatcttcaacagaaaacaataaacgtctagagaagtggcagatcatgggaaggccaatctatggcatcagagaagcttgtgrtgcctctgctgctgtccctaggcctgacaagagtctgaaattgtctttggtgatcaacctttgtcctttctggtagagaagggaggatacaatcaaaagt

SEQ ID NO: 28738 - DNA, 201 bp, Homo sapiens
gatccgtaaggaattgccacactgtcttccacaatgtttgaactaatctacactcccaccaacagtgtaaaagtgtttctatttttccacaacctctccarcatctgttatttcctgactttttaatgaacgtcattctaactggcgtgagatggtatctcattgtggttttgatttgcatttctctaacgaccagtgatg

SEQ ID NO: 28739 - DNA, 201 bp, Homo sapiens
cctctttcttggtctgtttctggaaatctatcaaaactacctccaatgccagccctgagaccctcccctcccccaccctggggcatcacctcctcttctgmcacagcgggagggtggggtgtgctgtcatcttgcttccctcagcagctgtgtgagctccctgaggacaggggacaccccctctccctaccccaaaacctg

SEQ ID NO: 28740 - DNA, 201 bp, Homo sapiens
tcccagcactttgggaggatgaggcaggaggatcacttgaggccgggagttcaagaccagcctgggcaacatagtaagactccatctctacaaaaaaaaawttttttttattatactttaagttttgggttacatgtgcagaacgtgtagttttgttacataggtatatacgtgccctggtagtttgctgcacccatcaac

SEQ ID NO: 28741 - DNA, 201 bp, Homo sapiens
tgaagcactctctggctgtctctgcaagtggctgaacagctcctcctggtctctatggggctgcagaggctccaggtccctatggctcaggggctgtcacrctcaccaggtcccaccaagggtgccccccaccgtgggtggtggaggagaccaggtgtagctgctcttgcccctacccctctcctgacctgccaatcttaa

SEQ ID NO: 28742 - DNA, 201 bp, Homo sapiens
acagctgccctgcagacatggaagttcaacactagctacatcgacactgacagcagcaacttccctgaacatggctactaccaagccggagtttggtgtcycatttgcagtgagcattgaatttggcccagggccaggaaccaggcacctggtgtttggagggctccatcagggaccctgggcgggaagcacagcagccac

SEQ ID NO: 28743 - DNA, 201 bp, Homo sapiens
tagaagaagaccagtggatatctgaagcatttactggtgacactaaaaaaaaaaaaaaaaaaagaaaaaaaagcacaagccctgtcacataaaaaaaaaaagcataaaaatatgctttccttagcccctgctttccccaggaacacatggtgccccacataatcactggctcatgtgacagccactctaccaggccctggg

SEQ ID NO: 28744 - DNA, 201 bp, Homo sapiens
cccaccccattccacacttaccactggtctttatctggggtttgatgtcacaaaggagcatcctgaggtctcgccccacttctcccagcgtttgggtcaaytctccccaagtgctggtggcatttaccttcttccccaggaggcccagaggtttgaccatgttgttgtcactgttgtactgaaggaaaagatttttattca

SEQ ID NO: 28745 - DNA, 201 bp, Homo sapiens
ggaagaatttcagtgtaatgtgaattgcacgtttgcttatgagtaacttagtctgtgagaaatggtgaatgcagaaaactgcctcacaaatgattatactrcctctcaaataatttccaacaactcttcttcctccactgcgtagtaatccacaagctgctactcttctaactcccggggatccatgccctcccctctgtt

SEQ ID NO: 28746 - DNA, 201 bp, Homo sapiens
agatcacgtaggttctctgtgagagaggccgcatgcccagcaggacagaacatccctggctgacaagggccatcttcccctgtccttatctctgcctgggmtccagctccgtcctgcctgacagaggccgtggagcagagcactgggctgctggtcaatgtcctggtctttagatagaccagtctccggatggggtcacag

SEQ ID NO: 28747 - DNA, 201 bp, Homo sapiens
attctcttctccctaattgttggctacaaagtcatctttcccagaaggagtctctaagatggaggtgacatttggacagtattggaaagcagtctccaacsactagaggacagtggaataaagccaacctgtttggtctctgtcagccagaaatggagaagaaaacctggttgagtcaacaagagaaagaaaattagtatc

SEQ ID NO: 28748 - DNA, 201 bp, Homo sapiens
tcccatgtgcctctatggttgggccaatgatcaatacacagatatacctaaagcccctccccatctgtgttcttccctcccctctcttactgcctgcctcygtttgcccaccccattccacacttaccactggtctttatctggggtttgatgtcacaaaggagcatcctgaggtctcgccccacttctcccagcgtttgg

SEQ ID NO: 28749 - DNA, 201 bp, Homo sapiens
gaaaggacagctgccctgcagacatggaagttcaacactagctacatcgacactgacagcagcaacttccctgaacatggctactaccaagccggagtttrgtgtcccatttgcagtgagcattgaatttggcccagggccaggaaccaggcacctggtgtttggagggctccatcagggaccctgggcgggaagcacagc

SEQ ID NO: 28750 - DNA, 201 bp, Homo sapiens
gggactctgggaattctccatccctgtcctccctcctcacccacctgccctttgctccactcccaattctgcccccatacctgtcactccaaaggactctyctcagcagccaggtaggatgaagcaggggaggatgaggaggaggctgcagggactgagggtggtggccatggctttgggtcagactgtgcctggagcata

SEQ ID NO: 28751 - DNA, 201 bp, Homo sapiens
ttcctgtgtccttggcattgggtgggcctgcaggcaaatattcctccttccccttcttcctcagcctctcctcacactgcaatcagcacccatagctctgmaggtgactgtccctgttccaccttattcattcctggtccagcccagtggtgcccatggacttaagcagcagctcaggtcccccgtgtctgagtccactct

SEQ ID NO: 28752 - DNA, 201 bp, Homo sapiens
ttgttttactgactgtatcatttggaagaaagaggtcatcattcaaaaagtacttgatttttcaaacaaaagcagaagaaagaaaatgttgacatatcttktttagtcagccagaactttaattgcaggaattccatcaggtagcaccaataaaaaataacataagatgttaggaataaccgctggtaaaattattgacaa

SEQ ID NO: 28753 - DNA, 201 bp, Homo sapiens
taatacaagaaaattctaaactcagtaggtttttgggaaatagaactctttgtggaaatattagtacagagcaataaattactgaggaaatatcattaatrtaattttttcttattaaataaagaattatccttcaggacgcggaaagaaaccttggaggtctgaaatctaacatgattgttttactgactgtatcatttg

SEQ ID NO: 28754 - DNA, 201 bp, Homo sapiens
ccccggaagagggacaggaaagaagctgagcctttgccagacacacacatcaaagggccagtgccagatgccttgaacactgagctctggcaggcaggctyccctgtggccttctatgccagtttctcagaaaggacagctgccctgcagacatggaagttcaacactagctacatcgacactgacagcagcaacttccct

SEQ ID NO: 28755 - DNA, 201 bp, Homo sapiens
ctagtaacctcacagctgcagtgtggcaaatcaaacagagctggagttgtctggtagatccttggagcaggtgctgctgccccacatggacaccttcctgyaagtgcatttcggccccatctgaaagagcttaaaggaaagcttgcatggcttttccccggacataacaaatctgtttcttgatgtggaggccaacaccag

SEQ ID NO: 28756 - DNA, 201 bp, Homo sapiens
attggcacaggggctctgccacgcagttcccctggcggctggcccctgacatctggcaaagagttaggaatgcaggtgtttctggcaaatatgtagggccyatgagataagaaagtgggggaagcaagatcacgtaggttctctgtgagagaggccgcatgcccagcaggacagaacatccctggctgacaagggccatct

SEQ ID NO: 28757 - DNA, 201 bp, Homo sapiens
tgtggagaggccggcctagcagaacacccgtccaccatgcaaaccgggtggggccacctgtcaactgtcacgtgtgagtgattctaggacagggtaactcrtccagaattggatccaattcagtactggattcaccatcagtagaaggaccaagaccagactcaagtcccagccacgaaattctagaaaggatttaatgta

SEQ ID NO: 28758 - DNA, 201 bp, Homo sapiens
ccttctgccgtctctaggatggagaggcctgaggtgactgcttcctcagagtctctgtgcaaactctctgaggagcagaaaccagttcagtctctctgggygtggagaggccggcctagcagaacacccgtccaccatgcaaaccgggtggggccacctgtcaactgtcacgtgtgagtgattctaggacagggtaactcg

SEQ ID NO: 28759 - DNA, 201 bp, Homo sapiens
cggaagggaggatctgagggagaatgggacaagagaagtcggaaagaaggagttagggcaggagaacaaggagaaatccctgtcccccaaattggagagargggcgattgggactccagactggaaggaggcacggatccctgagtgcttggtgtggaggcagaggacccgcagagccaccccgtcctccctgccttatcc

SEQ ID NO: 28760 - DNA, 201 bp, Homo sapiens
atcgtggtggataagctttttgatgtaatgctgggttcggtttgccaggatttttgcatcaatgttcattagggatattggcctgaaattttatttttttrttgtgtctctgccaggttttggtatcaggatgatgctggcctcataaaatgagttagggaggattccctctttttctattgtttggaatagtttcagaac

SEQ ID NO: 28761 - DNA, 201 bp, Homo sapiens
ccagtgcaccgttctgcttcacgttgacaaaacatctcgacttgcagagtggaaggatctgcaatccaaacacaaagccatcatcctccactctttgagargtccatcatcctccaataggtcaagtgtttctctgcacatttaggggtctgtattctttctgcccagacttgccctttcctgcccattgggtcccatgtg

SEQ ID NO: 28762 - DNA, 201 bp, Homo sapiens
tgagctaaatcacggtaaacgcagacagcaaacaaactttccgtcaaagagctggatgaaacctgggccggatggcaaggagacaacaccccaggcaggcrttccagatctttgaccttgcccctcctcgagaggagatgattgcttcatccctcctctcactgcacattgtgctgccagccctgctgtgtagtgtggggg

SEQ ID NO: 28763 - DNA, 201 bp, Homo sapiens
ctgccatcacaccacccaccacacgagccccttctggaccagtggcccttatctgactcaagccatatcttgccaagcctgttgtgacaccgatcttggcraactcacttttcatgtcagggcccctgcaaaacagacacatatctgagtcatggtattcgtttaagcaatgaaaagggtagaatcatttcttacatcaga

SEQ ID NO: 28764 - DNA, 201 bp, Homo sapiens
ctgagtcaaatggtatttctcgttctagatccgtaaggaattgccacactgtcttccacaatgtttgaactaatctacactcccaccaacagtgtaaaagygtttctatttttccacaacctctccaacatctgttatttcctgactttttaatgaacgtcattctaactggcgtgagatggtatctcattgtggttttga

SEQ ID NO: 28765 - DNA, 201 bp, Homo sapiens
ccgtaaggaattgccacactgtcttccacaatgtttgaactaatctacactcccaccaacagtgtaaaagtgtttctatttttccacaacctctccaacawctgttatttcctgactttttaatgaacgtcattctaactggcgtgagatggtatctcattgtggttttgatttgcatttctctaacgaccagtgatgatg

SEQ ID NO: 28766 - DNA, 201 bp, Homo sapiens
tccgcccagttccaacttcccagcagttttgtttacactgtgaccttaaaaccatttcctcaagcctcagcaacggcagaggtccttccagatgagttttrtaatagactccagcagtcctactggggccaagacctcaaggaaagccaagtctatcattgggaaaagtcttagggctctaagttttgaattctgaaaatt

SEQ ID NO: 28767 - DNA, 201 bp, Homo sapiens
atgggcacacaaagctctttttccctgggtgctgctcttccccgtgacagagaaatccatgcgacacagtggggaggccctccccaaagggtggcagatayatttttttccccttgaattgtaatacacctttccccaggcccactctgcctcccacttctgttcagctcagctgtgggcactgacctccaccggcgcttg

SEQ ID NO: 28768 - DNA, 201 bp, Homo sapiens
gcagagctcgaatgctgtgctgggaggtctgctgccctcttcagagccatcaggcggggacatttaagtctgctataagcccctgattggggctgctgccytgtttaccaacatgccctgaccagagaggagaaatctggcagtctggccatagcagccttgctgagctgcagtgggctccgcccagttccaacttcccag

SEQ ID NO: 28769 - DNA, 201 bp, Homo sapiens
tcaagtgatcctcctgcctaggcctcccaaagtgttgggattatagatgtgagctgctgtgcccagccctatcttttaaaaaatatgtactgaaaaaaaawtttttttttttgagacggagtcttgctctgttgccaagactggaatgcagaggcgcgatctccgctcattgcaggctccgcctccacttgactcagggaa

SEQ ID NO: 28770 - DNA, 201 bp, Homo sapiens
acaaaaaaagcccccaccaaatctattgcaacatcagtcaaaattttagttctacttattaaatacaattttattcttatagcaagtattttaaaattgttatctgtttttttaaatatgtaaaatatcttcttgtcgaagcgacaggtgctttgaattgttacctttatgtttgttgaaactatgaagaagagattagga

SEQ ID NO: 28771 - DNA, 201 bp, Homo sapiens
tgtccctaacccgttcaaactctttcctcttaaatggttgagattttctctcaccaagcacaccccagtattaattaaactagctgcaaacaggcagcaastggtctaccatgacagatgggttttgtgtgtgtgtgtgtgtgtgtaattgtaataaaacatattgagtcactcaataaacacagagtgtctactacatgt

SEQ ID NO: 28772 - DNA, 201 bp, Homo sapiens
ctgggtgctgctcttccccgtgacagagaaatccatgcgacacagtggggaggccctccccaaagggtggcagatatatttttttccccttgaattgtaayacacctttccccaggcccactctgcctcccacttctgttcagctcagctgtgggcactgacctccaccggcgcttgatccctgcctgctcctgcccagac

SEQ ID NO: 28773 - DNA, 201 bp, Homo sapiens
cacaaaaaaagcccccaccaaatctattgcaacatcagtcaaaattttagttctacttattaaatacaattttattcttatagcaagtattttaaaattgttatctgtttttttaaatatgtaaaatatcttcttgtcgaagcgacaggtgctttgaattgttacctttatgtttgttgaaactatgaagaagagattagg

SEQ ID NO: 28774 - DNA, 201 bp, Homo sapiens
ccacaaaaaaagcccccaccaaatctattgcaacatcagtcaaaattttagttctacttattaaatacaattttattcttatagcaagtattttaaaattgttatctgtttttttaaatatgtaaaatatcttcttgtcgaagcgacaggtgctttgaattgttacctttatgtttgttgaaactatgaagaagagattag

SEQ ID NO: 28775 - DNA, 201 bp, Homo sapiens
gaagttgcttgtcagcttaaggagattttgggctgagatgatggagttttctaaatatacaatcatgtcatctgcaaacagagacaatttgacttcctctyctcttgtttgaatgtactttattgctttctcttgcctgattgccctggccagaagttccaatactatgttgaataggagtggtgagagagggcatccttg

SEQ ID NO: 28776 - DNA, 201 bp, Homo sapiens
ttagctttgatcagctttttctctcttctgtcacttcagcagaaacaatgcccagaaatgccagagacaacaaaataggaatgtgtcatgggcacacaaarctctttttccctgggtgctgctcttccccgtgacagagaaatccatgcgacacagtggggaggccctccccaaagggtggcagatatatttttttcccct

SEQ ID NO: 28777 - DNA, 201 bp, Homo sapiens
gaggttattgtattctcatacttgccaatttataacagcaatttaaaaaataaaaatataccggggaatttagtaagcaatttaaggttctgatgagcatygttttttttgtcagaattttccaaataggccctcaaaaactgttgctagaatcttgtacaggattgatattggactggtatcgtctttgcaaaataaact

SEQ ID NO: 28778 - DNA, 201 bp, Homo sapiens
tcttggtgaatgtccctgtgtatttgaaaagacactccctgtcaacccctttgctctgtcatttagctttgatcagctttttctctcttctgtcacttcakcagaaacaatgcccagaaatgccagagacaacaaaataggaatgtgtcatgggcacacaaagctctttttccctgggtgctgctcttccccgtgacagag

SEQ ID NO: 28779 - DNA, 201 bp, Homo sapiens
ttgccctcccctccccactactgcccatctaagtacttttacaggcatcgaataagttaagtcagtgcatgtgaagtgcttagaagggcatctgacacattatagaagttcaataaatgctagttgttgttgttattacaacagaaatgaaggacctttcctaagattagaagtcatgaaaccacttgaagcctgaatctc

SEQ ID NO: 28780 - DNA, 201 bp, Homo sapiens
tcaaaaatgaactctttatggattcctcattcgacatgatgtcaacgtctcttttgtcttctctgtagcccttgactgtggatcccaagctgtgtgccaargagctcatggtgcaaactcactgtgagcaaaccctctgggtttattgaaatatttgaaagatgagcagtgtcaggctaattttaccatttttagcagaca

SEQ ID NO: 28781 - DNA, 201 bp, Homo sapiens
ctttacaataggtctttttgggagaagtggaaattatttaatgttgtgtttaccgtgagcagtggttatttctgggctgtgagttgcaagtactgaaggggaaatactgacttttataatttataagactttgttgaattttttttttgcaatgagcttgttgtaaatgattttctattttttaaaaataagtgttgacat

SEQ ID NO: 28782 - DNA, 201 bp, Homo sapiens
cagaatcactcatttattactcacaccatggaggaaaaatgaaataacattaattctctactgggtaatacaagaaaattctaaactcagtaggtttttgsgaaatagaactctttgtggaaatattagtacagagcaataaattactgaggaaatatcattaatgtaattttttcttattaaataaagaattatccttca

SEQ ID NO: 28783 - DNA, 201 bp, Homo sapiens
tcacgagcaaaggctcactgcagcttcagattcctgggctcaagtgatcctcctgcctaggcctcccaaagtgttgggattatagatgtgagctgctgtgsccagccctatcttttaaaaaatatgtactgaaaaaaaattttttttttttgagacggagtcttgctctgttgccaagactggaatgcagaggcgcgatct

SEQ ID NO: 28784 - DNA, 201 bp, Homo sapiens
tttccttgatatgtaggtgggggcccccaccttttttcagggtttaggcttctgcaggtcctggcatagctgtgacagcggccctacctcatttctggtgrgtgctggctccctctattgcttggtttctgtgcaaacactgcattatcgtcctgccctcttgagacctggagctcctgccccctgagctcgtgttcgcac

SEQ ID NO: 28785 - DNA, 201 bp, Homo sapiens
tcagagtctctgtgcaaactctctgaggagcagaaaccagttcagtctctctgggtgtggagaggccggcctagcagaacacccgtccaccatgcaaaccvggtggggccacctgtcaactgtcacgtgtgagtgattctaggacagggtaactcgtccagaattggatccaattcagtactggattcaccatcagtagaa

SEQ ID NO: 28786 - DNA, 201 bp, Homo sapiens
tcagctcagctgtgggcactgacctccaccggcgcttgatccctgcctgctcctgcccagacaggaagcccttcagcagccgactcggttaccaggatgargctagaggccaggaactcccaggtgtctatggaggtcccacctcctttaaatccctactgttcagacccagcttctaaaactgttcttttgcctcccttc

SEQ ID NO: 28787 - DNA, 201 bp, Homo sapiens
gcatagtgttccatggtgtatacgtgccacattttcttaatctatcattgatggacaagttttgctattgtgaatagtgccacaataaacatacgtgtgcrtgtgtctttatagcagcatgatttataatcctttgggtatatacccagtaatgggatcactgagtcaaatggtatttctcgttctagatccgtaaggaat

SEQ ID NO: 28788 - DNA, 201 bp, Homo sapiens
ccacttctgttcagctcagctgtgggcactgacctccaccggcgcttgatccctgcctgctcctgcccagacaggaagcccttcagcagccgactcggttrccaggatgaggctagaggccaggaactcccaggtgtctatggaggtcccacctcctttaaatccctactgttcagacccagcttctaaaactgttctttt

SEQ ID NO: 28789 - DNA, 201 bp, Homo sapiens
ggcaggggaatcgcttgagcctgggagatcgaggttgcagtgagccgggatcgcaccactacactccagcctgggagatagagtgagactctgtctcaaamaaacaaacaaacaaacaaagaattacttgcactgtgctcacataatttatacagtcagttctgctatatcaggttgtttgaaaaccgtactttattccaa

SEQ ID NO: 28790 - DNA, 201 bp, Homo sapiens
tgccccacccaaaattgtgtcttgcccaccctctgtgtttctgtccatcagaccacccatcacataggcaacccctggagagtgaccctggtttaaagccygactttgccaaaccgctgtggatgcattaatttggaaaggtccctgttcacctcagggcccacttgcaaagcagagacagtccccgagactcattcagcc

SEQ ID NO: 28791 - DNA, 201 bp, Homo sapiens
tgtggatcgcattttcttgctttttagcctgtccggaaatttttgcctggatgcgcacattgtaaatagaacactgttaagtgtctgtattttttaggatkgaaagaataaataattggtgggaaaatatcagtctctgctatgtgtttattatctccagagttgacatttaggaacccattgcttgcagatccagatcag

SEQ ID NO: 28792 - DNA, 201 bp, Homo sapiens
tgcagccataaaaaagaacaaaattgtgtcctttggatcaacatggatgcaactggaggccattatcctaagtgaattaatataggaacagaaaaccaaayactgcatgttctcattcttaagtgggagctaagctttgggtacacatggacataaagatgggaagagtagacactggggactatgaggaggggagagatg

SEQ ID NO: 28793 - DNA, 201 bp, Homo sapiens
ttgtggatcgcattttcttgctttttagcctgtccggaaatttttgcctggatgcgcacattgtaaatagaacactgttaagtgtctgtattttttaggaktgaaagaataaataattggtgggaaaatatcagtctctgctatgtgtttattatctccagagttgacatttaggaacccattgcttgcagatccagatca

SEQ ID NO: 28794 - DNA, 201 bp, Homo sapiens
cttgagtccttaccagactaagacgtcctcaagggccagagaccagcctgccactcaccattttgccaccagacacagatgagaacaattcccattaaaastaacaggatgaatgcccccaggatgatccatctatctggtagactagaagaagaccagtggatatctgaagcatttactggtgacactaaaaaaaaaaaa

SEQ ID NO: 28795 - DNA, 201 bp, Homo sapiens
gtcacggagaagagaggagagtcgcgggccactgaataagcttccaaaatgatgcccacactagttatcctgttgaaagaggggactgatagctcccaagrcatcccccagcttgtgaataacctcagtacctgccaggtgattgccaaggctgtaagagccaccctgggtgcctgtggcatggacaagcttattgtggat

SEQ ID NO: 28796 - DNA, 201 bp, Homo sapiens
tcagggatattcttcgcatactgtggagagtaacaggcaggaagctgggcgtgtacacattcaccctcactggtatggtgaagaaatgttatccaacagcrtgggtgtgggcactgcccaaattctttaccctggaacaactgaggtcaggcctgtagagacccaattaaagaacaattttgtgaagagagtgttttccaa

SEQ ID NO: 28797 - DNA, 201 bp, Homo sapiens
ctcacgacagcctgggatggaggacaagcagacaccaagtcctgggggcatgagcagggacttgtttgtggagacgccaggccccagaacttcaagcaccytcctctgttctacagattctagcaggcaggctcagtcactacaagacacctctctccagcatctctcactcattcctgcatcctcccgccttccctacct

SEQ ID NO: 28798 - DNA, 201 bp, Homo sapiens
taaagtattaacaacatctctcctctctggctgggctggcccccaatgtcctgcaacatgtctctgcctctactatctctgtttcaaccccatagcagtgrttctctggcaaacttcaggaggtctcactctgagcaagcactactcggccaaggactccccccacagacttctgcccctcctctccacttggcaatcccc

SEQ ID NO: 28799 - DNA, 201 bp, Homo sapiens
cttcaaaactctgtctcccctgctcatcttgacagggattgattttaagctttgttgggtagatctcactctgggacgtgacccttatttctaagctatgrccttaggatgttcatggtgttaataaagtattaacaacatctctcctctctggctgggctggcccccaatgtcctgcaacatgtctctgcctctactatc

SEQ ID NO: 28800 - DNA, 201 bp, Homo sapiens
attaggttattttattttaatttttttttgagatggagtttcgctcttgttgcctaggtgtacaatggcataatctcatctcacagcaacctccgcctccygggttcaagcaattctcctgctttagcctccccaaagtagctgggattacagacatgcgccactatgccaggctaattttgtatttttagtagagacagg

SEQ ID NO: 28801 - DNA, 201 bp, Homo sapiens
gttcctatgaccttctaaatgcaacttcaaaactctgtctcccctgctcatcttgacagggattgattttaagctttgttgggtagatctcactctgggaygtgacccttatttctaagctatggccttaggatgttcatggtgttaataaagtattaacaacatctctcctctctggctgggctggcccccaatgtcctg

SEQ ID NO: 28802 - DNA, 201 bp, Homo sapiens
cccacatggtggaaggcagaaggacaagctagccaaatggcacatgaaacctcttttataagagtagtaatcccatcgaggtgggaggagccctcgtgacmtaatcaactcttaaaggcccacctcttaacactatcacagtggtaacacctgaattttggagagaacacatctagacaatagcaacatccttcttagaac

SEQ ID NO: 28803 - DNA, 201 bp, Homo sapiens
agtgtacacaccttttacttcctttgttaaatttattcctaagtattttatgctttttgatgcaattataaatgtgtcttaatttattttttagataatayattgttagtgtattgaaatccaactgatttttgtatgttgattttgtatcctacaactttgttgtatacattaacttatttatttttgagacagggtcac

SEQ ID NO: 28804 - DNA, 201 bp, Homo sapiens
ggaggccagggtggctagagtaccagagaggagagagtgcaacggaaggagggagctctggagatctgtgcagggttcctctgagtcttcagcagaagttygaccaggtacatgcatgtgaggaaacttcccaagacagagaggcaaccactagaaaaaagctggcagaaaaacttctgagcttgcattggccaggcaata

SEQ ID NO: 28805 - DNA, 201 bp, Homo sapiens
tgcccactctgatctggaaggggtaaggaggtgaaagcattgataagccaaagtgacagcctcttttgtagacatgatcctgcctaaatttctcatgcccyacaaaagagggccctgaactccccgcttctccagagcttcatgcagtccttgaagcactctctggctgtctctgcaagtggctgaacagctcctcctggt

SEQ ID NO: 28806 - DNA, 201 bp, Homo sapiens
agacattgggcaacaggcaatgcagggcccaagagaagggagacaaaggaagtgaacatgctgcttgctccagcttactgcctggagagggtttccaagcygcaatgcagacaggcgaaccaaaagagactctgagttggaaaatagagctgagaattcagggaggccagggtggctagagtaccagagaggagagagtgc

SEQ ID NO: 28807 - DNA, 201 bp, Homo sapiens
ttgccagggtggggtgctcattggcctccaggctccactcacttttctgaccgcacccagtttccacctccaagtcaccccccagactgcttctccttttrctgttttttctcagcccagcagaaattctaatattcgccaggcttggccctgctcagggcaccggagaaggagcctctgaggaaaatcttggcacaagga

SEQ ID NO: 28808 - DNA, 201 bp, Homo sapiens
atgttatccaacagcgtgggtgtgggcactgcccaaattctttaccctggaacaactgaggtcaggcctgtagagacccaattaaagaacaattttgtgamgagagtgttttccaagtattcagaatataatcatttattgaaaaataaaagaagacatttaaaaacaaaattaactttgaataaactctctctcctctcc

SEQ ID NO: 28809 - DNA, 201 bp, Homo sapiens
caacctgcaaggccctgggagcaggtccaggccagggcgggcggggagggcaccaggggttggctgccaggcctgcagggggttccaggtcctgagggtckcagaacccagccctgcagtgttaggtggccccatgatgcaggcctgggtgggtgggattccagcccagctccctgagcttgccaggccgttgggaggcgt

SEQ ID NO: 28810 - DNA, 201 bp, Homo sapiens
atttgagccctcaggcttgggagggtatgtggggaatctggcccttgccgctgccttccagagacttgcgggtgctgggttagggttgggggctctggggrtcacgctctgagatgccccgtggaagggtgcctgctgcaggcagtctccagctccttggcccacatgcctcactccttgtcccctccagttccttcccct

SEQ ID NO: 28811 - DNA, 201 bp, Homo sapiens
gacctgtctcatagcaggatttttaatttggatttaagtgcaataatggttactcatttgatgcgccattagtcacattgccccttaatgagagattgtgygtttttcctgcctggctttgtggcttgctaataaagttctatggacatgcaaatgtttatagaggctcaccgaaggcaagggtgggaattgcgtgcagct

SEQ ID NO: 28812 - DNA, 201 bp, Homo sapiens
cccaggccccctagcctcaggggtggggcctggtctccatgtggaggcgggagccggtcaacctgcaaggccctgggagcaggtccaggccagggcgggcrgggagggcaccaggggttggctgccaggcctgcagggggttccaggtcctgagggtcgcagaacccagccctgcagtgttaggtggccccatgatgcagg

SEQ ID NO: 28813 - DNA, 201 bp, Homo sapiens
ccagagacttgcgggtgctgggttagggttgggggctctggggatcacgctctgagatgccccgtggaagggtgcctgctgcaggcagtctccagctcctyggcccacatgcctcactccttgtcccctccagttccttcccctgaggcttcagggcctagctcaatgaggcaggaggctggataggtgtgatgtcccagg

SEQ ID NO: 28814 - DNA, 201 bp, Homo sapiens
tccttttcaagtagcattcagtacgattctggagcgtagggctgggagagcacagagccccttgcagcttccttccctagtctcctgtgaccctccataawgttgcctgtttgctgtcagagttgtctccatcagttggcctcatggtcagcggtgcccaggacatttcggcgctgcgttacgacagctcattgtgcctct

SEQ ID NO: 28815 - DNA, 201 bp, Homo sapiens
tcttaaaacaacagaaatttgttctctcacatttttggaggccagaagtccaaagtcaaggtgtcagcggggccagttccttttggaggctctggggggggaatcctgtattcggctgctctcgcattgctgtaaagaaatacctaagattgggtaatttataaataaaagaggtttaattggctcacagttttgcaggct

SEQ ID NO: 28816 - DNA, 201 bp, Homo sapiens
gtaaagtggggagatgctagaactttccatattgcagggctgcaatgagggctggatgggatgaggtatgtgaggcactcagaacagatgtgaaagctgcrcgtggatgcccctgcctggcagggggatttggtctcaggagggcacatttcaagccccacttccttcctggagtcctccctgtccccacaggtccgtgtc

SEQ ID NO: 28817 - DNA, 201 bp, Homo sapiens
agcttgcacgagttctcagggattcagaggcagcacccaggacctgctttaggagctccctgcccatccgatgggggaggcagcctgggcggagcatccckagagagccccgaacccgtgggaggtgggaggtgggaggcctcgcctgtggatgtggccccatctgctgccgatggctggcccaggccctgtgagtggtgc

SEQ ID NO: 28818 - DNA, 201 bp, Homo sapiens
actcagaacagatgtgaaagctgcgcgtggatgcccctgcctggcagggggatttggtctcaggagggcacatttcaagccccacttccttcctggagtcytccctgtccccacaggtccgtgtcctgcctacctgtgaaccactcagggtaacgctgggcctgagctcaggctctttcttttttttttgagacagtgtgt

SEQ ID NO: 28819 - DNA, 201 bp, Homo sapiens
gcacatggtcttgttctggaggctgggcaggcacagcagaagcaggacagagcagcactcctgtctcagaatttaactcctgcgcgtccctggcatgtgcrctgagccctcctgtcaattaggacattccatcaagatccaaatgccagttccaaatggcagctcatgaacacggctgtccctgaccacccttcgcatccc

SEQ ID NO: 28820 - DNA, 201 bp, Homo sapiens
agccccaaattctgggggtcggtggtgtttgctttgcttttaagcaaagggtctaaggccaagccttcctccctccctcctgtgtgcaggagttagttacraccccacagcttgcacgagttctcagggattcagaggcagcacccaggacctgctttaggagctccctgcccatccgatgggggaggcagcctgggcgga

SEQ ID NO: 28821 - DNA, 201 bp, Homo sapiens
tgggtaggtggcattggtttttgtggctgtgggtttggtcccagccctggggcagccgtaactgcttagatccccaggcagtggtgggtgcctctgtgggkcagggcagcctggcggagctggggcccaggtgtggacatccagggaaccctttggaatactgtctggtggagccgagcacacaccccactggcccagcag

SEQ ID NO: 28822 - DNA, 201 bp, Homo sapiens
ctgtccctgggtggggatctggcccctgacctccttaacctcctagaatcccctgcaggccatccaccagtctcttttgcagatgtggaagcaggttcagkaatgtgcctgggtcatagctgtgagtggtcaggccacctgacccggctggtgcccctcgggcggacacaaggaccaagtaaatcagatggtgctcatgaa

SEQ ID NO: 28823 - DNA, 201 bp, Homo sapiens
tgggactgaccagagaagtttatgggacctgtggattcattctggctcctggtcccagccccagccccaaattctgggggtcggtggtgtttgctttgctyttaagcaaagggtctaaggccaagccttcctccctccctcctgtgtgcaggagttagttacgaccccacagcttgcacgagttctcagggattcagaggc

SEQ ID NO: 28824 - DNA, 201 bp, Homo sapiens
tgtggttctgtttcttggttccttgttttcagccttcgtactggagggccacccctgggagttgggaggatttaggtcttccttcacgaagatgggtcgaygtgggccttactgctttattctttggttaaagatggatattgctgtggctaggtctggggacggggcttggcagacagtgaggacacaggccaggagtgg

SEQ ID NO: 28825 - DNA, 201 bp, Homo sapiens
cacatttgagggcccaaaagctctctgggagcaggaagcagggtgacagcagctcccctaagcacagcccagaaaggcgcttcctgcctgcagccaccccrcccatcctttccaaacaagcagcctcaggtgggcaggctggggtgggtgggctctgtctccatgtcttatcctctttctgttcagcatcccctctgacaa

SEQ ID NO: 28826 - DNA, 201 bp, Homo sapiens
tcagctagcccatggacctggggctgtgccaggcgccagccctcccaggagagagaagttcctcctgcctccagaacccatgttcaaggtgaggtgaggcraggaccctgcagaagtctgctggagcgtcccctcatcacggttccctttctgtctgtgacatgctgactctccacattgttgatggcctggtggagaggc

SEQ ID NO: 28827 - DNA, 201 bp, Homo sapiens
cacctgcacacccacctctcacccacctgcacactcacctctcacccacctgcacactcaactgctcacccacctgcacactcacctctcacccacctgckcactcacctgcacacccacctgcacactcacctgcccacccacctgcacactcacgtactcacctgcacacccacctgcacactgccttctacacccact

SEQ ID NO: 28828 - DNA, 201 bp, Homo sapiens
cccatggacctggggctgtgccaggcgccagccctcccaggagagagaagttcctcctgcctccagaacccatgttcaaggtgaggtgaggcgaggacccygcagaagtctgctggagcgtcccctcatcacggttccctttctgtctgtgacatgctgactctccacattgttgatggcctggtggagaggctgactgaa

SEQ ID NO: 28829 - DNA, 201 bp, Homo sapiens
agtcccatttactcgggaggctgaggcagaagaatcgcttgaacccaggaggcggaggttgcagtgagctgagatcgcaccattgcattccagcctgggcracaaagcaagactctgtctcaaaaacaaacaaacaaaaaaaaaccacacagggaattagtggcccccgtgtgagatttgaacccggagtttgtgcttgtg

SEQ ID NO: 28830 - DNA, 201 bp, Homo sapiens
ggagaggctgactgaagtcacgttttatctgcccttttctcagagcctgtgtctggctttgggccaaaccactaataataaagcaacttgaagtactcctyacatttgtgggatgtgcagcccagcggccctgccctcctgccccgagcgaggcccagcggcatcctccttgagggtttcaccctgtcgccccctgttagc

SEQ ID NO: 28831 - DNA, 201 bp, Homo sapiens
ctaggggtcttaaaacaacagaaatttgttctctcacatttttggaggccagaagtccaaagtcaaggtgtcagcggggccagttccttttggaggctctsgggggggaatcctgtattcggctgctctcgcattgctgtaaagaaatacctaagattgggtaatttataaataaaagaggtttaattggctcacagtttt

SEQ ID NO: 28832 - DNA, 201 bp, Homo sapiens
ctgccccgagcgaggcccagcggcatcctccttgagggtttcaccctgtcgccccctgttagctcctctgcagccccctcggggttggcactgggtccagyggccacgtctttcctgagtggggtcctcaggtcgtcatgcaggcttgcctgtggtagtgggggtgctgtcttctaggtgtgcaagggcttgcctcccacc

SEQ ID NO: 28833 - DNA, 201 bp, Homo sapiens
gagggtctgtgctacctaagggggcccagagggagggtctttgcatctgaacgctagtcgtgcatccacccgtgcgatctccgacaaggcagcagacccasgtgccacacctttctgtctgttaatgaggtgtcccagtcatcccattgtatgggctcttgaggatcaaacaagacgcgtgtgtggtgacaataatagtag

SEQ ID NO: 28834 - DNA, 201 bp, Homo sapiens
ctccttcccgtgagggtggggtggtctgctgaagagggagtgtgcctggcaggtggggtcactcgggcacaggcaggggtggcagggctggccggacagtrggtgggagtgggggaagctccagggctgactttgtgctggctgtgagttggagaagcccctcgtgggatctgggaggcaggggtgggttgccttcccccg

SEQ ID NO: 28835 - DNA, 201 bp, Homo sapiens
gtgctgcctttgtcttcctcatcctttgtcttcattcctccttcccgtgagggtggggtggtctgctgaagagggagtgtgcctggcaggtggggtcactygggcacaggcaggggtggcagggctggccggacagtgggtgggagtgggggaagctccagggctgactttgtgctggctgtgagttggagaagcccctcg

SEQ ID NO: 28836 - DNA, 201 bp, Homo sapiens
ggaccccccgcctccccctgtggaagggccagcaccttccttagctggagctcttctctgtgtgcagaacaagcccagcaggtgatttcagctcctgcttyccctcctcggggaaatcctagggaatctcattctgcaaaggcagcgacctgtctcatagcaggatttttaatttggatttaagtgcaataatggttactc

SEQ ID NO: 28837 - DNA, 201 bp, Homo sapiens
tctccggctggcccctcactgtgctgcctttgtcttcctcatcctttgtcttcattcctccttcccgtgagggtggggtggtctgctgaagagggagtgtscctggcaggtggggtcactcgggcacaggcaggggtggcagggctggccggacagtgggtgggagtgggggaagctccagggctgactttgtgctggctg

SEQ ID NO: 28838 - DNA, 201 bp, Homo sapiens
acatttcggcgctgcgttacgacagctcattgtgcctctgggctcggggctggagcagacgggcgcagcagccctgcggctgaaagccaccgtcccctgcmttggtggaggctgctggcatgccctcgtgtatcatcctgcctcttctctggggtctccccaccctcctccctggcctggccttctggaaacccatttgtg

SEQ ID NO: 28839 - DNA, 201 bp, Homo sapiens
gcggcatcctccttgagggtttcaccctgtcgccccctgttagctcctctgcagccccctcggggttggcactgggtccagcggccacgtctttcctgagyggggtcctcaggtcgtcatgcaggcttgcctgtggtagtgggggtgctgtcttctaggtgtgcaagggcttgcctcccaccccccaaggaagctggggag

SEQ ID NO: 28840 - DNA, 201 bp, Homo sapiens
gacctcaggtgatccacctgcctcggcctcccaaattgctgggattgcaggcatgtgccaccgtgcccagcctagaattaattctttaggatagattccaytggaattactggatggtctaaaatattttttaagagtgttatgttgttattttgaaatttaaaagaaaaacccaatgaagcctggtggtctgcagtgtat

SEQ ID NO: 28841 - DNA, 201 bp, Homo sapiens
ctttgggaggccaagacaggaggattgcttgagtccaggagttcaagaccagcctgggcaacatgatgaaaccccatctctaccaaaaaaaaaaaaaaaaagctgggcatggtggtgtgcatctgtagttccaactacgctggaagctggggtgggaggattgcttgagcctgggaggtcaaggctgcagtgagctgagat

SEQ ID NO: 28842 - DNA, 201 bp, Homo sapiens; identical to SEQ ID NO: 6019

SEQ ID NO: 28843 - DNA, 201 bp, Homo sapiens
ctgccttctggttttctgggtgtactggatgttatgctagcatgctcacctcaggaagccagggcacggcaggccgccaccttgagagtggaagccatctrggccccttcccttcagtagagggtgcaggacagtgaaatgtccaaggccctggtcaccctgagaggcccctgctgcctgcctcctgcaggccccctcgtt

SEQ ID NO: 28844 - DNA, 201 bp, Homo sapiens
cggcaggccgccaccttgagagtggaagccatctaggccccttcccttcagtagagggtgcaggacagtgaaatgtccaaggccctggtcaccctgagagscccctgctgcctgcctcctgcaggccccctcgttgggagggaccacgtgatggggtggttcatgccaaatgctgcccaggtgccatggtggccagtggac

SEQ ID NO: 28845 - DNA, 201 bp, Homo sapiens
ggttcatgccaaatgctgcccaggtgccatggtggccagtggacgtggggcagagtttgcttacaggccttttcagggtagcaggtgcctggtaggaggtrggcgcctgcccagacactgattccatgaggctgtcctgatgtaaatgggtgcagagttcatggggccaggcagggagaacaggcatttgagacctggggg

SEQ ID NO: 28846 - DNA, 201 bp, Homo sapiens
atgaacccaacagccagacaatgagttattaggcaggtggggtgggggccggtgtcctcccgggcttctgtatccacctgcaccagggagagaggaggcarctcttcccggctgcccatgcagcctgcccccgctcccagcctccctcctggctgcatgaatcacagagacacactctgcccctgggttcatgcacctgga

SEQ ID NO: 28847 - DNA, 201 bp, Homo sapiens
catgaatcacagagacacactctgcccctgggttcatgcacctggagcatgtgaccaacctaatttttaggcttccagttattctagaacttgaatttgtmcaggccagtgctactaaggttttagatgatctcttgtagagggttctaggttgtctcccttttatgggagggattgaaggctttcctcctcctccttccc

SEQ ID NO: 28848 - DNA, 201 bp, Homo sapiens
ggcgtgatgctggcggtctgggggctgctctgagaatagagaagcagtgctggggccgggcctggcgcctggcatacaggtgccctggagtctctgtgtgyggtactcatggctctcctgcctcccctgaggttccactgatggtgctgtgagcagtcatccctcccagggatctcgttgagtgtgtggtttgtatcattt

SEQ ID NO: 28849 - DNA, 201 bp, Homo sapiens
ggcctggcgcctggcatacaggtgccctggagtctctgtgtgtggtactcatggctctcctgcctcccctgaggttccactgatggtgctgtgagcagtcrtccctcccagggatctcgttgagtgtgtggtttgtatcattttacagatgggaaaactgaggcccagaagattcatgggctgtcctaggctctcccggcc

SEQ ID NO: 28850 - DNA, 201 bp, Homo sapiens
ctacccagccctggctgcagcgttggtgcccgcaggcatgaggcaggcatgagggctgcgtgtgtgggtgggcagacccccttccttgctaagagggcagsctttggtggaggccactctgggctgaaaggtcctgggtccctttccctggtgtccagggagcatctatccagggggcagctggtgtgagtaggttcccac

SEQ ID NO: 28851 - DNA, 201 bp, Homo sapiens
gacagagcctgcgcagccccttccctgtgaggcgggcgtgatgctggcggtctgggggctgctctgagaatagagaagcagtgctggggccgggcctggcrcctggcatacaggtgccctggagtctctgtgtgtggtactcatggctctcctgcctcccctgaggttccactgatggtgctgtgagcagtcatccctccc

SEQ ID NO: 28852 - DNA, 201 bp, Homo sapiens
gaggaggcgtgcattgagtacaccgggcccagcgagcacagcccactctgcaccctcctccagtggcatttgaatgcccaggtggacagagcctgcgcagycccttccctgtgaggcgggcgtgatgctggcggtctgggggctgctctgagaatagagaagcagtgctggggccgggcctggcgcctggcatacaggtgc

SEQ ID NO: 28853 - DNA, 201 bp, Homo sapiens
tgtgttcctggacactgggtctccctgcctgaccttgggtctggtggcatttttcacatctgacctttcagagttttcctcctggccttgggtcccaggargccagggccgctacggccatgtggcttgtcgggagccctggaggcgtgtggcagcaggcacccccccatgcacgtagtgggtggggcttcagcactcagt

SEQ ID NO: 28854 - DNA, 201 bp, Homo sapiens
ggctgtccactctctgtgacatgggtttgtaggaatggatgctctgtgcctagagcgaccaggtgccagctggtgtccctaaggcctgtgttcctggacaytgggtctccctgcctgaccttgggtctggtggcatttttcacatctgacctttcagagttttcctcctggccttgggtcccaggaagccagggccgctac

SEQ ID NO: 28855 - DNA, 201 bp, Homo sapiens
gtgaggcccaggttagagtcctgcatgttggttctggaagggacttcttgtctcctagcccctcccccatgatccctgtctccggctggcccctcactgtrctgcctttgtcttcctcatcctttgtcttcattcctccttcccgtgagggtggggtggtctgctgaagagggagtgtgcctggcaggtggggtcactcgg

SEQ ID NO: 28856 - DNA, 201 bp, Homo sapiens
tcccacctggcatccctcctctgcccccttcccacatttacccagcttcatgtgtgctgggcacagtgcctggagcttgtgggttctccaggctggggccytgggtggctgtggtgtgcgcctgggcccctgggggctgtttcctcatctgcagactgagaaatggagggtctgcccgctcgcagcacagagcaggtcctg

SEQ ID NO: 28857 - DNA, 201 bp, Homo sapiens
tgtgaggcccaggttagagtcctgcatgttggttctggaagggacttcttgtctcctagcccctcccccatgatccctgtctccggctggcccctcactgygctgcctttgtcttcctcatcctttgtcttcattcctccttcccgtgagggtggggtggtctgctgaagagggagtgtgcctggcaggtggggtcactcg

SEQ ID NO: 28858 - DNA, 201 bp, Homo sapiens
ttccctgtcctggattaacttttgtttcacccagaggccaggccaacctaggcaggtttcggatatcgcctcctgtgtgggccagccctggttcaaacccsagctctggccctatgtggctgtggccaactgcccttcctcagaagcttggtttttgtgcctgtacagtgagggtggccatgtccatctcatgcaccatgt

SEQ ID NO: 28859 - DNA, 201 bp, Homo sapiens
gctctggcaggcaggccttggcgagatggcctggggagggagtttgtgaggcccaggttagagtcctgcatgttggttctggaagggacttcttgtctccyagcccctcccccatgatccctgtctccggctggcccctcactgtgctgcctttgtcttcctcatcctttgtcttcattcctccttcccgtgagggtgggg

SEQ ID NO: 28860 - DNA, 201 bp, Homo sapiens
acgcccaaaaggcacttggtcatcacagcagctggagctggggggttatcgtaacttggtagccattattattattattattattattactactactacthttgctgctgtggctgtgcctgttccagtagctctggcaggcaggccttggcgagatggcctggggagggagtttgtgaggcccaggttagagtcctgcat

SEQ ID NO: 28861 - DNA, 201 bp, Homo sapiens; identical to SEQ ID NO: 6017

SEQ ID NO: 28862 - DNA, 201 bp, Homo sapiens
tctgtgtgtggtactcatggctctcctgcctcccctgaggttccactgatggtgctgtgagcagtcatccctcccagggatctcgttgagtgtgtggtttktatcattttacagatgggaaaactgaggcccagaagattcatgggctgtcctaggctctcccggcccagaccctcccacctcctggctgccccttcaccc

SEQ ID NO: 28863 - DNA, 201 bp, Homo sapiens
gaggcagaagccctgcacctggcttcccagccacatggacccttccaggcaggaagctgggggtgggactgcctgcccctgggtagacatgcagcttctgrcagaggctgggtcccctccccaaggcctgatgtgggagctgggcacctggcagccaattcatcccgcagggctgggaggtggcagctgggaggcaggccc

SEQ ID NO: 28864 - DNA, 201 bp, Homo sapiens
agcctttggtggaggccactctgggctgaaaggtcctgggtccctttccctggtgtccagggagcatctatccagggggcagctggtgtgagtaggttccyacaaggagggaaagaacacctggctgtgtgcagggggtgagtggggcctaggtgcaggtttgattttttttttttttaatttcaaaggggatgtgttccc

SEQ ID NO: 28865 - DNA, 201 bp, Homo sapiens
gcaggtttgattttttttttttttaatttcaaaggggatgtgttccctagagaagcttaggaagatggggaaatgtagaagaaaaacccagacccatgcarcccagtcccgtggcctctgctgggaagatttctttcccctgagattgatctgtgtgttctctcccgggcaggggtgtgctggctgcgggcccgcctgctg

SEQ ID NO: 28866 - DNA, 201 bp, Homo sapiens
ccatgcagcccagtcccgtggcctctgctgggaagatttctttcccctgagattgatctgtgtgttctctcccgggcaggggtgtgctggctgcgggcccrcctgctgtgggtttatgtggaatctggctttttcagtccacgctgcatcagatgcatttttcctcttagtctgcagccaccctgtcagtggctacatcac

SEQ ID NO: 28867 - DNA, 201 bp, Homo sapiens
ttgtgatcggtttggaggctgtggcaggtggctccgagttacctccatggaagtcactttgggaaatgaggcagaatgttgcacaggatggcaaatgtggkgggtgagaagtgtgtctggaatttgctcagccttctctcgtcagtgatgtcatgtttacccttaaaaatctataagagaaggtgtaatagcttcctacgg

SEQ ID NO: 28868 - DNA, 201 bp, Homo sapiens
agaaggggatttaatcagccaagctgctgcgctgaacggtggtatcagctgtcttgcacagggcccatggagctgctgggcaggagccccgatggaggccygcggcttggagtggccaggtctcctgctaatgacctgccacgagcctgcctggccccagaccttgcagaaattgaccagggctgggaagccatgccgtag

SEQ ID NO: 28869 - DNA, 201 bp, Homo sapiens
ttaaaaatctataagagaaggtgtaatagcttcctacggcactaccacgaatggccacattatgatggtcatttgtgatggcagccacagcaaacgatcaygtgggaaaccctaggggtcttaaaacaacagaaatttgttctctcacatttttggaggccagaagtccaaagtcaaggtgtcagcggggccagttccttt

SEQ ID NO: 28870 - DNA, 201 bp, Homo sapiens
cccctgcccgccgacccccgctggtcctgtgggtggctggctttgtgaccttgggctactctgagcattccttttttcctttgtaagacggcgttctgcayggcagggtcctgtggagattggaggagcagagttagctcttctggcactggggtaggtaagcagcttcctttgccatactgggaaccttcattgttccag

SEQ ID NO: 28871 - DNA, 201 bp, Homo sapiens; identical to SEQ ID NO: 6029

SEQ ID NO: 28872 - DNA, 201 bp, Homo sapiens
aggactgcctgggaagaggaggccggctgctacccggagcctctaggccaccactccctgggtctgtggctgccactttgcctccttgaccctcagtttcytcatctgtaaactgggggggcctggtcacctgcctcatggtgaggaatgttgaggactaatgtgtgtaagccacacgattgctgttcggtagatgaatgt

SEQ ID NO: 28873 - DNA, 201 bp, Homo sapiens
aatatactgcccctgcccgccgacccccgctggtcctgtgggtggctggctttgtgaccttgggctactctgagcattccttttttcctttgtaagacggsgttctgcacggcagggtcctgtggagattggaggagcagagttagctcttctggcactggggtaggtaagcagcttcctttgccatactgggaaccttca

SEQ ID NO: 28874 - DNA, 201 bp, Homo sapiens
tggagctgagggtgtgggctgagggcatggggcaggggactgaagctggggtgggtggctccggagagttcaggcaggaaagcagtgtagacagattcacrgagcaagtggagccgaccacactgggtggcggggagagggtctgcagcagctctgagagcaagacacagtcctgtccctcccgcaacctgcactctccca

SEQ ID NO: 28875 - DNA, 201 bp, Homo sapiens
ttaaaacaacagaaatttgttctctcacatttttggaggccagaagtccaaagtcaaggtgtcagcggggccagttccttttggaggctctggggggggamtcctgtattcggctgctctcgcattgctgtaaagaaatacctaagattgggtaatttataaataaaagaggtttaattggctcacagttttgcaggctgt

SEQ ID NO: 28876 - DNA, 201 bp, Homo sapiens
cccttccctgccctgtgtgtttggcatcttgggttggccgccataccgtatcacctctgtcataggcagtgtagtctttgggtctctggaggactttaaaygcttccttagttgaacctcagagtcagtttggcctctcccttgcccagggaggaaaccccctctttccagccttccagccaatgaacagatggtcagtct

SEQ ID NO: 28877 - DNA, 201 bp, Homo sapiens
ggaaacgtacagtatacgatctttggtgtctcacttctttcctgtaatataagaaaagccgaagtttttgttatttttattattttatgatttttagagaygggagtttgctatgttgcccaggctgaggtgcagtggctattcacaggcatgatagcacactacggctttgaactcctagcttcaagtgatcctcctatc

SEQ ID NO: 28878 - DNA, 201 bp, Homo sapiens
gcagcaggcacccccccatgcacgtagtgggtggggcttcagcactcagtggcttgtggattctgctgaagggagcagcagagccctctctgcaaatgcakccctgccctgtggagactgagggaggcaggggaactgtcctgtggcccggcccaggcttctagtggacacaggcagctttaccctggcaaggctccctgt

SEQ ID NO: 28879 - DNA, 201 bp, Homo sapiens
agcttggcaggtggagcggaggcaccctgtgtgtcatcctcctccctccccgacttttcccagggagagctgaggcccagaatcggagctcagcattctcrtgcagtttttaaaaatttctcctgcctggcaagcctctaacaatgtgaggatgctttgcagattttcagactttgtagaaatggcatcgcactgtgtgtc

SEQ ID NO: 28880 - DNA, 201 bp, Homo sapiens
agtggtacaacatgaggagtttccagcatcttttctagaacagccgcccagactttcttcctttaacttacttcttattaagaaatagataaaaagcaatragcttggagaataatgagacagcgattactccacagcccgcctttatcacactgtcagcaataagcattttagcttcagatctttgccttttaagaaatc

SEQ ID NO: 28881 - DNA, 201 bp, Homo sapiens; identical to SEQ ID NO: 6020

SEQ ID NO: 28882 - DNA, 201 bp, Homo sapiens
ttggtcatcacagcagctggagctggggggttatcgtaacttggtagccattattattattattattattattactactactactattgctgctgtggctrtgcctgttccagtagctctggcaggcaggccttggcgagatggcctggggagggagtttgtgaggcccaggttagagtcctgcatgttggttctggaagg

SEQ ID NO: 28883 - DNA, 201 bp, Homo sapiens
cactgcagcccgaggcagaagccctgcacctggcttcccagccacatggacccttccaggcaggaagctgggggtgggactgcctgcccctgggtagacaygcagcttctgacagaggctgggtcccctccccaaggcctgatgtgggagctgggcacctggcagccaattcatcccgcagggctgggaggtggcagctgg

SEQ ID NO: 28884 - DNA, 201 bp, Homo sapiens
ttgccaggccgttgggaggcgtcatcagggccccatttacagagagggcggcagactcagcttccatggttggcccaaggattgccagaggtgggagcccsgaagatgtcctggaaaccccgcttccagggcccacagggcaccgctgggtgttttctgtctggctctgggcacttgtaagttcctcccaagcctctccca

SEQ ID NO: 28885 - DNA, 201 bp, Homo sapiens
tctcttactgttgcagagtcctggccaagaaaatcaggtggtttggaattttcgcccttaagtggagctaggggtacatctctcaggagaggtgacccagrgaggcatgggtggctctgatggggtggggggaggggtgtcactcatggttgggggagggtgagtgctgggcctaggggtgggggctgtagcctcttcctc

SEQ ID NO: 28886 - DNA, 201 bp, Homo sapiens; identical to SEQ ID NO: 6022

SEQ ID NO: 28887 - DNA, 201 bp, Homo sapiens
atgtgggagctgggcacctggcagccaattcatcccgcagggctgggaggtggcagctgggaggcaggccccagggagtgctcagggcgaagccggcctcrcccaccggtggctccagggtgggcaggggaagggagtttggagtcaggtgccagggttaagtccagaccttcctggtcttgctgtgatctgggtctcttg

SEQ ID NO: 28888 - DNA, 201 bp, Homo sapiens
agtagacctggttgatatttttttcccctaagattaagctgcacacgcactttcttctgtgatatttcatcctttcagctattttatgttatgtttggaarggtgcggactaaaatagtgattgtttcttttttctttatttttttgaggcagagtcttattctgtggcccaggttggagtgcagtggcacgaccttggat

SEQ ID NO: 28889 - DNA, 201 bp, Homo sapiens
aggcaggaagctgggggtgggactgcctgcccctgggtagacatgcagcttctgacagaggctgggtcccctccccaaggcctgatgtgggagctgggcayctggcagccaattcatcccgcagggctgggaggtggcagctgggaggcaggccccagggagtgctcagggcgaagccggcctcgcccaccggtggctcca

SEQ ID NO: 28890 - DNA, 201 bp, Homo sapiens
gtagagatggggtttcaccatgttggccaggctggcctcgaactcctggcctcaagtgatccacccacctcggcctcccaaagtgctgggattacatgtgkgagccatgtgggagccacctgtaccctgggcattcctttctctgagccattgtctccttctagcctggcttcacctctgctgggcccaggagtgacttgg

SEQ ID NO: 28891 - DNA, 201 bp, Homo sapiens
agcatcggctgttctcgttgcggcacctgcagagccgtgtatggaggtgcttcttgggcagcacgtgcgcttgtagcagctgtgccccttcctgctctctyccctgcaccccttgcccacaaggctgaccccaggcccccggtgcagagcttgctgggcctcagtgctggctgctggctctgcgatttctcttttgctgcc

SEQ ID NO: 28892 - DNA, 201 bp, Homo sapiens
cacccacctcggcctcccaaagtgctgggattacatgtgtgagccatgtgggagccacctgtaccctgggcattcctttctctgagccattgtctccttcyagcctggcttcacctctgctgggcccaggagtgacttggtgaagagccagatgcagcctttgccttggggctggcagatgtttaaagatggacactagat

SEQ ID NO: 28893 - DNA, 201 bp, Homo sapiens
ggcagctctgtgtgtaagatcccttctccctgggtcctgagggagccacccgaggaagactgggcaggtgggtgtttctggggagcggcagtggacccccygcctccccctgtggaagggccagcaccttccttagctggagctcttctctgtgtgcagaacaagcccagcaggtgatttcagctcctgctttccctcctc

SEQ ID NO: 28894 - DNA, 201 bp, Homo sapiens
ccatgtggcttgtcgggagccctggaggcgtgtggcagcaggcacccccccatgcacgtagtgggtggggcttcagcactcagtggcttgtggattctgcygaagggagcagcagagccctctctgcaaatgcatccctgccctgtggagactgagggaggcaggggaactgtcctgtggcccggcccaggcttctagtgg

SEQ ID NO: 28895 - DNA, 201 bp, Homo sapiens
ggccctggatacaggctggaggtgtcctgaactccggtcctcagtggaaaaggaggccctgcaacctcctgggtctcttcctccctagtctaggacactcrtgctgccctctggaggctctagaagtgagtaatgcggattgggcctggccagggtggaaggggccacgctgagtgtttggcagggctggccccaccctgt

SEQ ID NO: 28896 - DNA, 201 bp, Homo sapiens
gccctatctccgccgcaggggctcagcccagccctgggcttctgtgcagggctttgcatctgtgcccttgggggctcggcatgcagtcattgaacagcctmcctttacagaggcgctgctgaggctgagggatgccatgtgttcaagagccatgctgggtgcagtggctcacacctgtaatcccagcactttgggaggccg

SEQ ID NO: 28897 - DNA, 201 bp, Homo sapiens
cagggtagcccagtgctgctgcctgtgggcctttggtctgcgtctcagccttccagtggggcctacagaacggcacggctgtgcacctctggcacctgcaygcccaaaaggcacttggtcatcacagcagctggagctggggggttatcgtaacttggtagccattattattattattattattattactactactactat

SEQ ID NO: 28898 - DNA, 201 bp, Homo sapiens
ttgcagtgaaggccctggatacaggctggaggtgtcctgaactccggtcctcagtggaaaaggaggccctgcaacctcctgggtctcttcctccctagtcyaggacactcatgctgccctctggaggctctagaagtgagtaatgcggattgggcctggccagggtggaaggggccacgctgagtgtttggcagggctggc

SEQ ID NO: 28899 - DNA, 201 bp, Homo sapiens
ggctcagcccagccctgggcttctgtgcagggctttgcatctgtgcccttgggggctcggcatgcagtcattgaacagcctccctttacagaggcgctgcygaggctgagggatgccatgtgttcaagagccatgctgggtgcagtggctcacacctgtaatcccagcactttgggaggccgaggcaggcggatcatgagg

SEQ ID NO: 28900 - DNA, 201 bp, Homo sapiens
cctaggggtcaccccagggtggccccacataggccccctgcagctttgcaggcaggcattcactgcaggacggggttcccctctggggagaaggctgggcygcactgcagaggcccagaaagggctggggaacaactggagttcacccagcgagtcctcgctgggccccaagtcgggcagtgttgcagtgaaggccctgga

SEQ ID NO: 28901 - DNA, 201 bp, Homo sapiens
tgggaggatggcactattaagccaggcttgttgatgatcatttcggtcaacaatcaccctgctgttagttttatgtgaaacgcgggaagcccaatttgctrtcctcaaactgagtctatctcgcttctaaccgggcaggtccactccgctctgcctaatttcggggacagtgtctcgcaggagacccagttgcgttcctgt

SEQ ID NO: 28902 - DNA, 201 bp, Homo sapiens
ttagggcagccgttcgttttcctcttctctagctactttttttccctggaggcactgggaagggtgtcctcggcgtgtttgatttctaatccggctgtggragtgtgagatggagagtgtggggctccggtcatggcagctccgtttttgcatgcatccgcgaggtgggactttaggttcccatgatcccatgtctccggg

SEQ ID NO: 28903 - DNA, 201 bp, Homo sapiens
gcttctgtgcagggctttgcatctgtgcccttgggggctcggcatgcagtcattgaacagcctccctttacagaggcgctgctgaggctgagggatgccaygtgttcaagagccatgctgggtgcagtggctcacacctgtaatcccagcactttgggaggccgaggcaggcggatcatgaggtcaggagttcgagaccag

SEQ ID NO: 28904 - DNA, 201 bp, Homo sapiens
ttatcctctttctgttcagcatcccctctgacaatgctccctaggggtcaccccagggtggccccacataggccccctgcagctttgcaggcaggcattcrctgcaggacggggttcccctctggggagaaggctgggctgcactgcagaggcccagaaagggctggggaacaactggagttcacccagcgagtcctcgct

SEQ ID NO: 28905 - DNA, 201 bp, Homo sapiens
aagccccatcccctgcctcagtgggttgtctagaagagtcctgggtgtgggaacacacagacacacagacacacacacacacacacacacacacacccttyaaattttagccctgtttttatgagttctgtgactgggtggttatggagcccctcggaacctcggtctctttgttgggggagtaggtgaaagttgctgtgc

SEQ ID NO: 28906 - DNA, 201 bp, Homo sapiens
taagcacagcccagaaaggcgcttcctgcctgcagccaccccacccatcctttccaaacaagcagcctcaggtgggcaggctggggtgggtgggctctgtytccatgtcttatcctctttctgttcagcatcccctctgacaatgctccctaggggtcaccccagggtggccccacataggccccctgcagctttgcaggc

SEQ ID NO: 28907 - DNA, 201 bp, Homo sapiens
ccagaacaaggcccttgtgttgtcatttggggaaactgaggcccagtgtgtcatggagggcgctgccagggctgggactcctgacccagtttcttcccccrcactacactgcctcttctgaacagagatcgcagcagccctcacgggcacacagcttgtgttgtttgcattgctcagcaccaattatctcctcttgcaaca

SEQ ID NO: 28908 - DNA, 201 bp, Homo sapiens
ttggacaggtggggtgactccgagccctagagctcaccggcagagtggacaccccttccattggcttcttcccttccctgcctcccttctctacccctctmcctgggtttcctggggttgccacccacataacccacgtgaagttgattcctcctctctcagtctgcacccaacctgagatataagatcatagggaggcgt

SEQ ID NO: 28909 - DNA, 201 bp, Homo sapiens
tactcgggaggctgaggcagaagaatcgcttgaacccaggaggcggaggttgcagtgagctgagatcgcaccattgcattccagcctgggcaacaaagcargactctgtctcaaaaacaaacaaacaaaaaaaaaccacacagggaattagtggcccccgtgtgagatttgaacccggagtttgtgcttgtgaagactttt

SEQ ID NO: 28910 - DNA, 201 bp, Homo sapiens
ttctacacccacttgctcacttacctgctcactcattcacctgctcacctgcacacccacctgctcattcacctgctcatctgcatactcacttgctcackcattcacctgctcacctgcacacctacctgctcactcattcacctgttcacctgcttgcttgttcatgtgaccttccccccactgcctccaatcccgtgt

SEQ ID NO: 28911 - DNA, 201 bp, Homo sapiens
ataacccacgtgaagttgattcctcctctctcagtctgcacccaacctgagatataagatcatagggaggcgtgtgtgagacaggagcatcaggcaccgcmgagtcagatgcaaggagcgtgtgcccagagcccaggatgctctgccccctgtagcctcggcagctccttgtctggggttccccagcttggggtgcggggt

SEQ ID NO: 28912 - DNA, 201 bp, Homo sapiens
ggtttggaggagtggggtggtcacagcagcgggtttcccccgggttttctgttgcagctcagtttctggaagggagtggatggggtgtcatctcagcccaygtgtgtgatttggcctggtaggtgatttggattcctgatgtctacctctgccccctgtaggcagctgtgaaccacaggcggtctgtgggggttagtccgt

SEQ ID NO: 28913 - DNA, 201 bp, Homo sapiens
acgcttcagttctgtgtccctaggaggatgggctgtcctgagcccgggttcctccggagatgctggcgtcgcggtggtccacgtgggcatctctgttggtyagcgtttccatgccttggtagcaggctccaagcccttccctgccctgtgtgtttggcatcttgggttggccgccataccgtatcacctctgtcataggca

SEQ ID NO: 28914 - DNA, 201 bp, Homo sapiens
gtggccattagtgtgagccaccctcattagacgggcacagatcggtgaggtttggaggagtggggtggtcacagcagcgggtttcccccgggttttctgtwgcagctcagtttctggaagggagtggatggggtgtcatctcagcccacgtgtgtgatttggcctggtaggtgatttggattcctgatgtctacctctgcc

SEQ ID NO: 28915 - DNA, 201 bp, Homo sapiens
gcgggttaaccaccgtgatctttcctgtccattgtgggccagccatagcctccgccagcctccgcctgatgccagtttatgtgcaaacaaacagaggcccrgaaagttgaggagctgctctggcttactcagccaaggtaggatttggttttgcaaatccgcacccctcagctgggcgcagtggctcacgcctgtaatccc

SEQ ID NO: 28916 - DNA, 201 bp, Homo sapiens
ctttttggggatggaggaagatgtggccattagtgtgagccaccctcattagacgggcacagatcggtgaggtttggaggagtggggtggtcacagcagcrggtttcccccgggttttctgttgcagctcagtttctggaagggagtggatggggtgtcatctcagcccacgtgtgtgatttggcctggtaggtgatttgg

SEQ ID NO: 28917 - DNA, 201 bp, Homo sapiens
tccctagaggctctgacctagggagggggcttgctggggagtgggaggctgagcctggctggtggactccggtctcagcctgcactcacctgcctgctgcrtgcttactcacttgctcactcacctgctcacccatctgcccacccacctgctcacccacctgcacactcacctctcacccacctgcacacccacctctca

SEQ ID NO: 28918 - DNA, 201 bp, Homo sapiens
tgtctcttgagcccttttccctagaggctctgacctagggagggggcttgctggggagtgggaggctgagcctggctggtggactccggtctcagcctgcrctcacctgcctgctgcatgcttactcacttgctcactcacctgctcacccatctgcccacccacctgctcacccacctgcacactcacctctcacccacc

SEQ ID NO: 28919 - DNA, 201 bp, Homo sapiens
aatttggcttgggctgtctcttgagcccttttccctagaggctctgacctagggagggggcttgctggggagtgggaggctgagcctggctggtggactcyggtctcagcctgcactcacctgcctgctgcatgcttactcacttgctcactcacctgctcacccatctgcccacccacctgctcacccacctgcacactc

SEQ ID NO: 28920 - DNA, 201 bp, Homo sapiens
cccccctctgctggctacagccctgcaggacagaagcccgaggctgtcgtgcatgccatgaaggtgagggccactacccgctccctcagaagtcctcagaygctgggtgcactgtgagactgtgggacctttgcacctaggggtatccaagtggcaggggtgggaggtttcatctgtgtgtgggtggctgggtgaccatgg

SEQ ID NO: 28921 - DNA, 201 bp, Homo sapiens
tggaggccactctgggctgaaaggtcctgggtccctttccctggtgtccagggagcatctatccagggggcagctggtgtgagtaggttcccacaaggagrgaaagaacacctggctgtgtgcagggggtgagtggggcctaggtgcaggtttgattttttttttttttaatttcaaaggggatgtgttccctagagaagc

SEQ ID NO: 28922 - DNA, 201 bp, Homo sapiens
cgtacgtgccccatgacatcccacatgcatgcacggccacgcctactcacaccccctccacgtggcgagtgcccactcatctccagcgggccctgggttgsagtgagtccacctgtctgagggtcttccttgcccagcctgtctacttcctcccgggtggcccagccatgagctgcttcccttgtagggcatccagtgtca

SEQ ID NO: 28923 - DNA, 201 bp, Homo sapiens
gggcgggcacactcaggcggaggccttgcctgccacagtgaccaaggctgggtgggggtgtatccctagaaacgaaggatctggttagaagtgcagtgccrtggtggggcttgtgtgctgggatggccacagtcccgggcttggttagaagcacagtgccatgggggagctcgtgtgctgggatggccacagtcctcttca

SEQ ID NO: 28924 - DNA, 201 bp, Homo sapiens
gatctgctgctgtctgaatccatggccaacgcttcagttctgtgtccctaggaggatgggctgtcctgagcccgggttcctccggagatgctggcgtcgcrgtggtccacgtgggcatctctgttggtcagcgtttccatgccttggtagcaggctccaagcccttccctgccctgtgtgtttggcatcttgggttggccg

SEQ ID NO: 28925 - DNA, 201 bp, Homo sapiens
gccttctcctgggagggccgcttcccctttccctcagtgagctatgtatggatgcctttttatcagcgtggactcaggatttttatttcatccaacagggytgtaatccctggctcttattatcattattgccacttggcctgggagaaaaaagtggctgtgtgccagggaggagaagggatttgaaggcccaggtgtgtg

SEQ ID NO: 28926 - DNA, 201 bp, Homo sapiens
tttgggagggtcccccattgtaagctgagcatacaaatctctgtaagtaataactggtttgcgggagactcttggagacatgcagatgtcttggtctccarcaggcagacacgcacttgtctcagcatccacagttagctgtctggtggggacgatgctgattttctaacttctcccgtccttccacctccttccacattt

SEQ ID NO: 28927 - DNA, 201 bp, Homo sapiens
tgtgaactggaaggagctctctccagctccctgtcctccaacctggctcccatcccagcctggggactgcacagtgaccacggggacctggagaccatctyagcacacgctcagggcagaggcattgttagtgcctgcaggagctgcacggggcctgggctcatgtggctttttcctgcccaggttcccattgctctgagg

SEQ ID NO: 28928 - DNA, 201 bp, Homo sapiens; identical to SEQ ID NO: 6023

SEQ ID NO: 28929 - DNA, 201 bp, Homo sapiens
ggatgatggcttatctgtgggagtgggattggtgggaaatgtgaactggaaggagctctctccagctccctgtcctccaacctggctcccatcccagcctsgggactgcacagtgaccacggggacctggagaccatctcagcacacgctcagggcagaggcattgttagtgcctgcaggagctgcacggggcctgggctc

SEQ ID NO: 28930 - DNA, 201 bp, Homo sapiens; identical to SEQ ID NO: 6024

SEQ ID NO: 28931 - DNA, 201 bp, Homo sapiens
cccctgggatgatggcttatctgtgggagtgggattggtgggaaatgtgaactggaaggagctctctccagctccctgtcctccaacctggctcccatccyagcctggggactgcacagtgaccacggggacctggagaccatctcagcacacgctcagggcagaggcattgttagtgcctgcaggagctgcacggggcct

SEQ ID NO: 28932 - DNA, 201 bp, Homo sapiens
tttgagaaccagtgaccaactgtgtgccagccctgggcttgggctgggaggtgaaccacacctgtccagccatgcagacagacgataaaccaacaacgtcrttacacagtgccaagtctacctccccttccagagcagcccacaggcatgactgacggacgtgtggacacaaacctcctgcgtgccctcgtgggaacaact

SEQ ID NO: 28933 - DNA, 201 bp, Homo sapiens
ggcagagtgatgggcatggttggcatttactgggtgacactgttctccttccttctagctgccccgcccctacggccgcccgagaagctggcttcaggtaragctgcctggtgggaggcgtgtttgcagtggtgtttgtgggggtcgggaggctgctttgtgtgctgtgcgctgctgtgtgctctgtcccctactccccag

SEQ ID NO: 28934 - DNA, 201 bp, Homo sapiens
gccagccatagcctccgccagcctccgcctgatgccagtttatgtgcaaacaaacagaggcccagaaagttgaggagctgctctggcttactcagccaagrtaggatttggttttgcaaatccgcacccctcagctgggcgcagtggctcacgcctgtaatcccggcactttgggaggccaaggctggcaggtcacctgag

SEQ ID NO: 28935 - DNA, 201 bp, Homo sapiens
tcagccaaggtaggatttggttttgcaaatccgcacccctcagctgggcgcagtggctcacgcctgtaatcccggcactttgggaggccaaggctggcagrtcacctgagatcagaagttcaagaccagcctggccaacatggtgaaacctcgtctctactaaaaaatacaaaaattagctgggcatggtggccggcacct

SEQ ID NO: 28936 - DNA, 201 bp, Homo sapiens
tttccctgggagggtagcagggcacttggggtggctccaccctggtgtgagttttggggtgggctatggggggtggtgggtgctcctagggacccagtgcygggcacatggcaggtcttcagtgagtccttgtgaatctggagtttctgaagacgtggagctcctggagtcgccttggcgagccccaaccctggccttcgg

SEQ ID NO: 28937 - DNA, 201 bp, Homo sapiens
taaccaagggagggcttcagcaggtagtgagggtaccatctttggagataatcaagagatggctgggtgactatgtttgggaatcttgaagaaagagttcrcagccttgaatgagatgctgtcctaagcctcatggactctggctcgtgagattctgtgattctggcatttaaatcttgtcagggaaatcaagttgtacag

SEQ ID NO: 28938 - DNA, 201 bp, Homo sapiens
cactgctaggggaagcctagggtccttctcccattgagggccacacccccaggccatccctggtggcctggggtaaccaagtccctggccagcaggacaaygagctcctggtctgttagtcctattttgggtcacccagtgatgtcacggtgccaagagccatgcaggaagcaccgggttttccaagccttgcccaaggtg

SEQ ID NO: 28939 - DNA, 201 bp, Homo sapiens
tgggtatgatcctttatctgggaggggacttacacatggctcctcccagatggcagcttgttgtccaactctgctcacctagccactctctggcagcgttygtaatcctcatatagtcgggtttcacggtcgttcccttcatggtttgttctttttgttccttgattaagaaatccttttctacctgaaagctcaagtttt

SEQ ID NO: 28940 - DNA, 201 bp, Homo sapiens
ggcaagttcaggagtctgtttccccactgtgtagaggagggggctccccggaccccgaccctggggtgggctgtgccctggctgtgtttgtgagagctccrtttgagcctgcagcatcttggaagctgaaggaattgctccagggcaggctggcgaggccacccccacaccccccacctttctacaggtcctgaaggtcct

SEQ ID NO: 28941 - DNA, 201 bp, Homo sapiens
ggcccagctgaccccaggcctctcctcccttctatccggcactgctaggggaagcctagggtccttctcccattgagggccacacccccaggccatccctrgtggcctggggtaaccaagtccctggccagcaggacaatgagctcctggtctgttagtcctattttgggtcacccagtgatgtcacggtgccaagagcca

SEQ ID NO: 28942 - DNA, 201 bp, Homo sapiens
ttcacatagaactctctgaccttcctggaactgttttctgtatatggtgtgaggctgagatagagttttactgttttctgggtggacagcttgttgctacygcagccccgttcatgaagcgctctgttctttccccgccggcaccgtggccacacaccaggtgtgtgggtcttttctgggctccaccttgcctctccacgt

SEQ ID NO: 28943 - DNA, 201 bp, Homo sapiens
catatgctgtgggcacacatagcttgtgagaagttcctgggtgatcaggcgaagtggactggaaggatcccagatgctgacttggcaagttcaggagtctrtttccccactgtgtagaggagggggctccccggaccccgaccctggggtgggctgtgccctggctgtgtttgtgagagctccatttgagcctgcagcatc

SEQ ID NO: 28944 - DNA, 201 bp, Homo sapiens
tggctgagatgtcccacccctcccacgcctccccactgttcttactaactctgcaggaaagcaggctccggggcagagctgtgggggcagggcatcatccyggccccccagctcttcccacagagcctggcactcgatagagatttggttgacatctagtgatgaaagcagcccccacacactttctcctgaaaccagcaa

SEQ ID NO: 28945 - DNA, 201 bp, Homo sapiens
aggcccagctgaccccaggcctctcctcccttctatccggcactgctaggggaagcctagggtccttctcccattgagggccacacccccaggccatcccyggtggcctggggtaaccaagtccctggccagcaggacaatgagctcctggtctgttagtcctattttgggtcacccagtgatgtcacggtgccaagagcc

SEQ ID NO: 28946 - DNA, 201 bp, Homo sapiens
cggtcagtcactggtgcgaggtcacacagctgtgatgtgagaccagtgtttctgtgattacagaggcccagctgaccccaggcctctcctcccttctatcyggcactgctaggggaagcctagggtccttctcccattgagggccacacccccaggccatccctggtggcctggggtaaccaagtccctggccagcaggac

SEQ ID NO: 28947 - DNA, 201 bp, Homo sapiens
cccaggaggcggaggttgcagtgagctgagatcgcaccattgcattccagcctgggcaacaaagcaagactctgtctcaaaaacaaacaaacaaaaaaaaaccacacagggaattagtggcccccgtgtgagatttgaacccggagtttgtgcttgtgaagacttttgaagggcctgtgagaagattgtgacattcctctc

SEQ ID NO: 28948 - DNA, 201 bp, Homo sapiens
tgcctgagcctgggagttcagagttcaaggtttcaggtgagccatgatcacactgctgcactccagcctgggcaacagtgagatactgtcgcaaaaaaagracgagaactttcatatagcatagtgacaaaaaatgatcaatatcagaacatttaacgttgatactattaatacttgtcccaatatgatgctctagagcaa

SEQ ID NO: 28949 - DNA, 201 bp, Homo sapiens
ctacggccgcccgagaagctggcttcaggtagagctgcctggtgggaggcgtgtttgcagtggtgtttgtgggggtcgggaggctgctttgtgtgctgtgmgctgctgtgtgctctgtcccctactccccagcaccctcccgttctttcctgggagcacttccttcccaggctgcgctggccctgcctttagagtcttctt

SEQ ID NO: 28950 - DNA, 201 bp, Homo sapiens
tgccctgggcatcctggcagctgagctgactcccagcctggggggaggcaggaccaggggtatgggatggctggacgtgggggtggggatgggattttttygtgttttcctgatgtgactggaaagcagggtcagtgtggtgagggtgggtgaatttcaccctgcaccagtggtctgcatagatagggctcccttggcctg

SEQ ID NO: 28951 - DNA, 201 bp, Homo sapiens
cctcggacagaggttctgagagaggaaggccaaggaggaaggaggagttaggaggggtccggggacctggggccccaccactccagccctttagaaatgcscatgaacccatgagactatagtgagccgagatcgtgccattgcactccagcctgggtgacagagtgagactctgtctcaaaaaaaaaaaaaaaaaaaaaa

SEQ ID NO: 28952 - DNA, 201 bp, Homo sapiens
ttcagccatccaacaaatgtttacaaagcccacgctggagagtggatcgctgacatttgagctggggagagtgaagatcgattgatcccggctcgggggayggataagcggtgtggaggggagggtggaggggtcctccggggccgtgcctttgagcagcccctgctgccgtgaggagccatgcccagggcccttgtcctc

SEQ ID NO: 28953 - DNA, 201 bp, Homo sapiens
ccggtgggtggacagctgtcagggtggatggggtctgggctggcatctgggccaggtgatctctgcgagagatgttaataacccatcccttaccaggtggmttcgtggctcacaggggtacttgggacagccttgcttcccccttgcctcctccttccaaacctgctgttgctgggtggtcccccggcctgtgttctgggt

SEQ ID NO: 28954 - DNA, 201 bp, Homo sapiens
gggagagacactctctcctcactcgctctcactggctcttcttcattcattcattcattctgtttattcagccatccaacaaatgtttacaaagcccacgytggagagtggatcgctgacatttgagctggggagagtgaagatcgattgatcccggctcgggggacggataagcggtgtggaggggagggtggaggggtc

SEQ ID NO: 28955 - DNA, 201 bp, Homo sapiens
agcgaaggtgctgaggctgacggggcagctgtggacttgggttccagcccatccctcctccgattgtgggctcatggagagggaagtgctgggagctcctygctcaccctgtgggaaccagcagggggaggcgggtgggctgaaagtgcacccacctcctgaatggttctgtggcagcgaagggcagagaacaagttagtg

SEQ ID NO: 28956 - DNA, 201 bp, Homo sapiens
gcgtgatgctggcggtctgggggctgctctgagaatagagaagcagtgctggggccgggcctggcgcctggcatacaggtgccctggagtctctgtgtgtrgtactcatggctctcctgcctcccctgaggttccactgatggtgctgtgagcagtcatccctcccagggatctcgttgagtgtgtggtttgtatcatttt

SEQ ID NO: 28957 - DNA, 201 bp, Homo sapiens
ctgtctgcatcccttctccggatgccacctgccagcctgatcactgtctttaacccttactgggaagtgggtgtgaaaccccagttgtatctgagggggcrgactgctcagacaggagaagggtcacccagcgaaggtgctgaggctgacggggcagctgtggacttgggttccagcccatccctcctccgattgtgggct

SEQ ID NO: 28958 - DNA, 201 bp, Homo sapiens
atttgtacacgtgtgtgcatgcatgtgtgtgtgagggtgaggtgtgcaggagggatggaggaggaggtggctcctttgtgaccttctgtttccgtgagaamccttgggacacacctctcacccaggttgggggttccctgtcctggattaacttttgtttcacccagaggccaggccaacctaggcaggtttcggatatcg

SEQ ID NO: 28959 - DNA, 201 bp, Homo sapiens
tggggccgtgggtgtgtggccacctgtctgtgcctacaggtggcccgatgtgggggatggtagcctgtgggttctgaggtgaggtgctggctatgggcagkcagggcattgctggcgacctgtgggatggcctgtctgcatcccttctccggatgccacctgccagcctgatcactgtctttaacccttactgggaagtgg

SEQ ID NO: 28960 - DNA, 201 bp, Homo sapiens
ggtctggctcctggacacaagaacgttgtagggagacaccctcctccccggttggcagctggatagggaatcccccagaattggtccgatggcccccagaygggttaggggagcaccccaggggaccccttggccaggccagcccagggtcacctccctcattttgccctcaggcagccaagctgggaaatgatgtcccct

SEQ ID NO: 28961 - DNA, 201 bp, Homo sapiens
gagggggaataccacccagcccctgcctcacagcttcccagaaggccagtgagtcctggtcccagtggcaggacccagtgcagggtatctgggatggagcyggcacagcgccaatggggagggcttggcagacctgcaggctctgtgactccccccaccatgctgcacagctttcccccaccccctcctcatgggagcaag

SEQ ID NO: 28962 - DNA, 201 bp, Homo sapiens
cttctctacccctctacctgggtttcctggggttgccacccacataacccacgtgaagttgattcctcctctctcagtctgcacccaacctgagatataasatcatagggaggcgtgtgtgagacaggagcatcaggcaccgcagagtcagatgcaaggagcgtgtgcccagagcccaggatgctctgccccctgtagcct

SEQ ID NO: 28963 - DNA, 201 bp, Homo sapiens
tttgcaggctgtccaggaagcatggcagcacctgctcagcttctggggtggcctcaggaaatgtacaatcatggcggaaggcgaaggggaggcgggtgcgwcttgcaggcgggagcaggagaaagaggggagtagagtgcggggaggagccacacactttaaacaaccagatcacagaggaactgtatcacaagaacagca

SEQ ID NO: 28964 - DNA, 201 bp, Homo sapiens
aactgaggcccagaagattcatgggctgtcctaggctctcccggcccagaccctcccacctcctggctgccccttcaccctacccagccctggctgcagcrttggtgcccgcaggcatgaggcaggcatgagggctgcgtgtgtgggtgggcagacccccttccttgctaagagggcagcctttggtggaggccactctgg

SEQ ID NO: 28965 - DNA, 201 bp, Homo sapiens
tggcctcatggtcagcggtgcccaggacatttcggcgctgcgttacgacagctcattgtgcctctgggctcggggctggagcagacgggcgcagcagcccygcggctgaaagccaccgtcccctgcattggtggaggctgctggcatgccctcgtgtatcatcctgcctcttctctggggtctccccaccctcctccctgg

SEQ ID NO: 28966 - DNA, 201 bp, Homo sapiens; identical to SEQ ID NO: 6027

SEQ ID NO: 28967 - DNA, 201 bp, Homo sapiens
acagcgattactccacagcccgcctttatcacactgtcagcaataagcattttagcttcagatctttgccttttaagaaatcaagcttggcaggtggagcrgaggcaccctgtgtgtcatcctcctccctccccgacttttcccagggagagctgaggcccagaatcggagctcagcattctcgtgcagtttttaaaaatt

SEQ ID NO: 28968 - DNA, 201 bp, Homo sapiens
cagagacactcctgcccaacacactcagccagcacagacctgctgactctgtgcccaggctctctctgaagcactgtggggctcaggtttgcgcctccccstccctgcaagggcctggtcctgccttgctggggtcagtctcatgaaggcccccagagacccttgtggagggcaggtgtgtcagcctccgcagaatgcttg

SEQ ID NO: 28969 - DNA, 201 bp, Homo sapiens
ggcaaaggcccggacaggccacaaattaccctgtgcatgtgattccatttcccagccactttttttctctaaggagttgctggcatcgtaaatcttactgmaaacagtggggaagaaaagaatctgagattctacaaagcacatttaacatccatgactgtgtttgatctttccagtggtggaggggcccgcctgctcccc

SEQ ID NO: 28970 - DNA, 201 bp, Homo sapiens
cactttctgctttgtgatcttagatgagtctcttcatctctgcgagcctcagtttcctcacttttcaataggaataattgcatttttctccgaaggttacygtgaggatctgagaaggtaacagaggtaaagtgctcagcataacacctcccacgtggttctataaatggagttgaagatttttcttttcttttgaaatga

SEQ ID NO: 28971 - DNA, 201 bp, Homo sapiens
cgagaacagcctgggctgtacctggtagacgatctctgagaccacgtgccctggtgaattagagcctgggccttgggaaagggctttgggctcaaatcccractacagcactttctgctttgtgatcttagatgagtctcttcatctctgcgagcctcagtttcctcacttttcaataggaataattgcatttttctccga

SEQ ID NO: 28972 - DNA, 201 bp, Homo sapiens; identical to SEQ ID NO: 6021

SEQ ID NO: 28973 - DNA, 201 bp, Homo sapiens
ccaagggaccagcatccctcagatgctggccttgttaacccagctcttgtctcttcctccagccgagaacagcctgggctgtacctggtagacgatctctkagaccacgtgccctggtgaattagagcctgggccttgggaaagggctttgggctcaaatcccgactacagcactttctgctttgtgatcttagatgagtc

SEQ ID NO: 28974 - DNA, 201 bp, Homo sapiens
gtgccagaaagcaggaagaaaaggggcaggtgggatttgttgttctgatcagctcactggagacaggctcttgtcacagggggcattgaactgggcacctrcctgcctgaaatatttacattggcaaaggcccggacaggccacaaattaccctgtgcatgtgattccatttcccagccactttttttctctaaggagttg

SEQ ID NO: 28975 - DNA, 201 bp, Homo sapiens
ctgaggcttcagggcctagctcaatgaggcaggaggctggataggtgtgatgtcccaggccacccatgtgccaagaggtgccagaaagcaggaagaaaagsggcaggtgggatttgttgttctgatcagctcactggagacaggctcttgtcacagggggcattgaactgggcacctacctgcctgaaatatttacattgg

SEQ ID NO: 28976 - DNA, 201 bp, Homo sapiens
gcacagtgcctggagcttgtgggttctccaggctggggccctgggtggctgtggtgtgcgcctgggcccctgggggctgtttcctcatctgcagactgagraatggagggtctgcccgctcgcagcacagagcaggtcctgcaaggtctgagccaggagccactgcatggcgcccgcccctggtgcccaacaaaggacagt

SEQ ID NO: 28977 - DNA, 201 bp, Homo sapiens
tagctgctcacatctggggccatttacaaagggtcgtcggcccccatcctgcttcgtggcctttcaaggaaggccatgagcagcaggtcccactgccaggwtgtttccctgcgagcccattgagaaatccccctggaaatcctcctttggcctggcgcaggcaggcgagagaattgcagacaatggggagccggggaacaa

SEQ ID NO: 28978 - DNA, 201 bp, Homo sapiens
agtgcaagaccctggtgcttcttggttatcaggaccagagagcagcaaggacgcagcagtgggtgcgaagaggtctccacctctctgtccccttcactgcrcagaacaaacaacaaaacaagaaacttctgtggagagacagtgctctcttccatggctaatgggagtgaggtccagcctctatggagcgtaatctggtca

SEQ ID NO: 28979 - DNA, 201 bp, Homo sapiens
ccagcgggccctgggttgcagtgagtccacctgtctgagggtcttccttgcccagcctgtctacttcctcccgggtggcccagccatgagctgcttccctygtagggcatccagtgtcagcagggtgagatgacaacctgcccctcagttttttccacgcttgtccccaggggcccagcggctcagggtcctcagctttgg

SEQ ID NO: 28980 - DNA, 201 bp, Homo sapiens; identical to SEQ ID NO: 6028

SEQ ID NO: 28981 - DNA, 201 bp, Homo sapiens
ccccccaaggaagctggggaggcgggatatgccctgagctgcctcggacagaggttctgagagaggaaggccaaggaggaaggaggagttaggaggggtcyggggacctggggccccaccactccagccctttagaaatgcccatgaacccatgagactatagtgagccgagatcgtgccattgcactccagcctgggtga

SEQ ID NO: 28982 - DNA, 201 bp, Homo sapiens
gcccccttggtgccattccctactgagtggagtttcgtttaatctcaccaacgccgtagcgcaggggattctttcacagctgggttccaaaacctaaggcsgtctccctgctcccacctggcatccctcctctgcccccttcccacatttacccagcttcatgtgtgctgggcacagtgcctggagcttgtgggttctcca

SEQ ID NO: 28983 - DNA, 201 bp, Homo sapiens
cctggttcaaacccgagctctggccctatgtggctgtggccaactgcccttcctcagaagcttggtttttgtgcctgtacagtgagggtggccatgtccayctcatgcaccatgtgcctgatgtccagcagcgcgttactgttcctcagtgattgtgtggcattgcgctgtggctctgtggcacttggttagggcttgtgg

SEQ ID NO: 28984 - DNA, 201 bp, Homo sapiens
gggagccacccgaggaagactgggcaggtgggtgtttctggggagcggcagtggaccccccgcctccccctgtggaagggccagcaccttccttagctggrgctcttctctgtgtgcagaacaagcccagcaggtgatttcagctcctgctttccctcctcggggaaatcctagggaatctcattctgcaaaggcagcgac

SEQ ID NO: 28985 - DNA, 201 bp, Homo sapiens
ctgggattacaggcatgagcccctgtgtccggcctcctgccctatcttaagattagttttatctgccgcaccttggctgtcctggcccaggggtccctccygctggtgagaacacagccttaccaagctctttaggaaactgcaggtgccctgatggggtctcggcaccaccatgcctcccctggttgtcacgcccccaac

SEQ ID NO: 28986 - DNA, 201 bp, Homo sapiens
ccagccccagcctgggcctcccctgcccctgcagtttgtttgggtaactcaacagcctgctgatttatgggacattccgcagggttttatctgcccagccrctttctctcagttcctttgaagtagaaaagggtgtttcggccagaaacacccaaaaccctttagtgatgcagaaagaaaagaaaggccgggccttctgct

SEQ ID NO: 28987 - DNA, 201 bp, Homo sapiens; identical to SEQ ID NO: 6030

SEQ ID NO: 28988 - DNA, 201 bp, Homo sapiens; identical to SEQ ID NO: 6018

SEQ ID NO: 28989 - DNA, 201 bp, Homo sapiens
ggcctctcccaggttcctgagggccttggcactcccctggcgcagtcactaatgcacactaagcatcctaatgccctgcgctggctgagggccaggacgcrgcctcaccccacgaagactcctgtgtacgggaactcaggtggaacagggctggatcctgggggcagggccagccagcaggaaggaagagcaccctgacca

SEQ ID NO: 28990 - DNA, 201 bp, Homo sapiens
gaactgtgcagcccctcccccgcatcacctagtggggcctgtggaccccactggacagctgcaaggctgagccacaccccagcagtgacctgctcaggccygatagttagcgcggcatgcaaagacctggtgtgggtgtctctgggcctgcagtggcctccgtgtccctcctggccccatggctctgaggacgtgggtgat

SEQ ID NO: 28991 - DNA, 201 bp, Homo sapiens
cctggccacccatggctcaatcccctgcagggagcacctggaggtcctgttcgctctaggcgggaggctgagtgacgctggaccgctgagcagcaggtccygcggggactccgaggcaccgggggaaatgaagcggtgcccaggcagctgcacgcctgagtccctgcctggtctgagcgccccggaaacagcttaggcttc

SEQ ID NO: 28992 - DNA, 201 bp, Homo sapiens
ggagggtgcaaggaggagagtgcaagaccctggtgcttcttggttatcaggaccagagagcagcaaggacgcagcagtgggtgcgaagaggtctccacctstctgtccccttcactgcacagaacaaacaacaaaacaagaaacttctgtggagagacagtgctctcttccatggctaatgggagtgaggtccagcctcta

SEQ ID NO: 28993 - DNA, 201 bp, Homo sapiens
ggagagccccgtgcccgacccagctgagcaccatcggcggtctccttgggggtgcttgcaggagccatcggggaaggagtttcatagggtctgaacccagracttaaagggggggcgagaggctctgaactgtgcagcccctcccccgcatcacctagtggggcctgtggaccccactggacagctgcaaggctgagccac

SEQ ID NO: 28994 - DNA, 201 bp, Homo sapiens
gcaggtcccgcggggactccgaggcaccgggggaaatgaagcggtgcccaggcagctgcacgcctgagtccctgcctggtctgagcgccccggaaacagcytaggcttcacttgtcccctctcatttttagcaccaggctctgttctctgcctttatgtgtggcgtctcctgcggtcaccagggtgccttctgctctgagg

SEQ ID NO: 28995 - DNA, 201 bp, Homo sapiens
tttctctgcacttgtccccacgccctccccacccgtgtccagtgtccctctaagctgaactcagtctgtccagaaggctcaggttggctgggttcctagcyttctgtaaggaaaatttaatttggacggttgccaaggggccttaaaaggctggatgttgttcctgctgttgtgagatgggcctggacgaaccagcagcca

SEQ ID NO: 28996 - DNA, 201 bp, Homo sapiens
aggagagccccgtgcccgacccagctgagcaccatcggcggtctccttgggggtgcttgcaggagccatcggggaaggagtttcatagggtctgaacccargacttaaagggggggcgagaggctctgaactgtgcagcccctcccccgcatcacctagtggggcctgtggaccccactggacagctgcaaggctgagcca

SEQ ID NO: 28997 - DNA, 201 bp, Homo sapiens
caggtcccgcggggactccgaggcaccgggggaaatgaagcggtgcccaggcagctgcacgcctgagtccctgcctggtctgagcgccccggaaacagctkaggcttcacttgtcccctctcatttttagcaccaggctctgttctctgcctttatgtgtggcgtctcctgcggtcaccagggtgccttctgctctgaggc

SEQ ID NO: 28998 - DNA, 201 bp, Homo sapiens
ctgccgccacgcagatcccgcaccttctggagcttccatggacgagtgcacgttctccagtgagtgttttctctgcacttgtccccacgccctccccaccygtgtccagtgtccctctaagctgaactcagtctgtccagaaggctcaggttggctgggttcctagccttctgtaaggaaaatttaatttggacggttgcc

SEQ ID NO: 28999 - DNA, 201 bp, Homo sapiens
accctccagcccaccaggctggggctgcccaggagagccccgtgcccgacccagctgagcaccatcggcggtctccttgggggtgcttgcaggagccatcrgggaaggagtttcatagggtctgaacccaggacttaaagggggggcgagaggctctgaactgtgcagcccctcccccgcatcacctagtggggcctgtgg

SEQ ID NO: 29000 - DNA, 201 bp, Homo sapiens
ctgagtccctgcctggtctgagcgccccggaaacagcttaggcttcacttgtcccctctcatttttagcaccaggctctgttctctgcctttatgtgtggygtctcctgcggtcaccagggtgccttctgctctgaggctgctgccatcctatcttgtaggaggcgaaggcagggctcagagctaagagaaggcgctgcct

SEQ ID NO: 29001 - DNA, 201 bp, Homo sapiens
tagtttcagcagctcttggtggaaaaccagttgggggacagtgagctcaccggcccatgactaaaagccaagtgcagccgcctggctgcatgatcagaggycgcgggctgccgggagagggtctgcgtcccctctccttggaaggcggttggttgccccctgtggcagctgccgccacgcagatcccgcaccttctggagc

SEQ ID NO: 29002 - DNA, 201 bp, Homo sapiens
ctgccaggcccagcctctgcaggtgcagactggtgagtccgatgggctccggttcctccaggctgtgcacacctgagcacagtccccactcccatgccccycttcctcctacgtacgtgccccatgacatcccacatgcatgcacggccacgcctactcacaccccctccacgtggcgagtgcccactcatctccagcggg

SEQ ID NO: 29003 - DNA, 201 bp, Homo sapiens
ggagggccacagcctggccattcactaacgctgctggggccagggccactgaagcccaccctggaggtctttctagggaccaccaccctgtgaatttgagycctcaggcttgggagggtatgtggggaatctggcccttgccgctgccttccagagacttgcgggtgctgggttagggttgggggctctggggatcacgct

SEQ ID NO: 29004 - DNA, 201 bp, Homo sapiens
tttggaagatggataaactggcaaacaaatccatggatgggacagtttcatatcctggtgagtgctaggaagagcagaaaacagatggtggcaggggaggyctcttaaggaggggccaggtcacctggggcttggatgataagcagctgtcgtccctggaaggtttccagcaaaggacagatgtcagagctttcccggagc

SEQ ID NO: 29005 - DNA, 201 bp, Homo sapiens
gggtgttgtagaggagcctgagaggtgtgggtgggccctggactgcccctcttgcctctgtgctatcagggaccatttcatctgcagaagacctggtgggygggactggccagactggctgtgggctccttgggtctccatcctcacacctgcctcctctgcctcaccccggtccccttttcctcctgcctgggccctggc

SEQ ID NO: 29006 - DNA, 201 bp, Homo sapiens
cattcactaacgctgctggggccagggccactgaagcccaccctggaggtctttctagggaccaccaccctgtgaatttgagccctcaggcttgggagggyatgtggggaatctggcccttgccgctgccttccagagacttgcgggtgctgggttagggttgggggctctggggatcacgctctgagatgccccgtggaa

SEQ ID NO: 29007 - DNA, 201 bp, Homo sapiens
tccttccttagccgtttactgagcacctgttgcacaccaggccccgtttccatgctcctgggatacttccatgaagcaagacagacagaagtctcctttgsaagatggataaactggcaaacaaatccatggatgggacagtttcatatcctggtgagtgctaggaagagcagaaaacagatggtggcaggggaggcctct

SEQ ID NO: 29008 - DNA, 201 bp, Homo sapiens
acctgcaaggccctgggagcaggtccaggccagggcgggcggggagggcaccaggggttggctgccaggcctgcagggggttccaggtcctgagggtcgcwgaacccagccctgcagtgttaggtggccccatgatgcaggcctgggtgggtgggattccagcccagctccctgagcttgccaggccgttgggaggcgtca

SEQ ID NO: 29009 - DNA, 201 bp, Homo sapiens
ctggggccagggccactgaagcccaccctggaggtctttctagggaccaccaccctgtgaatttgagccctcaggcttgggagggtatgtggggaatctgrcccttgccgctgccttccagagacttgcgggtgctgggttagggttgggggctctggggatcacgctctgagatgccccgtggaagggtgcctgctgcag

SEQ ID NO: 29010 - DNA, 201 bp, Homo sapiens
tgggggcctgggagcagcttctgaaactgatgagcacctcgacccatgcaccaggcagagccggctccctgagggttcctgctagagtcctggccacccayggctcaatcccctgcagggagcacctggaggtcctgttcgctctaggcgggaggctgagtgacgctggaccgctgagcagcaggtcccgcggggactccg

SEQ ID NO: 29011 - DNA, 201 bp, Homo sapiens
ggcgttatttagagccaagctctgcagctgcaggcccctgccctggagggaagtgttggcatctggctgcaccctgtcctttgagccagaacgtccaggcygggtctgcctcactggtgactgcctgccatcagcagggctctggatagccagcacctccatggggagactgaggcccagggtgggggaggagcgccggac

SEQ ID NO: 29012 - DNA, 201 bp, Homo sapiens
acaaggagaattgcacctagggagggtgtgggaggccccagcgcatgcccctcacttgcatagaggccctggagtgctcggcggcccagaagagtgaggcyatgggctctaaccaggcttctgcagggcaggggcagagggattgggtgggttgtgaggggtgcatctcctggagggctgccgtcccacccaaaggcagca

SEQ ID NO: 29013 - DNA, 201 bp, Homo sapiens
aatgccagttccaaatggcagctcatgaacacggctgtccctgaccacccttcgcatcccaggatgagacgagttgatgagacaaggagaattgcacctasggagggtgtgggaggccccagcgcatgcccctcacttgcatagaggccctggagtgctcggcggcccagaagagtgaggctatgggctctaaccaggctt

SEQ ID NO: 29014 - DNA, 201 bp, Homo sapiens
tggaaggttatatccctggccccacaccctcccatgaccctctcctcctgtccccctccctgaaaaagaagcatccgaggcccagccccgagcccctgccrtctgggctctgcctgggcccctctggcccctgccgtgactcctcatccacagagtggtgtccgttcatctgtgtggaagggtcagggtgtggcaggggcc

SEQ ID NO: 29015 - DNA, 201 bp, Homo sapiens
aatgcattttatgtctcctgcctggcctggaaggttatatccctggccccacaccctcccatgaccctctcctcctgtccccctccctgaaaaagaagcayccgaggcccagccccgagcccctgccgtctgggctctgcctgggcccctctggcccctgccgtgactcctcatccacagagtggtgtccgttcatctgtg

SEQ ID NO: 29016 - DNA, 201 bp, Homo sapiens
tgcccctcctccaaagctgcacgtgcctgtgagctccacactttctgttctgctcaggggccgggaaggtgaatatctagataaggagaatctggtgccgrgaagaccccctggactgtaggatagctctcttgaggtcctggaatgcattttatgtctcctgcctggcctggaaggttatatccctggccccacaccctc

SEQ ID NO: 29017 - DNA, 201 bp, Homo sapiens
ggtgcccaggacatttcggcgctgcgttacgacagctcattgtgcctctgggctcggggctggagcagacgggcgcagcagccctgcggctgaaagccacygtcccctgcattggtggaggctgctggcatgccctcgtgtatcatcctgcctcttctctggggtctccccaccctcctccctggcctggccttctggaaa

SEQ ID NO: 29018 - DNA, 201 bp, Homo sapiens
gtgtgggggaactctggagccatttgcatcctgcctgcccctagcatccctgtgtggactccctgggcctcacaggttctcagctaagctgctggaccagmgaggcaggtcccactggtgtggttcatgagaagtgcgtggacagcaccatcctgtgctgggaggtgacagacaggtcaggagtctccaggcagagctgag

SEQ ID NO: 29019 - DNA, 201 bp, Homo sapiens
cgaggcccagccccgagcccctgccgtctgggctctgcctgggcccctctggcccctgccgtgactcctcatccacagagtggtgtccgttcatctgtgtrgaagggtcagggtgtggcaggggccaggcacgcaggtgctgccaagctgtctgaggtcagcacctcccccaccatcctgaccattctgagcctggcagga

SEQ ID NO: 29020 - DNA, 201 bp, Homo sapiens
ggcaggtgtgggggaactctggagccatttgcatcctgcctgcccctagcatccctgtgtggactccctgggcctcacaggttctcagctaagctgctggrccagcgaggcaggtcccactggtgtggttcatgagaagtgcgtggacagcaccatcctgtgctgggaggtgacagacaggtcaggagtctccaggcagag

SEQ ID NO: 29021 - DNA, 201 bp, Homo sapiens; identical to SEQ ID NO: 6025

SEQ ID NO: 29022 - DNA, 201 bp, Homo sapiens; identical to SEQ ID NO: 6026

SEQ ID NO: 29023 - DNA, 201 bp, Homo sapiens
tgtaagatcccttctccctgggtcctgagggagccacccgaggaagactgggcaggtgggtgtttctggggagcggcagtggaccccccgcctccccctgwggaagggccagcaccttccttagctggagctcttctctgtgtgcagaacaagcccagcaggtgatttcagctcctgctttccctcctcggggaaatccta

SEQ ID NO: 29024 - DNA, 201 bp, Homo sapiens
ttgtgagatgggcctggacgaaccagcagccagtactgtctcagcctcctgattgccccagccagatacttcctgccactgggactgcatgacaggccctsggggatgcacacaccagccagctggggcctgcccccctggggggctcagagtcaggtggtagagacattacaagatgagatagaataaaaaagaactaga

SEQ ID NO: 29025 - DNA, 201 bp, Homo sapiens
gagattcgtgcctccgaaagaactgtctgtgagattagtaatctgattcccatccagctggagccgggtcaggccgcttgtgtttcggaaccaagaccctygtagggtgcggagagcattattgctcagcaccagtacctgcaggctgtgaagcttgctgaaggtgtgatcagtgagcgaagagctggatatttggttgtg

SEQ ID NO: 29026 - DNA, 201 bp, Homo sapiens
aataaagtgattttcatctcaactttaactttttaccctcctttgcatttttcattctttgagtctctccactgttgaaaatgtagtaatattaaaagttygagagatcaagtttaaataagagaatctcatgtgcagttctgtgttctatgtataatttaaacttttcagagcaccatgatgaataaaaattatgtatac

SEQ ID NO: 29027 - DNA, 201 bp, Homo sapiens
aatggatctccatgcagatttctgcagtgccctctctgtgcagcttcttcttctcggttaccctgctccacaaatacagccccttcataatatcagaactmtcatttacactcttaactcagtgagacttcctattatgctttgtggcagaaaagtatttcaggcagaaaaccatggcaatcatgggatattgtgtgactt

SEQ ID NO: 29028 - DNA, 201 bp, Homo sapiens
atggatctccatgcagatttctgcagtgccctctctgtgcagcttcttcttctcggttaccctgctccacaaatacagccccttcataatatcagaactctcatttacactcttaactcagtgagacttcctattatgctttgtggcagaaaagtatttcaggcagaaaaccatggcaatcatgggatattgtgtgacttg

SEQ ID NO: 29029 - DNA, 201 bp, Homo sapiens
ttagccttacatgtaactctcattcaatacacagacaagccacttagtgaaatttctttagtgagaaagaagtagcattttgattcattaacttatttttracatttcgtatgataaaagcagatattgaatggtaatggtcatttatcccatcctatatatttcttgcaagatttaattcctatcattcagaaacaactc

SEQ ID NO: 29030 - DNA, 201 bp, Homo sapiens
catctacatgggcattcagatgataaataaataagctggatgggactccaacctggggatctaccttcacatctgtagtcttatacataaaagagcgattrctccccagagactcttctgtttattgctataacacagcttatacccacaagacacaaaaaaagtatttggaaagtgaaaaaagaaacggaatatgttact

SEQ ID NO: 29031 - DNA, 201 bp, Homo sapiens
tcattttaaacagttaagtttctaaaagtaaacctttcttttacacatagtcttaaatatctaagactcaatttaagaacactgcatattctgtggcattygaaaatggtttcctcgggagttgaaaccataaactctataccccattactgagtgtgccctatgttacagaatactctttattaaaggtgaaaaagcaat

SEQ ID NO: 29032 - DNA, 201 bp, Homo sapiens
tctccaagcagtaaaatgtattattattgtgtatttcagtcaaccaattaatgcctacatttgtatattacaatgtcagagaattagtaagctggatggakacttggtttggtaaatgctgtaggtttggttctcttggtgtgattttgacaaataaaaccaagtttttggtttttttttttaactggatttgtaggaaaa

SEQ ID NO: 29033 - DNA, 201 bp, Homo sapiens
catataattaagtcctaattattaatgtttatattaccttatgcctggtggcatatataccttccaaatttgtactttaactgtactggaaatacatccartttaacaattattggatgcctattacctacctaccatagtagggaacaaaatagattcagtctgtgacttcacaagagtttcatgtagtggaaagagtgt

SEQ ID NO: 29034 - DNA, 201 bp, Homo sapiens
ccagcaccatgcctaccccagtggattccagaaccaggccagtcctcatgtccccagacctctctctggcccccatggacccagcatccaggcccatgtcrctgccaaactagcccctgtagcctgtggcctcaggcctcaggctcattctaatatcagaccagccctcacagctccaggcctgctctgggccaccccagt

SEQ ID NO: 29035 - DNA, 201 bp, Homo sapiens
actagagttcatgtaagccctcctacatgaactcaggtacgaggctcattcatatggacccaatgtccaggccctccccagtagacccaggctccaggctygcccctacaaaaaaagacatcagattgacccctgtggacttaggcactaggcccatgaacccactgacctaggcagcaggccagcctgcctgaggactcc

SEQ ID NO: 29036 - DNA, 201 bp, Homo sapiens
ggttccctgtggaatcagatataaagaatgctttctatttgcatagcccttctaacctaaatatatcaaaatcaatcttgaaaataattttcctggtgacygtcatcctacacagaagccactgtttaagtttcaatatttatctgccagagtgcttagagctccaattttacaatatttagagtgtctcccctccccatc

SEQ ID NO: 29037 - DNA, 201 bp, Homo sapiens
tcccctccccatctctccccttcttcgtttctactattccaatctgaaagtgtagcgatcgctgtctcactcacttggatttgttctgcccttttcctgtrgtacaaaggacctgcatgaatcaatttaaattggtcagaagaaatagccagcagcctgcttatgttcaaatcctctgccctaatcaccagtatggaaaac

SEQ ID NO: 29038 - DNA, 201 bp, Homo sapiens
atcattactccaaaggtcatacaaattagtacatgaattctactcattagctaaaatcagataattctaaaatgcattgctctcaatggttaaatattttyttgaattttaaaacaaactaagtaaagcctacaattcaaaaatgactctgtatggtttcattaaaacttacattttgacactttctcagaaaaccaacac

SEQ ID NO: 29039 - DNA, 201 bp, Homo sapiens
ggcaacatctttaaggttggctgtttttctcttttgtaaattagcttcatagattatttttatagtgaacgcattaaaatagtattgaagtttaattttaytgaaaaacattgcattactcagaggatcatttggcattttttatccttcacaatcataagcccctagtgtaactagtaaacactagattgttggtggtgt

SEQ ID NO: 29040 - DNA, 201 bp, Homo sapiens
ataaattaccttgggcagtatggccattttcacgacattgattcttcctacccatgagcatggaatattcttccatttctttgtatcctcttttattttaytgagcagtggtttgtagttctccttgaagaggtccttcacatcccttgtaagttggattcctaggtattttattctctgaagcatttgtgaatgggagtt

SEQ ID NO: 29041 - DNA, 201 bp, Homo sapiens
atcatttgctttatgtataccttttacttgtacttctcttactagagaataatcttgaagttgactaatcctgtagtcatgtacttatttgctccacaagkcataattcatctttaatatatttatcaggcctacatgcgaatccttcttaacatgttttagctcaattcttttttatttttaattatactttaagtttta

SEQ ID NO: 29042 - DNA, 201 bp, Homo sapiens
cacctagcatctgcaaaaggattcttgaatattgcaaaactcttgatggaagaaggcagcaaagcagatggtaagattatatatttaaaagacctttgctrtcatttgctttatgtataccttttacttgtacttctcttactagagaataatcttgaagttgactaatcctgtagtcatgtacttatttgctccacaagt

SEQ ID NO: 29043 - DNA, 201 bp, Homo sapiens
gatgacttatttaatcctcacaacaactccaagaggtagaaatattattattccaactttagcaatgaagaagctgaagtatcaaaactataaacaatttkttcaaagcaatatagctgataagtagaagactgatttccaaacccttgctcttgtctattgtactcaataggaactcagttccccacatcacacccagct

SEQ ID NO: 29044 - DNA, 201 bp, Homo sapiens
tcaatttttctaagatataataatatattttcttttttgtctttgcaaattggtcgaagacaaaactaaatacatcacaatgactgaggcaaaaacagacrtgtatacgcataaattctatgtctgattccatatttgtcctggcttgttccttcagttggtatttacatcttctttgatgggaataatgtttcagccact

SEQ ID NO: 29045 - DNA, 201 bp, Homo sapiens
gctcagtactgaggttataggattaagtaagatggcaaaggtctctgctttcatgaagcatacagattacaagtgggtaggaggggtagggcaggaggagmcagataataatataaataagcaaggatattttagatatggtaagtgctgtaaaatgtatagatgtgagagtaagttattaggaatagagagactaatttt

SEQ ID NO: 29046 - DNA, 201 bp, Homo sapiens
gaataggtatcattattcgtttcattttacagattgggaaactgagttccagaaaggttaaataacttaatgtaggtcacacagctagtaagtggtgtagrttatattctatcctaagttgactgacttcatagtctgtgatcttaaccatagttccaacctgctttctgttacagatgagtatgctacagatgccttctg

SEQ ID NO: 29047 - DNA, 201 bp, Homo sapiens
atgctacagatgccttctgcttatttagggttaatgctttcatatattaagaatcccccaagactcaatttcataaagatattttaaattattatcttaargtttgatggtttgccttcagtatttaagtgctttacctacctaatattgattccagtctatggtacaaagcatgggtttaacttaattttttgacatgtt

SEQ ID NO: 29048 - DNA, 201 bp, Homo sapiens
attttccttattaataatatacaatactaattctgtcatatatcaagtgtccatttaattgcaaatctgtttctagatctctgttctgttcatttatctayttatctagtcatgcaacatcctatataaagttgttcagaatagtctcttaataattttaattttctaccaatagtggcatattcttttttattcctgata

SEQ ID NO: 29049 - DNA, 201 bp, Homo sapiens
tttttttctaacagcattttaggctacacatttgtaagttctgtttttggcacatttaagttgtaatatattttgttactgttcagtttaaaacatttttmcttctactagaaattctttttggacccataaattatttagaagtaggtttccaactttacaaacttagtgtttttaaattaccttgatattgatttttaa

SEQ ID NO: 29050 - DNA, 201 bp, Homo sapiens
ataaattatttagaagtaggtttccaactttacaaacttagtgtttttaaattaccttgatattgatttttaagttagttgtactgtaagcaaagaacttygtcattagttttccagtatttgaaatgcattgagtgctgctgtaagggccaatatttagtcaattttgtgaatgttccctttattcttgaagtgaatatg

SEQ ID NO: 29051 - DNA, 201 bp, Homo sapiens
ttggctttatcaattttgtgttaaaaatttttcaccatgattgtagatcttgctgtttattgttgtagttctataaggttttgcctaatatattttgatgytatgtgttattgatataaaatttaacatggtttatagtttcccagggtgaattaatgaatacattacaatagattgaacttctctatctctagcaatggt

SEQ ID NO: 29052 - DNA, 201 bp, Homo sapiens
gattattttctaagtatgtatagacatttttatcacattaagaattttttccttctattgtttgctaagaatttagtccacaattactattaacattaaawtgttatcaaatattttctcatctattgagatcattatgtaattttcttctattatttcattaatatgctaatttacattggttttgaatgccaaattaat

SEQ ID NO: 29053 - DNA, 201 bp, Homo sapiens
ttattttctaagtatgtatagacatttttatcacattaagaattttttccttctattgtttgctaagaatttagtccacaattactattaacattaaaatkttatcaaatattttctcatctattgagatcattatgtaattttcttctattatttcattaatatgctaatttacattggttttgaatgccaaattaattt

SEQ ID NO: 29054 - DNA, 201 bp, Homo sapiens
cttttgatccttttatgttcaaactttttgcatctttatatttaattgtgtctcttgtaagaaatattcgtattttaaaatttgagactaataatattccrtctgtttatttaatatttaatttattggatatatttgaattcaagtatattgttttattacttgattttgttgctccacctattgtttttgttcattttc

SEQ ID NO: 29055 - DNA, 201 bp, Homo sapiens
tcctgaaagatgggtagagtttggaagagcatcctataggcttagggaagacataataaaatgcatagagattagaaagttaaaggtatatataggaactrtagtttcattttagtatacaaagtgtataaatgtatgtaatgtgtataatgtaagaagtggacaactggaaaaaggtatagaaaaatagaaaaagagcac

SEQ ID NO: 29056 - DNA, 201 bp, Homo sapiens
ttataaacatgaggaaactaagtcaccctattgaatgtgagaatattcaaggtgaaggaaacagcataaataaattcacagaggcaagaagcatcatggtrtatgtagaaaaatactagcagttttatgtggctggaccttgaagtttaacataacagggtttggagaggatgctgaagagacaggcagtggctcttttat

SEQ ID NO: 29057 - DNA, 201 bp, Homo sapiens
tttaagtcattgtatcagaatctcgctttctaagggttttctttcaacataaacataatttttagggttttatttaaatataactaagatatatgttattrctgacactgatgggaaactccctgaatggaattacagaattatcattttgatgttagaagatcgaagcaaataaatgatttactagaggacaaagtgaaa

SEQ ID NO: 29058 - DNA, 201 bp, Homo sapiens
atttaaatttaaatgccagttttgttgtttgctatctggctagccttgggtggggatgaggtgcttactttatcaaactctacatttctttctctctaacrtaatcataataacaggattgacttgttatgttgttttgggggaaatgtaactaaagagcctagaaccatgactgatactgatctacgaggttctatctcc

SEQ ID NO: 29059 - DNA, 201 bp, Homo sapiens
acttgcttttccatgctatttctcctgtggttgactagaataaaactatctgtcagaggaaccttggaaacattttagtaaagacagcagtgacttctaartgactatgtggaggagagccaacatgccaacctatttaccaagtgcctattggtaaatgtgcaagaaatgaacttccatagcataccttgtttcactgca

SEQ ID NO: 29060 - DNA, 201 bp, Homo sapiens
atcagtccagtctgtcggcatcatatttctaaaagcctgtactcatttcatgtccctgtgtcacattttgataattcccacaatatttcaaactttgtcartattatatctgtgatggtgatgtgttgcaattgttttggggagccataaacagtgcccagacaaaacggtgaacttaatacaaattttatgtattcagac

SEQ ID NO: 29061 - DNA, 201 bp, Homo sapiens
tgggatcacatgcatgagccactgaacccagctgacaataaaatattttaaatcaaggtattacattgtgttttgagaaataatactgttcatacttaatrtaatacagaataatgtaagcataactattttgtgcactgggaaactaaaaaatgtgtgtgacttattttattgcaaaattaattttattgctgtgttctg

SEQ ID NO: 29062 - DNA, 201 bp, Homo sapiens
ggactttgagtaagaaaaagaggcatagggagaggagttacaagtaggaaagggatgtagagaaggtggggaccatattcatgtattgtgttttggtcaawttgacaattttgatgttgattatcaggcaggctgcaagtagtgaggggttctctaagagccaggttgaagtgaccgcactgtagaagcctacttcaggac

SEQ ID NO: 29063 - DNA, 201 bp, Homo sapiens
gagctcagaaactagaaaacccttgaagcttttccaagctgtaaggagggagctgtgctcttatacttgcaaagcaactagtcgttggtctctttctgccmagtggaaggggcacatgactttgagcaaggcagccgtcttcagccaaggcaaatccccagagtgaggctgacagctaagggctgtgctgtctgctcttgg

SEQ ID NO: 29064 - DNA, 201 bp, Homo sapiens
ttatttccttaagtgtaatatggttcaattatagttactgataactaacaactcattggaatatgtgttaatttgtatacggaagataaggcagcatgttwtgtgaaagtctttgaaaaactatctgaactcaaattatttttttctgaagatctttataggaaacaagaaatttcttacaaaaatattattttagttcct

SEQ ID NO: 29065 - DNA, 201 bp, Homo sapiens
atatttttctatgtaaatatattatccaatatcgaatgggttcttcattactacaattcaatatgattgcattttaaatataaacatctgcattttaaacwcacaatcagtaatttaaattaagtattgtagaatctagaataaaaaacagttttgattacttgtatgttatgatctgtgtctacattttgcaaaacacaa

SEQ ID NO: 29066 - DNA, 201 bp, Homo sapiens
tacaattgagactgtagagcaactagctgcaacactatgacaggaacaaagtcttacatatcaatattaactttgaacataaaggcctaattgcttctctyaaaagacatagagttgcaaattggataaaaatcgagacccaactttatgctatattcaagagacccatcttgcatgtgatgggtttactttgacccctta

SEQ ID NO: 29067 - DNA, 201 bp, Homo sapiens
gcagatcaaggaaaaagaactgacagaactaaggaatatatttgggtaaagttgtaagagtcattatttctttgtataagtgtcttcagtattcaccttawtttttaaagtatctgtatattttttaaacccgtagaacctcagacataagcagtcatgttctaagccttaggatgtcagattatctctctttgaccactc

SEQ ID NO: 29068 - DNA, 201 bp, Homo sapiens
atttatagctgtgttatgtaatgcactcatggcaaagaactccctctattttacttagaaaacaagtgtaaagcaatgaccaaatgacacatctttaaaayaaaattttagatatagtaaacatataaatatcacataattggcaaatgaaatcacccatgtataatatagtttatatgaaattcgtcaatggatgtaaca

SEQ ID NO: 29069 - DNA, 201 bp, Homo sapiens
gagacatttttggagagaaagaccaatagcctgatgctgatgacattaaagaagctacagaatgtgatgataaggaagctgaggagaggattatccagtcyagaatgatgtttctgcaagaactaggggcctcttatgttaatggagatggagactgtagtacttgctaaaattttcgattccatgactccaccctttatc

SEQ ID NO: 29070 - DNA, 201 bp, Homo sapiens
caaagtattatccatggaatgttaagcaaatcaaagcaataaagaatccttctttatatttaaacatagctacaaaaaaggtaggaaggtagcaacacagwttagataaaagagccctgcttattgagtaaggagatttggatggctctttgtcataacagtggggagctgggctctgatttgtcttcctcacatctaatt

SEQ ID NO: 29071 - DNA, 201 bp, Homo sapiens
gggcctaataaatagcagggggaaaaaattaatacatggagaactggttaaaaacgttttagaaagcctcctgcttccagcagaggtaaccacagttcatrtaaatggccatcagaaaggaaacactatagatgctgtaggaaacaggtgtggggataaagctgctaagcaagcctccctggaggaagaagttaaactgtt

SEQ ID NO: 29072 - DNA, 201 bp, Homo sapiens
ggatcatttgggttaaggttttagcatctttaagtagtcaattacagttggaaaattaaaaattaaatgttattaggaaattatgtttttagttaaatatrtatatgcacatgtatacacatccatgtgtgtggtttttaccttaaaaaataaaatgacaatttctctttgcagagaaggcagatattctcctcctaagag

SEQ ID NO: 29073 - DNA, 201 bp, Homo sapiens
acttagacaagtgacttaatttaggcaaagaaacaccagcaaacacgacacaagcagaggcttgatatatactcattcataggaatttgccctctggaatrctgctattaccatgtgagaagcccaagctgggagtaaggaggaggacgtggctgcagccagagtaggaggttgctaaagatttgggagttttaagatacc

SEQ ID NO: 29074 - DNA, 201 bp, Homo sapiens
ataattttgtactgttttttcatcacattcaatccttgtttttctttttgagatggagtctcactctgtctcccaggctggagtgtagtggcgtgatctcrgttcactggaacctccccctccagggttccagcaattctcgtccctcagcctcctgagtagctggatttacaggcatatgccaccatgcctggctaattc

SEQ ID NO: 29075 - DNA, 201 bp, Homo sapiens
aaggtcaatttttacgtttttcattttgaaagcatccttttaaatctttataaagaaatcagtataaaataaatataaatagcagatgcgtaagtgtagaytgggataaataaatcgtataaaccccaaataaaataatgcagaaagaacataagtgggtttattgaaggagtattagaatataactatttgtatgcagaa

SEQ ID NO: 29076 - DNA, 201 bp, Homo sapiens
ttcactggaacctccccctccagggttccagcaattctcgtccctcagcctcctgagtagctggatttacaggcatatgccaccatgcctggctaattctygtatttttattagagatgggtttcaccatgctagccaggctggcgtcgaactcctgacctcaagtgacctgtttgcctcggcctcccaaagtgctgaaat

SEQ ID NO: 29077 - DNA, 201 bp, Homo sapiens
tcaggtaagaaaatataggtaactcagtgaaagatagtcattgtgggtagaaaagaatacaaaacaggtgttattagtgatgtcaggttaacaatgccacsttcatgaattgattattggtaattaattcagtcatctatgtgtttattctttcattcacagagtagtcatttatttaaacatttatgaaaagtttcccat

SEQ ID NO: 29078 - DNA, 201 bp, Homo sapiens
aataatgttccaagtgtctttcagagagaatagaaaacaatgtgccaagttagaacaatacatagatttcagtaaaatcagttgcaatcagttcttttaayggtgtgattgcagatgatttaacgttgatatatttatcattgcatttagaatgctttaagatacatatcatgcattggatttcacaacgagtacatcatt

SEQ ID NO: 29079 - DNA, 201 bp, Homo sapiens
taacggagctattgtgtttattagtgttgcatttgtggcatctgaattaatcacggatttaaaatcctatgaaatttttacttgaaaatattctgtccatrtataacaatctatgctggttagtttacaattttgattaataacaaatcattctgcattttctctaaaatttataccttgacattgtgatgtaagagtcta

SEQ ID NO: 29080 - DNA, 201 bp, Homo sapiens
aacctttattacatccagttatacttgggattgtgattctgctcatgaactggtgtcaagcaacggatggaaaatttttgagtagtgttgatgccttttamattgttgtgcttctcttgctattcagcaatgcccattttgatgtacctgtatattagcatatataaattgaacttagtttaaaaatattaattgcttgtt

SEQ ID NO: 29081 - DNA, 201 bp, Homo sapiens
catatcaaaagacaaaatttctatgtttctttaaaacactgccctttgacagtgagaatactcaaggaactgaaaataacaaaaaaaaaaaaaaaaaaaaagagagagacagagagaaatacaaatgtaactggataaccgaatataactgttcattgaatactccattttcactcttcctcactttgtctttctagactc

SEQ ID NO: 29082 - DNA, 201 bp, Homo sapiens
ccacgcctgactaattttttgtatatttagtagagacggggtttcaccatgttagccaggatggtctcgatctcctgacctcgtgatcctcctgcctcggmctcctgaagtcctgggattacaggtgtgagccaccatgcccagcctatttgcccattcttatcaatggtatacatgaagctcagtcaggtgaggtagcat

SEQ ID NO: 29083 - DNA, 201 bp, Homo sapiens
atattgagtatatataatatatatctcagtagtagttttttaatatatatatatcagtggtattattatatattactattatattaatagtattattatatgtcaaatatgtctttttatatatcagtactattattaaatataatcatatatttatataaatatatattctatacatttaataatattaaacacatattt

SEQ ID NO: 29084 - DNA, 201 bp, Homo sapiens
gaacaaagccagaggcatcacatgacccaactccaaactatactacaagcctacagtaactaaaatagtttggtactggtacaaagataggcatatagatkaacagaacacaatagaaaacctagaaataaagaataaaaccatacacttacaattaagcttttttctttaaatgcaagttgtcaggtgggtattcctctt

SEQ ID NO: 29085 - DNA, 201 bp, Homo sapiens
tatattgagtatatataatatatatctcagtagtagttttttaatatatatatatcagtggtattattatatattactattatattaatagtattattatatgtcaaatatgtctttttatatatcagtactattattaaatataatcatatatttatataaatatatattctatacatttaataatattaaacacatatt

SEQ ID NO: 29086 - DNA, 201 bp, Homo sapiens
ggtatcttctactgagattatttatgactgatcttgcctttgcaggctgactggaagatgacaatgagatcttgtatatttttaatcaaaataaacacaargccgagaggaatttaaattatttaatgaggagagattaaaacaggaggctgacttctgattattctggactattttctaattggcaaaactgtccaagtt

SEQ ID NO: 29087 - DNA, 201 bp, Homo sapiens
aagaattcaagtgcagcgcaggtgggctggcagtgctgggggacccggtgcaccctctgcagcttctggcccaggtgctaagcctctcactgcccagggcyggtggcaccagcctgcggcgcagagtgtaggacccactaagcccacgcccacccagaactcacgctggcctgcgagcactgtgcacagccccagttcctg

SEQ ID NO: 29088 - DNA, 201 bp, Homo sapiens
ttatatattgagtatatataatatatatctcagtagtagttttttaatatatatatatcagtggtattattatatattactattatattaatagtattattatatgtcaaatatgtctttttatatatcagtactattattaaatataatcatatatttatataaatatatattctatacatttaataatattaaacacat

SEQ ID NO: 29089 - DNA, 201 bp, Homo sapiens
atgaagcttgtaggcaggcggaatgtgctattaagaagacgtttgaattttctttgccatgggcattgtttctatttttaaaaagtgttctaacaatctayctgtgttggcaagagaaaaagggaaaattaatgataagttcttattgaaacattagaaacacattacagcttcataaaaactttttatctaccagttcat

SEQ ID NO: 29090 - DNA, 201 bp, Homo sapiens
ttctgaaaggcaggaggtgaaagtagaagagctccaaggaacaggaaggtagtgaatgatagtcatggcactgtatgaaaccatgaattctgaacctcacygtctgggagattttttctgtattagttcattttgcaaagatttagcatgacattggcacacaaatgggttctgaatcatttagtcctacaatatttagag

SEQ ID NO: 29091 - DNA, 201 bp, Homo sapiens
gtacatgtgcacattgtgcaggttagttacatatgtatacatgtgccatgctggtgcgctgcacccactaactcgtcatctagcattaggtatatctcccratgctatccctcccccctccccccaccccacaacagtccccagagtgtgatattccccttcctgtgtccatgtgatctcattgttcaattcccacctatg

SEQ ID NO: 29092 - DNA, 201 bp, Homo sapiens
ttctaacaatctacctgtgttggcaagagaaaaagggaaaattaatgataagttcttattgaaacattagaaacacattacagcttcataaaaactttttrtctaccagttcatagtgtaagtgtcaagatattagtgtttgatgccaaataaccatttattagttttaaatttacaaatatagctatttatgttctttgg

SEQ ID NO: 29093 - DNA, 201 bp, Homo sapiens
caatgggatggggcactgtggagcagggggcagcacgctttgggtaagctcggccatgcaagagcccatggcagggggtcggggggaagctcaggcatggmgggctgcaggtcctgagccctgccgcacggggaggcagctatggcctgctgagaaatggagcacagcgccagtgggccggcactgctgggggacccggag

SEQ ID NO: 29094 - DNA, 201 bp, Homo sapiens
aacattgaaagcctgttttctcagccagggactttaaaataagagctccacataagagaatgatgggggaaaaatgtatacatctaatgaagcaaatagcrcagcaagatgatggttaactgaacaacacagaaaatctgcctttcttttcttacaaatatctctttggtgggctcccttgacaggcattcttttgttctc

SEQ ID NO: 29095 - DNA, 201 bp, Homo sapiens
ggacaatttcaagacagcaacagcagaacattaagtcatgcaggaagtcaccctaagtacagcatcctttgcaactgcttgggttgcacaacttgatgtcmtaaacacatttataaatattcctgaaaatgttcttaatagagaagtgatcaaaatcataataaaatgaaatgctgatagtgaaaaaatatatatgtaatt

SEQ ID NO: 29096 - DNA, 201 bp, Homo sapiens
ctcctgcctcagccttctgagtagctgggactacaggcgcctgccaccacgcccagctaattttttttttttttgtatttttagtagagacagggtttcaycatgatagccggaattgtctcgatctcctgacctcgtgatctgcccacctcggactcccaaactgctgggattacaggcgtaaaccactgtgcccagcct

SEQ ID NO: 29097 - DNA, 201 bp, Homo sapiens
ccctaagtacagcatcctttgcaactgcttgggttgcacaacttgatgtcataaacacatttataaatattcctgaaaatgttcttaatagagaagtgatyaaaatcataataaaatgaaatgctgatagtgaaaaaatatatatgtaattgtctttgtttcctctaatttgattacaatttgggtagaaacatgtttgta

SEQ ID NO: 29098 - DNA, 201 bp, Homo sapiens
aagtacagcatcctttgcaactgcttgggttgcacaacttgatgtcataaacacatttataaatattcctgaaaatgttcttaatagagaagtgatcaaartcataataaaatgaaatgctgatagtgaaaaaatatatatgtaattgtctttgtttcctctaatttgattacaatttgggtagaaacatgtttgtagtta

SEQ ID NO: 29099 - DNA, 201 bp, Homo sapiens
agtaacagatccttttgagggggaaaatgcactccaagtgtcacatcctcacatttttttaatagacataatatcttttcttcaaacctttacagatgtawcttcataaacacaaaacatagggcatcctttgaaacatttgctttgaccagaagtcttcccttttgtggtaaggtttcaagatgaagcatttctttaact

SEQ ID NO: 29100 - DNA, 201 bp, Homo sapiens
agtaatgtgaatttgtcacataatgaaagagagcttataccagcaattttacaagtaaaagtgtctttagaagagaaaaagtgaccagaaacagtgaagawtccattattagtctagtttaaatactatttccaagactgatatttaaacacattatgtattttcagcccagtgaagaaccattagaggatgaataatata

SEQ ID NO: 29101 - DNA, 201 bp, Homo sapiens
  misc_feature (1)...(201): n = A,T,C or G, or insertion/deletion polymorphism (see Tables 1-2)
tttaagaaacaaagaaaaatgtatgttctgaatagatgcaaacaaactatttgggcacatttaaaaaagggaaattttgtgcttctgactcccaatacatntctagaatgcagatgagtgctttttatcatcagttttacaacataattggccagtccagtaacagatccttttgagggggaaaatgcactccaagtgtca

SEQ ID NO: 29102 - DNA, 201 bp, Homo sapiens
tcactgattcttttacacaattattaaacaaatatttaccaagcaactaataggttccaagatctgtgttcaatgttggtaatttaatggtgaataaaatygcatataattcctagcctcaccaagcttatggtctagtgaaaaagactggcaatcaaataatcaacaagaaacataaaactgccactaggataaaagctg

SEQ ID NO: 29103 - DNA, 201 bp, Homo sapiens
ggttttgaacctattatttgtgactactttaaatgtccaatctgctgttttcaacatctagattagctcagtatttgtttctatttcatgttgactacagrgcacatttttctgtttcttcatatatcaattaattttttattgaaagctagaaattatgtattatgtgttataggaaatctttatcatgtcatcttcctt

SEQ ID NO: 29104 - DNA, 201 bp, Homo sapiens
attttgttccattttgtagattttatttgccagtagagaaagtctatataagttgttctgtcatgcccatatctacttttgcattgcttccaaaatgatcwgaatgaaacaaaaatctatgatatcattgctcactttaacacttactattgtcatccattgcctatataatgacattcaaactcctaaatatgagactca

SEQ ID NO: 29105 - DNA, 201 bp, Homo sapiens
ttgtgtattttcttcacaggactcttttaaagatacctgccaatttcgtctattcagttgaagtgtctattcagttaaaatttgatattaaaatttataawcccacttactttggctcacataagctacagcacatccccaataactaaaagctaagaaaaaaaaaagagtgagaggcagctctcagtcctttcccatgta

SEQ ID NO: 29106 - DNA, 201 bp, Homo sapiens
gtgtgattatgtgtgagtgcctgtatgtgtttgtgtacatagaaaaaagtacaactctttttttaaaaaaaaaaaaaactccttcctctcatgatattccraatactttgtcaacattttattaagtccgttgcttctaagccccacattaagtgtgtgtgggtagggagaggaaaaacaagagatgaattttcacaatta

SEQ ID NO: 29107 - DNA, 201 bp, Homo sapiens
gagtagtgttgatgccttttacattgttgtgcttctcttgctattcagcaatgcccattttgatgtacctgtatattagcatatataaattgaacttagtytaaaaatattaattgcttgttttagggcaaatgctatgttggtacaaaggatctacgttgaaaaatatatctgttctgtcatcattgaacttgaaagctt

SEQ ID NO: 29108 - DNA, 201 bp, Homo sapiens
tacacacccattgacaaatatggtaagtaggcagattctttaggtttgttaagaaaactacccctaggaaggtgatgtctatttgacaaaaagggagaaarcattgcatattgtaatatccaaaatgacagatgctttaaaaatataaaagtataaaatttgattttatatgtcttttataactcatttacctttaaggtt

SEQ ID NO: 29109 - DNA, 201 bp, Homo sapiens
  misc_feature (1)...(201): n = A,T,C or G, or insertion/deletion polymorphism (see Tables 1-2)
tatttatattattactaagataataatgttcttgttttagttctttttagtaaggattacaagcacaaactggaaattatttatgttcttttcctattttncaggtaaataaactgaggctcagaaaggatggcatacccaaggttataccgctagaaattgtaacctatgcttaagagccaggactcacacttggatatg

SEQ ID NO: 29110 - DNA, 201 bp, Homo sapiens
cgatgcagaaataaaatagtggctataaaacggtaagcaagcaaatgaaaaaatttaacatccaggtggaattgtgacctttgagaagcatgtgcatggcmagccccttgtttggatccatctgtttactgaagattttctgttgctgccatttccagttatcgagccaatacctactgctccaagtcagatgtggatatg

SEQ ID NO: 29111 - DNA, 201 bp, Homo sapiens
tccagccaagagaagggaagtgagaatttgaataagacagaagtctcttgaggtttcaaaattttaactgtgatcttttaccttggttttaagatatttcmtttgacgtgatttattttctctttccctcagaatcaagatttctacagtctctggatgaagacaacatgacaaaacaacctggggtttgctgctgcttgt

SEQ ID NO: 29112 - DNA, 201 bp, Homo sapiens
tgcccgaatctgatccccagaaattatgattttattggcctaagactgatcttgagttcctgcatcttttaaaaattcccccacataattctaaaaagcarttagttgagactctccaactaaataagcttttgttgaatgtaattaaattgaatttaaccaacagcaaataatattaactctcttattctagccgcatag

SEQ ID NO: 29113 - DNA, 201 bp, Homo sapiens
taacagatggattgctacatgttataataagagtttttccaaggtgtctgtaccattatgaatttccaacagtagtcggtgagaatttcagttgtttcacrtccttgccagcactttgagttgtttatttttaaatatatatgtatatattaggcatttgagtgggggtacatggaacatcattgtgatatttacatttca

SEQ ID NO: 29114 - DNA, 201 bp, Homo sapiens
caatgcataatctgctataaaaatgtagactctttggaatgtggaagctcatgcagaagaattgcatatgagcaccataataagaataaagatattattgraaagctgtaactatgcatggtttcaaaataaggtggacatttcaaaagaattagcaaccaacactacacacaagattttggtaagagtgataaaagaata

SEQ ID NO: 29115 - DNA, 201 bp, Homo sapiens
aactgatcttcagctgatgggtctttttgacaagtttagagggtttgtctaaagtaggaattctttatacattcaacattagataaagtataaacatgatyacattttataaatagctgttttgaatcagcaaaactaaaaaattttgatttagccctttggggcccatttattctctagggcaaacaaatgatgtctatg

SEQ ID NO: 29116 - DNA, 201 bp, Homo sapiens
ttgcatctatacatgataagaacctaaatatattattagaatttttgtgttaaacatttatatcttttaaagaaattaataagagagaaaatatgcttttyggaagtttgattataataatcctacatatggttttctgtatttaaaactctttgagattcactgagtttttatatctgtaaatttatggtttcatcaaat

SEQ ID NO: 29117 - DNA, 201 bp, Homo sapiens
atactgctactgtctcttctattattgcccctgttatctttgccccaatttttaaatctttgccttccttgtttcatcaatgcggccacctgagctcccayggaaaggctcagttctgttttagaaccaatctgtacctaggcagacagtattcaaacagcctcagtcactttttaatccagtctttttcaatgaaattga

SEQ ID NO: 29118 - DNA, 201 bp, Homo sapiens
tagttttctcagggaggcccttccagaccatcctagctctgatactgtctaattgcttccctcttttattattttttttttaatttttatttatttatttwtttatttttgagacggagtctctctctgtcgcccaggctggagtgcagtggcacgatcttggctcactgcaagctccacctcctgggttcccgccattct

SEQ ID NO: 29119 - DNA, 201 bp, Homo sapiens
ccgatattctgtagagcccaagagagggaacctttaagaatattacctcagggaagctgacaggagaaagttcattgtttatatatatatatatatatatatgtatatatatggatttcaagttctaaagttggccatttaaaagacttattcacagtattccccatatatatataaatatatatatatttaacttttatt

SEQ ID NO: 29120 - DNA, 201 bp, Homo sapiens
accgatattctgtagagcccaagagagggaacctttaagaatattacctcagggaagctgacaggagaaagttcattgtttatatatatatatatatatatatgtatatatatggatttcaagttctaaagttggccatttaaaagacttattcacagtattccccatatatatataaatatatatatatttaacttttat

SEQ ID NO: 29121 - DNA, 201 bp, Homo sapiens
ctgccttgggacctttgacctgcttttctctacccggacttttcttctttctcagttactgaatgtcttactcccttaccttcatacagttctggttcaartgtagttttctcagggaggcccttccagaccatcctagctctgatactgtctaattgcttccctcttttattattttttttttaatttttatttatttat

SEQ ID NO: 29122 - DNA, 201 bp, Homo sapiens
cctctgataagactgaagtcttaaccgatattctgtagagcccaagagagggaacctttaagaatattacctcagggaagctgacaggagaaagttcattrtttatatatatatatatatatatatgtatatatatggatttcaagttctaaagttggccatttaaaagacttattcacagtattccccatatatatataa

SEQ ID NO: 29123 - DNA, 201 bp, Homo sapiens
gcactttgggaggccgaggtcaggagatcaagaccatcctggccaacatggtgaaacccagtctctactaaaaattcaaaaattagctggccttggtagcrcatgcctgtaatcccagctactcggaaggttgaggccggagaatcacttgaacctgggaggcagaggttgcagtgagccgagattgtgccactgcactcc

SEQ ID NO: 29124 - DNA, 201 bp, Homo sapiens
cttttatttttctccagcactgatcattatataacacagtctatcttttatttccttttctttactgcctgtcttctggctaagatataagctcaacaaasacacataactttgtttttgtttttcgtttcattattctcagttcctaacacagcatctgcctgccacataggcaacacaatatttgctgaaagtatatat

SEQ ID NO: 29125 - DNA, 201 bp, Homo sapiens
cacttgttaatttttgtttttgttccatttgcctttgaggtcttaatcataaattatttgcctaggtcaattccagaagagtttttaaccaggtcttctcrtagggcttttatagtttaaggtcttacacttgtctttaacccatcttgaattaagttttgtatgcagtgagaggtaaacgtccagttttattcttctgaa

SEQ ID NO: 29126 - DNA, 201 bp, Homo sapiens
tttatatataaatgtatataagcagattttctaattctttttgtaccctaatgaattttattacaagattcctgtcacatttatatccctctatagggcayacttctttaggtggtatctaaattgtattcctaaaatgaaacacaagactttggggaaaaaattgagacctctgatatagtttagaagatcttaattgag

SEQ ID NO: 29127 - DNA, 201 bp, Homo sapiens
tgagattgtctcaggtaagagtaatccagtccctgttactccatattggatgcatgaagaaatccctaaggagctattttaaaatgtagatttgtggtatygagagattctgattcagtaattctggaggggatatctgtaataaattctttttaaaagcctcagtgtgactcttaggttaccaggatatttaatcacttg

SEQ ID NO: 29128 - DNA, 201 bp, Homo sapiens
agaagctctttagtttgattaagtcccacttgttaatttttgtttttgttccatttgcctttgaggtcttaatcataaattatttgcctaggtcaattccmgaagagtttttaaccaggtcttctcgtagggcttttatagtttaaggtcttacacttgtctttaacccatcttgaattaagttttgtatgcagtgagagg

SEQ ID NO: 29129 - DNA, 201 bp, Homo sapiens
tcccaagtttgggttaggtattgcttcattgtactctcttagctcctagtacttactatgctgtgtatgctactgtatattattacttagttaaatctttmtatcttcctctatattagcggtcacaatctcacatattttaaggatgacataaataaatgaaagacagacaatgataaatgggaagtaaaactcaagact

SEQ ID NO: 29130 - DNA, 201 bp, Homo sapiens
gccccctactattaggtgccacctagctctactctgtcatagtactcaggttgagttctgagttcattgaataaaagtgtgaaaatatttgaaacttttgsaaaacttggctccaagagcaatggtttttgaccatagcatagcatagcagtttagtcatatgagctctggagcaagcctgcatagtgtgtttgtatacag

SEQ ID NO: 29131 - DNA, 201 bp, Homo sapiens
ttgactttttaataatagccattctgactggtgtcagatggcatctcatggtggctttaatttgcatttctctgatgattagtaatgttaggcattttttyatgtttcttggccacttgtatgtcttcttttaagaagtgtctcttcatgtgctttgcctactttttaatggggttattttcttgttggtggtgatttaag

SEQ ID NO: 29132 - DNA, 201 bp, Homo sapiens
agcagttattttcatactgattaatggatactttcactggggatgtctatgatgcacgaggcagctctagtccattaaattttaatgcctagaactaagtrcatttcatactgaagccctgaatagttccttgtcctaaaggaaaacttaataatattcttcaaagcctccaaaattacttttctaaaaaaacctttttct

SEQ ID NO: 29133 - DNA, 201 bp, Homo sapiens
tttcctagccatgtgttgggttatagaagtctgggtttgagtcccatctgcaattatatcttgttcatttctgtttctgaagccaaaactacttgggcgcrtgtgatattgtgcttctttttatttttattgtaggcttctattatttagccaccctgtatttaccttaacatggtttaatataaccaacggaatggttga

SEQ ID NO: 29134 - DNA, 201 bp, Homo sapiens
agaatgacccagacaatcctagaaaaggtaaaaacagaaaaaagatcaatagctatcacatcaaatagttacatggagagtaggaataactgaagaatttcaactttatagattagtcacaagtcccctaaaaaagacttgattgcagagaattgatccattgtgtcctgggagatatggcttctcagtgaccctaatgta

SEQ ID NO: 29135 - DNA, 201 bp, Homo sapiens
ttcatactgattaatggatactttcactggggatgtctatgatgcacgaggcagctctagtccattaaattttaatgcctagaactaagtacatttcataytgaagccctgaatagttccttgtcctaaaggaaaacttaataatattcttcaaagcctccaaaattacttttctaaaaaaacctttttctttataaaaac

SEQ ID NO: 29136 - DNA, 201 bp, Homo sapiens
atgctaaatttatataactgatgaaattattttatatacataagttagtgtgtgtctctaagttttatttccatgactttttagagcttccttttaatttmttttatgatattatcttgtggaatcatcttctgtgtaattttaagatccaatttaattttaacctgtgataataagagaaagatcacataaaaagacctc

SEQ ID NO: 29137 - DNA, 201 bp, Homo sapiens
gaggaaaccaggatgagggctctcaccagaacctatccatgcttggcatcttgtccagtgtgtgtgtgcgtgtgtgtgtgtgtgtgtgtgtgtgtgtgtgkataaatataatattttctttatccattcacctgtcaatggacatttcagttgtttccatatcttgactactgtgaataatgtgcaatgagcatgggggat

SEQ ID NO: 29138 - DNA, 201 bp, Homo sapiens
cagaagacctgatttcaaatcccagttcagcctcagtttaaagttacattaaagaaacacattttatgctatggaatgccaattgggttctctaaaaagcrttctctgaaaagaatgtaggagtacaagaggtttatttaaaggtgacacctgtgaaaggaaaaggaatgaaacagaattggttatgaggtgccatcagat

SEQ ID NO: 29139 - DNA, 201 bp, Homo sapiens
tagtcattacaaaaatattcaaccaatgttataactgaaaaactctgtaatcacatgacatagagaaatctcagctaacgtttgtaatggttgtcaaggartggagattatataaatatataaattaaaaatagaaaagcctatagaaattagagcatagagtcaaaaaagggcgtggtaactctaaagcaaatgttacca

SEQ ID NO: 29140 - DNA, 201 bp, Homo sapiens
atgaaacagaattggttatgaggtgccatcagatcccaatacagagctgctaaaatctccgccagcccattgaggagctccagaggaaaaattgcctatgraaggagtgccacacgggctagaaatgtcgaggcccttcttttaccaccaccttactcagtcattgactgggagtaaggtccaccctgagaagagactgaa

SEQ ID NO: 29141 - DNA, 201 bp, Homo sapiens
aattataagaatccactacaggctaaaaagcatccatgagaatgggcaattagggggcctttgatgtcattttccagagaaatatccctggagtggtgagktctaaagacagattgtagtgggctgaggagtgaataggaggtgaggaaaggtagaggaaagttggagatgactctttaaaaaattgtctacgaagtttag

SEQ ID NO: 29142 - DNA, 201 bp, Homo sapiens
ctggatgaagacaacatgacaaaacaacctggggtttgctgctgcttgtgtttcctataattataaaccaattaaaatatgtaaactcagcatgagaggaygtaagatgagagcagttttaattggaagaaatgtcattgtctcagtgttgggataatggcttatgtctttatttttagtaagctgtcaaaataactatct

SEQ ID NO: 29143 - DNA, 201 bp, Homo sapiens
gttattgaattatttattcattttctttgttttttacattttcttctctgaggtattctggttgtctgttgaggcataacaaactatcccaaacttggtcytctaatgcaactattttattattctcatggattcttagttcaaaaattcagacaggatgccgtgtggatggcttgattctgtcccacaatatttagagcc

SEQ ID NO: 29144 - DNA, 201 bp, Homo sapiens
gagtatatataatatatatctcagtagtagttttttaatatatatatatcagtggtattattatatattactattatattaatagtattattatatgtcaratatgtctttttatatatcagtactattattaaatataatcatatatttatataaatatatattctatacatttaataatattaaacacatatttaataa

SEQ ID NO: 29145 - DNA, 201 bp, Homo sapiens
acaacatgacaaaacaacctggggtttgctgctgcttgtgtttcctataattataaaccaattaaaatatgtaaactcagcatgagaggacgtaagatgaragcagttttaattggaagaaatgtcattgtctcagtgttgggataatggcttatgtctttatttttagtaagctgtcaaaataactatctcaaggctcta

SEQ ID NO: 29146 - DNA, 201 bp, Homo sapiens
acagaaaggaagctgtgtggtcttctatgtcctagccttagaaaagaaacactctgctccacgctattgatcacaatccacccaggttcaaggggaagggrcatagatagcaaatatctgtgggttgagtatagatgaatgctcaccatgttttaaaaccaccagaaggtatattttgtccataatcagaagaaagtacat

SEQ ID NO: 29147 - DNA, 201 bp, Homo sapiens
agttgcagttactaccattacaaaatatttttatccatttacatacattttgggagatctattctacctcaaattctatttctcaaggatatagctggagygcttttttgtctaagcctcattcttccacacatggattttcttctgcttaaaaataataaatatgacacacacaaatacattacaaagagcttatttatc

SEQ ID NO: 29148 - DNA, 201 bp, Homo sapiens
gatagagttctaaagaagttaggtatattaataagggaaattgtattttgaaaaatgtcttgagtgatattctattgccatatttattgttgattgagaamacattatgtcccatttaagccaatactttgtcttcttcttaagtattgctttcttctaaaaaacaacatctctactctatagcttaaggaagtgaggcca

SEQ ID NO: 29149 - DNA, 201 bp, Homo sapiens
aaatagaggtcctgatgaatcttctaaatccgggcatctgtgaaatgcttgctgaagtctggatgcacatgggtggaaacagctagttccattgatcaggktctggtttcttctgttttgtttgacctggcatgggtagcttccatctgtctgtcatcctagaacagcatctggagccagcctatgtggtatctcttgggc

SEQ ID NO: 29150 - DNA, 201 bp, Homo sapiens
agaaaacaaagtcttagattattgatttgtcaagtggagataagtgcacactatcgaattgagtaatacctaaaaagcataatggacacattagaatagataagaaaatagaattgttaggacatggtgacattttatgaaggagctgagaaagagggaggaatcaagaacagcccccagtttttatctgggtaactaaat

SEQ ID NO: 29151 - DNA, 201 bp, Homo sapiens
aaaagttatacgtatgaggcacaaggtgatgtgacatatgtatacattgtgaaatgattaccataatcaggctaattaacatatctatccacctcatatgrctacctttttgtgtgtgttgtgagaacatttaagatctactctgacactcttcttaatctaacttgaattcttggttgaagggggactttggtgaccttt

SEQ ID NO: 29152 - DNA, 201 bp, Homo sapiens
tcaagttccacagactcccaactaagccactagtttattcacaaaagttgccaggttttctggttatatggctctttctcactgtgtatattattgctctktagttagaagacaaagctagagttttggaggttatctttgtttttgttgttgttgttgtcttttagtctctaatatttaaactgctcccagataggctcc

SEQ ID NO: 29153 - DNA, 201 bp, Homo sapiens
catacttggtttttgtagtcatgtgcagttccacaatgccaaaacttgatataccttcattttaaacagttaagtttctaaaagtaaacctttcttttacwcatagtcttaaatatctaagactcaatttaagaacactgcatattctgtggcattcgaaaatggtttcctcgggagttgaaaccataaactctatacccc

SEQ ID NO: 29154 - DNA, 201 bp, Homo sapiens
tttttaatatatatatatcagtggtattattatatattactattatattaatagtattattatatgtcaaatatgtctttttatatatcagtactattatwaaatataatcatatatttatataaatatatattctatacatttaataatattaaacacatatttaataataatattaagatgtatatttatgtcagttat

SEQ ID NO: 29155 - DNA, 201 bp, Homo sapiens
caaagagaaaaagtgacccataattctggagtcacatctcctggtttcattctcattctggatcatagccccttaattcttcactgtatttagctgttttygaaccttcaaaaaatattttatacagttcctctcagaagtagttttcatctgttattatcaatagtaaaaatctcacggtacatcctctttaagtgattt

SEQ ID NO: 29156 - DNA, 201 bp, Homo sapiens
agcttaggtatctcagtgtgattgatcaaagaatatagatatgagtctaaaaaaaccatgaggctgaagtatgtgccaaaatacgcagggtggtttaaacyaagcaaatgagttttggaactatgaggagtcattaattttaagcaggtaaataatatgaccctctttacatttttagaattgaaaagtggtaaataaact

SEQ ID NO: 29157 - DNA, 201 bp, Homo sapiens
tgaggcattcaaaatatctcgctgtgttaccataccgcagttgcttaacctttctttgattacatttcttcatatggtttaactgtttagtcacacatcayatattctccttacacattctcataagattttctaagcactatcagagttattcatcctttcatgcttcagcttatctcctccttcttcatatgtaaaatt

SEQ ID NO: 29158 - DNA, 201 bp, Homo sapiens
tgtgcaaatagatgccctgtagttagtgcctttagcatctgtatctccacatttcacataggctgtagacatgcttagatcctcagttcagggaaaaaagrgtaagtaatataggaaaaagaatagttgttagtcaaatgattcattaggtggccttgggaggaaaaacagctcttcctttatagaataagggatcattta

SEQ ID NO: 29159 - DNA, 201 bp, Homo sapiens
cttcaatcccactggcagtgggacaaatccactagctttagaggtaagccttcaaatatacttctactgacaggttgaagtttgttttaggaaaaatcaargttctacaatcctttgcatttattggagttttcagtttccatggtttccaagagttcactgaaattaggctttccatgtttagaagtcatgataggggct

SEQ ID NO: 29160 - DNA, 201 bp, Homo sapiens
aactaatgactttcacagtgtgatgagattgaaaatgaagcctaattgcttccactgatttaacccttggaatgcttccaggcatgctcacagccatgtgwctttaatcatgtgagttaatcaccttcagggatacatcagaaaacagtggcttataggaagcctgggaagcattgcagttgtgttattaagcctgcactt

SEQ ID NO: 29161 - DNA, 201 bp, Homo sapiens
gatacatcagaaaacagtggcttataggaagcctgggaagcattgcagttgtgttattaagcctgcacttctgggggctgtcatctcttcaaataaggacrctgagaggttggccgtggtgcccttacactagtttttgttagtaacaactgacataggcaattacagaaaaaatgaattaatatttatgaatttttaagt

SEQ ID NO: 29162 - DNA, 201 bp, Homo sapiens
tccctgattttaaaggctttgactctgggtgtgatgcccactgaagctgtcactgtgactgattagcacaggttctgccagcttcaaccctgcctgccccycttcatgaacttcactccatataggaagcacggcttacttcaaaatggaaaaaatgtgtgaaagaatcttagagatggtattacaatttagttttcatta

SEQ ID NO: 29163 - DNA, 201 bp, Homo sapiens
ccaaggcgggcggatcacaaggtcagaagatcgagaccatcctggctaacacgttgaaaccccggcactactaaaaatacaaaaaattagccgggcgaggyggcgggcgcctgtagtcccagctactctggaggctgaggcaggagaatggtgtgaacctgggaggtggagcttgcagtgagcggagatcgcgccactgtg

SEQ ID NO: 29164 - DNA, 201 bp, Homo sapiens
attattactgagtggttagagaaggagtggacaaatccaagactatcttgaagtgaatagaaactttcactttattctagcacttgctaagttgctctcaktctgcaaagtcactttcacagcatccttttgacatttagacccattattgctatgaactctcattgtcctgtgttcctaaactgtcactgcatcctttgt

SEQ ID NO: 29165 - DNA, 201 bp, Homo sapiens
aaagaaaatgtgggtatagaatactatacatatcatatatgtgaatattatttatcttaaaatgaagaaaattctctcatttgcagcaacatgaatgaacygggaggacattatgccaagtgaaataagctaggcacagaaagacaaatgcttcatgatctcacttacatgtaaaatcttaaagccttaaaattacagaag

SEQ ID NO: 29166 - DNA, 201 bp, Homo sapiens
cattgttaaggttaaaagaacattattgtggagtaatctgtgaaagacagacacttcaaagagataaatactcacttctgttacataaacaattaactcaagtcatttgcttcatggtaaaagacaaagctagagccaaatccaaatactgtggtatcagtgcagtcaggggaacaaagattcctttaagtgaaacaccgt

SEQ ID NO: 29167 - DNA, 201 bp, Homo sapiens
gcattgttaaggttaaaagaacattattgtggagtaatctgtgaaagacagacacttcaaagagataaatactcacttctgttacataaacaattaactcaagtcatttgcttcatggtaaaagacaaagctagagccaaatccaaatactgtggtatcagtgcagtcaggggaacaaagattcctttaagtgaaacaccg

SEQ ID NO: 29168 - DNA, 201 bp, Homo sapiens
tggaaagagtgtgaagttgatttaccaactttttcaggttctgaagcagatgaatcatgagtaaaataacttgataggtatatattgaagcctaaatgttkgtatgagtgtacttgtcttagtccacgtgacggacaatataccatattcccgttagaatgctgggagatactctccccatcattactccaaaggtcatac

SEQ ID NO: 29169 - DNA, 201 bp, Homo sapiens
atgcattgttaaggttaaaagaacattattgtggagtaatctgtgaaagacagacacttcaaagagataaatactcacttctgttacataaacaattaactcaagtcatttgcttcatggtaaaagacaaagctagagccaaatccaaatactgtggtatcagtgcagtcaggggaacaaagattcctttaagtgaaacac

SEQ ID NO: 29170 - DNA, 201 bp, Homo sapiens
tagaagaaaacatagagaaaagcctttttgaaattggtttgggcaatgatttcttggctatgacctcaaaaacacaagaaacaaagcaaaaagagattaayaggattgcatcaaactaaaaagcattggcatagcaaaagaaacaatcaacagaataaagagacaacttatgaaatgggaggaaatatttgcaaaccatac

SEQ ID NO: 29171 - DNA, 201 bp, Homo sapiens
taggtaggaagattgcttatttcattgatgtgctgctcagagtgcactggagtgcaatgaagagctgggcactgaaaatacttttagaagtacaggcccaraagcacaagtaatggaaaaatcccatcatttcctaacctcaggcacagacaggatatatacaatgcatattatttgtagagtcatcctctttgacgatta

SEQ ID NO: 29172 - DNA, 201 bp, Homo sapiens
catgcattgttaaggttaaaagaacattattgtggagtaatctgtgaaagacagacacttcaaagagataaatactcacttctgttacataaacaattaactcaagtcatttgcttcatggtaaaagacaaagctagagccaaatccaaatactgtggtatcagtgcagtcaggggaacaaagattcctttaagtgaaaca

SEQ ID NO: 29173 - DNA, 201 bp, Homo sapiens
taaagagcctgtatgcatgttgggtggagaactaaatttgtttactttccctgaaaatatagtcacagtcttataaaattatgctaaaatgtggatggccyttttatgataagggactcactttctgtgtgtgaaggcagcacataagtaatttatggaggctattgtcatttgctaaaatatgctgacaaggagaatggt

SEQ ID NO: 29174 - DNA, 201 bp, Homo sapiens
taaagggtatattgaaaagagaaatgcataatcaaaactgggtgtaggaaaatgtatctaattgtatgcaggatggactgcaatgggaaaaagtattagtygaggagactagttaggaagctgcgtaatacagaggatgatgctagaaataagaagaaatgtgagaagtataagtcagttaaaaccagtagaattctgaaa

SEQ ID NO: 29175 - DNA, 201 bp, Homo sapiens
gctccaggcttgcccctacaaaaaaagacatcagattgacccctgtggacttaggcactaggcccatgaacccactgacctaggcagcaggccagcctgcytgaggactcccgtggcaagcccactgcaaaccccaatggataacctggtcagaatctctggacaagctgtctggtgaagggctttccttgccagtctgta

SEQ ID NO: 29176 - DNA, 201 bp, Homo sapiens
aaggaatgttagatgacaagtcagcctgggaaaattataaacgataattataagaacaatttcaaattttgcatttgagatgccattgataggcaaaatayatgggactcagacttagcagagaagtcaggaccaaagatgcatttatcagattgtataataattaccaaagtggcatttaggaatgggaaagcagcttag

SEQ ID NO: 29177 - DNA, 201 bp, Homo sapiens
ggccctccccagtagacccaggctccaggcttgcccctacaaaaaaagacatcagattgacccctgtggacttaggcactaggcccatgaacccactgacytaggcagcaggccagcctgcctgaggactcccgtggcaagcccactgcaaaccccaatggataacctggtcagaatctctggacaagctgtctggtgaag

SEQ ID NO: 29178 - DNA, 201 bp, Homo sapiens
tttcaaattttgcatttgagatgccattgataggcaaaatatatgggactcagacttagcagagaagtcaggaccaaagatgcatttatcagattgtatartaattaccaaagtggcatttaggaatgggaaagcagcttagggctacatttccaaatcatacacttttagaagacagtcagaaacaaagaataggcaaca

SEQ ID NO: 29179 - DNA, 201 bp, Homo sapiens
ctctgccctaaagcagatctcaggttactaactaacccatttatgccagaggttgcacatttttttgtgtgaaaaatcagaccttggcgatgaccttgagmagtaggatataaataactcccacaagcttagcgttccaataatggaacactaggcataaatgggctaactccttcagctctgggctgagtttctcacaat

SEQ ID NO: 29180 - DNA, 201 bp, Homo sapiens
ttcagtgggaaaaaaaaaacaaaactttttttttaaaacggagaaaacataagtttatagttcaagcatatagagccaatgaaagaagaaaggttgaagaygcaatatttatttcactttcttgggagagcaggtagaaaaacgggaagatttggagactataacattaattttactatttgtagctctttaccaaagttt

SEQ ID NO: 29181 - DNA, 201 bp, Homo sapiens
tttttagaatttcttgtaggcctttatgcaggtgtgacagcattaagaaatcaaactttgccttttaatggtaaaattttcttaacaaacagtatttgatrttatatgtatgtaagtcataaatgcactggcctatcttatgacttgactttattgctacttggtgtgttgatagaccaaatattatagaagttgtggttt

SEQ ID NO: 29182 - DNA, 201 bp, Homo sapiens
gtatctccaaaggcagaaatacaatacaaataatattataaaaaagtaagaattactttaattgttgcacaaatttttcaaatttggaggctcaaataatygttctaacatattcactggtaaaacgagtcaagttaagaaagatattatgaattaattgtgcctagatttaatgatattatttattaggtaagaagaaat

SEQ ID NO: 29183 - DNA, 201 bp, Homo sapiens
gtctgaataatattccttgtgaatatgtaccacattttctttatccatttatctactgatgtacatttaggctggttcaaaatctttactattgttaattrtgctgcagtaaacatgggagtgcagctatctcttagatatactgatttcttttcttttggatatatacctggcagtgggattgctggataatatggtagt

SEQ ID NO: 29184 - DNA, 201 bp, Homo sapiens
acctacctgtaaaactgagtttgtggttgcaagagtctcaccataggtaatgtcctttctgtctttcttgttcaagcggtagaggattgattagaactgarcacctctgtcatttggtcctactttccaccatctgagaactattctctggtatctaatgtgctcttatgctagaaatcacacttaagtttcctttgagca

SEQ ID NO: 29185 - DNA, 201 bp, Homo sapiens
tcttcactaatacacacacatatacgcacacaaactgtgaacaaatagagctgcatataaaattatacttgaagcctgtaaaacagaggtgatccatctcycttaacagtgtcacttcaaagggctcttacattcaatacaaattaaaatatctcgttgagagcaaaatagtttccttcatgttgacatttccactccttt

SEQ ID NO: 29186 - DNA, 201 bp, Homo sapiens
cctgggttgccccaggattcaaagaggcatcacagcacatcacaccagagtggggtaagaacccccacattactggcaagagaagaggttttcaatgagarcaaggcaccccagctacataatatcattttgttattcagggtctgacagcaaagaatacacagaggaggagaggaaagctttggtgttgtgtgatgaggc

SEQ ID NO: 29187 - DNA, 201 bp, Homo sapiens
agaaatgtcattgtctcagtgttgggataatggcttatgtctttatttttagtaagctgtcaaaataactatctcaaggctctactagagaaatagataakatatatatttggaaaacagtatggataaaataatacagaatatgtttcaaatataactgaaaagaacgttgtgggcatggatcttttcatatttagatca

SEQ ID NO: 29188 - DNA, 201 bp, Homo sapiens
ccatttggcagttgggcttatttttagccagactatcaaagtatttttcaactggactgtcactgcacttgaacttggaatcttataacttgaagaactgycctggagaaaggaagaaacttataataaatgggaaattataaatctagaccaacccaaacttgtactggtaattattctaattattcttatttccttaag

SEQ ID NO: 29189 - DNA, 201 bp, Homo sapiens
ctttattctcttcttatatgggggactaattaaattattgatcaaataataaagaaaagggtatccaaaactatctaaaataattatattcaaaatgaatrtttttgttggagtatttctttgaaaactattaccattgacttttgaccaatgtgggagttaggagcactgatcccctgtacagttgaaaatctatatata

SEQ ID NO: 29190 - DNA, 201 bp, Homo sapiens
gccagtggctctcaaaattgaaaatgcaccagaatcacctggaagattttttaaggcaaaaactgctgggcccactaccagagtttctgattcagcaggtstgatgtagagtgaaacatttgaatttctaaccagttcccaggggaggctgatgtcccaggcatcacactttgagaaccactgctctagctagtacttaaa

SEQ ID NO: 29191 - DNA, 201 bp, Homo sapiens
ttaaacagactgattagttccctttatgatttcaccctcgaaagcacacacgattttgttctttatcattgttgcatgacattccatttggcagttgggcktatttttagccagactatcaaagtatttttcaactggactgtcactgcacttgaacttggaatcttataacttgaagaactgccctggagaaaggaagaa

SEQ ID NO: 29192 - DNA, 201 bp, Homo sapiens
tatatacgaggaatttcaaggcaatctatatgaagtcaaactagggttgttttctgggatcataaaataataacattacaatttgtatttgtagtgaagarctgccttcaaagggattaatggggaagtctacatttgaggttctctggcctttggtaaggaggggagtgccctgataaaataacgtctaaaaaacagact

SEQ ID NO: 29193 - DNA, 201 bp, Homo sapiens
ttttcctgcctgtcctttgttctggaagacttgtgtttgctcatcacatgtaaatgtccagtgcatttcagggctttatgtacagagtagggattgcatagagactttataatttttagtatattcaaaactgaatattcagaaaggtggctaggaagcagtatttatgtaatagttaaagagcaaaagttggaaactttt

SEQ ID NO: 29194 - DNA, 201 bp, Homo sapiens
atacctcctctacagaaccaagggtatatacgaggaatttcaaggcaatctatatgaagtcaaactagggttgttttctgggatcataaaataataacatyacaatttgtatttgtagtgaagaactgccttcaaagggattaatggggaagtctacatttgaggttctctggcctttggtaaggaggggagtgccctgat

SEQ ID NO: 29195 - DNA, 201 bp, Homo sapiens
ctaggatttaattttaacatgcagagatggacagtattaacagaccttttatgtctggatgttgaataggtgctcagaaggtccctggcacattgccagakagttattcttggatctggtttcttaaatgtaagtgagaagaatccggtgacacttctgtgcaaatagatgccctgtagttagtgcctttagcatctgtat

SEQ ID NO: 29196 - DNA, 201 bp, Homo sapiens
ctgggagtaaggaggaggacgtggctgcagccagagtaggaggttgctaaagatttgggagttttaagatacctattaaatattgtctcacgttgactcartgacatcaggccacataattttgtactgttttttcatcacattcaatccttgtttttctttttgagatggagtctcactctgtctcccaggctggagtgt

SEQ ID NO: 29197 - DNA, 201 bp, Homo sapiens
gctcttaagataaaaacaaaacatcttaaaacaatcttcaaagccccttatgattatgtccctgcctgcctccccggcctccatctcaccacatgcagccygtcatccagagtcatcccaaccacaggaaactttcatatccccagcatgtgtcctctcacctccatgcctttgtgcacattagtctctttgtcagagaca

SEQ ID NO: 29198 - DNA, 201 bp, Homo sapiens
cagagacactcttctccacttttcattacagcaactccaatttatttttaggtcttagtctaaatataatttctttccaaaaatctttcttaattctccamtatcaagtgcaatttcctccttatcccaagttaccatttatcattgcatttatcacattttactcacagttttgtaattttctctacttcattagacttt

SEQ ID NO: 29199 - DNA, 201 bp, Homo sapiens
cagtgtgatgaataagaaatcacgtgctctgactcacgctccagccaaacagcgctgagcaggaacgtaggtatacccacgctgaccatatcaactaattwctttctgctcattaattaagaaatctatacattttttaatgttggcaattaattcagcattttaaagaaaatatgtttcaggctaacaccgtaggggcta

SEQ ID NO: 29200 - DNA, 201 bp, Homo sapiens
gaaggctgggtgcggtggctcacgcctgtaatcccaccactttgggaggccgagatgggctgttcacgaggtcaggagatcaagaccatcctggctaacayggtgaaaccccgtctctactaaaaatacaaaaaattagctgggcgtggtggcaggtgcctgtagtcccagctactcaggaggctgaggcaggagaatggt

SEQ ID NO: 29201 - DNA, 201 bp, Homo sapiens
aaagctgagatgaattaatccatcaatatgtattgtatccattcccatttccttataaccaggtacccagatttgtggatcactttcaaattatagtctgrgcccaaagaagagagtctcttgttttctttttgttttcctgtgtgacgccagctggttcacaaagagatttaactctgtgtcctgggattccttaatgcc

SEQ ID NO: 29202 - DNA, 201 bp, Homo sapiens
aagctagtgaaaagaaaatgttataaagaaaatcataaggattagaaaatatatttactatttattaagtggaagtggataatcataaaggtcttcatcascattgccttcacattgaataggcaaaggaggaggaggaagaggaggggtaggttttgctgtctcaggggaggcagagatgaaagaaaatccatgtatatg

SEQ ID NO: 29203 - DNA, 201 bp, Homo sapiens
aataagctctgttgtatttcacaaatcctatggcaacatctttaaggttggctgtttttctcttttgtaaattagcttcatagattatttttatagtgaaygcattaaaatagtattgaagtttaattttattgaaaaacattgcattactcagaggatcatttggcattttttatccttcacaatcataagcccctagtg

SEQ ID NO: 29204 - DNA, 201 bp, Homo sapiens
tttttaaatttagctttattctcctttaatggcaaagtctcattctttaaagtagaaaccaacatttacataaatcctctaacatattttttgtagcaatmaaggtaaaaatttgattaatgggctgacaatctccttcctgaatctgtaataccagaaaatttcccagatgttagtgtagcatggctgcttaggcaagac

SEQ ID NO: 29205 - DNA, 201 bp, Homo sapiens
aagcttatatctgtctttcgacttttgcactagctatgtttcatattttaatacttatccttgaaattgtgactttttgccatctaccatttatctcaaadtcacctctgcagtgaagctttccctgattaaccagtttaaaatagccatctaatcatttgtctatttttatctcatatcagttggtactttaagctactg

SEQ ID NO: 29206 - DNA, 201 bp, Homo sapiens
caagcttatatctgtctttcgacttttgcactagctatgtttcatattttaatacttatccttgaaattgtgactttttgccatctaccatttatctcaargtcacctctgcagtgaagctttccctgattaaccagtttaaaatagccatctaatcatttgtctatttttatctcatatcagttggtactttaagctact

SEQ ID NO: 29207 - DNA, 201 bp, Homo sapiens
atagccaagacaatcctaagcaaaaaaaataaagctggaggcatcatggtacccaacttcaaactgcactacaagactacataaccaaaacatcatggtaytgggaaaaaaaaaaaagacacatagaccaatggaagagaacaaagaactcagaaataagaccacacatttacacatctataaccatctgatctttgacaa

SEQ ID NO: 29208 - DNA, 201 bp, Homo sapiens
atccttttgttcactacatcaaatagctctttcaattatacaccctggcatgctgggcctgactcattgttagaggaaaggggtcccgatccaggcctcargagagggttcttggatctcgcgcaagaaagaattcagggcgagtccacagtgcaaagtaaaagcaagtttattatgaaagtaaagtggtgaaaggacagc

SEQ ID NO: 29209 - DNA, 201 bp, Homo sapiens
atttctgatttcaaggtaatgcactcagtattgtttcagttcattctttactaaatcatccaaatgtttcagtagagaattttgtttaccaagaagcctcrgaccctgtgtaagttattttttaataatcgctttagtttcctctccaaaggcacaaatgacagaatgcttagaattataaaatatggtttctctctctct

SEQ ID NO: 29210 - DNA, 201 bp, Homo sapiens
tatttcaaacttacaaagacaattgcaagaatagtacaagaaactgcttatccaggttcattaactgtttgcattttgtcccatttccattattttttttwagaaccatttgacagtaaattgtataaaacatgccctgttgccacttcagtcttcatttcctaagaacaagaaaattcacttacataactccaatgcaat

SEQ ID NO: 29211 - DNA, 201 bp, Homo sapiens
ctctgatttgcatccagagtaacttttccagactatgtaattaattccattattctttggtagattgttatattaatcccctcccccactccaaggaatcrtgcctcctggttatcacacacttttgtagtctgttcctaccctgactgaggacttagacaagtgacttaatttaggcaaagaaacaccagcaaacacgac

SEQ ID NO: 29212 - DNA, 201 bp, Homo sapiens
aatttttagtatattcaaaactgaatattcagaaaggtggctaggaagcagtatttatgtaatagttaaagagcaaaagttggaaacttttttttttttttggcttgatgactttattttagtaatcagactagctaattattaccttttcatacttaaatgtaacatatcttttgccatcttctttattctctaaggttt

SEQ ID NO: 29213 - DNA, 201 bp, Homo sapiens
cctgaatgggcaggccacctcttacctgggtattggacaaggcccctactccagacgattaatcctccttcccaccacaggctcactctttgcattcttargcagttatgactctgtaaaaatgcaaaagtttctaatgcttcagttgcggttagctttttgtagttaaaattttagtaatcagttcataggctaaagctt

SEQ ID NO: 29214 - DNA, 201 bp, Homo sapiens
ctgctgagaaatggagcacagcgccagtgggccggcactgctgggggacccggagcaccctccgcagctgctggcccgggtgctaatcccctcactgcccrgagccggcaggactggccggccgctcggagtgcgggcccgccaagcccacgcccacgcccacccagaactctagctgggccgcaagccccgccgtgcggc

SEQ ID NO: 29215 - DNA, 201 bp, Homo sapiens
attactgtgagcattcaatgagattatgtttgtgaccacactttataaattgcaaactctctgtaactgtaaggtgcaagattaggaaaaagtgtaatacraggtcaaggctccttttgattctgtacttcagtggcactctcgttctctaggtggcccatgtagaaacttcaaagtcatccttgactcctctttagtctc

SEQ ID NO: 29216 - DNA, 201 bp, Homo sapiens
tattctcttatctggcccccacccacatcctgctgactggtccattttacagagagctgattggtccgttttacagagagctgattggtccattttgacarggtgctgattggtgcatttacaatccctgagctagacacaaaagttctccacatccccactagattagctagatacagagtgccaattggtgcatccaca

SEQ ID NO: 29217 - DNA, 201 bp, Homo sapiens
caacagaaatatattttctcacagttcagggcaatagaagttcattatcaaggtgttggcgaatttgatttcctctgaggcctctctccttggtttgcagwtgcattcgctgtatgttaacatgctcatatctctgtgtgtgcacatgcctggcagcttggtctctgtgttctaatctactctttttatgaggtcacttgt

SEQ ID NO: 29218 - DNA, 201 bp, Homo sapiens
acactgcatattctgtggcattcgaaaatggtttcctcgggagttgaaaccataaactctataccccattactgagtgtgccctatgttacagaatactcyttattaaaggtgaaaaagcaatctactactctgcaggcttttggtctggagataaacacaagatcatagatcatgtattattatcagttattttaaggtc

SEQ ID NO: 29219 - DNA, 201 bp, Homo sapiens
agtaatataaaaggacgctagcttgtcaatttctttttgtcactcaggtctttggcatagactctgttagctttattaaacattaagtattgctttcaggktgaggtagaagagcataagcaagaaaagctttataggctaataaaaatgtaaatgagatgttcatcagcttgctgccctggaaaatgatggaagaaacat

SEQ ID NO: 29220 - DNA, 201 bp, Homo sapiens
acctgatatgagaaatccctttgtaaccatttgtgttaatttgcatccttatgtcaatctttctatgcactgaatttgcttccaacatcctaggtcctctrtacatatatatgtagataatgtatatacacatttttatatatacatagaaatatatacacatatttgtataattcatgttattaattaacatgtattagc

SEQ ID NO: 29221 - DNA, 201 bp, Homo sapiens
agactggagatcattagttattaaaaggactatacttacacctgccaacctaatgccccatagtgccagtttacctcctggctgccttcaaggttctgatrtctgactcagttgagaagaagggacttgcctttgcagaaaatgtaaatggagagagtagtactgatgtctttaggagcctcactagaggggaaggaaagg

SEQ ID NO: 29222 - DNA, 201 bp, Homo sapiens
taattacttgtgtgatgttttaggaagaattatgaactttatgatcttccaatgattaaaaaatgccctttgaggaactgaacagccacagtaaacacacygtgtatgtataaacatgtttattgcacacactgagggcaatatgtatggatgttaatttatatttatgccttttgagagcatcgggagaacacagtaaat

SEQ ID NO: 29223 - DNA, 201 bp, Homo sapiens
aggaatttgaagactgagttgtaaatcagaatttctatagcttgttaaagtcacatcctcagagtttggaaacctctgagctcactatgtctcaggaagaygggaaattcttcttctacttcttcttccccttaattaggaatacattgtaataataatattttctatgtgacctttgaatacagtagtaaaataacaagt

SEQ ID NO: 29224 - DNA, 201 bp, Homo sapiens
ggaaatctgaggtttttctcttcagaagcctagtcttcctaaattggctatttctttagactggagatcattagttattaaaaggactatacttacacctrccaacctaatgccccatagtgccagtttacctcctggctgccttcaaggttctgatgtctgactcagttgagaagaagggacttgcctttgcagaaaatg

SEQ ID NO: 29225 - DNA, 201 bp, Homo sapiens
ataaacatgtttattgcacacactgagggcaatatgtatggatgttaatttatatttatgccttttgagagcatcgggagaacacagtaaattctcactargaagaatgctactctgcagtggaagaaccaaacacttggtaaatggcttgtggatgtttcttgatgtgcagaacctccgttggatggctcctgaggtgtt

SEQ ID NO: 29226 - DNA, 201 bp, Homo sapiens
ataagtatgataaaagctaagggaaatctgaggtttttctcttcagaagcctagtcttcctaaattggctatttctttagactggagatcattagttattwaaaggactatacttacacctgccaacctaatgccccatagtgccagtttacctcctggctgccttcaaggttctgatgtctgactcagttgagaagaagg

SEQ ID NO: 29227 - DNA, 201 bp, Homo sapiens
ctatgctctgtgtctgtgggaaattctcactggcgaaattccattcgctcatctcaagccaggtaagacacactgcaattgaagttttcctgttttacagrgttcactggatttttataacttcaagaaaattttttttcacaaaatgattagtctcagtgagatggcaaaagaggaggtaagcaaacaatcttaaattgt

SEQ ID NO: 29228 - DNA, 201 bp, Homo sapiens
agttattgtaaaggatggaacttttaagcaaggcacacaaaaccttctaaagtcactctgagaagcaattcagagtagccccttgctgcatctttcatttwgcagccattttactcttttctctgccctaaagcagatctcaggttactaactaacccatttatgccagaggttgcacatttttttgtgtgaaaaatcaga

SEQ ID NO: 29229 - DNA, 201 bp, Homo sapiens
cttcagtccagctctggaagaaaatcagaattggaaagtggtctaataatcaggccagtctgattaatagtgacaattagtattggactacagtgcataamcaactgattatgaatcattcgagcactttaggtaaattttcaatacaggcaattaaaatgaaaagactcatgatccttacataatgacttcattaaatta

SEQ ID NO: 29230 - DNA, 201 bp, Homo sapiens
tggcatctaagaagagaatttttttaaagcctggtattccttctaagatacactaatgtaatagccaagatgatgagataactgtgaaaagccagtagggrtcttgaattgagatgtattctttgaaagcctaactatgctcttatggtgctctcaaaatcagtggtgccttatgaggaatcacagcctgagactggcttt

SEQ ID NO: 29231 - DNA, 201 bp, Homo sapiens
tgcattgttaaggttaaaagaacattattgtggagtaatctgtgaaagacagacacttcaaagagataaatactcacttctgttacataaacaattaactcaagtcatttgcttcatggtaaaagacaaagctagagccaaatccaaatactgtggtatcagtgcagtcaggggaacaaagattcctttaagtgaaacacc

SEQ ID NO: 29232 - DNA, 201 bp, Homo sapiens
cctagaaagttaaatccttctttatttagtgtacctggatttttaaaaagcaaaagtccccgcttcaaatccaaatgcaacatggtaatgtattgtcagartccttcagactaagattatagtttaacatttaagtagataatttcataacgtaggtctgtataagacattttgttgtactattttgtagaaaacctattt

SEQ ID NO: 29233 - DNA, 201 bp, Homo sapiens
tgttgatcatcagttactcaagttagtcacaagtcataggcctagaaagttaaatccttctttatttagtgtacctggatttttaaaaagcaaaagtcccygcttcaaatccaaatgcaacatggtaatgtattgtcagagtccttcagactaagattatagtttaacatttaagtagataatttcataacgtaggtctgt

SEQ ID NO: 29234 - DNA, 201 bp, Homo sapiens
catatcagatacaaggaaatgtgattctgatgcctaagtgtaaaggaaatagtatagaagttatcaatagaaaattaaattagcattaaattatacaaacrtttttttattcaggaaataatttttaaggtcctatgattaaagatttgcatttggcacagtcatagattttgttgtattgtttttctgaaaatacatatt

SEQ ID NO: 29235 - DNA, 201 bp, Homo sapiens
agactatgcacaactattttaaatgtgctcaccatactggcttatgtacttacagctacaccagctcaacaatatccaaatgatcataaggtaacaaagtrgagttagaagatcagtgattgctgagcaccagtttgtttgcttattgatttacctcatcccagaaataatttaaaaatagtcaagagtggcccagcatgg

SEQ ID NO: 29236 - DNA, 201 bp, Homo sapiens
cagcatacatcagaatcatctggacagattgttaaagcactgatttctggacttcactcctgagtttctgattcagtacgtattagttggggccaaaataytgtattgctaacaagttcccaggtgagactaatgctgctgatttgggaaccacactttgagaacctctggcctatgctgatctcccagactatggactca

SEQ ID NO: 29237 - DNA, 201 bp, Homo sapiens
cgtgggctcctgcgtggcccgagcctctcctatgggcactgccccctgcttcacggcaccgggtcccaccgaccgcccaaaggctgaggagtgcaggcgcrtgatgcaggactggtgggcagctctgcccacggccctggccaggtatccactaggcaaagccagctgggctcctgtgtggggtggggtcttggagaactt

SEQ ID NO: 29238 - DNA, 201 bp, Homo sapiens
tcccaaaaagagtaacacttgagctgaggccataaacagtagttttctgaaagaaggcggcttggtgagaaagaaaaacagtctaagcaaccagaacataygaaaattcattaggagaacagatacaagggaaagactagtagcagttgcaacattgtagccatggagaggttaaatctctgtatcaggcattatttgaaa

SEQ ID NO: 29239 - DNA, 201 bp, Homo sapiens
gagaggttaaatctctgtatcaggcattatttgaaacaagttcatctttagatggaggacactaacatcatgctattctggtcattactttctaggttatsaactgtgcttctcattttttcttgcatatctgtctttacttcattccttgaatttgaagcacagtattttctccaggatgtcttcttagtcaaaactcat

SEQ ID NO: 29240 - DNA, 201 bp, Homo sapiens
aatattataatattctaaattgtgaaggtatgcttcaaatattttttacagtggtctcaataattaaattatttgaatatatctatatttttcaaataagyatggctttgaatgagacatgtttgttctgttactgtttttaaatttaatatttatattcacatttaattccagtgtataaggaggagttctcactccaaa

SEQ ID NO: 29241 - DNA, 201 bp, Homo sapiens
tggggaatgagagaggaatcataagtttctgtttttgaaagttttttttctacatcattttcttccttatccataatacaattttccacaatttgatgtgrtatttggggttttgtcattaatgttttttctttattttcaagctgtgcatgacttgaattttgctctctgtgttgtaagccttcattttggtctaaagtg

SEQ ID NO: 29242 - DNA, 201 bp, Homo sapiens
attttccacaatttgatgtgatatttggggttttgtcattaatgttttttctttattttcaagctgtgcatgacttgaattttgctctctgtgttgtaagscttcattttggtctaaagtgtattccttgttgtagctgtcagtcttgtgagcatctaaaagttgtgtttgattcctcggggacaaagaaaactgatttaa

SEQ ID NO: 29243 - DNA, 201 bp, Homo sapiens
gatgggagctttatgtaagtaaacaaattatgttggggaaagaatctgtagcctttgtcagagtctcagagagttctgtgactcaaagataaacattaagractattagtctagatctaaagtactctctacactggaaagtctataattctttttccaagtcagaaggcataatcagagtggcaatttttctttaccgat

SEQ ID NO: 29244 - DNA, 201 bp, Homo sapiens
caaattatgttggggaaagaatctgtagcctttgtcagagtctcagagagttctgtgactcaaagataaacattaagaactattagtctagatctaaagtmctctctacactggaaagtctataattctttttccaagtcagaaggcataatcagagtggcaatttttctttaccgatttctgttctggagcagatgtgac

SEQ ID NO: 29245 - DNA, 201 bp, Homo sapiens
acagctcataaaggcagtgtggacccaaagagtgagcagtagcaagatttattgcaaagagctgaacaacaaagcttccaaagtgtggaggggcacccgartgggttgccactgcttgttcaggcagcctgcttttattctcttatctggcccccacccacatcctgctgactggtccattttacagagagctgattggtc

SEQ ID NO: 29246 - DNA, 201 bp, Homo sapiens
tctttgactggctacaccatgtctagttttatccactggagacaatattaatgaaaacatatttttaaaacttaaatgaaaagggagggtatcaggtcatrattgtttcttttttttctgttaaagatgaagagcaaacatggagaatagcagtttctggtaaaatcctcataccattgtatagtttaccatatcttgaac

SEQ ID NO: 29247 - DNA, 201 bp, Homo sapiens
gggatacttagtgttggaattgaaccttgagattttcataaatataaatttataaaacatacaaattatattatgcattgatcattttataattataatamtttctactttgtatttattatgagctaaatatcatactaagtttaatgtattttagtcattaaaataactgcatattaggatttactttacagaaaatgc

SEQ ID NO: 29248 - DNA, 201 bp, Homo sapiens
ccgtccggagttgttcattcctcccagtgggtttgtgatcttgctggcttcaggagtgaagctgcaggccttcatggtgagtgttacagctcataaaggcmgtgcggacccaaagagtgagaagcagcaagatttattgcaaaaagcgaaagaacaaagctcccacggtatgaaaggggacacaagcaagttgccgatggt

SEQ ID NO: 29249 - DNA, 201 bp, Homo sapiens
ttgttcctcccgtccggagttgttcattcctcccagtgggtttgtgatcttgctggcttcaggagtgaagctgcaggccttcatggtgagtgttacagctyataaaggcagtgcggacccaaagagtgagaagcagcaagatttattgcaaaaagcgaaagaacaaagctcccacggtatgaaaggggacacaagcaagtt

SEQ ID NO: 29250 - DNA, 201 bp, Homo sapiens
tttggacgtgttccgagtttcttccttctggtgggtttgtggtctgctggcttcaggagtgaagccgccgaccttcgcagtgagtgttacagctcttaccrcggcgcatctggagttgtttgttcctcccgtccggagttgttcattcctcccagtgggtttgtgatcttgctggcttcaggagtgaagctgcaggccttc

SEQ ID NO: 29251 - DNA, 201 bp, Homo sapiens
ttttaaattttaaaattaaagtattattaatccctaatttcttgttttaaaactggaactttagctgtcccaaagagcttatattaattttccaaaatcaygcaactagttaatggcaaactgagattagaactaacattttctaactctgattcttaatccagtgcactttccactactccaggctccctcaatatatga

SEQ ID NO: 29252 - DNA, 201 bp, Homo sapiens
tgttgccattgcttttggtgttttagacatgaagttcttttcctttttttttttttttcagacggagtctcgctctgtcgcccaggctggagtgcagtggygcgatctaggctcactgcaagctccgcctcctggattcacgccattctcctgcctcagcctcccaagtagctgggactacaggcacccaccaccacacct

SEQ ID NO: 29253 - DNA, 201 bp, Homo sapiens
acttctagctcacagggatagactgtctggtgtcttgaaaaaaataaacagcttctcagcaactgaagagacgctgaaaggttcagtgaatttaaaaaaaatagttatgttcatttcttgtgaattttcaaagtgtccttgatggaaggcatatgggactaagtacatttttaacctgcccttttgcagagacatgggcat

SEQ ID NO: 29254 - DNA, 201 bp, Homo sapiens
tctatcctgaagtttttctatgctctgaacaaccacaatgttttttttgtacctttctaataacatgtaacaccacctgtttcatgagcatagttttattygattattttattatactcttttttgagcacaggaactgcacactagaaatcatcatatttctcacaggttccaatattgtgatttttgcatacagtagat

SEQ ID NO: 29255 - DNA, 201 bp, Homo sapiens
tctcacaggttccaatattgtgatttttgcatacagtagatttttaataagtttctgtcaaatgactaaactaataattattcaagtgttttaggaattawacagaatgaggaaaattatttctactctccataaaagcagaagagattataatgatacgtttcatgaagaaagtagcttacaaaattacaagcaattttc

SEQ ID NO: 29256 - DNA, 201 bp, Homo sapiens
gagattatggcatctgaatggagcagagaaatcagcaaagacacattgaagaggacaagaatagttttacattatgcatgtcaccctttcctaaagcctaygcagttcagtacaaatagagatagcctccatgtaaaggaaaagaataaagtgagtccctaacttcattgcaggccccagcaccatgcctaccccagtgga

SEQ ID NO: 29257 - DNA, 201 bp, Homo sapiens
tattgcaacattattcacaatagccaagatgtgaaatcaaccaatcaacctaagtgtccatctatttatgaatggataaagaaaatgtgggtatagaatastatacatatcatatatgtgaatattatttatcttaaaatgaagaaaattctctcatttgcagcaacatgaatgaaccgggaggacattatgccaagtgaa

SEQ ID NO: 29258 - DNA, 201 bp, Homo sapiens
cattgggggaaaaaagcctagaggtctctttgaatgtctgctgatgttgctcagattgatttttaatgcctttttgtgtgtgtgtgtcttcatttgttgcytgaaataaacatgtgaatttcaaaactgacatgaccatttggtttgcagcggctgcggcagcagacatggcttaccaccacatcagacctcccattggct

SEQ ID NO: 29259 - DNA, 201 bp, Homo sapiens
agaatcttatcaagacagtcaactgatttgattactattaacagggtttgattaccccctgaaaaactttgaaagaggagttttcagcccatttttcttaygttatgactaaaaattagaaattttattatctgttagcctaggtcctctagttgcaagtaacaggcattaacctagcttaagtaagacacgtctatttca

SEQ ID NO: 29260 - DNA, 201 bp, Homo sapiens
acgagggtggaacgcatgtcctgaagtgagtaatttttatttcctcttagaaaatgtgttatggtcaaaatctgtcacaaatagtataactccaaagtctrctttcagtgtgtattttaagactgtcaaggcgggaagactgatttgccttctgctctttagtctctaattgcctcaagaagtctgagtatctcatatttc

SEQ ID NO: 29261 - DNA, 201 bp, Homo sapiens
tactgctgtcaaaatttgcaaactgtcaagataaataagttcattcagattatttatatctgctgtttctccccctaacctcatacttagaaaattatatrtgtctagtccttctccaacttgattttatgtcttttagcctaatacattggcaaaccaaatgcatgactctgacaccgataatactaagaagggctgaaa

SEQ ID NO: 29262 - DNA, 201 bp, Homo sapiens
gtttaggggttgaaaagctagattgatgagcattaccagagagaaatattttttggaaagtaagtgaagctgatgacacattactttacagtttagtgaawttcagcaaatctaattctattatcctgtcaaagtttcacaaaaaggagacctgaaagcatattttagatgaatctttaaagatttcaagaagccacaacc

SEQ ID NO: 29263 - DNA, 201 bp, Homo sapiens; identical to SEQ ID NO: 6045

SEQ ID NO: 29264 - DNA, 201 bp, Homo sapiens
agaagctatagatgaggatctaaagtcaatagaagtagaaataaaagaacatggagtcaagtaagttcagtacccaaggaaaatcggaaggaagagggcarctttccttcatgcagcttcccttccagtcactgagacctcagactcttctcttcattcaggcagtgagcatgaaaagatctggatgggactggatatagc

SEQ ID NO: 29265 - DNA, 201 bp, Homo sapiens
agcagtgtgataacatagctccttgaaaatctagtcaatcaccattttatagtaaaagcctatgaatttttgtagcttggtgtcttattgtctctattcaytagttgcttctaacttttctgggcatccccagaaaagtggaaacctcctgtgaatgaggcaaatttagtaacctccaattaatcaagcacactaagcaca

SEQ ID NO: 29266 - DNA, 201 bp, Homo sapiens
tctcttcagtcctgggggaattcacagtttaagggaggaggtcagagaaacacacaggaagataagtactgagccatgtgtaggaagccctgtgagcctgrgaagagtcaaggtaggcttcccaaaagccatcccgtttcacttgagtttggcagagttaaccaagcagagaaaggaagaaagagtgtactaggaaaggga

SEQ ID NO: 29267 - DNA, 201 bp, Homo sapiens
ctctctatggtaactattcctttgctttcctagatattaagtatatgtaaatgtatgtgtaactctgtgaatatgtatctctgtataaaatcattaattawatatttttaattttttctgttcttgaactttatgtaaatgaaatcaaaggcatatttttgtgactttattatttattgtgacttctttgtgagtgatcac

SEQ ID NO: 29268 - DNA, 201 bp, Homo sapiens
ttaagatagcttgtttatatgcagatttccctttagtaatgaaatatttcataatctctttctaaatgaacacattctcaataaaaagttaataggatcckagctgaagatggtaatttgcaatttatgcttcaattcttacaccagacagtagtatttcctggaaaaccttccctgatccctcccaagtttgggttaggt

SEQ ID NO: 29269 - DNA, 201 bp, Homo sapiens; identical to SEQ ID NO: 6048

SEQ ID NO: 29270 - DNA, 201 bp, Homo sapiens
cccctctttactccaaacccaaaatgccacctggccagcttgggtccaaattagacattagtcattcatatttgcctggtctcagctctctgttttcattrtaaatgttgcttgtgctttgcaactactcaccagcaaccgttgtccagattgtctgttcacatgatctggaagacctgcctggttcaggctggttataaa

SEQ ID NO: 29271 - DNA, 201 bp, Homo sapiens
gggcaaaggacatgaacagacatgtctcaaaagaagacatttgtgcggccaacaaacatacaaaaaaacgcccaacatcactgatcattagagaaacgcaratcaaaaccacaatgagacaccatttcatgccagtcagaatggcgattattaataagtcaacaaacaacagatactggcaaggctgtggagaaataggaa

SEQ ID NO: 29272 - DNA, 201 bp, Homo sapiens
attttaaacacacaatcagtaatttaaattaagtattgtagaatctagaataaaaaacagttttgattacttgtatgttatgatctgtgtctacattttgyaaaacacaactatgaatcaatctcatttgttcttctttactagatgaatggaagaaaaaagtcagtgaatcatatgttatcacaatagaaagattagaag

SEQ ID NO: 29273 - DNA, 201 bp, Homo sapiens
tcacattaccatggataatgaagagagagctgagtatttgtttttaaattttacttcttatgcttcattttgcctgcatcctgttcttattaccaccattwgagtaaataattgaaatttcttcggtcctttttatgtgttgtctatttagtaatgtgtgttagttaagaacctggaccccactgcccaccccaatgtcct

SEQ ID NO: 29274 - DNA, 201 bp, Homo sapiens
taattaaattagacatcgttgaacataaagtggggttcaatagacatttgatttattattattgtctactattaacattagattcaaacccataacaagtwatcagaggggcaaaaacaatactatactggctgtagctaccaaaatatatacatgaaaaatgaaaatgaaccagtggctttgtttacataagctaaatat

SEQ ID NO: 29275 - DNA, 201 bp, Homo sapiens
ttatattttgttccaaattttctagttctgaagtaacatttgttctctcccgtgttactgccaaactttcagtatgtcaatactaattaaattagacatcrttgaacataaagtggggttcaatagacatttgatttattattattgtctactattaacattagattcaaacccataacaagttatcagaggggcaaaaac

SEQ ID NO: 29276 - DNA, 201 bp, Homo sapiens
ttctgttaaagatgaagagcaaacatggagaatagcagtttctggtaaaatcctcataccattgtatagtttaccatatcttgaactcttaaatctatttkaattcatttgccaacaatacactcttggaaagtgctataacatattgaagcaatctctattaaaggcacatttttaaagttgtagcaaaattatgtaaat

SEQ ID NO: 29277 - DNA, 201 bp, Homo sapiens
gtcccatcagtttttaaatatctatctcctagtgtcataacaaatgcactagtactctttggtgaaaggatgattgatgaaatatagatattattcctgtrttatacacaaggaaactaaagtctaaatagcaggttaacctgttcaaggtcaccaatgctatttataccagggctggagcccttgaattctggtccaggg

SEQ ID NO: 29278 - DNA, 201 bp, Homo sapiens
tagcatcaacctgagattgcaccactaagtctcaaagtggaaccatcaagaaaagcaggattttttttctaaaaaaaaaaaaaaaaaaaaaaaaaactcamctaagagtcattggacctagtctattggaaaaggatttgcagttacagcctgcagtgagtggctctgtctcatgactctttgctggaatttctaaagaaa

SEQ ID NO: 29279 - DNA, 201 bp, Homo sapiens
ttttttttctaaaaaaaaaaaaaaaaaaaaaaaaaactcaactaagagtcattggacctagtctattggaaaaggatttgcagttacagcctgcagtgagkggctctgtctcatgactctttgctggaatttctaaagaaaacttttgtgtaaaaagaagcttcagtgtttagacctaagatcctctttcccttctcttat

SEQ ID NO: 29280 - DNA, 201 bp, Homo sapiens
cgcagtttcataagaccttatcctctctattcttcaacttttcagtcaacggtttagatcaaggccaagagggagctactcatcccatgtgcagatataawcaagttaagagggacagaaagtatttgaaagcaggaccctagatcttggaggatgaagtaacaggacatgtctaacaagaataattttaacaggaataca

SEQ ID NO: 29281 - DNA, 201 bp, Homo sapiens
agtccaacaggtgttttaaacatctgaaaaactatcacatggtaaagggagtggcctgttcaatatgggaaaagacttgccacacattaaagcatttttcrtcttataaaattgatgtattcttggaaaagtgtgtaaattcattttacatgaagggaataatttcatgtaaagggaataattttagctatgatttaaagg

SEQ ID NO: 29282 - DNA, 201 bp, Homo sapiens
ataaaagttgaatataacttataaaattttaatttactcaaagtttttctgggttacaacaattgtgtaagatgatagcaccatgacactgatgttcctakgaagaatgaagaagggagagcagcaaggggaccgtgtccatttgcttcagtatagcagatgtttaccagataacagtggccatgtctcctcctcatcacc

SEQ ID NO: 29283 - DNA, 201 bp, Homo sapiens
cgtgcacactgggttacaagggacaaccagcatgcatttcccttgaactcagggtctttacttttcctgcaaatgggaccatgtctgattatttattatgratgaacactttacctagaatttttccttggctcaagcaatcctcctgcctgagcctcctgagtagctgggactacaggcatgcgccaccatgcccagtta

SEQ ID NO: 29284 - DNA, 201 bp, Homo sapiens
gctattccatgttttactttctttgttgctgttaaaatttcatctatgaatctaattgttatttcttttgtttttaatctgccttttaaaactgcttttaraagtcttctttatctttggtatcctacagtttaattatgttgtgtatagatataaatttatgtttatttattttacttgtgatatattatgtttccagaa

SEQ ID NO: 29285 - DNA, 201 bp, Homo sapiens
gaaaacaaagtcttagattattgatttgtcaagtggagataagtgcacactatcgaattgagtaatacctaaaaagcataatggacacattagaatagataagaaaatagaattgttaggacatggtgacattttatgaaggagctgagaaagagggaggaatcaagaacagcccccagtttttatctgggtaactaaatt

SEQ ID NO: 29286 - DNA, 201 bp, Homo sapiens
tagaaaacaaagtcttagattattgatttgtcaagtggagataagtgcacactatcgaattgagtaatacctaaaaagcataatggacacattagaatagataagaaaatagaattgttaggacatggtgacattttatgaaggagctgagaaagagggaggaatcaagaacagcccccagtttttatctgggtaactaaa

SEQ ID NO: 29287 - DNA, 201 bp, Homo sapiens
ttagaaaacaaagtcttagattattgatttgtcaagtggagataagtgcacactatcgaattgagtaatacctaaaaagcataatggacacattagaatagataagaaaatagaattgttaggacatggtgacattttatgaaggagctgagaaagagggaggaatcaagaacagcccccagtttttatctgggtaactaa

SEQ ID NO: 29288 - DNA, 201 bp, Homo sapiens
tattagaaaacaaagtcttagattattgatttgtcaagtggagataagtgcacactatcgaattgagtaatacctaaaaagcataatggacacattagaatagataagaaaatagaattgttaggacatggtgacattttatgaaggagctgagaaagagggaggaatcaagaacagcccccagtttttatctgggtaact

SEQ ID NO: 29289 - DNA, 201 bp, Homo sapiens
acctcactccctgcctattttattatgaaaaaaatcatgaaatgcctctacgaagcctctgttaattgtgaccaaaattcaagcatatgaagaacattacyggaaagaaaatacaacccattataacctctttgttacgtgaatgctgcatatactctgtgatttgcatacaagttattcatggacagaaattaggtttta

SEQ ID NO: 29290 - DNA, 201 bp, Homo sapiens
gaaaatgatttgagtcatttatatcttatacttaggaaataggtcaaaggaagaaaagcaatttgaaacttttgtttctacctcactccctgcctattttrttatgaaaaaaatcatgaaatgcctctacgaagcctctgttaattgtgaccaaaattcaagcatatgaagaacattactggaaagaaaatacaacccatt

SEQ ID NO: 29291 - DNA, 201 bp, Homo sapiens
ttgtaactagtaaacagcagggccaagatttgagccgagatcagcctgattccaaagcccatgatttttttactacttgctgagctgctatagtgtgagayaagagagctgctctcatactaatcagttgtgtgacatgagcaaatccctttctgccctgggttttaggattatcatctataatgaggcatttgaattgga

SEQ ID NO: 29292 - DNA, 201 bp, Homo sapiens
aaacttagtacttcttaaactggttatatgtgtatatcgtcagtgacttgagctgcttaatagtctgcaaaagaattctattcatactcaattttcccttytgctttgccttttccaaccttgataatctcagtttaggcagtaactatcaggcagaatattccaattgatttagctttaaatataagcttcattgtgttg

SEQ ID NO: 29293 - DNA, 201 bp, Homo sapiens
aattaatagaaaactttacaaatggcctgcagaacgcagcttgacatttttatacagctgtatggcatttatcattaggtcaaaaagagtctcaaactcamcccatccccacaatgatttagccttttttcatttttctctttaaggcaagaaatcacatattcgaactcttatgttgaaagggctccgcccatctcgact

SEQ ID NO: 29294 - DNA, 201 bp, Homo sapiens
ttaatatctatggagatacccccttacacctgtgagtattatgtagcattccataggttctccaggtatactgcatgtacttgcttacaatattaacaagmtattttcttcaaatctagggcatgctacaatggcaaatttgaagttgccaaggaaatcatccaaatatcaggaacagaaagtctgactaaggaaaacatc

SEQ ID NO: 29295 - DNA, 201 bp, Homo sapiens
aatgacatattgggacaacgaatggcctgactttctagtgatgagagttctatgaggttttcattcctgaaaatgaagagaaaccctctccattcatacasaaaggagggcccgggcccactcttaagcacatcaaagcacacagatcccgcctttggcagttgcgtgtgtgtacaactgaaagtaagacttggcccaaaa

SEQ ID NO: 29296 - DNA, 201 bp, Homo sapiens
ggagcaacaagtaaaaggattacatcttcatcttccacatagtgtggttaaacagaaaaaaataaatattaaaaaaatcaattatttttacattgtgtatrtaaatatccaaagaagcagctaaattagtcaaagtgcttatctttgggaaataataatggaaggagaagtaaaccagagaactttgtttttcaaagttga

SEQ ID NO: 29297 - DNA, 201 bp, Homo sapiens
aatttgaaaaaccaagagtcacatgcaacttagggaggaaagaagagccctggattgcttttattattattattattattattattattattattattttwgattttttcagcacaattacttctttttagaaacctactcctcataataaagggcattttaaattgaggagataaatatatactcactcacagcctttag

SEQ ID NO: 29298 - DNA, 201 bp, Homo sapiens
aaatttgaaaaaccaagagtcacatgcaacttagggaggaaagaagagccctggattgcttttattattattattattattattattattattattattttagattttttcagcacaattacttctttttagaaacctactcctcataataaagggcattttaaattgaggagataaatatatactcactcacagccttta

SEQ ID NO: 29299 - DNA, 201 bp, Homo sapiens
ggttaaaatttgaaaaaccaagagtcacatgcaacttagggaggaaagaagagccctggattgcttttattattattattattattattattattattattattttagattttttcagcacaattacttctttttagaaacctactcctcataataaagggcattttaaattgaggagataaatatatactcactcacagc

SEQ ID NO: 29300 - DNA, 201 bp, Homo sapiens
aggcaaattataaattaatagaagattgcactgcattctgctttgcatttttccttctgaaccttaagaattcttatgtcacgctccagatgccctggacycctaactgttctcaagcattgacttgtggcattgactatccctggcttagaacagcatgtgaacaaaggaaaagcttttttaaaagggagataatcagaa

SEQ ID NO: 29301 - DNA, 201 bp, Homo sapiens
ttggttaaaatttgaaaaaccaagagtcacatgcaacttagggaggaaagaagagccctggattgcttttattattattattattattattattattattattattttagattttttcagcacaattacttctttttagaaacctactcctcataataaagggcattttaaattgaggagataaatatatactcactcaca

SEQ ID NO: 29302 - DNA, 201 bp, Homo sapiens
tgggccatatattttttttcttccttgctgactccttattttatttcactgttcaacctctctcctagaggttgtgcttagagatgctcctatccccagcyactgtgtgttagatcttaattagctgaagccactcacagtaaatctttccccttgcccagggattggtttagaaagttgcaaatgacctagtccagactg

SEQ ID NO: 29303 - DNA, 201 bp, Homo sapiens
tcatgacaacccatgagttaagtcttaatattattcccattgcacatatgaaaaaacttgggtatagataaattagctaatttttctcaagaacacagagytgatataaatcagattctagattcgaatctaggactatcttaaactgcaccttaactcttaatcagtatatgatattacccctcacgttaacaacataag

SEQ ID NO: 29304 - DNA, 201 bp, Homo sapiens
aataagttcccacttgtggtcatgttagatatcttcttgaaaggatgaggtcatgaaaaagaagtttaattggatcacaaaactgcacacttttctaggtmaaaggtaaaggctaggaaaagaattcattatgctacaagaaagaaagtaacctttgggtacagaactatcatttttaatgattaagaacagcatttacta

SEQ ID NO: 29305 - DNA, 201 bp, Homo sapiens
tggcacacattttgttgttgttgtcagtttaattttatatatatatatatatatatatatatatatatatatatatatatatttcatttcatcacctcagstaatccccaagggcatttacacaattcataatgaccaatgtgacttgacagtgacgctgagggcttggcattgggtgatacagtcagctctgtcttggtg

SEQ ID NO: 29306 - DNA, 201 bp, Homo sapiens
agatgtacatgacatgttgtatgggccaggcattagcatggcacacattttgttgttgttgtcagtttaattttatatatatatatatatatatatatatatatatatatatatatatatttcatttcatcacctcaggtaatccccaagggcatttacacaattcataatgaccaatgtgacttgacagtgacgctgagg

SEQ ID NO: 29307 - DNA, 201 bp, Homo sapiens
acctaggttgaatggtccaaattttcggtactagctcttaatgagagcaactgttatgcatgatctcctgggcggcctgaggcacaggtggttccatttcycctaggatagtatatcaatcgcaaccaaatgcactgcatgttggctctatactaggacagggatgcatggggaaatgagacttgcaaaagtctatcattg

SEQ ID NO: 29308 - DNA, 201 bp, Homo sapiens
taagatgtacatgacatgttgtatgggccaggcattagcatggcacacattttgttgttgttgtcagtttaattttatatatatatatatatatatatatatatatatatatatatatatatttcatttcatcacctcaggtaatccccaagggcatttacacaattcataatgaccaatgtgacttgacagtgacgctga

SEQ ID NO: 29309 - DNA, 201 bp, Homo sapiens
ggaaggtccctttcaagtgctcctgatcactgagacagccttatgaacagctgggtggggccggggggcgggcggtggacacattacactcgagtcaagakactggtaaaagaatccccagatggaagggaaaaggatgaatgggaagtgtatagatcacctaaggaacccttaaagctaaccctaaggaaaacccagaag

SEQ ID NO: 29310 - DNA, 201 bp, Homo sapiens
cttttgcttactttattattatatcatcaaatttaatcctcacttaatgttattgatgagaaaaacagagattaggtaaattgtaccaaatcatacagctrttgtttcagagtctaaattttaacctctgataagactgaagtcttaaccgatattctgtagagcccaagagagggaacctttaagaatattacctcaggg

SEQ ID NO: 29311 - DNA, 201 bp, Homo sapiens
tctctttccctcagaatcaagatttctacagtctctggatgaagacaacatgacaaaacaacctggggtttgctgctgcttgtgtttcctataattataarccaattaaaatatgtaaactcagcatgagaggacgtaagatgagagcagttttaattggaagaaatgtcattgtctcagtgttgggataatggcttatgt

SEQ ID NO: 29312 - DNA, 201 bp, Homo sapiens
ctcaatgtctactttttttttttttttttttacagtcacaatattcttctctatgaggatgggcatgctgtggtggcagattttggaggtgagataccccmaaatggcatcctttttttctttgttcctagctggtacaatatggtgcctgatattgtaccatgaaactgaacactgaacactgacagctatactacactg

SEQ ID NO: 29313 - DNA, 201 bp, Homo sapiens
taagacagatttcagtgaagatacattttagacttattgcagatcagggtactctgtggttaagaggacaggctaccataagcttaggcgatagaaagttwtgtcattgtcttttaaggagtagaaagctgtataactgcttctcagggatcttttaaatctatgaagaatattcacaaatatagtaatatctgtaagatg

SEQ ID NO: 29314 - DNA, 201 bp, Homo sapiens
cccttatgaggtgtattattctgtttattcattcatatgcttgttcgcagactgtcctcctctgctacaactgagcactgtgaggcaacacatccttttaktcctgttcaacattctatccccagtgtccacaactctgagacaaaggaggcagaaatatttattaaatattcttaaatcaacagaagggattctgtttat

SEQ ID NO: 29315 - DNA, 201 bp, Homo sapiens
aagatattaaagtgatatatttgttaagtgtgtagctggataaaatggtgatattcttttgcaatagcaaaataactcagttacctttgaaggtctttaartagttttgattgagaccatcaggaacaggaaaataaaatattgccagtctctttagtcattgtatgaagtgtactcattaaagggttacctcttaagctg

SEQ ID NO: 29316 - DNA, 201 bp, Homo sapiens
aagaattcccccaagatggagaagtaagagaaatgtgatgtaataatgcaaaatttgggttttcctatgcatacctgtctcagggatgaaagaaaacatgragggtgtttggatggagtgagagtacctataaacaaagaagatacattcgatatctcccattaggagcatcacatcatacaagaaagaacgctttaattg

SEQ ID NO: 29317 - DNA, 201 bp, Homo sapiens
aacacaaatgtatgtgtcattttccctattacgctagcctcttcactgatctaattccattggatatgcatttatctatcatttattaagcagctcttatrtattgaatcatgtagtaaatattggacacccaatgatggattagagatctcttcagtcctgggggaattcacagtttaagggaggaggtcagagaaacac

SEQ ID NO: 29318 - DNA, 201 bp, Homo sapiens
gacctcagactcttctcttcattcaggcagtgagcatgaaaagatctggatgggactggatatagcagccaccagtctttattgaaatagccctggggcaygactcgaacctgtgagggaccataaaggggcatgatttctgcagctgtgtttactgtcagtgattgtacagactcaaacatggagctagggataatatgg

SEQ ID NO: 29319 - DNA, 201 bp, Homo sapiens
tgagcatgaaaagatctggatgggactggatatagcagccaccagtctttattgaaatagccctggggcatgactcgaacctgtgagggaccataaagggscatgatttctgcagctgtgtttactgtcagtgattgtacagactcaaacatggagctagggataatatggtaatctagatgagacatgagtgacatagac

SEQ ID NO: 29320 - DNA, 201 bp, Homo sapiens
ttttaggagattaatagggcagccgtgtgcaggttactagaggacagatggtggaccaggaggttcccaggtaagtcaagaagaagcaaagaaatgataayagatgttgagaaatattggcccagtggagtagatggagagggtttgctgatcaatggaggaaaaaagagttgtcagatgtgacagtctgcttttcagtct

SEQ ID NO: 29321 - DNA, 201 bp, Homo sapiens
tctcatatttccaggaggctctgaacattccgaatgcagcaatctaccatcctggcaaaataaagtgctgcctaccccacggtctttctttttcaggtttmtaaatgatctgtcaagggttgcagactcagaggccgatgttgcttgatggctattttcctgtaaaagtggcatttcttttctggaccccacaatggacat

SEQ ID NO: 29322 - DNA, 201 bp, Homo sapiens
atccagcactgcgtgatccaaagcttcagtaggttcatgatcagaagcctacacttctaactccaagcccaactgcccactggaaattgaagaatccaaaytactaatgagaggggaaaccccatgcattcactacagcagatcacaaggtttctgtaatacagccatgttgtggagcagaaaagcagtgagcttcagtat

SEQ ID NO: 29323 - DNA, 201 bp, Homo sapiens
agcatggctcctagtctgaaggagtgtgcttctggtgtgccacatatcaaagcttaataaataaccaatataaatatgaccatggaggcctggatgtgcasaaggccacagagaacttcttacagcatccacagtcatggtcttgtcaatacagaagccgggagcagcagttggcccagcaggaaatgtcaaaacctgggt

SEQ ID NO: 29324 - DNA, 201 bp, Homo sapiens
agtggggtaagaacccccacattactggcaagagaagaggttttcaatgagagcaaggcaccccagctacataatatcattttgttattcagggtctgacrgcaaagaatacacagaggaggagaggaaagctttggtgttgtgtgatgaggcaaagggtcccagaggtttggtatacattcgcttaaaacaaaacaaaaa

SEQ ID NO: 29325 - DNA, 201 bp, Homo sapiens
gtttagctgctctcttttaaaaaaaataagtaagtaaaataatctcaactgtcattagaatggaaaaaccttcatcattgcagggagataactcacaaaaatgtttttgaaatataataacgtaagaattcacatacttaaaatggatagtaaaagagaacttacattcattgagtatcttttacagatgcatatatatgt

SEQ ID NO: 29326 - DNA, 201 bp, Homo sapiens
gcataacacaatggctatgctgtcattgatggaaacaaacaatctttatgtgaaaaaggtagattacccaataactagtcagaccaaacctctgaattatrtaggccctaaagctcctagaaggccaagaaggcgctatatatagtgattccaaatattccctatggagtgctacacacctttggaaagatctggacagag

SEQ ID NO: 29327 - DNA, 201 bp, Homo sapiens
acactaccttcataggactaacaaattagccacaagattagaaataatggtttaggaatcacatagctggagactgaaagattcgaaacctccccagattscttctggggataaatcactattgcaaaacctaagatcagtgcttgagatattttgcagatgctgtacaggatggctcagctgctaccacccagactgata

SEQ ID NO: 29328 - DNA, 201 bp, Homo sapiens
tgtttccccttcctcttctattcattattttccagtgtaattgaaattagatacatgaattttaattgattttttttcttattcttacattaaatatcttstttttcaagaataatttttgcccgtacgatttaattttgtcatatttaccacaatcttttagaaaaatgtttgactggtagtaatgttatctggaattct

SEQ ID NO: 29329 - DNA, 201 bp, Homo sapiens
ataatactgagatataaaatactgctactgagatatatatatatctcagtattattcttatatatgtatttcagtagtagcatttaatatatatatctcartattttatatattgagtatatataatatatatctcagtagtagttttttaatatatatatatcagtggtattattatatattactattatattaatagta

SEQ ID NO: 29330 - DNA, 201 bp, Homo sapiens
aaaacttttgttcaagttcagtttctgcctctggctagctctgtgagtttctgcaagtcattcgaactttctgagcctgactttgcatccccaaaacgccrgtgaaattaattccttcccagacaccccacaggggttttataaaaatgttacaagctaatcgatagaaaagtatatgaaagctataaagccttctgcaag

SEQ ID NO: 29331 - DNA, 201 bp, Homo sapiens
agaatgcaatcccacttacaagagccacacacaaaataaatacataaataaaacacctaggagtacatctaaccaagaaggtgaaagatatctacaaggakaactacaaaacactgatgaaataagttatagatgacacaaacaaatggaaaaatattccatgctcatggattggagaaatcaattactaacatgtccata

SEQ ID NO: 29332 - DNA, 201 bp, Homo sapiens
ctccaaaagactcctagacctgataaatggcttcagtaaagtttcaggatacaaaactaacatacaaaaatcagtagcacttcttaatactaataatgttygagctgagaatcaaatcaagaatgcaatcccacttacaagagccacacacaaaataaatacataaataaaacacctaggagtacatctaaccaagaaggt

SEQ ID NO: 29333 - DNA, 201 bp, Homo sapiens
cccaaagggagaaggcagcttaggagagcaacacgtataggacttatctgacactctaaagaagagattggtaaactacagctcatgggtaaatccaactscctgcttgtttctgtaaagttttattggaatacagccacactcatttgtttacatattatctatgtctgtgtttgcactgaaacagcagagttgagtagt

SEQ ID NO: 29334 - DNA, 201 bp, Homo sapiens
ttaaaaagaatcagagtaaacagacaaagataaacatgaataaaattgcagaggaggaaacatcattcattcattcaatcaatcatttctttaatccatayttactgagaaacaaggcatagtagaaaataggaaacacaagattagatggagtggtaaatgacaaaaacaagtctgccgtaaggagactctgagaaatgc

SEQ ID NO: 29335 - DNA, 201 bp, Homo sapiens
ttttatcttcatgttcatctccccttgtaggcatcctcttttatagtcatttgttgaccatttcttctcatctttacttatcaccagcctcccatatgttrtcattctgactaattctacctttttttttttttttttgtcatggagtctcactctgttgcccaggctggagtgcagtggcaccatctcggctcacggcaa

SEQ ID NO: 29336 - DNA, 201 bp, Homo sapiens
agaaccagaaagccactatggtggatagggaggggagacagggcagacagggacaagatgaagttccagaaggaggtagaggccaggtcatgagggctttrtcagccaggacagggtgttagggtgttgatctacatgtgttgggcagccactgagggattggaatcagggaggtgacataatctgattagcattttaaaa

SEQ ID NO: 29337 - DNA, 201 bp, Homo sapiens
tgggagaaggaaagggtttccacaggaggttggggctgcccggccaaggtggtagtgcttaagtatggtaaataaggtagtcacgtgggagagtaccctgrcagaggagatcagaatcgaagcccaggaagaacgttatgtatgagaagggtggagagaatagtggctcaagtaaggccagagcccaagaatggtaagcag

SEQ ID NO: 29338 - DNA, 201 bp, Homo sapiens
aaagatgcataatttgaatctaatcattaggaaacctctgataaaaccaaattgaaggacattttgcaaaattactggcttgtcatcctcaaaaatgtcayggttaggaaattcaagtagagatggagagaccatttcagacagaaagaaaataaagaaacatgacaattcagtgctgcatgtgattctgaattagattct

SEQ ID NO: 29339 - DNA, 201 bp, Homo sapiens
agtagagatggagagaccatttcagacagaaagaaaataaagaaacatgacaattcagtgctgcatgtgattctgaattagattcttttgctataaaaagygttattgagataattggcaaaacttgaatggcgtctgagagtagatggaagaatcaaatgattgtattgtggttatgtaggaggatgtctttattttgga

SEQ ID NO: 29340 - DNA, 201 bp, Homo sapiens
agaatgctactctgcagtggaagaaccaaacacttggtaaatggcttgtggatgtttcttgatgtgcagaacctccgttggatggctcctgaggtgttcaygcagtgcactcggtacaccatcaaagcagatgtcttcagctatgctctgtgtctgtgggaaattctcactggcgaaattccattcgctcatctcaagcca

SEQ ID NO: 29341 - DNA, 201 bp, Homo sapiens
aaaatgaatgggttgaaactcaagcaaaagacaatgaagttggagcagccagctggactgctgtttgagtaatccagttgattacaacacacagactacartggttaccatggagattcaagggcaagggtaaacctgagaactatttcaaaggaaacatcataaagaggtaaaagactggatttcagaaatggaagagag

SEQ ID NO: 29342 - DNA, 201 bp, Homo sapiens
ttgcagagtttgaggctggacttctccaggctcaagattccatagcttttgaactttccttggattatatgttgtaagtaagcctgcttcattaaaagctstcatatttccaggaggctctgaacattccgaatgcagcaatctaccatcctggcaaaataaagtgctgcctaccccacggtctttctttttcaggtttct

SEQ ID NO: 29343 - DNA, 201 bp, Homo sapiens
catttccaagacaaagtgccttgaataggcttaagtcagcaaactacagaagaaacaggatatactaggcccctgctggatagctgatgcctgcttgtcarcaaccccctttcccccattagctgccctcacccaaaccaaagaagtttagtctaagatgaaagtttactagcctgcaaaatagctcacttttgtctgttc

SEQ ID NO: 29344 - DNA, 201 bp, Homo sapiens
gcaaaagttggaaacattttccccaagaactagtacaaaacaagaatgtctattctcaccactcctattcaacataatactggaagttgtagacagagcarttaggcaagagaaagaaataaaaggcatctaaatgggaaaagaggaagtcaaattatctctgttcactgaccatatgatttcatatctagaaaaccctaa

SEQ ID NO: 29345 - DNA, 201 bp, Homo sapiens
acaatatacaaataatcaatgaaatgaaaaattggcttttgaaaggataaacaagattgataggccactagccagattaacaaagaaaaaaagagagaagrctcaaataagtgaaatcagaagtgacaaaaataacaacaactgattccacagaaatacaaaagattctaagggaccactataaatatctctgtgtacaca

SEQ ID NO: 29346 - DNA, 201 bp, Homo sapiens
aaaacctctgggcttcagtaaaagcactgttatgaggaaactttatactggtaaatgcctacatcaagaagatagaaggatctcaaattaacagcttaatrtcacaactggaggagctagaaaaacaagaacttaacctaaagatagaagaagaaaagaaacaactaaaatcagagcagaactaaattatattgagaccaa

SEQ ID NO: 29347 - DNA, 201 bp, Homo sapiens
ctttcaagccatgtaaaatagtatacgtctgttataattcaccaaatcaaagttcccaagtttgcaaaagccacgctcagaagaatgtgattttaaaaaawtgattccttttggactgcatacccatctgaagtcttctttggaatgcaattcagtcagaagcaattgtggcactagcaaatattctgagaattcatgaaa

SEQ ID NO: 29348 - DNA, 201 bp, Homo sapiens
catttcaaatgaaatgtatttagacaaaagctactaacagcacactgagtagcagtggtaacgtatagccagatatgctgtggcatgtatgtaaaaatcasgcattcagccctggccaaatgttggacacgtcagataaggaagctaaaaatctcctgcctaaatgaggactgtgtaatttcactctgcctttccaacatg

SEQ ID NO: 29349 - DNA, 201 bp, Homo sapiens
tgcagcattttgttttaattattgttgatgtctaaggttcaacttaactctgtgggaatgtcatctatatgaaataccttcaccatttgaagactgtgtcwgttgtcgatattcagtcagtcacaattgaatctaaccactcgtcatctggaacagatctccccttcttacttacaaagcagtcaggagtaattctgtcca

SEQ ID NO: 29350 - DNA, 201 bp, Homo sapiens
attttgttttaattattgttgatgtctaaggttcaacttaactctgtgggaatgtcatctatatgaaataccttcaccatttgaagactgtgtcagttgtygatattcagtcagtcacaattgaatctaaccactcgtcatctggaacagatctccccttcttacttacaaagcagtcaggagtaattctgtccaacactc

SEQ ID NO: 29351 - DNA, 201 bp, Homo sapiens
ctagaatccagctgtatgttctagcctattgatttccccttattatttatcttcatcaaaaaaataataaagtaaatctagaatgattttcttttcttaakgtatccatggtagctcctagtaatcagtgtttttctaagagtgcagaaaacttctgtttaaatcattcctttctgaagctttgcctataatgtacattaa

SEQ ID NO: 29352 - DNA, 201 bp, Homo sapiens
ccaggaggctctgaacattccgaatgcagcaatctaccatcctggcaaaataaagtgctgcctaccccacggtctttctttttcaggtttctaaatgatcygtcaagggttgcagactcagaggccgatgttgcttgatggctattttcctgtaaaagtggcatttcttttctggaccccacaatggacatgacctttatc

SEQ ID NO: 29353 - DNA, 201 bp, Homo sapiens
agaggacttggtatatcggcttggggaattgcaggggaatgctgtggtaaggcttttattataataagaccctttggggggagtattgaatgactgggggrtagaatgtcatttaaggatctattaattctattaaatgctccaaaaactcttttttaagcttctcttatgtaccaggcactgttctgagtgttgaagata

SEQ ID NO: 29354 - DNA, 201 bp, Homo sapiens
caggtttctaaatgatctgtcaagggttgcagactcagaggccgatgttgcttgatggctattttcctgtaaaagtggcatttcttttctggaccccacartggacatgacctttatctcgttttcctgagttaagtggcagttgcagtatcccttagtgtggtaatttcttgcctcatgagcacacaggggttcatcgaa

SEQ ID NO: 29355 - DNA, 201 bp, Homo sapiens
tcaagagacagaaagaatgccaaaaagaagaagcatttagcaaaagatgtggagaagggtatgggttgaagtttgagaagtaggaaggaccagaaccttayaggtagagcatttgtattttattccaaatgaactgggaagcaattgaaaagttttaagtaggtgaatgatgtaatctgtttatattttgaaaagatcacc

SEQ ID NO: 29356 - DNA, 201 bp, Homo sapiens
tggcaaactgcaaaagcccaaagaggaaaagattcgtctaggccttgaggctggagagagatggatagtttaggattatattttggaggcagagctaaaakgacttgaattgagtgagaaatgtgagggaaagaagctattaccaaggaggactccaataattttggctcaaggtaactgaacgatgtaatactggtaact

SEQ ID NO: 29357 - DNA, 201 bp, Homo sapiens
tttaggattatattttggaggcagagctaaaaggacttgaattgagtgagaaatgtgagggaaagaagctattaccaaggaggactccaataattttggcycaaggtaactgaacgatgtaatactggtaactgaaatggaaagaactggcttgggtgctgggagaattaagagttcttctacagtcatggtgaagttctg

SEQ ID NO: 29358 - DNA, 201 bp, Homo sapiens
ctggtaactgaaatggaaagaactggcttgggtgctgggagaattaagagttcttctacagtcatggtgaagttctggggggaactagggtagttgctttragaatgacaaatgatgaatggatgctagagagattatagatatacaattaactgactgatgtagttagatgctaggatgaagattttgataaattcaggt

SEQ ID NO: 29359 - DNA, 201 bp, Homo sapiens
cctagtcaaatttcttcttgatcagaatgtcataaacatcaaccaccaaggaagggatgggcacactggtaagactgtggtgaaaacaccactagttctakatgcttatcaatgattaagaataatggtatgcaaagggatgtgggggcattgggagtgctcaactccagtgggaaagggtattttatcaactgccagcat

SEQ ID NO: 29360 - DNA, 201 bp, Homo sapiens
tatgtccacaatcaaatttccattggagtcctgtggggcaagaggcactggaacatcacaggccagtaaaattgcatgtggtatgttagaaagctgattayggtcataaaagtattacaagcttatggaagcatctacctatgcctgaaatgaagtctcatttttagcctggatacagtaaatattttgctgtagaaggta

SEQ ID NO: 29361 - DNA, 201 bp, Homo sapiens
tctactctatagcttaaggaagtgaggccaaagatgcagtcatttttaaggcaggtagaaagaattaatcagtgtgaactgatgttagctttcaggaaaawctgatgtctccaaatgaacattttgtaataatttaattttatttaatttaacatacatacttttattttaagtatttgcagagtactggctaacccctgt

SEQ ID NO: 29362 - DNA, 201 bp, Homo sapiens
gtgtttaggaagatgaatccatgcatgcagcttaaaaaattttacacaagatcagagggttgagaggaataataaatttctcatttagaaagtttagtgcrtgtgtatctcatgttttagcatcatagcaaggtaacagcaagcaattgttggataaaggaaagtatcatttttttaaagatgaagcaaacatgagaaagc

SEQ ID NO: 29363 - DNA, 201 bp, Homo sapiens
ttagttgagctctccaagtctcaaatttctcagctataggatgaaaataagaatatcatcttcttcattaggttgcaatgaaggtgacgtgagaatgcaayttctacatgtctaatatgtggtaaacactaaataaatataaattggatatttttttctgttttccattagctcatgcattttagtctttaacattcctct

SEQ ID NO: 29364 - DNA, 201 bp, Homo sapiens
taaagcaagtcttaataaatttcaaaaaactgaaactataccaagcatcttctcagaccacagaggaacaaaattagaaatcaataccaaggaaaactctkaaaactacacaaatacatgaaaactaaaaaacttactcctgaatgacttttgaataaataatgaattaaggcagaaatcaaaaaattatttgaaacaatg

SEQ ID NO: 29365 - DNA, 201 bp, Homo sapiens
gagcatgtgtgagtgtgcatgagtgtgtaagtatatgtgtgattatgtgtgagtgcctgtatgtgtttgtgtacatagaaaaaagtacaactctttttttwaaaaaaaaaaaaactccttcctctcatgatattccaaatactttgtcaacattttattaagtccgttgcttctaagccccacattaagtgtgtgtgggta

SEQ ID NO: 29366 - DNA, 201 bp, Homo sapiens
cattgctttcacaccacatatatgttgcttaatgtgatatatgttggtaatcaggctaatggaattttcttgccttattaaagctgtttgctttaagtttytctacaattgccttaattttctacacacctggtcaagagatagcatttcaaaataatcgagggagctaaaacatgcacactacttgaaaaataatatatt

SEQ ID NO: 29367 - DNA, 201 bp, Homo sapiens
gctaggatgaagattttgataaattcaggttttgagtcagatgaactgggaaggaagtgaccccatttaccaaatcggcaaaagagaaggaggagtttgaraaaggagaaggatcaatacagagtaggaatcattaggaaattcatatttgatagtagataaacacatcagctttggaatctaaaagatgaggatttgaat

SEQ ID NO: 29368 - DNA, 201 bp, Homo sapiens
ttgctttcacaccacatatatgttgcttaatgtgatatatgttggtaatcaggctaatggaattttcttgccttattaaagctgtttgctttaagtttctytacaattgccttaattttctacacacctggtcaagagatagcatttcaaaataatcgagggagctaaaacatgcacactacttgaaaaataatatattct

SEQ ID NO: 29369 - DNA, 201 bp, Homo sapiens
catacccaaggttataccgctagaaattgtaacctatgcttaagagccaggactcacacttggatatgacttaaaccaaataattctgaactcttccccarctagttactgttaagataaaagctgctttgtatcactttgccatttctctgggatctatgttgagtggaaaaattctgtgtttataaaaatgttattatc

SEQ ID NO: 29370 - DNA, 201 bp, Homo sapiens
atattcctctcaaggtctgtctttggaggagatgaaaagaagtcttcaatacacacccattgacaaatatggtaagtaggcagattctttaggtttgttargaaaactacccctaggaaggtgatgtctatttgacaaaaagggagaaaacattgcatattgtaatatccaaaatgacagatgctttaaaaatataaaagt

SEQ ID NO: 29371 - DNA, 201 bp, Homo sapiens
ttaaagctgtttgctttaagtttctctacaattgccttaattttctacacacctggtcaagagatagcatttcaaaataatcgagggagctaaaacatgcmcactacttgaaaaataatatattctcaaatggaaataagtgttactggtggaggaagacatacatcacacatagaggatcatatatgcatttgcatatgc

SEQ ID NO: 29372 - DNA, 201 bp, Homo sapiens
ggaagccagaggatggacaattgcctttatcatcagctgcgatatcaatgtgttagggctgggatgtccttttaccaacctttaagcctgagaggcactaygtttaattggaattttagcacaatgggcccatttatccattgcaacttcctttgactatttgaaggactgaaaaagtatctgtcagttaaagagatcaga

SEQ ID NO: 29373 - DNA, 201 bp, Homo sapiens
  misc_feature (1)...(201): n = A,T,C or G, or insertion/deletion polymorphism (see Tables 1-2)
tgggatcctcaccaattcacctcatctgcagagactcattacctaaggcattagaaaccttttaagaaacaaagaaaaatgtatgttctgaatagatgcanacaaactatttgggcacatttaaaaaagggaaattttgtgcttctgactcccaatacatgtctagaatgcagatgagtgctttttatcatcagttttaca

SEQ ID NO: 29374 - DNA, 201 bp, Homo sapiens
ggtggaggaagacatacatcacacatagaggatcatatatgcatttgcatatgcagggaaggggcaacaatagagagaaatagcatcaacctgagattgcmccactaagtctcaaagtggaaccatcaagaaaagcaggattttttttctaaaaaaaaaaaaaaaaaaaaaaaaaactcaactaagagtcattggacctag

SEQ ID NO: 29375 - DNA, 201 bp, Homo sapiens
tgactcccaatacatgtctagaatgcagatgagtgctttttatcatcagttttacaacataattggccagtccagtaacagatccttttgagggggaaaaygcactccaagtgtcacatcctcacatttttttaatagacataatatcttttcttcaaacctttacagatgtatcttcataaacacaaaacatagggcatc

SEQ ID NO: 29376 - DNA, 201 bp, Homo sapiens
gacaagagacctttcttatgaaaataaatatttcgatccaactgcatactgctagatgtcttaatgaaaatgtagatgactgggttggttatgaaaactcrgctatcaaaggggagcaaaagcagcaatagctattgacaaatgtgctcactttcatgaagcaatgaatggctttcttgcttcagagtgaaaagaaaactg

SEQ ID NO: 29377 - DNA, 201 bp, Homo sapiens
attgctttctttttctttcagaaaaaatgaacttctaagattatgtttttgcatgcttagcacattaaatttctttctacgtgcatgcagcactgagctcrctccgaagatgttcaattaactgtaattgtaagccaaattatagcagcaccaggaaagagttattccaacagagtgattatttgggttaaattatttcca

SEQ ID NO: 29378 - DNA, 201 bp, Homo sapiens
attagatagatcaacgagacagaaagtcaacaaggatacccaggaattgaactcagctctgcaccaagcggacctaatagacatctacagaactctccacsccaaatcaacagaatatacatttttttcagcaccacaccacacctattccaaaattgaccacatagttggaagtaaagctctcctcagcaaatgtaaaag

SEQ ID NO: 29379 - DNA, 201 bp, Homo sapiens
atgaagcccacttgatcatggtggataagctttttgatgtgctgctggatttggtttgccagtattttattgaggatttttgcatcaatgttcatcaaggwtattggtctaaaattctcttttttggttgtgtctctgcccggctttggtatcagaatgatgctggcctcataaaatgagttagggaggattccctctttt

SEQ ID NO: 29380 - DNA, 201 bp, Homo sapiens
gaaagaaattggtagtgtgaaagttaaaacttcaaaataaacatgatgaaggtatttgtgataaattaaatcatcccttgatgactataaatgactcacaraaatatagtttacattgatctcatttggacagtagtttacttactttgctaaccttaactgtatattaaggatatgtactcattgtcaagacaagggaga

SEQ ID NO: 29381 - DNA, 201 bp, Homo sapiens
ataaagctggtaagtgacagactaaggttattacacacactagatagttaggtaatccaaaatataggaatgtatagtcatttagccccacaaaacaggarcagtagtcagataatccaaaatatagggatgtatagtcatttggccccacaaaacaggagcagcactgactgaatagcaatgcaatgtatttttcagatc

SEQ ID NO: 29382 - DNA, 201 bp, Homo sapiens
aaaagagtataaagattcctcaaaaaattcaaaatatgactaccatgtgatccaacaacctcatttctgggtatatattcaaaagaattaaaatcagcatrttgaagatatatctgcattcccattttttaaaaatggtgtctcattctattgctctctcattcgtattgcaacattattcacaatagccaagatgtgaaa

SEQ ID NO: 29383 - DNA, 201 bp, Homo sapiens
ctcctcactcagcttccagagtagctaggactatgggtttgtgccaccatgcctgtctaatttttaatttttttttatagaaatggggtctcactatgttkcccgggcttgtctcaaacttcctgccttaactgatcctcctgctccaatctcccaaaatgctgggatcacatgcatgagccactgaacccagctgacaat

SEQ ID NO: 29384 - DNA, 201 bp, Homo sapiens
gttgcttgaaataaacatgtgaatttcaaaactgacatgaccatttggtttgcagcggctgcggcagcagacatggcttaccaccacatcagacctcccaytggctattccattcccaagcccatatcatctctgctgatacgagggtggaacgcatgtcctgaagtgagtaatttttatttcctcttagaaaatgtgtta

SEQ ID NO: 29385 - DNA, 201 bp, Homo sapiens
aggtagattggatttttctcttaaagtttgtagggaatcagtgtccataaataaaaagggaatgaaaactgtgactggaaactgagaatgttgatggacartgattcagctctgagctgcttcggcttttcttccctggtctttctattgtccagcaaatgaaacacactataaaaccacaagaaaaaaaaacaaagtatt

SEQ ID NO: 29386 - DNA, 201 bp, Homo sapiens
atctttagcatagctgcataagataaaagttttattttggcagtattcagttaaaaagtatttagatcaattagaggtcaatcttgagaaatccaaccaargtatgaaaggataaattattactcttaacttttgaccttaccatttgcccattctgaaggaatcctaatatactttaaaaaaattccacaaatattgact

SEQ ID NO: 29387 - DNA, 201 bp, Homo sapiens
atatttatttggaaggtactataggtattatcagaacaattttaaggtggttacaattactctttttttatataatcaaggaaattagcaaaaaggagtgwcagaactgctccagtgcacatagtcattgtgagagctgaaattctaattagggaggctaattctatgacctgcatcttaaccctgccttatatgcagctc

SEQ ID NO: 29388 - DNA, 201 bp, Homo sapiens
tcagtgggaaaaaaaaaacaaaactttttttttaaaacggagaaaacataagtttatagttcaagcatatagagccaatgaaagaagaaaggttgaagackcaatatttatttcactttcttgggagagcaggtagaaaaacgggaagatttggagactataacattaattttactatttgtagctctttaccaaagtttt

SEQ ID NO: 29389 - DNA, 201 bp, Homo sapiens
tatttcaactttggtgaatctgacaattatgtgtcttggagttgctcttctcggggagtatctttgtggcgttctctgtatttcctgaatttgaatgttgrcctgccttgctagattggggaagttctcctggataatatcctgcagagtgttttccaacttggttccattctccctgtcactttcaggtacaccaatgag

SEQ ID NO: 29390 - DNA, 201 bp, Homo sapiens
caccgtaatcttgaactaccaggctcacatgaacctcctcactcagcttccagagtagctaggactatgggtttgtgccaccatgcctgtctaatttttawtttttttttatagaaatggggtctcactatgttgcccgggcttgtctcaaacttcctgccttaactgatcctcctgctccaatctcccaaaatgctggga

SEQ ID NO: 29391 - DNA, 201 bp, Homo sapiens
gccctcaaggatgactttgagggatttaagacttcagtggaagaagtaactacagatgcagtggaaagagaaaaactaaaattacaaatgaagcctgaagrtatgattgaattgccagactctcatgacaaaacttgattggatgaggaattcttcttatggatgaacaaagaaagtggtttcctaagataaaatctactc

SEQ ID NO: 29392 - DNA, 201 bp, Homo sapiens
gttgtaaatcagaatttctatagcttgttaaagtcacatcctcagagtttggaaacctctgagctcactatgtctcaggaagatgggaaattcttcttctwcttcttcttccccttaattaggaatacattgtaataataatattttctatgtgacctttgaatacagtagtaaaataacaagtgggggctacttactttt

SEQ ID NO: 29393 - DNA, 201 bp, Homo sapiens
attcatgggaggaggtcaaaatacctacagtaacaggagtttggcagaagttgattccagccctcaaggatgactttgagggatttaagacttcagtggargaagtaactacagatgcagtggaaagagaaaaactaaaattacaaatgaagcctgaagatatgattgaattgccagactctcatgacaaaacttgattgg

SEQ ID NO: 29394 - DNA, 201 bp, Homo sapiens
gaaaagctttataggctaataaaaatgtaaatgagatgttcatcagcttgctgccctggaaaatgatggaagaaacattacctgaaaaattagattcaacrattattgctaaccaaatcaacctgatatgagaaatccctttgtaaccatttgtgttaatttgcatccttatgtcaatctttctatgcactgaatttgctt

SEQ ID NO: 29395 - DNA, 201 bp, Homo sapiens
agataaagcatgaatatatgaggcagaaggacatttctggctgaagaaataatgtgaacaaagcctcaaaggagcaggaagctggatgcagtttgactctrcaattgggtttaggaaagagactaatgagaaatacatttaaaacaaacactgtcagattgaagggaccttgaatgtcatactaaggaaatttagtcttta

SEQ ID NO: 29396 - DNA, 201 bp, Homo sapiens
ctaaatccactttgcccatgctctatgaatggaacaacaatgcctggatgacagcccatctgtttacagcatggtatactgaattattattattattattwttattttgatatggagtttcactcttctgcccaagctggagtgaagtggcatgatcttggctcactgcaacctccacccccaggttcaagtgattctcct

SEQ ID NO: 29397 - DNA, 201 bp, Homo sapiens
gaaattataggttataattgaatactataaaaaaatgccagattttaaagtcacattttaattgttattttaacttttgatgactgcattgtctttttacratattaaaaatgtgtaaagaaacatagttatctttttaaatactcaaatcctaaaagattgtactgaaaataacaattattaagctataagatttcctag

SEQ ID NO: 29398 - DNA, 201 bp, Homo sapiens
gaaagacttaataactgcctggcttaggtttgaattacaactgggttatcttgggtaagacatagtctctctgagccttggtttcctcatatataaaatgrgttgttaggtggggcaaattttgtaagttttgtaaagtatcgagtagagtccctggcgcttagcaggtatgaaacaattttgttttcccactgtccttaa

SEQ ID NO: 29399 - DNA, 201 bp, Homo sapiens
gctagtggataataagctcattgggagttaaaatataaagtgactgtcttgctgcaaaataaaagatatgattagtcttgttctgaaatggcaaagtggtrtccagttgtgtctgtgagccttttaaaggaataattaaaactgggatacacattttagaagagagagatttgagtggtgaataagctgaaaatcacgtaa

SEQ ID NO: 29400 - DNA, 201 bp, Homo sapiens
catgttgaccagatggtgtcgatctgttgaccaggatggtgtcgatctcttgacctcatgatccgctcacctcaggctcccaaagtgctgggattacaggygtgagccaccacacccagccaagtccaacaggtgttttaaacatctgaaaaactatcacatggtaaagggagtggcctgttcaatatgggaaaagacttg

SEQ ID NO: 29401 - DNA, 201 bp, Homo sapiens
gccagtcctcatgtccccagacctctctctggcccccatggacccagcatccaggcccatgtcgctgccaaactagcccctgtagcctgtggcctcaggcytcaggctcattctaatatcagaccagccctcacagctccaggcctgctctgggccaccccagtgccaggaaggcccccataagtcaggctgcaggccagc

SEQ ID NO: 29402 - DNA, 201 bp, Homo sapiens
atgcctaatttaggtaactaagcattttaagcctttctacacttttataatatttgtaattgaaaaaaacccagcaccaatatataaataattaatttacyttcgaaatactgctgtcagaattatgatgcaaactctgcatcacatttttgcataccttttaacccaggaaattcacttctagaaatttattttacgaaa

SEQ ID NO: 29403 - DNA, 201 bp, Homo sapiens
ctacaaaggacgtgaactcatcattttttatggctgcatagtattccatggtgtatatgttccacattttcttttttttcttttttttttttttttgagayggagtctcgctctgtcgcccaggctggagtgcagtggcgggatctcggctcactgcaagttccgcctcccgggttcatgccattctcctgcctcagcctc

SEQ ID NO: 29404 - DNA, 201 bp, Homo sapiens
cctaatttaggtaactaagcattttaagcctttctacacttttataatatttgtaattgaaaaaaacccagcaccaatatataaataattaatttactttygaaatactgctgtcagaattatgatgcaaactctgcatcacatttttgcataccttttaacccaggaaattcacttctagaaatttattttacgaaaata

SEQ ID NO: 29405 - DNA, 201 bp, Homo sapiens
ttttttaatcaatttctgcttttatctttcttaacttcatataatttcactactgtttttctaatttcttaagatggatgcatagcttagcttattaatayttagccttttttttctaacagcattttaggctacacatttgtaagttctgtttttggcacatttaagttgtaatatattttgttactgttcagtttaaaa

SEQ ID NO: 29406 - DNA, 201 bp, Homo sapiens
ttcatccatgtccctacaaaggacgtgaactcatcattttttatggctgcatagtattccatggtgtatatgttccacattttcttttttttctttttttyttttttttgagacggagtctcgctctgtcgcccaggctggagtgcagtggcgggatctcggctcactgcaagttccgcctcccgggttcatgccattctc

SEQ ID NO: 29407 - DNA, 201 bp, Homo sapiens
aggacaggctgattctcttgtcagcaactaatgcagcaggtgactttacctagaagtgaatgctcatttactattctgaaaatcttaagtcacttaagaastgtgctaaatccactttgcccatgctctatgaatggaacaacaatgcctggatgacagcccatctgtttacagcatggtatactgaattattattattat

SEQ ID NO: 29408 - DNA, 201 bp, Homo sapiens
atacaaattttatgtattcagactaatccactgacaggccattttcccatctctctttctctccttgggcctacctattccctgagacacaataatattgmaatcatgttaattaataactctacaatggcttctaagtgttcaagtgaaaggaaaaatcacatgtctctcactttaaatcaaaagctagaataattaagg

SEQ ID NO: 29409 - DNA, 201 bp, Homo sapiens
gggagaagaaacaaacaaagccatctggtttgagaaagaaaggctctttccttttccttttctttttctttttccctttttttttttttttttttttttttttttgagatggagtcttgctctgttgctaggctggagtgcggtggtgcgatctcggctcactgcaacctctgcttctcgggttcaagtgattctcctgcc

SEQ ID NO: 29410 - DNA, 201 bp, Homo sapiens
ctccaaggaacaggaaggtagtgaatgatagtcatggcactgtatgaaaccatgaattctgaacctcaccgtctgggagattttttctgtattagttcatyttgcaaagatttagcatgacattggcacacaaatgggttctgaatcatttagtcctacaatatttagagaatatatttcttcaacctctgtttataataa

SEQ ID NO: 29411 - DNA, 201 bp, Homo sapiens
gatgccaaccttagctttttattcctctgcacaactccagagctcagtagtgtcaaaatgaatgtcatttatgatcagcatgtctctttcagtgcaaaagrcattgaaatgtgtaatactacaaccatattccccttacataccagcatcatatgatacaatttttaacattttctttttgttgcacgcaagtattacatg

SEQ ID NO: 29412 - DNA, 201 bp, Homo sapiens
actccagagctcagtagtgtcaaaatgaatgtcatttatgatcagcatgtctctttcagtgcaaaaggcattgaaatgtgtaatactacaaccatattccscttacataccagcatcatatgatacaatttttaacattttctttttgttgcacgcaagtattacatgcctcttattcaattattttataaagtcaagaga

SEQ ID NO: 29413 - DNA, 201 bp, Homo sapiens
aaggctctactagagaaatagataagatatatatttggaaaacagtatggataaaataatacagaatatgtttcaaatataactgaaaagaacgttgtggrcatggatcttttcatatttagatcacctaactacttatagtaaagtaaacatttaatagggaactcacaataaaattagtagttcatcagcatctattaa

SEQ ID NO: 29414 - DNA, 201 bp, Homo sapiens
cttgggacttgcttaacaatatatctctttggattaaattacatagagttttaggagtatctcctctatcttgtaagcattgcaacatgaatattctacaratttcttttatataagaattcttgtttagcagttctggatttcctagtgccagccttatacaacctgtcattcaaatccttaacgatgggtttatgtgaa

SEQ ID NO: 29415 - DNA, 201 bp, Homo sapiens
catcatattttgatctatttttttgtacgatattttgtacatagtgttcctcaggctcacaaggcttggatgatgagcttgtaataaaatgtctttgcctrtgagggtgtaagccattgtcttctttttctattggaggctgccatgattcatttgttaaacgcttctcaagactttctcctgccaaggctgaagcgggtg

SEQ ID NO: 29416 - DNA, 201 bp, Homo sapiens
aacttagccaggcgtggtggtgcacgccaatagtcccagctactagggaggctgaggcaggagaattgctggaacccaggaggcagaggttgcagtgagcygagatcgagccactgcaccctagcctaggcaacagagcaagactccatctcaaaaaaaatgatggggagggggttgatataggaaattaagaatgaccca

SEQ ID NO: 29417 - DNA, 201 bp, Homo sapiens
gcacattgattttgtatcctgagactttgctgaagttgcttatcagcttaaggagattttgggctgagactatggcgttttctagatatacaatcatgtcrtctgcaaacagggaccatttgacttcctcttttcctaattgaatgccctttatttccttctcctgcctgattgccctggccagaacttccaacgctatgt

SEQ ID NO: 29418 - DNA, 201 bp, Homo sapiens
tctagggtttttatggttttaggtctaacatgtaagtctttaatccatcttgaattaatttttgtataaggtgtaaggaagggatccagtttcacctttcyacatgtggctaaccagttttcccagcaccatttattaaatagggaatcctttccccattgcttgtttttgtcaggtttgtcaaagatcagatagttgtag

SEQ ID NO: 29419 - DNA, 201 bp, Homo sapiens
ctttagtttaattagatcccatttgtcaattttggcttttgttgtcattgcttttggtgttttagacatgaagtccttgcccatgcctatgtcctgaatgrtattgcctaggttttcttctagggtttttatggttttaggtctaacatgtaagtctttaatccatcttgaattaatttttgtataaggtgtaaggaaggg

SEQ ID NO: 29420 - DNA, 201 bp, Homo sapiens
cattgttggacatttgggttggttccaagtctttgctattgtgaatagtgccgcaataaacatacgtgtgcatgtgtctttatagcagcatgatttataaycctctgggtatatacccagtaatgggatggctgggtcaaatggtattgctaattctagatccctgaggaattaccacgccgacttccacaatggttgaac

SEQ ID NO: 29421 - DNA, 201 bp, Homo sapiens
tagcctttattctcttcttatatgggggactaattaaattattgatcaaataataaagaaaagggtatccaaaactatctaaaataattatattcaaaatkaatgtttttgttggagtatttctttgaaaactattaccattgacttttgaccaatgtgggagttaggagcactgatcccctgtacagttgaaaatctata

SEQ ID NO: 29422 - DNA, 201 bp, Homo sapiens
tatagcatactaaggagttccctgagcaatttggaggtaaagctgaggaaggactaaaactctacttgatgtaagaatggccccatcatggtttaccatgyaccctatcctatcccgggagagataaacaagaagggagcttcacaatcaagggtgtctatttgaataggtctacttttggatacgcccaatttaaatagt

SEQ ID NO: 29423 - DNA, 201 bp, Homo sapiens
tattttttagctactgaacacattggggtaaaatttagctgtataaatgagctttggatagtcaattcagtcaattttctaacagtgtatttaatcatcarttaacataaaggtagctagatatacagaggctttatagcagctcagtttccacaacttgctattttaaccttggggaagttactgaatctcatgacctcc

SEQ ID NO: 29424 - DNA, 201 bp, Homo sapiens
ccagggagaagaaacaaacaaagccatctggtttgagaaagaaaggctctttccttttccttttctttttctttttccctttttttttttttttttttttytttttttgagatggagtcttgctctgttgctaggctggagtgcggtggtgcgatctcggctcactgcaacctctgcttctcgggttcaagtgattctcct

SEQ ID NO: 29425 - DNA, 201 bp, Homo sapiens
tgcttaacaatatatctctttggattaaattacatagagttttaggagtatctcctctatcttgtaagcattgcaacatgaatattctacaaatttcttttatataagaattcttgtttagcagttctggatttcctagtgccagccttatacaacctgtcattcaaatccttaacgatgggtttatgtgaaagtggtttc

SEQ ID NO: 29426 - DNA, 201 bp, Homo sapiens
tgctataaagacacatgcacacatatgtttattgtggcactattcacaatagcaaagacttggaaccaacccaaatgtccaacaatgatagactggattamgaaaatgtggcacatatacaccatggaatactatgcagccataaaaaatgatgagttcatgtcctttgtagggacatggatgaaattggaaatcatcatt

SEQ ID NO: 29427 - DNA, 201 bp, Homo sapiens
gaaactggatcccttcctcacacctgatacaaaaattaattcaagatggattaaagacttaaacgctagacctaaaaccataaaagccctagaataaaacytaggcattaccattcaggacataggcatgggcaaggacttcatgtccaaaacaccaaaagcaatggcaacaaaagccaaaattgacaaatgggatctaat

SEQ ID NO: 29428 - DNA, 201 bp, Homo sapiens
tttccttcttggtaagatggtaggtgggaaaatgaggaagtgaggagtgggccttatcactgtcatgctaccaagaactcaaaaagtttttttttttttttcctggatgatagtatagaaggtgagggatatgaaagattttgctatagagtatgttcctcagttttagcagtcaaggcatgcaaagtctgcctcttaatg

SEQ ID NO: 29429 - DNA, 201 bp, Homo sapiens
tagtcctttatagaagctttacagttctgaagctagtaagtattgattactctagtcagtcatttggtcaacaactatgtttgaacatatatgtttaaagwctattttcagcacagtagagcttacaaagtgggacgttcatagactacattcagggagttttcacactctatgtagaggagaaaaatatttacctaaatg

SEQ ID NO: 29430 - DNA, 201 bp, Homo sapiens
tattccacatcaatcactttcattttatgatagtcaataagattcaaatagattgtgtatatagtcctttatagaagctttacagttctgaagctagtaartattgattactctagtcagtcatttggtcaacaactatgtttgaacatatatgtttaaagtctattttcagcacagtagagcttacaaagtgggacgttc

SEQ ID NO: 29431 - DNA, 201 bp, Homo sapiens
atatatgagaatttcagttgcttcccacagcatccccaatatttgatattatattactatactttttaatagagtttgagtgtgatccatttgggaaaaaraaagctttagaatacatagaaggacttcagaatcagttgatagaatagaatttcctttcatttttattttcttaattataaaataaattttggaaagttt

SEQ ID NO: 29432 - DNA, 201 bp, Homo sapiens
gttgtcaaatctctggaactgccagttccttggttcaaaattcagattgatatttagttaataaagctaatcaatgttttttatctacccataaggaatayacaaagtatcctagagacaaccgtggcaagagactaaggtaatttccagtttccaagttgtaaacaagggccactttatttcgtaaaatgtaagaaacat

SEQ ID NO: 29433 - DNA, 201 bp, Homo sapiens
acctctttcagcatttaccctcaaattcaaaatgaggatattaataaccactttacagaattctgacgaggtttaaggataagatttaagtgcttggcacrtaacagagtctcaataagaatggcggcagctcttattggtaagtgcagagcagagattcaatcgaatccacataactcccaaatttcatggtctttccta

SEQ ID NO: 29434 - DNA, 201 bp, Homo sapiens
gtttaaggataagatttaagtgcttggcacataacagagtctcaataagaatggcggcagctcttattggtaagtgcagagcagagattcaatcgaatccrcataactcccaaatttcatggtctttcctaatttataacatgtacagttagaaattttaatatattaggataataggaatccgctataaaccctctgatg

SEQ ID NO: 29435 - DNA, 201 bp, Homo sapiens
tgtccttagagcatgtcctttctcctgtgttgaagtttacctgtacatgcctatgggtttttttccttgttttgaggcagggtcttaatctgtcacccagsctggagaacagtggtaggatcacagctcactgcaacctctacctcctggcctcaagagatcctactgccttggcctcccaaagtgctgggattacaagca

SEQ ID NO: 29436 - DNA, 201 bp, Homo sapiens
gatgggcattagattgtcaacttatctcaaatgcttcagaagaataaacactgtataattgtggcaacttttctttatgtttaagatagtttttaaatgaraagtttttttaagaaagttcatatattcacttcagccatttgattccaaagtctttgcacatgcccctgctttgctctctccctggatgaccccacccct

SEQ ID NO: 29437 - DNA, 201 bp, Homo sapiens
ataaaatttggctgagatgcagaatatttatatagtctcaaaatacctcctcacaaaatacttattaattacaaagagaaaaagagtaattttatagtgtrgaagcctatcagacatcactcaatcaagtaatcaaaattaacaacacaataatgggacaaatcaaaatgtgatgggacacaatgaaagaaacaacatccc

SEQ ID NO: 29438 - DNA, 201 bp, Homo sapiens
aaagatggtgacataacaaaggaatacattgaaggcaccccaggtggtcaactatgagttaatttgagtataaaataaatgatgacagtgacatcaataawattgtaactataagttcatatagatataaataaatgatagaagtaaataaaatttggctgagatgcagaatatttatatagtctcaaaatacctcctcac

SEQ ID NO: 29439 - DNA, 201 bp, Homo sapiens
aggaaacaaggcacttgaagaaatgacagactttaaggctgacacaaggaaggtacaaaacaagaaaataagcctgaaacatcttgcaccagaaaggagaragatacaaagaaagatggtgacataacaaaggaatacattgaaggcaccccaggtggtcaactatgagttaatttgagtataaaataaatgatgacagtg

SEQ ID NO: 29440 - DNA, 201 bp, Homo sapiens
acctggcacatagttactgttcaataaatgttaactattttatgaaatatgtattctaatgcaataaatccttaccttatctctctcacacacacacacatgtaaacgcattatgtatgtgtgtatgtgtatatatatatatacacctatatatacatatatgcagtcaaaattaaatgctactatttccataaagccttt

SEQ ID NO: 29441 - DNA, 201 bp, Homo sapiens
tacctggcacatagttactgttcaataaatgttaactattttatgaaatatgtattctaatgcaataaatccttaccttatctctctcacacacacacacatgtaaacgcattatgtatgtgtgtatgtgtatatatatatatacacctatatatacatatatgcagtcaaaattaaatgctactatttccataaagcctt

SEQ ID NO: 29442 - DNA, 201 bp, Homo sapiens
cagtggctcacgcctgtaatcccagcactttcggaggccgaggcgggcagatcacgaggtcaggagatcgagaccatcctggctaacatggtgaagccccrtctctactaaaaatacaaaaaatattagccgggcatggtgcctggcgcctgtagtcccagctactcaggaggctgaggcaggagaatggcttgaacccgg

SEQ ID NO: 29443 - DNA, 201 bp, Homo sapiens
tttcaaggcaagcacaatccaagttctttaaatataggtccaggaaaatttgcaaatatcacacatgatgagcagtttttaaatttcttcaccccccccccatctttttaacacaaaaatacataaaggattcaattaagaccaagttcaatcccaatgtctcctcctgtaggaagttgtcctaaataccctcaactagtt

SEQ ID NO: 29444 - DNA, 201 bp, Homo sapiens
cttccagactgttgtaagattcaccattatacacattcacatcatgtaccttttcttcctagagcttggctaaataaaatttgagtgaaattatatttatrtaattttttccactagatagcattgaatataaaagtaaataatatttctttttcaaccctctcactcatacctagtatcattcattcgttcaacaaaaat

SEQ ID NO: 29445 - DNA, 201 bp, Homo sapiens
acttttcaatgcttctggaaagtgagtttttaacataatgggaaggggatatattaaaatattgaacaaagcctaatatttatcattactgtgaaagtttsattatttgggccaggtataaagtaaggcctagtctgttcctttgatgacctgagcatgtgagacatgaggtcaatgagaattccttctgtaactgagact

SEQ ID NO: 29446 - DNA, 201 bp, Homo sapiens
cattttatttaattagtggaagtttgattatctctggaggtattccattagtgtgccttggttatctgggtgtatccattatcaggagtttggcttaacamgtccatttagtgagctccattaaggtttatttttctgcctaactccttgtggccaagtgtccaggagctgggctttagtgggtttcgggtttctttccat

SEQ ID NO: 29447 - DNA, 201 bp, Homo sapiens
aagtggagccaagagagctgttgaaatgaaaggtaacatcaagggtgtgatcactaactcacacaggcgctcaggattcaggatgcaactttctgcttcaytggggaaagcatgaggccctctcatctgtcagccgatgtcaattctatataggggctgagatagactggaaggtgggctctgtgaattaagctttgttgt

SEQ ID NO: 29448 - DNA, 201 bp, Homo sapiens
acacaggcgctcaggattcaggatgcaactttctgcttcactggggaaagcatgaggccctctcatctgtcagccgatgtcaattctatataggggctgakatagactggaaggtgggctctgtgaattaagctttgttgtgcttgggtaaatgtaggggtttgggttgtttttattcccccaagaagtgtctcctaggaa

SEQ ID NO: 29449 - DNA, 201 bp, Homo sapiens
taacctgtagatgacgatctttttaaaaagtaaaacagatcatatcctttaactaattaaaatgcttcaggggctccccatctcgcctaccctacacgaawatctcatctccttatcctcacctgtaaagctctacatcagtcgcagtcaaagtgcagattgctgatgagcatcacctgggaccttgttagaaacacaaca

SEQ ID NO: 29450 - DNA, 201 bp, Homo sapiens
acattatctattctctctgcctattaggtgcttcccctagaaattagtttgttggctaatgtccttaaattagtcttaaggtttccctgatcgtgagctcrctgcagtccaaagaaagaatgccaatgggactgccccccacgttatttcattataacttattcctatgatttgagaaaattagagatccaccagtcatga

SEQ ID NO: 29451 - DNA, 201 bp, Homo sapiens
tgtgtccttggtcaatttatttaacatatcagttttctaatttccaagacggttatatttaaatgcctaccttattggatttaaatgagaaaatacattascattattagcattatttttcttctttattctttcgaaagaatcttttcactattaaattttcttgcatgccctagttgccctcctgaattaaatgtttct

SEQ ID NO: 29452 - DNA, 201 bp, Homo sapiens
ggatttttcaccattttattctcagtgctttgtacaatgactggggcctaataaaaattcaattaatatttgtcagatgaatgaattaataataatcaagraacataaggataacatatattaatgttctttatgccaggtattgaactcaatgctttacagagatcatctaattaaatcttcgtagctctatatgatgac

SEQ ID NO: 29453 - DNA, 201 bp, Homo sapiens
agatagtttttgctgaaagaaagctgtaattgtataatttcctatgcttacctttgttcaaatgtctcaacaattgaacaatacaaacaatttatgatacwtgttttctattgtgcttcacattctttagaatatgttaaggaaaagtgtgatcttctggtatgtaaaacctaccatggtgagaacaaagaatatactctg

SEQ ID NO: 29454 - DNA, 201 bp, Homo sapiens
tggtactcatagaggtggcaaataatcagcatggctgtcattgtgacgattagcagaaagcagtgtgctgagaggagtgaaggtataggtgaaaggcagcrggcactggcttatatttattttattctcataattgcagggcagttttcttcaattttattctatatgctatctcagataattaaagcagtggagaaggac

SEQ ID NO: 29455 - DNA, 201 bp, Homo sapiens
tctacaattgccttaattttctacacacctggtcaagagatagcatttcaaaataatcgagggagctaaaacatgcacactacttgaaaaataatatattytcaaatggaaataagtgttactggtggaggaagacatacatcacacatagaggatcatatatgcatttgcatatgcagggaaggggcaacaatagagaga

SEQ ID NO: 29456 - DNA, 201 bp, Homo sapiens
atgttgcttaatgtgatatatgttggtaatcaggctaatggaattttcttgccttattaaagctgtttgctttaagtttctctacaattgccttaattttytacacacctggtcaagagatagcatttcaaaataatcgagggagctaaaacatgcacactacttgaaaaataatatattctcaaatggaaataagtgtta

SEQ ID NO: 29457 - DNA, 201 bp, Homo sapiens
tacaaacactgcagactaagatatatgagattgccataatagcatctcttcgtccatctgtgaaagccctctgactcttactatacaccatggagaagcayacaaatgtaagtgccttgaggaaagagtctatgtcccatcagtttttaaatatctatctcctagtgtcataacaaatgcactagtactctttggtgaaag

SEQ ID NO: 29458 - DNA, 201 bp, Homo sapiens
gatcttgaatgcactgttcatttaaagtttttgcggaagggaagatttgaaaggcaagcaaatctcagcatatactctctacataagctagatgtatgctyaacccatgttaactacagatcctttgtgatggataagtatttatgctttttcaattccttaaatttaccagttttacaataagctctgttgtatttcaca

SEQ ID NO: 29459 - DNA, 201 bp, Homo sapiens
ttgagatatgtataataatttacatgaaataaacatcaaatgtaaatctgctcaaatactcttcttatgtagtttttcatttgtttaaggcttttttttttcaatgtttgcttgcttttgcaagacttggcaaaacttttcttacttgttttttcattccttagagaagcatactcagttaattgtgtcagacgtatccta

SEQ ID NO: 29460 - DNA, 201 bp, Homo sapiens
tcaaattatccatcactttctttagaccattgggggaaaaaagcctagaggtctctttgaatgtctgctgatgttgctcagattgatttttaatgcctttktgtgtgtgtgtgtcttcatttgttgcttgaaataaacatgtgaatttcaaaactgacatgaccatttggtttgcagcggctgcggcagcagacatggctt

SEQ ID NO: 29461 - DNA, 201 bp, Homo sapiens
cctgaatgactactgggtacataacgaaatgaaggcagaaataaagatgttctttgaaaccaacaagaacaaagacacgacataccagaatctctgggacrcattcaaagcagtgtgtagagggaaatttatagcactaaatgcccacaagagaaagcaggaaagatccaaaattgacaccctaacatcacaatgaaaaga

SEQ ID NO: 29462 - DNA, 201 bp, Homo sapiens
gatacccaggaattgaactcagctctgcaccaagcggacctaatagacatctacagaactctccaccccaaatcaacagaatatacatttttttcagcacsacaccacacctattccaaaattgaccacatagttggaagtaaagctctcctcagcaaatgtaaaagaacagaaattataacaaactatctctcagaccac

SEQ ID NO: 29463 - DNA, 201 bp, Homo sapiens
tcctggactctttttggttggtaaactattgattattgccacaatttcagctcctgttattggtctattcagagatgcaacttcttcctggtttagtcttyggagagtgtatgtgtagaggaatttatccatttcttctagattttccagtttatttgcgtagaggtgtttgtagtattctctgatggtagtttgtatttc

SEQ ID NO: 29464 - DNA, 201 bp, Homo sapiens
caaatatgtaaccatcctcaaagcactcatgcaactgagagtactttgttggatgaagagaccatgccccgacctcagtatcagctaactgcaagggaacrgaccacagatacaagactctctggcagtgttatggagagtggcttagtacaggagcatttgccataggtcaggaggaaattaaaatagcacaagctggaa

SEQ ID NO: 29465 - DNA, 201 bp, Homo sapiens
cattttctgcctaaacacaagccacttatagctgttttcctgtgttctaaaagcaccccaggcactgtgaagacacagaacatgtggtactcatagaggtrgcaaataatcagcatggctgtcattgtgacgattagcagaaagcagtgtgctgagaggagtgaaggtataggtgaaaggcagcgggcactggcttatatt

SEQ ID NO: 29466 - DNA, 201 bp, Homo sapiens
aaggtataggtgaaaggcagcgggcactggcttatatttattttattctcataattgcagggcagttttcttcaattttattctatatgctatctcagatmattaaagcagtggagaaggacaggaatattgagttagttagggatatagataggatggaaaagcattctggacaaaaaaaaatgagcatagaaaggattt

SEQ ID NO: 29467 - DNA, 201 bp, Homo sapiens
catacttaatagctagatgtgagcacccttatgtcacataaaacaatctaccttgtttccacgacaaaatacagtgcatgggtaggacattgaatgccaarccgatgacaattttcaagtagggataggcttccttatgaagtgctggctttcaaaaagaccttagtgatcactgaaactcatttacatataccacctgtt

SEQ ID NO: 29468 - DNA, 201 bp, Homo sapiens
attcagtatgatattggctgtgggtttgtcatagatagctcttatcattttgaaatacgtcccatcaatacctaatttattgagagtttttagcatgaagsgttgttgaattttgtcaaaggctttttctgcatctattgagataatcatgtggtttttgtctttggctctgtttatatgctggattacatttattgattt

SEQ ID NO: 29469 - DNA, 201 bp, Homo sapiens
tcagagaaatgcaaatcaaaaccactatgagatatcatctcacaccagttagaatggcaatcattaaaaagtcaggaaacaacaggtgctggagaggatgmggagaaataggaacacttttacactgttggtgggactgtaaactagttcaaccattgtggaagtcagtgtggcgattcctcagggatctagaactagaaa

SEQ ID NO: 29470 - DNA, 201 bp, Homo sapiens
tgctagaggttgcaattttttgaatttttgcatgagtgaaaaatcagaccttggcgatgaacttcagcagcatgatataaataactcccacatgcttagcrttccaataatggaacactaggaataagtgggtttaaaaatatcttttctctatccatagtcagcatcagttacttatctgcttttaggtggaagagcaat

SEQ ID NO: 29471 - DNA, 201 bp, Homo sapiens
aggccttttcttgaactgtccttgtgcctagggttccagcaagctggttctcttgctctgactctaatacgcccatgatgcttttcactctttccttgtarccacaattgtgttagcaaatgagcctcaaggagctgaaaaactgatcttcagctgatgggtctttttgacaagtttagagggtttgtctaaagtaggaat

SEQ ID NO: 29472 - DNA, 201 bp, Homo sapiens
gactgtaggttatttgagagtatagactctgcatttatctgttattagctttggacacagcaaatttctaagatggacattagtaaaaaggttaagtaatwtttattaaatgtctagtatgggacaagcatcatgctagatagacgctttccaatcatgatcctctttattcttttcagcatccctggaacaatgatctta

SEQ ID NO: 29473 - DNA, 201 bp, Homo sapiens
agccctgcatatccaaggctgtcagggaatgtagatgagctggtgcttatgaaaagttactgtgaggacccataactccatccatatttgccctattcatkaaattcctatggtggagcagaattagctgtatctacagggacaaaggcaaagtcagagtgaattcgagaccttccaacaaataatagggcaggcaaatgg

SEQ ID NO: 29474 - DNA, 201 bp, Homo sapiens
aactacattgtaagcttcttaagggtaagaccatagtcactttgttcactgcatcaccagtacccattcccagtagagtgcctgacatagtgcttcgcatrtggtagtcttaagaaatcattttgaaccaaagaatgaatgaactaaatttctattgcaatacattacctcttatgatttgtcctatgttgtaagctactt

SEQ ID NO: 29475 - DNA, 201 bp, Homo sapiens
tttcctgcctggggactacactaccttcataggactaacaaattagccacaagattagaaataatggtttaggaatcacatagctggagactgaaagattmgaaacctccccagattgcttctggggataaatcactattgcaaaacctaagatcagtgcttgagatattttgcagatgctgtacaggatggctcagctgc

SEQ ID NO: 29476 - DNA, 201 bp, Homo sapiens
acaataaaacaaatggctttagagcagttgattccattattttagttttaaaaattattaaagccagattaggaattgagcagtttgatgttcagttgttwttacttcaggactgtaattattgactgtttaactagactgtaggttatttgagagtatagactctgcatttatctgttattagctttggacacagcaaat

SEQ ID NO: 29477 - DNA, 201 bp, Homo sapiens
accaactttttcaggttctgaagcagatgaatcatgagtaaaataacttgataggtatatattgaagcctaaatgtttgtatgagtgtacttgtcttagtmcacgtgacggacaatataccatattcccgttagaatgctgggagatactctccccatcattactccaaaggtcatacaaattagtacatgaattctactc

SEQ ID NO: 29478 - DNA, 201 bp, Homo sapiens
tgaaggttaatttgaaatcaattatcaataaatgtttgatgaattgaattatttaaaaattctatcatataattaagtcctaattattaatgtttatattrccttatgcctggtggcatatataccttccaaatttgtactttaactgtactggaaatacatccagtttaacaattattggatgcctattacctacctacc

SEQ ID NO: 29479 - DNA, 201 bp, Homo sapiens
tgggtattggacaaggcccctactccagacgattaatcctccttcccaccacaggctcactctttgcattcttaggcagttatgactctgtaaaaatgcaraagtttctaatgcttcagttgcggttagctttttgtagttaaaattttagtaatcagttcataggctaaagctttgctaatcaaagtctgatttattgat

SEQ ID NO: 29480 - DNA, 201 bp, Homo sapiens
caaaaaggaaacttaatacccattaagtagtcagtcccacccagccctcactgccaagacaaccatgaatctactttccatccctacagattggctattcsagacattttatataattggaattatgtaatgtggtctttttgtgactggcttcttttattttgtgtaaagttttcaaggttcattcattttcagtaaggt

SEQ ID NO: 29481 - DNA, 201 bp, Homo sapiens
attgtaaagtcaaaaaattgtaagctgaaccatcgtaagttagggattatctattattagaaacataataatgtagagaaaatgtcagagaacacaaaatrgaagagttaagagttcagtgaggatagagattgtattagtccattttcacactgcttataaagacatacccgagactgggcaatttacaaaagaacgaga

SEQ ID NO: 29482 - DNA, 201 bp, Homo sapiens
gtaaattaagctaggcagatgttgccactagactttttcctgaaaggaaaagccaggagcaagctgagtgaatagaaattaaaatatgggaaaccttggartagaaagttaaatccatattttatgttatgtcttcacacctgttggaagtattaaacaattgaaattgcccctcctccactcagctgatgtctcctgcat

SEQ ID NO: 29483 - DNA, 201 bp, Homo sapiens
atttacagccttgcatttagcagtttacaaggtaggacactttaattcccataaacactgcattggaactaaggatagtgtgtatctttaggctttttttytttttttttcaaattagtaatcatggaaaattttcagtgaccagaggcgttacattactaaaggacttctttctctttattgagcagatacctgctgcat

SEQ ID NO: 29484 - DNA, 201 bp, Homo sapiens
tttaaagtagttttttccaattctgtgaagaaagtcattggtagcttgatggagatactattgaatctataaattaccttgggcagtatggccattttcaygacattgattcttcctacccatgagcatggaatattcttccatttctttgtatcctcttttattttattgagcagtggtttgtagttctccttgaagagg

SEQ ID NO: 29485 - DNA, 201 bp, Homo sapiens
tctgactgttgaagaaaatctgcagaacacacagtatttattttggcttctgtctcagaagttttggataatttcttaggaggcaacaatacctgcttgcrttgctttgggagacttgacaaggatttttctggatggactctgacttttctaaaaggatgtaaatttaattttaagttttgtcctttaattttccctttg

SEQ ID NO: 29486 - DNA, 201 bp, Homo sapiens
ggggggcacgtttagtgtttcgttgataatatggggtctgctttgagtcatgtttcagaggcagcctctttgaagtgagtctaacatagttgctactctcygactgttgaagaaaatctgcagaacacacagtatttattttggcttctgtctcagaagttttggataatttcttaggaggcaacaatacctgcttgcatt

SEQ ID NO: 29487 - DNA, 201 bp, Homo sapiens
atatgctttcttggtttttgttgataatcctgataaatctatgttgtcctcactcataagaaatttttctattgcactgttaatttggatttgctctttcycaggctttgagtgttgtctacgatttggcttcttttctttcatgtaatcttcaaattgctcacagggcacatatttacagataagagaattgtttggctg

SEQ ID NO: 29488 - DNA, 201 bp, Homo sapiens
tacgatttggcttcttttctttcatgtaatcttcaaattgctcacagggcacatatttacagataagagaattgtttggctgaaaatacctaggtttgctstgttttaacagtccacaaggatcatcatattttgatctatttttttgtacgatattttgtacatagtgttcctcaggctcacaaggcttggatgatgagc

SEQ ID NO: 29489 - DNA, 201 bp, Homo sapiens
tctctgttaatatgttatataaggtaattgtgtaacatattaacagagatatcttttaaaaattgaaatttcagagaaaagatgaaagagagagaaatgcrtaataatggcattttgattattcagggaaatatacttgttcttaggatatatgtgatgaagtattaggtgttgtagcaactatgaaaatgtactgctcag

SEQ ID NO: 29490 - DNA, 201 bp, Homo sapiens
atatttcatgtacttccctgttcaagccaaggtacccttcatgctgcttcccgtcagtggctgtgcacagtaggtgtactaatgcaggcccatgtcctcargaagtgggaccccattaacagatgactttggctcaagacttcccattggcctggccaaaacttacttagaaatgtgctgcgttctgaaatttttctccct

SEQ ID NO: 29491 - DNA, 201 bp, Homo sapiens
aagaatggcttgaacctgggtggcagaggttgcagtgagccaagattgcaccactgcactccagcctgggtggcagagcaagattccgtcacaaaaaaaawaataataatttttttctgtcttcccactctcctacccaacaaatattcttcctcttgatggccacaatatgctttgtttacattaatcatctcgagaaat

SEQ ID NO: 29492 - DNA, 201 bp, Homo sapiens
gttccttcttgtttctgctgttgctgttttaaagttctgggtttaaattaacaaagaattattttttaaccagtccatctatattagtttcctgtggcttycgtaacaaattatcaaaagttggtggcttaaaacaacaggaagttattctttcactgtcctggagggcagattcaaagttaaggtgtcaggagggtggtt

SEQ ID NO: 29493 - DNA, 201 bp, Homo sapiens
aaagctaaatatgctttcatttatgcattaaacacacatctctgggatgactatgatgttccaggaatcatgttaagtatagaaatgattaagatacatawatattgtattcacagatttcataatgtattaagagggtgtgatacaacataaatggctatacatcaaagaagaaaataataaggatctgaggagagaata

SEQ ID NO: 29494 - DNA, 201 bp, Homo sapiens
gcacagataacacaactcccatggaaactgctagatctttggacctattctgtgccatgggtaccatgggtttgtggatctctgtctttttaattcactaytatatcaatgcacatataagtatacatatttatatataaatgcccatataaacagacacatttccatatgttttcgtaatgcttccagccttttaaaact

SEQ ID NO: 29495 - DNA, 201 bp, Homo sapiens
tatttttttgtacgatattttgtacatagtgttcctcaggctcacaaggcttggatgatgagcttgtaataaaatgtctttgcctgtgagggtgtaagccrttgtcttctttttctattggaggctgccatgattcatttgttaaacgcttctcaagactttctcctgccaaggctgaagcgggtgttgcatatcttcttc

SEQ ID NO: 29496 - DNA, 201 bp, Homo sapiens
ttttgtacatagtgttcctcaggctcacaaggcttggatgatgagcttgtaataaaatgtctttgcctgtgagggtgtaagccattgtcttctttttctaytggaggctgccatgattcatttgttaaacgcttctcaagactttctcctgccaaggctgaagcgggtgttgcatatcttcttctaaatatgtcactgctg

SEQ ID NO: 29497 - DNA, 201 bp, Homo sapiens
tgtaataaaatgtctttgcctgtgagggtgtaagccattgtcttctttttctattggaggctgccatgattcatttgttaaacgcttctcaagactttctyctgccaaggctgaagcgggtgttgcatatcttcttctaaatatgtcactgctgatatctgtggaacaataaatgcaagaatttagcacttagcagagttt

SEQ ID NO: 29498 - DNA, 201 bp, Homo sapiens
aggaatagactagtgctatagtgatttttatagtatttcctgttgaggaaattaaaggagggaggctccctccttcaaaaagaattaaacggagtgggatyttctaaaacaagacaaactcaccttctgttcttattatatggtgttgcagagtttgaggctggacttctccaggctcaagattccatagcttttgaactt

SEQ ID NO: 29499 - DNA, 201 bp, Homo sapiens
atcaaagaagaaaataataaggatctgaggagagaatacattcaaatggcatgggtgttaggaagagcgataagagaaaagacaaaataatttaggggagrcatgcactttgattccttagtatatagatatgaaatgaatgagtaaatagatttggatgcattttttatgcatttgcaactacaagagaggtagaaatct

SEQ ID NO: 29500 - DNA, 201 bp, Homo sapiens
tggtgatgtccttcactaagagaaaagaaacaagctttggttgaaaagaaggagggctcaaaggcattatgtggtatgatataaagcctaaaagattccaytggatttaaccacacaatagtttacgttgaaaaggtttattggagtagtaaagacaaaatgagactgtagtggattgaagaggggatggtcagtgaagat

SEQ ID NO: 29501 - DNA, 201 bp, Homo sapiens
tagttataaccatttagtctcaattggtgcaggctagaatatttgggtaaagattcaaacagcaggcaagacaagcttgttttaaaataaggacgaggaamatgttggtcaggaagggcataaggcagaagtcattggtgtgagtagagcttcaggcagaagggcctggcttaggcatggcagtcaatgattagagggata

SEQ ID NO: 29502 - DNA, 201 bp, Homo sapiens
ttatcaattatttttactcatttgcacttgaaaaatgtcaattaattaaataatatcaaatacttattgaatacatgatatgatctagggtctatgctatsccgtaggggtacaggtgagaaggacagatcataacactttttccagcagagcatagagcctaaggaagcatttacaaactttcctgaagaatcatttggg

SEQ ID NO: 29503 - DNA, 201 bp, Homo sapiens
ttattttaattaggaacttcattcatgccccagcatgcactatgaactctttaggatatgttaagttacagtgtggcatggcaggtgatgaaaaatgtaargggaaattaaaaaataaattgagcttagggtattagaatacataagtgatgctcaattggcagtgaatttgacatacacagttactttagaagaggcaaa

SEQ ID NO: 29504 - DNA, 201 bp, Homo sapiens
tttaggatatgttaagttacagtgtggcatggcaggtgatgaaaaatgtaaggggaaattaaaaaataaattgagcttagggtattagaatacataagtgrtgctcaattggcagtgaatttgacatacacagttactttagaagaggcaaaagaagagaaaatggaatttctctcctaggaatgattgcttaaatatctt

SEQ ID NO: 29505 - DNA, 201 bp, Homo sapiens
ctgtgagggtgtaagccattgtcttctttttctattggaggctgccatgattcatttgttaaacgcttctcaagactttctcctgccaaggctgaagcggktgttgcatatcttcttctaaatatgtcactgctgatatctgtggaacaataaatgcaagaatttagcacttagcagagttttattaccccaaccaaacag

SEQ ID NO: 29506 - DNA, 201 bp, Homo sapiens
tctaccatcctggcaaaataaagtgctgcctaccccacggtctttctttttcaggtttctaaatgatctgtcaagggttgcagactcagaggccgatgttrcttgatggctattttcctgtaaaagtggcatttcttttctggaccccacaatggacatgacctttatctcgttttcctgagttaagtggcagttgcagta

SEQ ID NO: 29507 - DNA, 201 bp, Homo sapiens
tggcattcctgagcgtgtgagcagaagacttaatgtagtttcttaaaaaccgagcaaggggatggagatcacaagtgcagctccactggttcttatctaarctcagaaggattaactgcttcagtggagtaaacacatccggcatgtgggctaacctatttcgggaaaggtccacttcctgtagttgaggcaggggccgga

SEQ ID NO: 29508 - DNA, 201 bp, Homo sapiens
cagcctagcacatacatcctttctttatattttattttgttatgtgcacatctctttctctgtgtttaccactttatactgaaacactctcttctcttacsaaattgtaaacttcttgagagcaagcatttgggcctttaattcattgtcttccaaaaatttgaattcagtggatgactcctaatagatattcatgcttgt

SEQ ID NO: 29509 - DNA, 201 bp, Homo sapiens
cacttaagttgtacagacatgctgtaagctaggtattatgtgtattaataatagctaatacttatttagcagttcagaatttgccaaattccatctatctytttttcattttcttcattcctcttacaatttttgaagatgagaaaaagagtctcaaaaagttaaagtattataatttggccaaaatcacaggactagtaa

SEQ ID NO: 29510 - DNA, 201 bp, Homo sapiens
tgagtaggggggaggaaagtcatgaaaaaaactgttgtcagatgctactttcattcctctgtaatgtgaggttgaagataggtgcaatgtgaggaggaatrtgagaaggagggagtttaacttgtactccagtttccaagtttgagcagttgcaatgtagtgaaaactgtggggcctgtggcaatttatataaataaatcc

SEQ ID NO: 29511 - DNA, 201 bp, Homo sapiens
acagaagactgcctttctctcaagattttatagaagagcaaatggatgtaaataaacctcttgggtggtcttttgaaggaaaagaagtctgagaattcccrtcacccttctatttctctcttctgatcctgatgattgtctccctggtgttgacactcttcatgtgcctggcttacttcccaggtcaaattgcactttcct

SEQ ID NO: 29512 - DNA, 201 bp, Homo sapiens
tttcatatttagatcacctaactacttatagtaaagtaaacatttaatagggaactcacaataaaattagtagttcatcagcatctattaactattcatcrttctccactttaacattgtaatgtaataagtggtatatccaagtattaatgtttaagtaaaatataaattataataactgaagcaaggataattgtactc

SEQ ID NO: 29513 - DNA, 201 bp, Homo sapiens
attgcactttccttgtttgcagtgattatgcttccttaacctacatttctttaaagagcctatgacatagcatccaatctcttgaagggaggaaagttagwctttgcctgctttaccttggtggaacagaggtatattgggtttatttctaattagcttattgatttcagtctcattaccttacagtaacatattgaaaac

SEQ ID NO: 29514 - DNA, 201 bp, Homo sapiens
actgctctcagatattttgatggatccactctactgctttcttttttctactctaccttcgcactttagtcatttggtaattgcattctaaaattatttgraaataaccagtctgtgatttcagagcattaaaatatatgcataaaaacctgtactagtgccttctacatcctgcatcaagtccagaattgttctctaatt

SEQ ID NO: 29515 - DNA, 201 bp, Homo sapiens
taaaatgggcatcaaagacatatggtaagaagcattcaaagacaatcttggactatcatatgcatgtctgtaaaatagtccacaattaaatttactaattmtggggaagagtaagctctctttggactatctcagctttgatttacttcttaaaaaggacactcttttttctgcccttattgaggtataattaacaaataa

SEQ ID NO: 29516 - DNA, 201 bp, Homo sapiens
acatttagataggatgaaggaaaacgttaacatttaataagaggcctgacatgggagtaatctacatggggggagagctatgcaggtgggggcaatagtargtgcagaggtcctggggcaggagagttcttggtgtgttcaaactaacatggctggagtgaggtgagcaaggaggaaagtggcagtttatgaggtaaggga

SEQ ID NO: 29517 - DNA, 201 bp, Homo sapiens
gcatcccagaatggaaactaatttttttaactgaaaaatgtgaaattacaaatgaaaagaatgtaaataatgtcatcgaaacagaggctagaactttgtayggagggacttgtaatattttatgggcttcctttctggaatattgcacaaacagcattcataaatagcacatctgggcagagaaagtaagacagacctgat

SEQ ID NO: 29518 - DNA, 201 bp, Homo sapiens
tctccccttcttcgtttctactattccaatctgaaagtgtagcgatcgctgtctcactcacttggatttgttctgcccttttcctgtggtacaaaggaccwgcatgaatcaatttaaattggtcagaagaaatagccagcagcctgcttatgttcaaatcctctgccctaatcaccagtatggaaaacccattgaaaagac

SEQ ID NO: 29519 - DNA, 201 bp, Homo sapiens
ttcccagtgcctgtctgggatcaatccacttctcacacctccagcccttggcaaccaatgacctcatttctgtccggataagcttacttatataccaatgycatataaatggaatcatgttgcttcatttatcagtaatttattctttttcactactttgtaatatttcatattatagatgtgccatgatttatttatgca

SEQ ID NO: 29520 - DNA, 201 bp, Homo sapiens
tggagatcacaagtgcagctccactggttcttatctaagctcagaaggattaactgcttcagtggagtaaacacatccggcatgtgggctaacctatttcrggaaaggtccacttcctgtagttgaggcaggggccggaaggcatctttcccaatgtaggaaataaaattgttggataaatccagatacctgagactgtgg

SEQ ID NO: 29521 - DNA, 201 bp, Homo sapiens
atgtcctttgcagggacatggatgctggaagccattatcctcagaaaactaacacaggaacagaaaaccaaacaccacatgttctcacttataagcgggarctaaacaatgagaacacatggacacagggaggggaacaatgcatactggggcctgttggggaaggcagggggagggagagcaccaggaaaaatagctaat

SEQ ID NO: 29522 - DNA, 201 bp, Homo sapiens
tcaaattatagtctgggcccaaagaagagagtctcttgttttctttttgttttcctgtgtgacgccagctggttcacaaagagatttaactctgtgtcctsggattccttaatgccaggctcttagtagtctaggatatagcagtaatttaagaacatctgccaattttttctaggcaggttttggtgagacttcatattg

SEQ ID NO: 29523 - DNA, 201 bp, Homo sapiens
aagagagcatggattttgaaacaaaagactgcaccaaacattagttatatgtaaaatgtttataaattaaaaactagctccacacataacaacaacaacamcacctactttgcatggtggttaggaggattaaaggagtttatgtagttatctaccatgatgcctgatacaaaatgcattcagtaaaagtagctacaagct

SEQ ID NO: 29524 - DNA, 201 bp, Homo sapiens
aaaagcaataaagtcttgaatattggcgagaaaagatgaagaagagaggtaagaagtttaggaattttcaaaataagaaacttaagttatttcctagcaaytctgaataggaagggaaacaaaagaggcggggtatgtaggcaatatttatgttgttctaatcttataaggtttataaagcttatttattattattattct

SEQ ID NO: 29525 - DNA, 201 bp, Homo sapiens
gattttgcagatctttatgggaacagccaactatccctggaaatccttaatttttttctcttagagaaataacaagttttaaagacttctacttaaatctrggatgattgtcaacaggacaattgcaaatgtatgaaacataccaatatgcatatcagttacactacagttaacaaagctgaatttttattttcatactat

SEQ ID NO: 29526 - DNA, 201 bp, Homo sapiens
gatttcattttacaatattacaaagaaattaagtatagtattataaataaattataaaaccaagtataatatcttaaacaagagatgctgtatatcttaaytgattcataattaagcattttctgatgtaggaaagctattcagatttgttgaatttctagcttaaccttcaagaaacaaaaaatggttaagatgatataa

SEQ ID NO: 29527 - DNA, 201 bp, Homo sapiens
gacaaaaataatagtaataccattaattgagcacatgctaagagctaggcattgtgctcataatgtacgttcatcatctcttttaatattcacaagagacrtgatccattggacagatcctactgtcttataacttttacagatgaaggaatgagctttaaagaagttgaatgctttcccgtagtcacacatcagctaagt

SEQ ID NO: 29528 - DNA, 201 bp, Homo sapiens
gatactaggtatatatctgtatcccattaccagtcaggtatggtcactttccattagtgcagaaagcaaaagcagcaaatgaagcttgtaggcaggcggartgtgctattaagaagacgtttgaattttctttgccatgggcattgtttctatttttaaaaagtgttctaacaatctacctgtgttggcaagagaaaaagg

SEQ ID NO: 29529 - DNA, 201 bp, Homo sapiens
ccaatgaagtccatcatgtgatgacaggtggtactcagggcttccaactgttaaatcccttcaccataatcacctcagagctatcactgctctgtcattasaaatcaaagcattttaactcaataaagaagtattataatcaggagtcattgtaacacatctttatcatgctaacattgttttgactgcaaatgacagtgt

SEQ ID NO: 29530 - DNA, 201 bp, Homo sapiens
ccagtacctgcaggctgtgaagcttgctgaaggtgtgatcagtgagcgaagagctggatatttggttgtgctccagcaacaaggtccgcaacatcgtaagsccatgcagggcatcttcctgaacatcctcgataccatttctgcttagggagagcagggcaagattaaacaagagagacaggtttgtgctctcaatagagg

SEQ ID NO: 29531 - DNA, 201 bp, Homo sapiens
gtccacttcctgtagttgaggcaggggccggaaggcatctttcccaatgtaggaaataaaattgttggataaatccagatacctgagactgtggagattcstgcctccgaaagaactgtctgtgagattagtaatctgattcccatccagctggagccgggtcaggccgcttgtgtttcggaaccaagaccctcgtagggt

SEQ ID NO: 29532 - DNA, 201 bp, Homo sapiens
aaatagacaataagagtggaaggagaagagactctctaggactaagagtgacttgaaatattccacagtaaagtctgtctctattgtgagttttgagtcaraaagtcactttgcttccaagattcattacttaatacctaatgtatacagctttattgtttacaaaagtgcatttgcacttaagttgtacagacatgctgt

SEQ ID NO: 29533 - DNA, 201 bp, Homo sapiens
ctcctagtttagttctcaagtcactagaccgtgctgtccatagcccttagtccagtctacttctcatctataaagtcatttctcccaggttccatcagtarccctactgctttagatgcagaaacccctgattcaatttcttgctggaatggatttctcacaaataaggataatcctccatttcatgtttactcacttggt

SEQ ID NO: 29534 - DNA, 201 bp, Homo sapiens
ttctcctgcctcagcctcccaagttgacttcacaataagtttatcaagatattaaatgcactgtccacttaggatattttccacttataataagtctgtcrtaagtggtaactggattgtaactggagagggctgtgggtcagggagggatttgaaggatgggagctactagagccggtgtccatgataagggaataatct

SEQ ID NO: 29535 - DNA, 201 bp, Homo sapiens
tatctaccaggcactgtgctcagtactgaggttataggattaagtaagatggcaaaggtctctgctttcatgaagcatacagattacaagtgggtaggagrggtagggcaggaggagacagataataatataaataagcaaggatattttagatatggtaagtgctgtaaaatgtatagatgtgagagtaagttattagga

SEQ ID NO: 29536 - DNA, 201 bp, Homo sapiens
ataataatctgtttcactggtacatcacttaatcttactaatgctgaacaattgcagttcaggtttctgattcattgatatttcttccagctggtggtagrgttcaaatctgcacaaagtatgtacaaagatattaaagtgatatatttgttaagtgtgtagctggataaaatggtgatattcttttgcaatagcaaaata

SEQ ID NO: 29537 - DNA, 201 bp, Homo sapiens
acaaagtatgtacaaagatattaaagtgatatatttgttaagtgtgtagctggataaaatggtgatattcttttgcaatagcaaaataactcagttacctytgaaggtctttaaatagttttgattgagaccatcaggaacaggaaaataaaatattgccagtctctttagtcattgtatgaagtgtactcattaaagggt

SEQ ID NO: 29538 - DNA, 201 bp, Homo sapiens
ttcttataagggcaccaactctactggatcagggctttacatttatgacttcatttaaccttaattatctccttaaaggccttctctccaatttagtcacrtgggaggctagggtttcaacatatgaatttgaggagggtcacactccagtccatagcaataggtaaatctataaaaacaaaaagcaaatgggtgcttcta

SEQ ID NO: 29539 - DNA, 201 bp, Homo sapiens
tccttgcactacttaaaatcaactctaggaatcggtaaagcgtttagctaagttttaaaatgtgtcaaaatagaaattatgtatgttctattcattactgkatccttagtatctatctagcagtatgattggcataaagtcagtaagaaatatttgttgggcagataaagaataaaaaattggataaattggctcaataaa

SEQ ID NO: 29540 - DNA, 201 bp, Homo sapiens
aaattagaaagttctattctttggaaaagtttgtgaagatttatgttatttcctccataaatatttaataacattatctagtaaatttatctaggatatgkgttttctttctggaaatgtgttcaaattatgaatttgatattttcagaagatatggatagtggtttgtgggaatctgttgatactgacactggctcaggg

SEQ ID NO: 29541 - DNA, 201 bp, Homo sapiens
gcataggagatgcatgttccagaagcttgaaatattttgccaatacttgtatttgctggacttccagtttctcctggaagtcaatctgtgaataacttcgrctatttctcccaagcctgccttttcagcttgtgtatatgaaggcagaggaagtgagaacagcgatcaataggtgtttaaagtcagagagcccaaggatat

SEQ ID NO: 29542 - DNA, 201 bp, Homo sapiens
attagaatcatctgggaagcttttacaagtaccagtgcccaggaccaattaaaccaaaacccatggggttggcacccaggcatcagaatgctttaaagttycccaggtgattccaatatacatccaagtataagaaacatgctgaaagagaatgatacgatgctaacctgccagtcattctgtaagaaggggatgcagcta

SEQ ID NO: 29543 - DNA, 201 bp, Homo sapiens
acctcaacactgtcttgagaaatgatgcatttacttttcaatttttggtcatgaagttcacagatgataggtttgagttttgtaatgcttgattttatggrgtttttggttgtttgtatatttgtttctaattattattattctttataaataaatttagaggtgcaaaattgtgtcagagattttctccacagataatag

SEQ ID NO: 29544 - DNA, 201 bp, Homo sapiens
taattgttctattttattattaattattgtcaatctctcattgtgcctaatttataagttaaattttatcataggaatataggtataagaaaatattataytgtatattggattcagtaatatctccagtttcaggcatccactgggggtcttggaatatatccctggtagataagaggggagggggctactacaattttt

SEQ ID NO: 29545 - DNA, 201 bp, Homo sapiens
caaagctaatccctttcttaacccactctatctagtagtacagcgtgtagatgcaattttcttattgcatttgaacttccagagagctcctggtgctgtaragttctctgacaggacagtctgattctcatcatgtgtattaattagtaatttgtggttaaagacatcatcttggaggtccctgttttgtttgacatcctg

SEQ ID NO: 29546 - DNA, 201 bp, Homo sapiens
caccttgaacccaagattggcccctagaactgtgcaaaacaggcaacactgcagggtggctcatggcactcaactattcctgcactgatgacattcctgtrctgatgacatcacccacatgatcatctgtttataagtctgtctctttaaatggtgaggaaagagaaataaaggtgtaaaaatccagccatcataacaaaa

SEQ ID NO: 29547 - DNA, 201 bp, Homo sapiens
aagaacatcaaacaaaatattctgttcaaaagaggaggtgatgaaaatggaaaattaataaaagtcaagatatgagaagagccctacgtgtgtaaaattgrcacctttaaaaaaaatttaagtacctggatttattgtcacacataaaagatttgcatgaaaagagtgagcgagtgacatatttaggttacaacatatcca

SEQ ID NO: 29548 - DNA, 201 bp, Homo sapiens
tgatttggaagttcaacctcatgttgttaatatctatggagatacccccttacacctgtgagtattatgtagcattccataggttctccaggtatactgcrtgtacttgcttacaatattaacaagatattttcttcaaatctagggcatgctacaatggcaaatttgaagttgccaaggaaatcatccaaatatcaggaa

SEQ ID NO: 29549 - DNA, 201 bp, Homo sapiens
ttttacttagaaaacaagtgtaaagcaatgaccaaatgacacatctttaaaacaaaattttagatatagtaaacatataaatatcacataattggcaaatraaatcacccatgtataatatagtttatatgaaattcgtcaatggatgtaacaaggctttcacaagtgttcaacttatggttcaaaaagtagttggttctc

SEQ ID NO: 29550 - DNA, 201 bp, Homo sapiens
atttgtgtcaaggtctgcctgactccatagatagcgctcttcctaccataccctgcttacaaaaacaagatttaggtcctgatttattcattgatttttgsaatcattgtagataaaaagcatagttaagtaaaggtgtgtaggcaagaatgaatgagtaccatagaaagtttaggaaaagtgagaaaaaataatgtcttc

SEQ ID NO: 29551 - DNA, 201 bp, Homo sapiens
agcttagggtattagaatacataagtgatgctcaattggcagtgaatttgacatacacagttactttagaagaggcaaaagaagagaaaatggaatttctstcctaggaatgattgcttaaatatcttgaatattttaattacatgtttcaaaacagaaacgtttgactagaagttaatgggaagtgagaattaggattca

SEQ ID NO: 29552 - DNA, 201 bp, Homo sapiens
aggatccgggatttagtgagtagtttatatcaaggagactcttgaaaacaacctgaagtgagccttaagagcagaagtgaggcgtatagtaggtgtttagyaggtgttgtgccagacttattgaatggatcatcaaatttagatcacagaataagaaagcaattgagtttaccctctcaaataaagtgattttcatctcaa

SEQ ID NO: 29553 - DNA, 201 bp, Homo sapiens
taagtcaaaaaagaaaaacagtaacccagagcctgctcctctagaaggaggtttaagtttctgtcactggatagtcatactctgggtccagacttcacctrtgggatccttcaggaggtagtgctgtttgccttgggggattcccttgggcagccggtggtggtctagtggatggagcctgcctcctcctcggccttcctt

SEQ ID NO: 29554 - DNA, 201 bp, Homo sapiens
gttatactctctggcatgggaaggagaataaaaagcaaacaaatgaattgtgtgtctcctccaggttctttagtaaacagacatggctcagggcttctgcyatcaacctagggacagacctgacttcatttcttcttgggtccctgctttccaggctctgtgctaggtcctcggatttaggtgaatcagaaatgacagtgc

SEQ ID NO: 29555 - DNA, 201 bp, Homo sapiens
acttagaaatggtattgacagtacaggttgacatcaacaacaagtggaagtgatgactataaatttcgtgacagttctttcttctcgaggaatgggtgctyattgtgtcctctccttctggaatgctctactatacctgttgcccttgactgcctattgcctggctgtctcctgtcaattttttcaaattagtctcaattc

SEQ ID NO: 29556 - DNA, 201 bp, Homo sapiens
ctgtgtctccttcccggcccttttaacctttgattaatctctccctcctctgtgttttagtcacactcatatgtatccctggcataacacacacatcttgwggcactgtgataattggtctgtatgtttactcatccattcttttgttcaacacattttattgagtgcctcttatgtgttgtctgttgccctctttggact

SEQ ID NO: 29557 - DNA, 201 bp, Homo sapiens
gagcaacacaaaggatggaacataaaaaaatcttgcagagaacctgattgcttttatgtattcaggaagaaggggatgggggtagggagggtggcaaggaragaaatgtgcagagcagaatttcatgaggtttttttttttttttctggtttattcaaagattattatgtgttggatacagtaaatcatctatacacccac

SEQ ID NO: 29558 - DNA, 201 bp, Homo sapiens
tgtaatgaagctggtcattcttgctttgtgtagccattccccaagaatcccgagctttttagaaaatcaaagaagatgacgttcccccgcaatttctaccytaaagacctatttctgcatgagttgttcttgggtttttatgtctttattttgccttatttcctacctgcaagttaaatagcaatgaaaagggaaaacata

SEQ ID NO: 29559 - DNA, 201 bp, Homo sapiens
cagtataaataaatcaagtactactccaatgtgagttaggtctaatttttgctgttaagtggtgttttgtttatatttttcataatttattttaattttaygcaaattaaattgggctggatagattgaccatctgaccagtttcctagaacttatgcataaggtttatcattgagataattgttttaaaaatatccttta

SEQ ID NO: 29560 - DNA, 201 bp, Homo sapiens
ggataagggtatttgtaaaagaaacatcatgttctgtgaccttctttggttctttcctcttgatcctttcgcatgaattgtgcagtgaggctatatctccrccagaaaaccaggagttaaggactgccaaaagtatggtgacaggtgtacaagaaccctgcactgggctcttagatgatgaatgtcagtactgagttctgt

SEQ ID NO: 29561 - DNA, 201 bp, Homo sapiens
ccagattgccagaggcattgaatgctgtgccaagaagtctggactttatctgggtgcagaatggagccatggaagggtattttgtaggttttgtttgtttwtcattttagaatgggagtcagtgaagaataggtactatgcacaaggtacaaaattcaaaaagtacaaaagagatacagaagatgtttttaaagcatatca

SEQ ID NO: 29562 - DNA, 201 bp, Homo sapiens
cattatcataggattctacctttccatgagtgttctgctggttaagggcatcttaggagtctgcaaaatggggtgtttttttccttcacttacttgtagtrgggtcttggtaaagtcattagcctgtctgagcctcagtttccttatctgtaaaattgggctaataataccttcctccaaagcttgtttagaagatgaact

SEQ ID NO: 29563 - DNA, 201 bp, Homo sapiens
tctttacagagagaggaagtgactctgttgatagccttaccagcaggctagattcatccctggctgtgaattgtcaatgaattctccgtttgagaacagakagaagaaatttggtcatggagttaagtgttatgtgctggggacataaacatcaccatttatcaagcacttcatctgtgctggatacttgctaagcgctgg

SEQ ID NO: 29564 - DNA, 201 bp, Homo sapiens
tgattgcttttatgtattcaggaagaaggggatgggggtagggagggtggcaaggagagaaatgtgcagagcagaatttcatgaggtttttttttttttttctggtttattcaaagattattatgtgttggatacagtaaatcatctatacacccacttccaggaggtaaatcttcagaactccatgtgtgggtagctctg

SEQ ID NO: 29565 - DNA, 201 bp, Homo sapiens
aatgtctactgcacagtggtccctcagtaaataaatctattattgtaagtacagctagtatgcttcaaggaaagtggccagaacagaaaaaaaagtatctrtcaaattctccaaatagggccaggctttgattatcttgtaccagagcactggaacatctatccttaaacagaatttcccatacgttcagaaagccaatat

SEQ ID NO: 29566 - DNA, 201 bp, Homo sapiens
tttcagaagtacatggaatggggtctgggggctttagctgtcttcaagtgtaaaagaagccaacaatgtgatgtgagctgcttcaaaaaaaaaaaaaaaaatcagcacaactttagttgtgttgggagaattatggactccatatcacagaaaatagtggtcctttcttgtccactctggtcagcccatcctagtgtctta

SEQ ID NO: 29567 - DNA, 201 bp, Homo sapiens
aaaatgaaatttctgggaacatatggcagggtcttgtaattcacctccccctgcccccaccacacgtacacacacacacacacacacacacacacacacamgccactcacacaccatacttacacagtgagatggaaagagaagggtcccagcagctggagtgcacccagcattctctccttcctcttcagttactaatcc

SEQ ID NO: 29568 - DNA, 201 bp, Homo sapiens
catagtgtcttcatcatcttgctcagtagagctgcacactttaattccccttcctacagtcaagggaaagagatgtagtctttaatagtccacatcacacycccagttctttcactggccatccatggtaagtaccctgactctgggaactggtgcatggtagaggaagtaacctgactgcagacttcactatcagaggac

SEQ ID NO: 29569 - DNA, 201 bp, Homo sapiens
cagacggttcctagggtcacctgcagaagaatagccagatggggaaactcaacgcctaagagattcagatgtttaagagtcatgtaaaagcctcaaaagcwtttgaggtcccaacatgtaaagtataggaattctcaggttggtatttgggcatcagagagttgggtggaggttgtaaaaaggtctgccacagaggacagt

SEQ ID NO: 29570 - DNA, 201 bp, Homo sapiens
tgtgaccaaatgagtttgaaaaactgaagtgaaccaagtttaaaagtgatttattggtggggcatggtgcctcatgcctataatcctggcactgtgggagrccgaggcaggcggatcacttgaggtcaagagttcgaggccagcctggccaacatggtgaaaccccatctctactaaaaatacaaaaaattagctgggctt

SEQ ID NO: 29571 - DNA, 201 bp, Homo sapiens
agatagcagtattgtctgaaagcactttgcaaacacaacagagctacctatagctttctgcagcttaaaaatgagaaaagcagcgatttggaagctttgtytaggaaaggttgcatttgttaatttatttaactatcatttattatgaatcagatataagccccatcctcaaggagctcaagtgggacagacatgcaaaag

SEQ ID NO: 29572 - DNA, 201 bp, Homo sapiens
aaagtgatgattgtacatatcctagctttctcgtggttataagaataacacagtaaatactctgtgaatatttgttgaatgattataatgagtaaatgatrtatgttatttaacctctttcttagttttccttatatgtcaatgcagagataataataacagtacctaccttataggattgttgtgaaactaagtgagtaa

SEQ ID NO: 29573 - DNA, 201 bp, Homo sapiens
caaagttttggattgatgttcaaattacattgagaaccttcagtaaaaagtgatccaaaatggaatgtgagggtttggtatcacacccactaaacctttcrgagtgttgggacacctgtttgcgttttgacctaaatgtcaggagtaggattaaacaagcgttcactgctggctctgcctccagaagctcctgtctcatgg

SEQ ID NO: 29574 - DNA, 201 bp, Homo sapiens
agacattggttttcatcagctctattaggagccttatccactcatttttaaagcaaaacatgcttctttgtaaataatttggtatgtacagaatcatatcrtgaaggcaatatcagccattcctaagccaacagtgttaacatttttatatatttatatatttccatccttttttttttttaaattaagacagggtctcgc

SEQ ID NO: 29575 - DNA, 201 bp, Homo sapiens
caaaatgaaatttctgggaacatatggcagggtcttgtaattcacctccccctgcccccaccacacgtacacacacacacacacacacacacacacacacacgccactcacacaccatacttacacagtgagatggaaagagaagggtcccagcagctggagtgcacccagcattctctccttcctcttcagttactaatc

SEQ ID NO: 29576 - DNA, 201 bp, Homo sapiens
agcttgaagttcattatttcatatcaaggagaatcatcatcatttttcctcttcctttctgaaatgatgttcatctgttttttgtttgtttttttttttttcattttcccaaaagcaccctcattcttgatgttaaatgcagtctctctctaaagttagagcaggtgataacacagttgtgctaattgcagtcaggaacta

SEQ ID NO: 29577 - DNA, 201 bp, Homo sapiens
ggaaaataaggggttataaccagctatgctctcaacactttctagagattaaatataacaaaaatgcttaacacaaactactggagataatttactctttyacagcagattcaaaaagcctctgatacatttcagggtctcagaatcattgttattataataacattttagttcaaatggagtaactagttgtggcagaga

SEQ ID NO: 29578 - DNA, 201 bp, Homo sapiens
ttctgttcctctagaaccactcctggtaccaaaatctgtattagtcagggttctttagagggatagaactgataggagatatgtatatatatatatatatwcacacacacatatatatatgtatatatatatatataaagaggagtttattaagtgttaacttacatgatcacagggtcccacaacaggttgtctgaaagc

SEQ ID NO: 29579 - DNA, 201 bp, Homo sapiens
gtggctgtagccaggtcacccttggtgagtggaagtccatgttgctgagcctatgcataacctccatccctgccaccgtggccactttgttcatgacaggkgtggctggggaaagaggctgagtggtgtccacataatgggccattctatccacttaattattaaaatcctcctctgctgaagttacccattggtgagcac

SEQ ID NO: 29580 - DNA, 201 bp, Homo sapiens
tactaattcctctacttactgtgtgctttgggttgacagaaaactccttagcatttgtgtaagtgcaatatagtttagcatgagagattttaaattagatrttcttggttccggtctgacctcaccactcagtagttatgtgacttgcataattaattttttggtccttcctgccacttttttcgccatagatacatgggg

SEQ ID NO: 29581 - DNA, 201 bp, Homo sapiens
tttgtttgttttttgagacagggtctccctctgccatgcagcctggagtgcaagggcaggatcgtggctccctgcacctcctcctcccaggcccaagcagtcctcctgcctcagcctcccaaagtgctgggattatacatgtgagccactgcacgcagcagttggcctttcttaatgaatagtgtagctttgtaattggtc

SEQ ID NO: 29582 - DNA, 201 bp, Homo sapiens
ccctagggtgtgcattttaggtattggtaatttattttggggctcacagggagagaagagaaaaatgagagctacttcccattctataactttcaaaaaartgagcagataatctcaaaaccaaagatatgtcatctcagaaaggactgtgaagaaaataaaattagatttgctgtaaatcagtatgattgagactggtct

SEQ ID NO: 29583 - DNA, 201 bp, Homo sapiens
gtacgagagagagacagcactacccaagagctccgcacaccccagcacacacacacatcccccaaacacttttctggcatgcatgtgcgtgcacaggcacrcacacacacacacacacacatcccccaaacacttttctggcaggcatgtgcgcacgcaggcacacacacaaacacatcccccaaacactttctggtcaga

SEQ ID NO: 29584 - DNA, 201 bp, Homo sapiens
tctgctgctggcagaagttagattaggatctggaaaagggaggaaggcaggaaaacaacctggtagatgctgatgtgtaggtgtctgagtcctgcccaacyattgtcactcccatcttgccaggggaattaatttttcacttatttaatactgaaaattcccttttctgtttgatttttgtcctcatgattggaactttta

SEQ ID NO: 29585 - DNA, 201 bp, Homo sapiens
cttcttgttttttgacatgtcactttgatccaaaaaggattttcattggcttattagatagtatggaaaaaactaaaattgaaatagccatcaattttttwaaaaaacagaatagaaggaaatggatatagaatggtaaaaggagaccagaggaaatttagtaaattaattgtggttaaatgactcaaacggaccacctag

SEQ ID NO: 29586 - DNA, 201 bp, Homo sapiens
ggctgcttatttttcttgctctttcttcctctcttttctttgcctggtttgttgttgttgttatattttgtgtgtgtgtgtgtgtgtgtgtgtgtgtgtgtttgtcctgcttcctctttctgccttcttgttttttgacatgtcactttgatccaaaaaggattttcattggcttattagatagtatggaaaaaactaaaa

SEQ ID NO: 29587 - DNA, 201 bp, Homo sapiens
tggctgcttatttttcttgctctttcttcctctcttttctttgcctggtttgttgttgttgttatattttgtgtgtgtgtgtgtgtgtgtgtgtgtgtgtgtttgtcctgcttcctctttctgccttcttgttttttgacatgtcactttgatccaaaaaggattttcattggcttattagatagtatggaaaaaactaaa

SEQ ID NO: 29588 - DNA, 201 bp, Homo sapiens
actgttctaagtccttgtgtgttttgtttccttttgccccaaggtacccatgtgctaacaaataataaagaaaaaatttcaagcaggagtttttacattasttgagttgtgaaaccttgaagatgatgtaagcatttcaaaatccttgaacaagatgtaagttttaatggtatgcataacatatatgacacacatttacat

SEQ ID NO: 29589 - DNA, 201 bp, Homo sapiens
tagcattgaatcttctcctgcttctatgagttatcctttagcccttaaagttgttttgccaacagtgttcataatagagactgactgtcattccttgttgkgtgaagatgtatttgttgaggacttactatgtgcatttctttggaacgtggaatccaaggtcaccatttctttttcttttgacaatgatcagaagacata

SEQ ID NO: 29590 - DNA, 201 bp, Homo sapiens
agcaataaaatgagtgctttggtcagaggcaatgttgtgtggaataccatgatggtggataaggcattccgtgaatccatggatggtagtctcggcagaakcattgtgtgcaggataggcaaacccatttctggagtaagtgtctattccagtgaggacaaacctctgccctttccgtgatggaagaggtctaatataatc

SEQ ID NO: 29591 - DNA, 201 bp, Homo sapiens
tctaaaaatgtgtggtcccaagcctcttaaacttcttgaaatcaaagaaagccaactgctggcctgaaggtcttggcagaatggtaatgctacttctatarcattaaccaccaaaagcccttcatctccaaggatagacaggctccttcaatcactcggtgcactagaagccaggaaacaagaaagggcacccacccacac

SEQ ID NO: 29592 - DNA, 201 bp, Homo sapiens
acacaaaagatgccttttgtgtaggaaacattaggggcaggcctatcactagcaggtgattttgagagaagcagctaaggtaagatggaaagaattgaatwtgagtaaatcaagagaacaccaagagctgtatctgaacatgacggaaactgtaaccaaactggatgggcaaggggtaccagaagccctatacttataggg

SEQ ID NO: 29593 - DNA, 201 bp, Homo sapiens
agtgcctgagactgggtaatttataaagaaagaggtttaattgactcacagttccacatggctgtggaagcctcaggaaacttacattcgtgtcagaaggygaagcacacatgtccttcttcacatgatggcaggaagaagtgccaagcaaaaggtggaaaagccccttataaaaccatcaaatctcctgagaactcactc

SEQ ID NO: 29594 - DNA, 201 bp, Homo sapiens
ggatgaatgaagcaaacaggatcctgactgaggcaaggggggttctccagggcgctggctccagtgttggaagccctgtgactccaggccactggcccagsggcattaatatgccatcaatgctgaccctgaaaattggcaattttttggaaatctttcagcctaaccaagggcctgaccactgtagtcattcagttagaa

SEQ ID NO: 29595 - DNA, 201 bp, Homo sapiens
cagatagaagaaatttggtcatggagttaagtgttatgtgctggggacataaacatcaccatttatcaagcacttcatctgtgctggatacttgctaagcrctggacataccctatttcatttaacacggagcctccattttcttagatgaggaaactgaagcttggtgatttccccaggcagcatagttattagcaggtg

SEQ ID NO: 29596 - DNA, 201 bp, Homo sapiens
acactgtggccaaaaactaggagcaagagaaactgtaggctgggtaattcatggatgccttttgtacctctctatgaacgtgaaccccctgtattccttcyccagcagagacatgagcatgctttgtccacacagccccgctgggccttctcactgttttatgagacagataccaagacacatcagagtggcagcccctca

SEQ ID NO: 29597 - DNA, 201 bp, Homo sapiens
tcacctgggcaccaaggggccaaatgctcactatagtttctaaattttggaggcagtcttaatttcatatctcattttttaataaagaggattcaataaaygtaactttgatgatttcctttttatttgttcaacttcccatcaaaatagactcataaattgggaacaaaaatacagcttgttttaattttctgttctgaa

SEQ ID NO: 29598 - DNA, 201 bp, Homo sapiens
acactagctacatgtggaggacacatgagaagactagaaactggacagtgagtgatcagttatagtaacttttgggaggtgatgatggggcagagcagtgrtagaggactagaggggccagatgcaagagagccctgtgttctgtggctgggaggcatcagtccagagccatgatagcaggaatgcaggtaaacgtgtttt

SEQ ID NO: 29599 - DNA, 201 bp, Homo sapiens
gaggagatggaagccattttatgatggacaaatagaggacggtgtaagacaaaatggaaagttgcgaattatgggctgcgtttggggccaggaaatccggktgcaggcctggactttgcccccatttttctatgataacagagaagtaactggacatctctgggcttcatctcgaatgtgagtgttgagctagattttgtt

SEQ ID NO: 29600 - DNA, 201 bp, Homo sapiens
taaaaagaaagaaagagagagagaaagaaagaaagaaagaaaagaaagaaagaaagaaagaaagaaagaaagaaagaaagaaagaaagaaagaaagaaagrgaaagaaagaaagaaagaaagaagcagtgaagggagaaattaacaataaactttcaagtgtgataaagtaattttcagatttaaaactactctatcagaa

SEQ ID NO: 29601 - DNA, 201 bp, Homo sapiens
ttaacatttctcaagcctcactttccttatctgcacagtaggcctgatgatacccatttcacacagaattaaatgaggtaacattaataagccacttagcrcagtgcctggcacaaagtaggcactgaataaattgtagctgctattagtccccatgttaatataatcttcacagtgatactttgattgtgagaattaagg

SEQ ID NO: 29602 - DNA, 201 bp, Homo sapiens
actgaaccagagactgtttctagaaatgtgatttttattcatttgggctcccatgagtactctaatgtaggaacaaacagagtgtgtccaaggagagatcytacaggatagctctggggaggagacagaatcatttttaatactgtgactccaaactggtttgaaggacttgacattttctttcttttttaaaaaacaact

SEQ ID NO: 29603 - DNA, 201 bp, Homo sapiens
tccttatctgtaaaattgggctaataataccttcctccaaagcttgtttagaagatgaactaattaacatgtgtaaagaacctgaatcggggcccggcacstagtaggcatctaataaaggaagatttttaaaataagctcagtccccctagggtgtgcattttaggtattggtaatttattttggggctcacagggagag

SEQ ID NO: 29604 - DNA, 201 bp, Homo sapiens
gttataaccagctatgctctcaacactttctagagattaaatataacaaaaatgcttaacacaaactactggagataatttactctttcacagcagattcmaaaagcctctgatacatttcagggtctcagaatcattgttattataataacattttagttcaaatggagtaactagttgtggcagagagtacaggatttg

SEQ ID NO: 29605 - DNA, 201 bp, Homo sapiens
gatgcctcacgcttacctcattgttacaaatataagttccttttagattataaagcgctatattctcattgtagaaacaaaacaaagagttgacaaataawcaagtcatttgtttaggatgtaggcatttataccaggaaaaggacagtcagttcagtatcaaaacaggtaggattagtctgagtgtatacgatttatatg

SEQ ID NO: 29606 - DNA, 201 bp, Homo sapiens
tgacttgcccaataatagatatccagtaaatgacaagaatagggacttaaatcctggttttgtgacttcaaagcatgatcaatttgttttgttttttttttgttttgtttttgtttttgtttttgtttttgtttgagacagagtctcgctctttctcccaggctggagtgcagtgccgcgatcttggctcactgcgagctc

SEQ ID NO: 29607 - DNA, 201 bp, Homo sapiens
tcagccaaagtttacttttcttgggggaaaaataaggtaatttctcttctatatcaaatttttcgttggagaatcaacaaatatatatatatatatatatagcatgtctgttgcatataaaccatattctagatgcatcctggagcatcatagtatttaaaatatattatagtaagcaaggacaatggcaagcagaatgat

SEQ ID NO: 29608 - DNA, 201 bp, Homo sapiens
ataacctattgaagataaatatattttaatttttataaatttcaccttagcgatgtgacctaaaatgtaaccacctcaagtagacactgaattttctacaygaaatttgctgtggactaaattgtgtcttcaaaatttgcatattgaagctctagctcttgatgtgactgtatttggacataaggcttctagggggtaatt

SEQ ID NO: 29609 - DNA, 201 bp, Homo sapiens
ctcagccaaagtttacttttcttgggggaaaaataaggtaatttctcttctatatcaaatttttcgttggagaatcaacaaatatatatatatatatatatagcatgtctgttgcatataaaccatattctagatgcatcctggagcatcatagtatttaaaatatattatagtaagcaaggacaatggcaagcagaatga

SEQ ID NO: 29610 - DNA, 201 bp, Homo sapiens
gcaaaaatgtgtaaggaaatgtctgacatgagatagacctgggcctgggaagtgagtctggagcctttagtcctatgcaagaaagaggataagctgtgttstgtaaggccagggagaatgggaagaaagagagagggggaggggaaatatttgacgattatttaggggtataatgcctgaaccataatagttgcttgataa

SEQ ID NO: 29611 - DNA, 201 bp, Homo sapiens
gtgaccgttttggcatgccaaattggaagtttgctagtggagcagaaatcatagttactttgtcatatacatctaaatactgtggtgtgtgtgtgtgtgtstgcgtgtgtgtgtgtgtgtgtgtgtcatgtgttgtagacagctgggagccccggtgtgccgtgggatgtgccaataatggcttctcaagtactctgtgtt

SEQ ID NO: 29612 - DNA, 201 bp, Homo sapiens
catttctgcccagtgtgggaactcccctaatgggtaatctttatttcagagctctccattaggttggcaggcctttgtctgatttgcctcatagtctgagrctctgtctccaattctactttcttcaccctcctcgccccaaaattttcacagcaaactaataaatctcttgcacttctgtctgtctcattgtctgtttct

SEQ ID NO: 29613 - DNA, 201 bp, Homo sapiens
aggctggagtgaagtggcatgatctcggctcgctgcaacctccacctcccgggttcaagcgattctcatgcctcagcctcctgagtagctgggattacagscatgcaccaccacacccagctattttttttgcattttagtagagatggggtttcgccatgttggccaggctggcctcaaactcctggcctcaagcgattg

SEQ ID NO: 29614 - DNA, 201 bp, Homo sapiens
tctctgtctctctctctctctctgtctctcactctagctccagctgtctctttctctccaccccacccttgagactgtctttgctcagaacattttaagaycaaccaattttgctttaggggagctcatattcagatccttgttgtatctaataccaaaggtatttctcccctcaataaagatccccctctacaaggatca

SEQ ID NO: 29615 - DNA, 201 bp, Homo sapiens
atgttagatacatgtatataagtagatacatgtgtatatgtattaggtgtaggggagacatatagggaattggctcacatgattgcagagggtcacaaatsccaaaatctgtagtcagcaagatggagacccaagacaattgatggtatagttttagtacagatgctggcaggcttaagcctggaaagagccaatgtttca

SEQ ID NO: 29616 - DNA, 201 bp, Homo sapiens
cattggtaaaaataaggaggcggtaagatggaagtgttaacatctgtgctttgctttgtaagttggtgtgcaagtgtgtgtgtattaggaacatccttatrtttgtgaaatctccacgtattttaggggtaaagggcttttataggtcactggctttctaagggtaaaaaaaaaagaaaaggtgatctgtgggtgggtggg

SEQ ID NO: 29617 - DNA, 201 bp, Homo sapiens
tccagcacggtgctagacaggatagtctagtgattaagagctagactacctatatctacgtctctgccttatcatttactagctgtgtaacaggcaaattyttaacttctctgggcctcaggtttatcatttataaaatagtgatactgataggattattgtgaacattaatttatgtaaactacccagaacaacacctgg

SEQ ID NO: 29618 - DNA, 201 bp, Homo sapiens
acagaatagttttaatcttgaaaaatgtaaggttattttctttcctaataatttttcacaaacccatttattcttggactttgaaacccagaaatatagcwtattttttggtctgtatgtctactctgcctagttctgtctcactgtcaactctagtcaaagattaaagattacattgaattttgtatttggtaatatgtg

SEQ ID NO: 29619 - DNA, 201 bp, Homo sapiens
gtagaagtgttgaggaaataaggtcagtgtaatttttgtgcttgcgtttttgttttttgttgtttttggaaagtcttatttttaaccccaaaagtaaaatrcaaaactagcatatgggatttttttaatgaaaaaaatatatatgtcttaggtctctcctgaaaataacctcccttggactcttcatttgaaaaataacat

SEQ ID NO: 29620 - DNA, 201 bp, Homo sapiens
tttcttcccttttctaaagggacacaatgtttaaggtaaaaatcatattaaaggaaagaaaaaagcaaaccccttttgtatgctgtttaatagtctcatcwtttattaatttttttaaattgcttttttgtctttcaggccactgtttacctctgcttcagtttgctttgataagtgacatgagatctatctctttgctct

SEQ ID NO: 29621 - DNA, 201 bp, Homo sapiens
ctgtgaaatgggacaaatgttccaggagggtcaggaggaggatttggccaatcattcaactaagaacagggtcagccagaatgtcttctcaattaaggctkttaagatctcctgatggctccttgcaggagcctgaacctagaaggtgagttagccttggcattatcataggattctacctttccatgagtgttctgctgg

SEQ ID NO: 29622 - DNA, 201 bp, Homo sapiens
aaagcttgtttagaagatgaactaattaacatgtgtaaagaacctgaatcggggcccggcacctagtaggcatctaataaaggaagatttttaaaataagytcagtccccctagggtgtgcattttaggtattggtaatttattttggggctcacagggagagaagagaaaaatgagagctacttcccattctataacttt

SEQ ID NO: 29623 - DNA, 201 bp, Homo sapiens
aggcttttagaggcctggggctctgtgaagaaaagcacttggttaaaatggctctggagtcttaaatcctgagtccaattctttctagtaataagttagartatttactttttagtgggggatgaaggggatggatgatttggttattttcatatgtcaaaaatttcaaggaaggactcctgtgctaactggaattataca

SEQ ID NO: 29624 - DNA, 201 bp, Homo sapiens
aggacagaggagagagaggagttgtctgaagctatgtaggtcagggaggtggactccagggagtcttgcaaaatggcagggtaatttagatggtgatggcraaagcatttcagtggacatatatgcaaagacatggaagggacatactgccaaaggcattcagattatggtacttggctcactgcatctggaactttgttt

SEQ ID NO: 29625 - DNA, 201 bp, Homo sapiens
gacacttgctctgttatctctacacttcccaccacacctttctgactgtgccctggaaaaatcctctggaagtgcattctgtcagtttagctgcttattgrggtatacagtaagaaaggagcagtccaagtggaggatggaccaagaacaaccctgctcttccaccctgagtttccttgtggggagccggaaaagccctct

SEQ ID NO: 29626 - DNA, 201 bp, Homo sapiens
gggccattcacagtggatggctttttgaaagggcaaaagataccagaaattgtgtttgtaagtgtcaaacatgctactttcattatttctttttttagaawccacatagcccctccccctttgctatgtgtttactggtttggcattattgtgagagcttattagtggatgtttgtggagcattgtgaagatgaatagcta

SEQ ID NO: 29627 - DNA, 201 bp, Homo sapiens
atttacattctctaagattactaggttgcatttcatagtgataggaaaagtcctcagacttagagattgaagaaagggcacaaatttggtttcagccttgrgttcaagttacagtcctagttaagtgacagtggactctgcctgaagactcattactccatcatgtgtagagtgacagcacttctacatctgtaaatgaga

SEQ ID NO: 29628 - DNA, 201 bp, Homo sapiens
ggaggtggcattcagtatgggcttagaaagatgggcaggagtttattctgccatgatggtgaacaaacagcaaaacaaagacatagaaatagaaattttckggacatattcagaaaactgtgacatgtttttgtctgaactggagcatagggtgcatgaaggggttggcaggagatgagaggttgggccagattccagagg

SEQ ID NO: 29629 - DNA, 201 bp, Homo sapiens
gtaaacactcactcagccctctgccccatgtctgtgtctgtgcatctgtgtgttatccttggtcagactgatgtctggaccagtccccccttctgcttgtycccccaggttctccccaattaccattgatggaatgacaagccttgtgggaatgaacatccctggtcacacaggaactgggtggtgcatctttgtctacaa

SEQ ID NO: 29630 - DNA, 201 bp, Homo sapiens
accatggttcattgagaacactgctggggagatttttaggagaaggtgagattagagaaagctgcctagagaagatgtcatttgatctgagccctgaagargagtaggatttggacttgaggaagtaggtataaaaaaaatgtctgtatgagcaaaggtataaaggtggtaggttgtgttttgagggagcacaaatgtcat

SEQ ID NO: 29631 - DNA, 201 bp, Homo sapiens
tggggaaatggtttttgttgtgtcaccaactttcaagtgccagctcctcttccctggcagggttcaccctgttccctctgtaccctagctctggctgtgcrgaactaatgggagttaaggtcatgactatccattatgcatttattgggtgccaggtactgtgctaagcccttgatcttcatcacctcatttgtcctcgtg

SEQ ID NO: 29632 - DNA, 201 bp, Homo sapiens
cccacactgcaaatgcacacactgggaccccctatataaaggcccctctacatctcagccatgtgctgagaaggagcccacagaggcctcccagcccaccygtgagtttctagaagatggagatactgaaggcagctgcctcactccatcagcaggaggaggccagggaggcagattagtcactcacatcattttatctgt

SEQ ID NO: 29633 - DNA, 201 bp, Homo sapiens
tcgactgaaaatgagccggctacagtcatatggaacaggtctgtttagccacatcactggatagcctggcagatggtagaccgtcaatgggtggtattgaytggctggatttgccttagggtaacaagactatgggtccttaaaaacccgcttcatcttattttcctttgtgcagcttcatacagtagtggttttctcttc

SEQ ID NO: 29634 - DNA, 201 bp, Homo sapiens
acgggaaatgagctactcagcattaatgtgtaactttactcttctgcttaaaagtagttaaatcatttccccagctttagagtcagagaggggaagaactraaaagggtcaagtggagagttgcctctttctgacagttatatagcatgcctctcttgtttttcacatttttttatttgcctctcatagagaaaggaagca

SEQ ID NO: 29635 - DNA, 201 bp, Homo sapiens
ctccccccgagcctcagtttccattcctgtaaaatgagacagttggagcagatgcccttctaagccctcttccaatttactactgtgactgtataaacttyagattctttggtagaaacaaaatgtctgtatttaaccaaacatgaaggttcagtttcaacaagagttaatcacagatcagtgaccacattcagcagatta

SEQ ID NO: 29636 - DNA, 201 bp, Homo sapiens
aaataagggtctttgccttcacagcttagtaggaaagatggaaatagagataaataaatgatggatacaagtacatatatagacaagttatgatgggtatrtgtgtggggaagggccaggattggaaacacaaaaagagcatggtaagttcttccttagaaggtcagggatgatgtcacaaaggtgacatttgagctgaat

SEQ ID NO: 29637 - DNA, 201 bp, Homo sapiens
gctgggaggtgctatcaggcagtaaacagtaagccactttttaaaaatcttaacctgcaaactccccctgcctcccaaaaatgtgtgtagtaagatgattyagttaatgtagcaaggctaacagaaaagatctgttctgatacatattgtgtgcctgtgtattgttaatctggaacagagacctttatttacaagtttaat

SEQ ID NO: 29638 - DNA, 201 bp, Homo sapiens
ggactctgcagatccaaggccagttcttcattctgagcccctcaagtcactccttggcctctgctgttctttagctaaaggaagagattcccattgttcccatctatttttccaaagggagaatgccagtactgaggaagagggtgggcttagagagtcaatcaattatcttttgggcttaaaactaaagaaaatgaaccc

SEQ ID NO: 29639 - DNA, 201 bp, Homo sapiens
agaggtgcccagattggctctattttcagccttcataatctgggcaggatcttctgaaaactttattttgctaggcctagaggtagccattgtctaaaaawacagttgccccttgctccttttcctctaaatctatatccaaatagtaaggaaggacctattcagagcaaagaaagcatatttgcgttgtcattgctggca

SEQ ID NO: 29640 - DNA, 201 bp, Homo sapiens
atagaagttcaaactagatcaaagtgtaggaacattttgagggctcttgcttcacattactgcaaaaatttcatcccagcatcccaaagtgtatacaactrtaagcactgtgtgggggtgccagtttcactgcatccttgccagcatcatcagtttttaaagtcttagctattttgataggtgacttaaaccatgcctgca

SEQ ID NO: 29641 - DNA, 201 bp, Homo sapiens
aaggcctcagccccttccatgagaagctctgaagctaagatagcctttcaaaatagtcctgagtcagggtgagggtgtcaggtctttataccctatgttgrtcactcactggatgtggacacctcaagaagggggcatgaccttgggaaagacaattctctcagtcaaggcagtttcaaagagagttgacagttgagggtt

SEQ ID NO: 29642 - DNA, 201 bp, Homo sapiens
aaataccatctgctggatctgagttctagttattatccatctctcatcaagtgatgaagtctgggtgattcatttgccatctaagatgttcagtttctgcracttttaatttgtaattatttattattattttttagatggggtcttgctttgttgcccagactggtctcgaactcctgggcccaagagatcctcctgcct

SEQ ID NO: 29643 - DNA, 201 bp, Homo sapiens; identical to SEQ ID NO: 6050

SEQ ID NO: 29644 - DNA, 201 bp, Homo sapiens
cttaaagatgaaataggaatttgccagatgaagacactagaggaaggcaggggacagtggatcagtctgggtagacagaacagtaaaggcagaggtaggaagatgctcagctatgtgatgggtttatggaacattaattaagaaaatatatagaacactggctgtgtgctaggcactggggatgtaattatgagcaaatcc

SEQ ID NO: 29645 - DNA, 201 bp, Homo sapiens
ttgtatgaatataatgattgccataactaactagatacgcaaactaaatgcacaaagactctaagtgcataagaaagtagaagtctaacacaggatcctakaaatcccagaaactctagactttcagataagaatcctatacctttagttgccttctggacatcttcattggatcttgtgaatgagactgtgaactggtat

SEQ ID NO: 29646 - DNA, 201 bp, Homo sapiens
tggatgattcagggaacattcttcctcaggtcatgctgttcttcccaccctgcccaggccaagccctgtgtatgaacaggtaaagggagttgtgggtgctrcatgggaagaggcagccctcagccctcgtcctgatgccccatctgtgatgaatgacaacgcctgctttacccaccttggtgagacttgctgagagcagaa

SEQ ID NO: 29647 - DNA, 201 bp, Homo sapiens
tacctctctttgcagacaagttgatgccatctccacctaaagtagctaaatcctcttttcagagtttatttgcactcttagctttgtgttaggagctcccyagctctttccagtagaaaccccctctcctttttctttattgttctttggctcagggaatgatgagggtaaagaatgatttgtagcaactgctttgaattc

SEQ ID NO: 29648 - DNA, 201 bp, Homo sapiens
tggcaattttttggaaatctttcagcctaaccaagggcctgaccactgtagtcattcagttagaatttaatacatgtatatggaaagttgaaaattttagrtactaggatgaacatttggatattcaatgcaggaagatcttttttctgtcatttttgtttatccatacgccacaggtttcatggacaggaaactgagaga

SEQ ID NO: 29649 - DNA, 201 bp, Homo sapiens
caagtgtcaaagaaaagcgagccttcaacttggccctgaatttggtagagattagattgtaggagaccagtccatgcagaggaggcagctgagcgaagctycagagacattgttatggaatgaatgtttatgtccccgcaaaattcttatgttgaagttctaacccccaatgtaatagtttttggagatagggcctctgca

SEQ ID NO: 29650 - DNA, 201 bp, Homo sapiens
aagattactaggttgcatttcatagtgataggaaaagtcctcagacttagagattgaagaaagggcacaaatttggtttcagccttgggttcaagttacartcctagttaagtgacagtggactctgcctgaagactcattactccatcatgtgtagagtgacagcacttctacatctgtaaatgagaggaatgacaatac

SEQ ID NO: 29651 - DNA, 201 bp, Homo sapiens
attgataggatgcagcactctacagtcctccttggggtatgtatatattgtcatatacatgtctcaattgcatcatcagaatttcaagtttattgagggtkagtgagctcaaatattcatctgtttatctccacctacccctaagtttcatccttgcctgttgacacaatgttaccttatacagtagttgctagatgaatc

SEQ ID NO: 29652 - DNA, 201 bp, Homo sapiens
aaatggataagtcatagtttgtgcccatgtgttgctgcaggaccaacgagccagggaaaccagaacaaatgacagcccttcatgaaagtctggaagtgacrgggagctggctgcttattatgcatattaactacacatctaccttgctgttttgtgggcgggggcaagagggaagtggaggttgttttgttttgttcttca

SEQ ID NO: 29653 - DNA, 201 bp, Homo sapiens
atttacttccttgcaggcaggaactctttctctctccttcatatctctggcattcaacataatggtttctggcccatcgaaggaactcattaatgttaggraacttagcttggcttttgttccttcttttgagagctaacttcagtttgggggaggggctgctccaatgaagtactaaattaacatcattaaattgtgtct

SEQ ID NO: 29654 - DNA, 201 bp, Homo sapiens
actaaagaaattttagattgctctaattgacaatggatgattctgaatatgtgttaacattttactttttaaaaaaggtaaatttctgggataaaaagaayatattaagagttgcaagagtttaccaaacaaattttctttgtatctgtgattcaaaggacaagcttaccctactcagaaaagtaatgttttagtttcaaa

SEQ ID NO: 29655 - DNA, 201 bp, Homo sapiens
ggacaagcttaccctactcagaaaagtaatgttttagtttcaaaatacatgtattatatccatttgataaatatacatgataatatacatgtatcatatamtaaatattcttagggacatagtaaattaattctaaaagggtcttatctgagaattgtagattatgcagcttgaattataatacaaatgtaatttttgaaa

SEQ ID NO: 29656 - DNA, 201 bp, Homo sapiens
ttgacaaatttcttcattagctccaatgatctgtggccaccaggcagttaatttatatgcctagacatttaatatgtacatttgttggtgagctggccagmggatgctaaacacacgagtatgcgctggcaaatgctgcaatgcagtatttttttcccaatgtcattgggaattttggggctaggaagggacatgaacatt

SEQ ID NO: 29657 - DNA, 201 bp, Homo sapiens
atagcgtaaaaacaattgaaatggtgatctgttagggttttttactaaaggacaaaatagatgcatgatcagggagctaattgtaagcccaaaaatgagakatttaaaaatgctgaaatacactaaaagattaggaaatataattggctttattgaaagtacacttaatttttgctctcttcattgcaaatccccccaatt

SEQ ID NO: 29658 - DNA, 201 bp, Homo sapiens
gattagaagagcttctaaaggtaggctttctgacaaaaggaaaactttcccctgactgccctcttgtggaggtgccaaaatagcccaaagatggcaagtcyataaaatcatcataaaccttaattgagagagcagttttctgtactgtctgttgtactggttagtcaagctgccatatgcatataattacatatttttaaa

SEQ ID NO: 29659 - DNA, 201 bp, Homo sapiens
tggatagatctaacatacttttctctcactccactttgaactctggaatctgactgtttattccattcatttgacaattagtaataccctcttacttttcrtctcttactgttcctttagccttttgtatatttctgtcttgcatccccaagtggtgttgagttccatgagggcagggaatatgggtttaactgctttgaa

SEQ ID NO: 29660 - DNA, 201 bp, Homo sapiens
attttatcacagcaggagataggacaggcacatagagtactgtatattttacttcagaagtgttaagaaaagtgcctgacacacagtaggcattcactaargatttattacattgaattgaagttggattaattctcctctagggattagggaacctttgtactaaagaaacactgtacatttttatatgtttagctgtat

SEQ ID NO: 29661 - DNA, 201 bp, Homo sapiens
ggatttagaacgcttcctaccaaaatgctgcaattaactgtcaccaactaggatagaggctgtacttgcaatctctttgctggccctgacctttgacttayaataaatacttagctgttttctacctataaacagaaagaggtcagttcaccagggtcaactcacttggttggaggatagaatattaaaaagacaatcttc

SEQ ID NO: 29662 - DNA, 201 bp, Homo sapiens
agaagcccagcggtgctacggaaccgattactgtgaagtttgccaacaaccccagccagaagtccagccaggccctgctctcccagctctaccagtccccyaaccggcgctacccaggtccacttcaccaccaggctcagaggttcaggtaggcatgcccaaagaggaagaagccctgctacaggggttcatagctgggca

SEQ ID NO: 29663 - DNA, 201 bp, Homo sapiens
gttcacatggacaagtgctggctttcaccacgtgtctgaaaacgaaagatgaacctgactatcaggtgacctttatgagttttggtcccacagaatctcarcatgaaattcttccacatactccatcactagcaccaaataagctgccttggtgtgggatattttctaggtgtttgttggggagctgaaagaagggtaacc

SEQ ID NO: 29664 - DNA, 201 bp, Homo sapiens
gaactaaagtaatcctctttagttatcattagtattagcctctgaaacctttacttgcttgctaagataaggtacttgggtgtgggttgtaatagaggtggagttgtgagttagagctggtggccttactaattcctctacttactgtgtgctttgggttgacagaaaactccttagcatttgtgtaagtgcaatatagtt

SEQ ID NO: 29665 - DNA, 201 bp, Homo sapiens
gggaaggcgcgtgtgttacactaagcagtgctcatgtttagctgaggaagaaggagcctcaagtgttcgtagggtgtacctgtgtatgttgtaattgttgyctctctttgggctgggggctgttatacatgtaggatttagtaaacacaggtcttgaagtcttgaacctgcaggagactcatttgtttctacaaggagaga

SEQ ID NO: 29666 - DNA, 201 bp, Homo sapiens
tgatctgataagattagtgatcttataagaagaggaagagagactggaattttctccatacatatgcaacaagcaagaaggcagctatctgcaagccagaraaagagccttcactagaacccaaccatgctagcaccctgatcttggatttccagactccagaactgtgagaaaataaatttctgttgtttaagccaccca

SEQ ID NO: 29667 - DNA, 201 bp, Homo sapiens
gatggagcgagattccatctcaaaataaaaaaaaaaaatggggggctctttttatcagtacttctctgaacctgtgctaacacgacgtgaaaaggaatggyataatatggagcattacccaaggaacccttttccctccagcattttgtatactctcctttctaagccagtagagaagaatggagtccttggaggataaat

SEQ ID NO: 29668 - DNA, 201 bp, Homo sapiens
atagggtgactttgatcaagtccttttacctcctctgcatttcagtttccttgggtgtaaaatgaggcccataggtggagaaatgggaggaggagaggctscctaccacataagggtgttgaaaaactgttgagagaacatacgtgatagcagtctatattgagtagcactcacataaattgacataaatgcatataaagt

SEQ ID NO: 29669 - DNA, 201 bp, Homo sapiens
tgaacccaggaggcggaggttgcagtgagcagagatcgtgccactgcactccagcctgggtgacagagtgagactccatctcaaaaaaaaaaaaaaaaaaagccactactaaacggtgacgtttcagaagggcagataaagttacataatatttttaggcttcaactttttgctttggaaataccacatactccataggac

SEQ ID NO: 29670 - DNA, 201 bp, Homo sapiens
aagatggctatggatttaaatggaagtctgcagataacattttccaaaaagaatgatctattctggtttcagcatccctggatgaaatgaattaataacarcgctttacttaatagacagtttctctttctaggatcacagagtggttttattgaccatagagctgtacctgatttaaacagggtatggtaactgaatttc

SEQ ID NO: 29671 - DNA, 201 bp, Homo sapiens
tagtggccaagtaattcttaaaaggaagcaacagaaatgtggttaaaatggtcctttacttttccttgtcaccaatcaaatatgttcgtattcttgaggaytgaggtagtgatttgacaaagttaagattaagaagcctgcagaggaacaagtagggaaccatatcatgtatttattccatttaacaggcattaaccagga

SEQ ID NO: 29672 - DNA, 201 bp, Homo sapiens
aggagcagcatgggtgtgtaatagagaaaggtgtgctgagaaactgcagtcattacaatgtgtctggtgtgtcatagagtgcaagggcataggtggcaagrggtacccctgggaagttaggttgtgttagatcaaggtgggtctttcctgggtattgagaacagaaagaaaataatctggaagtgaaactggttgaatttt

SEQ ID NO: 29673 - DNA, 201 bp, Homo sapiens
tttctatcttgcttcccgatgatacaaatatgttaagctgagtttttatccattaatccatccatccattcacccatccatacttgtttgttaagtctacyaacccatatttatctagtactctcatgtgtcaggcccagtgccaggttctgttcacacagtggtgaacaaaaagcacagtctctgtcctcaagaaggttt

SEQ ID NO: 29674 - DNA, 201 bp, Homo sapiens
tcacagtaagaccaaatccttaaataatgcatactaaattctgggcactgtttaacatgtttaatccatagtaactaatggaaacctcacaaccccatcargtagtgtggccctcatggaggtgcaccattcagatctgcctttaagaggaagcttatgtttgtttgcaaggagtgcagttagatgacagtctccagttgc

SEQ ID NO: 29675 - DNA, 201 bp, Homo sapiens
tagacatgtgtttaatatccagcacagagtatctctatacatttaaaaaatcaaagctttgaataaccaaatgcagaacaaacctcaatattccgtgatamctcttgagattgtaatatcaatcctaaagtatcaaagaggtcaagttcaccagcatggattttgaaaagtaaggtccttatgatgctctgcgcttaactg

SEQ ID NO: 29676 - DNA, 201 bp, Homo sapiens
gacagtgagtgatcagttatagtaacttttgggaggtgatgatggggcagagcagtggtagaggactagaggggccagatgcaagagagccctgtgttctstggctgggaggcatcagtccagagccatgatagcaggaatgcaggtaaacgtgttttgattggtgagagagatcagggagctgggctcagccctggcacc

SEQ ID NO: 29677 - DNA, 201 bp, Homo sapiens
tcagtccagagccatgatagcaggaatgcaggtaaacgtgttttgattggtgagagagatcagggagctgggctcagccctggcaccacaggtgggcttaytcctcacacaatatccacaggacccatctcttcccaaagatgtttaccagtttggtgtgttcactctttacaaaggctctttctctttccccaggagtgt

SEQ ID NO: 29678 - DNA, 201 bp, Homo sapiens
gcaacttttctcgcaatacggccgtatcatcacctcacgaatcctggttgatcaagtcacaggttaagtgtttctttgtaatttctttccttgtatatcartgtcatcagccctgttactcataagagcagaaggctgatggctgcttaaagcagatgatatggatcatgaatagacagatttttgacttggaagaaagac

SEQ ID NO: 29679 - DNA, 201 bp, Homo sapiens
catttacgatgacaggatttgagtgcctacgttattgtgcaccgctctaatagtttatccctgaaattttctgcctgtataatgtttcttaaaatatatcmcagaaacataaaagatttaatgtagtgctttgtacatccattagagttcgaagtcaactgaacctcctcaatgatctatcctggatgctgactgtaattc

SEQ ID NO: 29680 - DNA, 201 bp, Homo sapiens
tatcatgagaacacactgcaaacagtgtaaaaaaaaaggggagggggacaggacctcgattatctttgctgttctttgtggccagcccaactttaattatwcgttattaataggtgttaattacatttctaactctggtttacagtgatttttagaaatctatttttaagcatctgttctgtctcccctgtttttgtgtgt

SEQ ID NO: 29681 - DNA, 201 bp, Homo sapiens
ccttaatcttaggtcagtaggtagggtcctgaatgcagatgccaaagagcttaggaaattttcagagtttttatttagggtttcagtggtgcttctaaatrtagcatgtcccatttttccttttccctcaaactgtctcattgatgtaacatgaaaccaaatagaacagtgccgaacagcttgaaagagtgaatatcatgt

SEQ ID NO: 29682 - DNA, 201 bp, Homo sapiens
aagtccaggcagcttcgggcgatcagggtcccgaggcgctgggcgcgcggacttggatcctcagggggcccctctgtgtgactttcgctaattgtctcacrgggagggcagcaccctcccctatctttcctctattacaccccgctgtggacctgggacttgggtatttctagacgagattgggaaggcgcgtgtgttaca

SEQ ID NO: 29683 - DNA, 201 bp, Homo sapiens
caatttacctgattaaaattaagattgaagagaaagagagaaaaaagcacagtttattctcatcccaaacctcctttgttttcattagcaatgtgtagacytgaaattaccttaaaaacaaaacaaaactcccccatgaaacacatttaagaataaaagaatgattttccaaatatttgtcaatgcactttttgtacaggg

SEQ ID NO: 29684 - DNA, 201 bp, Homo sapiens
cagcactgagtttatctttatgcttggcaccaagtaggtgctcagtaattgattgttaactgatgtagtcagatattaattaggtgtttcataatgtgttsccatcaggtgccccctagcttatgagtgggatattggacccaaatcccccttgttgtgaagactggttttgacacagctattgctcaccaaccccagttc

SEQ ID NO: 29685 - DNA, 201 bp, Homo sapiens
taaaagaatgattttccaaatatttgtcaatgcactttttgtacagggcactgaatgaaactttaaatatttttttcctcttatggttagtgacatgttastattgtgattcactcagaatttatttgacccccttgatcactagttcacatttgttttaatcttgatggctacactcatctaaaataaacagagcaggaa

SEQ ID NO: 29686 - DNA, 201 bp, Homo sapiens
tgtcatgaagtggtgatatactacactagtgctaaaaatacctgtgatctactcaggaagaaattagggctctaaagaaaattcggcagtaagcctaaaaataatgtattttttcactctcccagtgctgttttgtttgtgtttcatggagaaacagtgtatttgctataagcacacaattaagatgagatttcagagatg

SEQ ID NO: 29687 - DNA, 201 bp, Homo sapiens
caggattgttaggattaaatagacccatttgataaaaacttactgagacttactatttggtagtctgtaaatatgtagtagtaaaggagacatggcccccygtcctcaaagagctgaatatctggtgaatgtgctgtgagaagtgggattcagactcccaccacctgcacaggtcactattgataggatgcagcactctac

SEQ ID NO: 29688 - DNA, 201 bp, Homo sapiens
taatatgaagcatcatatcctacatctttgataactactgatgtctgcatgatatatgttggggctctttattaaccaaagtatttattaactaggaaacyttatgccttggttgtgctacatagcaaaacctggaatgtaataataaaagtgacaataatcagtagtgaatgtgacctagaggtgggactagaaataata

SEQ ID NO: 29689 - DNA, 201 bp, Homo sapiens
tgtgatatgaagctgtggtgttccatatggtgttcaatatgttccttacttttttattttactttgttgggtcatggtcagaaaagtttgagaaatactgktctagataatagtgagctctgtattatacaaaggaaaaataacagtcagcttttttagaactatgcaatgcaagatctctagtatcttctgagttattaa

SEQ ID NO: 29690 - DNA, 201 bp, Homo sapiens
  misc_feature (1)...(201): n = A,T,C or G, or insertion/deletion polymorphism (see Tables 1-2)
ctaacatacccagatctagccatagtggaagtaaaccctttttaaatgtgcgtatgacctgacatatccaggaactagtgttacaggtaacttgggtaganaaaaggagcctggattgtgttgagagaggtgccagaagggaacagaggggtggctttttagtttccaagagcaggaggctggctgagcctctgctcctta

SEQ ID NO: 29691 - DNA, 201 bp, Homo sapiens
ggcgatcagggtcccgaggcgctgggcgcgcggacttggatcctcagggggcccctctgtgtgactttcgctaattgtctcacagggagggcagcaccctyccctatctttcctctattacaccccgctgtggacctgggacttgggtatttctagacgagattgggaaggcgcgtgtgttacactaagcagtgctcatgt

SEQ ID NO: 29692 - DNA, 201 bp, Homo sapiens
atatcaatgtcatcagccctgttactcataagagcagaaggctgatggctgcttaaagcagatgatatggatcatgaatagacagatttttgacttggaaraaagacttcttatcggtcaactgcccaaatttaaaatgggccatcttgggaggtaggagttctccatcatgggacttgttttagcagcagctaaactact

SEQ ID NO: 29693 - DNA, 201 bp, Homo sapiens
gttccaatacaatgtctttctgctaaaccatattgctggctttcaatgtgacaccatttgttgatcatctgcctaggtgtgaggtatggcagggtgggggwtgaggggaatcagtctaagccttgtctacactagaatccttactctgaacccctgccatatgccagatactgagctaggggcacggcaacaaataaacat

SEQ ID NO: 29694 - DNA, 201 bp, Homo sapiens
aagcataataaaaacccagcctcatttaggcatatccaagaaaatcccaagatattgattagctaaatgaacttttctacatgcacataagacggaaagtsattagtgatgggaagagtacagcaaatggtagcatttatcagcatattttgctgctgatttggaaaatgtgcttagtacaatgtgatgtatctcctgatt

SEQ ID NO: 29695 - DNA, 201 bp, Homo sapiens
tgctgcctttggggatttagggtctgtctctggagatgtgttgcagtaattctccctagctgagattctacctatgttggaatcaacttttggggaaatgrtttttgttgtgtcaccaactttcaagtgccagctcctcttccctggcagggttcaccctgttccctctgtaccctagctctggctgtgcagaactaatgg

SEQ ID NO: 29696 - DNA, 201 bp, Homo sapiens
tatgcatttattgggtgccaggtactgtgctaagcccttgatcttcatcacctcatttgtcctcgtgacagaggaaggctattatcaggccaccattaccwgactccaccaccacctttctcaccaccagtctcagctcagctgtgtctccttcccggcccttttaacctttgattaatctctccctcctctgtgttttag

SEQ ID NO: 29697 - DNA, 201 bp, Homo sapiens
accgttttggcatgccaaattggaagtttgctagtggagcagaaatcatagttactttgtcatatacatctaaatactgtggtgtgtgtgtgtgtgtgtgygtgtgtgtgtgtgtgtgtgtgtcatgtgttgtagacagctgggagccccggtgtgccgtgggatgtgccaataatggcttctcaagtactctgtgttttc

SEQ ID NO: 29698 - DNA, 201 bp, Homo sapiens
aggttttaaaccattcttaagctgggcatggtggcctgtaatcccaacactttgagaggccaaggcaggaggaatgcttgagcccaaaagttggagaccargctgagcaacaaaacaagacctgatttcttaataaacaaataaatttagccaggtgtggtggcatgcacctgtaatctcagctaccctggttgctgaggt

SEQ ID NO: 29699 - DNA, 201 bp, Homo sapiens
tagatttaagcctgctgaaagcaagaaagacctctcagaatgggcagtgaaggagtcccaggatatggagttggctgcaattaacctagtatgtggattaytgccatgcaggtaattttgaggtgactggggattttatcatgcactttcagaacaggatttcagcctgaactaggggttctaacttccataaaaattcct

SEQ ID NO: 29700 - DNA, 201 bp, Homo sapiens
taggggttctaacttccataaaaattccttactcaactcagaagttttcaacagcagctacccatctggctgcctcctcaggggctttgtagatgaggggagtaactgttcggtttctggagaatgatggtttttaaaaagcgaaagagcaaggtgtgcagattggcagtgcagaaatgctgaggttctttctggccagct

SEQ ID NO: 29701 - DNA, 201 bp, Homo sapiens
cctccattaccgctagtcacaacctgggcgagaatgcttctctgccaaggtcagcaggggcggctggatcactgaatccccagggagccaagagagagcaygtggcaatgccagcagaaaccagagacacgtttaccccagttgtgctagcagccctctcttgtgggagattttatttggctgctctgcttcccagtgccc

SEQ ID NO: 29702 - DNA, 201 bp, Homo sapiens
tcttgtctctactaaaaataaaaataaaaattagctgggtgttggggaaaaggcctgtagtcccagctactcaggaggctgaggtgggaggatgacttaarcctgagaggtccaggctgcagtgagccatgatcatgccactgcactccagcctgggtgacagagcaagaccttctctcaaaaagaaagaaaaaacaaaac

SEQ ID NO: 29703 - DNA, 201 bp, Homo sapiens
tagttgtgttgggagaattatggactccatatcacagaaaatagtggtcctttcttgtccactctggtcagcccatcctagtgtcttatgtcccattctcrgcttcatattttaaaagattgtctaaaggtgaatgacaaagatgggaaagaagtctctgcacccacccacagattcacctcacaatggttgcttttctat

SEQ ID NO: 29704 - DNA, 201 bp, Homo sapiens
tgttctggtgctttacataagtcatatcactggatcggttcttaccgctttgccatacggtggcattgttcccatttttcaaatgaggaaaatgaagactsttaggatttaagtcccttgccaaggtcacacagctagtaagtggcagagtatgatttcatttccaaggagttgatgatcagtttctgaggagatggaagc

SEQ ID NO: 29705 - DNA, 201 bp, Homo sapiens
ggggatgggggtagggagggtggcaaggagagaaatgtgcagagcagaatttcatgaggtttttttttttttttctggtttattcaaagattattatgtgytggatacagtaaatcatctatacacccacttccaggaggtaaatcttcagaactccatgtgtgggtagctctgcatttaacagctgccatacagtagcta

SEQ ID NO: 29706 - DNA, 201 bp, Homo sapiens
gtgtgtgtgtgtgtgtgcgtgtgtgtgtgtgtgtgtgtgtcatgtgttgtagacagctgggagccccggtgtgccgtgggatgtgccaataatggcttctmaagtactctgtgttttcctaagctgccagtctaaaccctttaaaggtttgctttctaatttgtacatgaaaaataacaggctgagttgaacttttttttt

SEQ ID NO: 29707 - DNA, 201 bp, Homo sapiens
gcatgagcttgaaataataataataaagattaatagtaatgctaatttatagtgagtattcactctgtatccaatactattataacccttttacatgcttratatcatttcatctttgaaatatccctggagctaggtgctttacacacatcaactctaattcttaaaatagccctgtcaggaggtactattacctccttt

SEQ ID NO: 29708 - DNA, 201 bp, Homo sapiens
ttatcattctttggatctcgcctcagttcaggcttctcccacgaagccttccccatcactccagatctcatcctcattatcaactatctctaacacttaaytttggtattctttttacatccttccttaggctattaggattcatgcataaaaaggaaagctccttcccaatcagattttaagctccttgaaggtggggac

SEQ ID NO: 29709 - DNA, 201 bp, Homo sapiens
aggcatggaacccataaagggacctggcatgtctgtcatggaaagggggagagtgccatggatgagggttctgctcatccttcatcttctttgctagaccyattctctcccctgaaggtcacagaagcagggtccacattactgctggaggtttaggtcttaatgtcaaaggtctggtttaatgtgttcaattccttttgc

SEQ ID NO: 29710 - DNA, 201 bp, Homo sapiens
cacctgaggtcaggagttcgagaccagcccggccaacttggtgaaaccctgtctctacaataaataaataaataaataaataaataaataaataaataaawtagctgggcttgatggcaggtgcctgtaatcccagctactggggaggctgaggtgagataatctcctgaacccgggaggcagaggttgcagtgagcctag

SEQ ID NO: 29711 - DNA, 201 bp, Homo sapiens
tatatttattttactttagcaaatatttattgagcaccaactatgacagccactgtgctcagctggagggaaacaaagacaaataagaacagtctttgctyttgagtaccttgaaaacaggtgggagagacagacccgtaaacaactgtggtaatgctctgacatgagttctgtggagtcagaaagaacaagctagtatga

SEQ ID NO: 29712 - DNA, 201 bp, Homo sapiens
acattttaaccagggcttctgtcaactgatgtccttttgaaccacctgcattagggtgcacattgttgcatcctctaccctcatccctctgttggaaaccrtagtggctatcaggtaaaattggtcataggtaatgtgaccatgtgacctggtttgccattactggtttatgcctgttgtcttgttgtaattattaataga

SEQ ID NO: 29713 - DNA, 201 bp, Homo sapiens
atggcgtgaacccgggaggcagagcttgcagtaagccaagatcgtgccactgcactccagcctgggtgacagagcaagactgtatcaaaaaaaaaaaaaaagcacacctacttattttaaaaaatagtttattgtaaaacagcctcaggcaggtccttcaggagttatttcaaaataaggcattgttatcacgggaggtga

SEQ ID NO: 29714 - DNA, 201 bp, Homo sapiens
aaatttcagagaggtagggtggagatgggagtaaggagaaaataaaaagcaaaagttctgagtagtcatcaactgcagactgcctaaataggaagtctacrccaggaagtcatgtttttgctgctggaggtttgagtaggactctgtataactttgctctcttatgcaacttgtgattgatctgggttagttggctctgct

SEQ ID NO: 29715 - DNA, 201 bp, Homo sapiens
ggaatcaaaaggttcaatccagatgtttgcctccttgcttcttcaataaagtgacagtacaatgctgcatgacaccacttgcttccttaataaagtgacartacaatgctgcgcggcacctctcctttcagtttttaggtagggtagactgtggcactgtggcttatggggtcaaccatgagcaagtggatggctggattc

SEQ ID NO: 29716 - DNA, 201 bp, Homo sapiens
agagacttcatttcgataaataagtaaataaataaataaagtctgaagctccactggtcactccttttattgattatttgcagctggtctaaccagttacrtatgtctggcttgattacatggccagagcaacataaaagccctgctgggaacttctgatttgagctcttccaaaaccaggatggatgcctcacatagatc

SEQ ID NO: 29717 - DNA, 201 bp, Homo sapiens
gtcagggtgctggtgtgttgggcagagagagctccccacctcacctagtcccaggtacatttaatatggtaggttcggccaggcgcagtggctcccgcctrtaatcccagcactttgggaagccgagggaggcggaccacctgatgtcaggagttccagaccagcctggtcaacatggtgaaacaccatctctactaaaaa

SEQ ID NO: 29718 - DNA, 201 bp, Homo sapiens
ggtgcccagcctcagctgctggcaccagggatgcaggaatcatttcccagcctgctgaccttcagcaaacagcagcctttctaacagtattcctgtccacrttttgggagcagcacgccacgctgcctgcagaccccagctcatgtagcctgttcctgccagacttgctgctacgtgagccagggtctgcaagcagcgtgg

SEQ ID NO: 29719 - DNA, 201 bp, Homo sapiens
ccccaccctgactctggccgctgtggaggaaacagtaccagcactgcgggtttgccagcctttcttaagcaagacctgaaggactatggcctggccctacrttgtggcctctctctagctgggtgcttcctgggcctgggggtggggagtcctgccttgctaaccctatcctgatgcctgtatcccctatagggcatgaag

SEQ ID NO: 29720 - DNA, 201 bp, Homo sapiens; identical to SEQ ID NO: 6077

SEQ ID NO: 29721 - DNA, 201 bp, Homo sapiens
ttcctcccagctcatcccctactgcggggcatctgagaccagtattttgctctcttgagtgttctggttgtgctctggtcctggtactctctctctctctstctctgtgtgcgttggggttgaaggccagaaacagccaggttgaggctggggccagatgtccccagtgaggcaggtgctgggccctaggtcatcctctgt

SEQ ID NO: 29722 - DNA, 201 bp, Homo sapiens
gcgcccgccaccacgcctggctaatttttttgtatttttagtagagatggggtttcacggtgttagccaggatggtcttgatctcctgacctcgtgatccrccggccttggcctcccaaagtgctgggattacaggcatgagccaccacgcctggcttctgtctttctgtctctttctctctctgcctctctttctctctc

SEQ ID NO: 29723 - DNA, 201 bp, Homo sapiens
agaggtctcactgtaagatggtgttataatttatatttccctcaggaggccaggtttctcccccttgaagaggatatcatggccaggtggtactgcagaaraatataagtcatttctttcttagcgtctgagggtcaaattggtcccaaatctccagaatacatcttaggggcgtttttgccttgtggggaacgtttccca

SEQ ID NO: 29724 - DNA, 201 bp, Homo sapiens
acaatctcagctcactgcaagccctgcctcccaggttcacgccattctcctgcctcagcctcccaagtagctgggactacaggtgcctgccaccatgcccrgctaatttttatatttttagtagagatggggtttcactgtgttagctaggatggtctcgatctcctgaccttgtgatccatctgccttggcctcccaaag

SEQ ID NO: 29725 - DNA, 201 bp, Homo sapiens
aggccacgccagtgtccaggagacagttaacctcctggcccttaatggtcaagcatacctggggctctgtgagggtgatggcatgggttggtacttgcccygggcaccctcagtcctgctgctggatcatctggttagtggcttctgactcagagggccttcgtcccctggggcagtgggccttccagtgattcccttgac

SEQ ID NO: 29726 - DNA, 201 bp, Homo sapiens
aaataagtaaataaataaataaagtctgaagctccactggtcactccttttattgattatttgcagctggtctaaccagttacgtatgtctggcttgattmcatggccagagcaacataaaagccctgctgggaacttctgatttgagctcttccaaaaccaggatggatgcctcacatagatcatgatgattcaatccaa

SEQ ID NO: 29727 - DNA, 201 bp, Homo sapiens
tgtttggaaaccttgtagccacaggtggcgaggaaattcaagagcgcttgggtagcttgatggcacaaggtttctgaatgggtggctaaaagcaaatcatmcacatactgaaggacaagagtgtcaaggtatgagaactggctcaagtcttgggttaacgcctggccaaatagatgggagctatcccggaacccttggggt

SEQ ID NO: 29728 - DNA, 201 bp, Homo sapiens
gtgaaaagagtaaagttccccagtcacaacttagtggctgggagaagtatctagtgactggctgtcctaggaccccttggatagtgatagatctggaggayagttgtccgggacaggagagtaagactgagaaggccacgccagtgtccaggagacagttaacctcctggcccttaatggtcaagcatacctggggctctg

SEQ ID NO: 29729 - DNA, 201 bp, Homo sapiens
atcccttctctctgtactagtctctttagcaaactggttgctgggccatacccttggtttcctctcccaaacatgcctttttactgtttttttttttttttgagatggagtctcgctctgtcacccaggctggagtgcagtggcgcgatctcggctcactgtaagttccgcctcccaggttcatgccattctcctgcctca

SEQ ID NO: 29730 - DNA, 201 bp, Homo sapiens
gcccagggtcacatagcaagtcagtggcactgtggtaggagaggctctgtccttaaccaccagcataacattgccaccttgatttttttttttttttttttgagacagagtcttgctttgttgcccaggctggagtgcagtggtctgatcgtggctcactgactcccaggttcaagcaattatcctgcctcagcctttcga

SEQ ID NO: 29731 - DNA, 201 bp, Homo sapiens
catttaggtgtttgccattgtacccccactcagaatgactgatgctgtgccatgcacataataaatgttcctgatgctggggtttgcattggctgggactrcctgagaattggtctgactccatcagcgccattgctggtggaatgtttcattgggtcatggcctctgaagtatctttatttccataggcaatcttgctgc

SEQ ID NO: 29732 - DNA, 201 bp, Homo sapiens
gaggtggacaggatccctgcatagagaatgggattgctgtgggccgggcgagcaagctgggaaggatgtggggatgggagtgcctggaccgagcattttgyttcccagcaaaggtgatttcgtggacccctgcctgggggacctggtctcaattctgaagcttccccaatggcttaaaggactgctggccttcctggtgaa

SEQ ID NO: 29733 - DNA, 201 bp, Homo sapiens
gagctcatggagtaaggttgggttgctatctgccttgagagtgacttttcagacagtgtcattgtggaagggacttgagaggcagtctaaccagctacccwtcctgtagtagccttcccttatccatgtttccagctccttatgttgctcttctactgctgggaagctcactagtcactgcttctgtctctttctggtttc

SEQ ID NO: 29734 - DNA, 201 bp, Homo sapiens
gggcgtggtgacacatgcctgtaatcccagctactcgggaggctgaggcaggagaatcgcttgaacctgggaggcggaggatgtggtgagccgagatcgcrccattgcactccaacctgggcaacaagagtaaatctctgtctcaccaaaaaaaaaaaaaaaaaaaaaaaatagagatctgttgtggccaggcacggtggc

SEQ ID NO: 29735 - DNA, 201 bp, Homo sapiens
ctttgacagttttttgttttgttttgttttgttgttgttgttttgagacagaatctcaatctgttgccaggctggagtgcaatgacatgatctcagttcartgcaacctctgcctcccaggttcaagcaattctcccacctcagcctccgaagtagctgggacttcaggcacgtgccaccacgcccagttaatttttgtat

SEQ ID NO: 29736 - DNA, 201 bp, Homo sapiens
agcctttcgagtagctgggattacaggtgcctgtcaccacgcctggctaatttttcttttttactttttttttttttttgagatggagtcttgctctgtcrcccaagctggagtgcagtggtgcgatcttagctcactgcaagctccacctcctgggttcacgccattctcctgcctcagcctcccgagtagctgggacta

SEQ ID NO: 29737 - DNA, 201 bp, Homo sapiens
tcacatagcaagtcagtggcactgtggtaggagaggctctgtccttaaccaccagcataacattgccaccttgatttttttttttttttttttgagacagrgtcttgctttgttgcccaggctggagtgcagtggtctgatcgtggctcactgactcccaggttcaagcaattatcctgcctcagcctttcgagtagctgg

SEQ ID NO: 29738 - DNA, 201 bp, Homo sapiens
aatcccagtactttgggaggccaaggcaggtggatcacctgaggtcaggagttcgagaccaggctggccaacatggtgaaaccccatctctactaaaaatmcaaaaaaaaaaaaaaaaaaaaaaaaagtgggtagagaaccaagcccacagagaataataatgcaaaatatggcttaatgtaggagggatcatattgagag

SEQ ID NO: 29739 - DNA, 201 bp, Homo sapiens
ctttctctccatattgctgcatgggcatggaggactaggtaagcatacttagagtctgtatatatgtttacccttttttctttttctaattttagtgcccragtaagggctattagttttgccagctgagcgctagttcctggagtgaggggattattttcaagtattccattatcactgaccactgcataccctgctttt

SEQ ID NO: 29740 - DNA, 201 bp, Homo sapiens
gtgcagcttcttgcgtgagtgacagatttttaaactcaggactttgtgccagagtgctctgggagactgggggactggaagctcttaccaagaccataacmcacacaagaatcttatggctggagatctgcctagaggagacagaaatgggatcatctctggaacataaaaaccctatttgaattagctgggtgtggagat

SEQ ID NO: 29741 - DNA, 201 bp, Homo sapiens
ggaggcggagcttgcagtgagccgagattgcgccactgcactccagcctgggcgacagagcaagactccatctcaaaaaaaaaaaaaaaaaaaaaaaaaawatatatatatatatatatatatgtaaattagtctggagtggtggtttgcatctatggccccagctactcaggaggctgaggtgggaggattgcttgatcc

SEQ ID NO: 29742 - DNA, 201 bp, Homo sapiens
ttaggccgggcatggtggctcatgcctgtaatcctagcatttcaggaggccaaggcgggcagatcatgaggtcaggagatcgagaccatcctggctagcayggtgaaaccccggctctactaaaaatacaaaaaattagccgggcatggtggcaggcgcctgtagtcccagctactcgggaggctgaggcaggagaatggc

SEQ ID NO: 29743 - DNA, 201 bp, Homo sapiens
tccttacctcaggtgatctgcccgcctcggcctcccaaagtgctgggattataggcatgagctactgctcctggcctaattttttttttttttttttttttgagatggagtctcactctgttgccaggctggagtgcagtggtacgatctcggctcactgcaacctgtgcctcctggatttaagcgattcttctgcctcag

SEQ ID NO: 29744 - DNA, 201 bp, Homo sapiens
ctccttacctcaggtgatctgcccgcctcggcctcccaaagtgctgggattataggcatgagctactgctcctggcctaattttttttttttttttttttttgagatggagtctcactctgttgccaggctggagtgcagtggtacgatctcggctcactgcaacctgtgcctcctggatttaagcgattcttctgcctca

SEQ ID NO: 29745 - DNA, 201 bp, Homo sapiens
tctttttagtcccattttatagagaaggaaacaagcttagattgcttaagtaactcaaaaagttacaatctgaaatttcttttttttttttttttttttttaagacagggtctggctctcaccagggtggagtgccgtggtgtgatctcggctcactgcaacctccgcctcccaggctcaagtgatcctcctgcctcagcc

SEQ ID NO: 29746 - DNA, 201 bp, Homo sapiens
tgagcagcctgggcaagagagtgagactccgttttgtgccactgcactccagccagggtgacagagtgagactctgtctcaaaaaaaaaaaaaaaaaaaaaggcattgggatttataatgtgctgtttaaagtctgaagctcggccaggtgcggtggctcacgcctgtaatcccaaaactttggaaggctgaggcaggtgg

SEQ ID NO: 29747 - DNA, 201 bp, Homo sapiens
tgctgggattacaggggtaagccactgcacccgagcccttgtttctttctttcttttttttttttttgttttttttgacagagtctcactctgtcgcccasgctggagtgcagtggcacaatttcagctcactgcaacctccgcctcctgggttcaagcggttctcctgcctcagcctcctgagtagctggtattacaggc

SEQ ID NO: 29748 - DNA, 201 bp, Homo sapiens
gtgggtgatgggcaccaggggaggttgtggagcaggagactggcatggctggagcctgggtatgcacagtcaagccagccctgctctcaacaggctccaamccccaccctcacgatgacgcccagaaaccacacagacgaggagctgtttcttgactgttagttgggccttggcctatgtcatacccatgggctgccacat

SEQ ID NO: 29749 - DNA, 201 bp, Homo sapiens; identical to SEQ ID NO: 6070

SEQ ID NO: 29750 - DNA, 201 bp, Homo sapiens
ttgggaggccaaggtgggaagatcacttgatcccaggaattctagatcagcttggacaatgtagtgagacctggtctttaccaaaaaaaaaaaaaaaaaaattagctgggtgcgctggcatgtgcctgtggtcccagctactcaggaggctgaggcaggaggatcacttgagcacaggagtttgaggctgcagtgagcagc

SEQ ID NO: 29751 - DNA, 201 bp, Homo sapiens
tgaatccaacaaaggcctgagcactctgggcagggacctcgctgtccctccagctgggcacattgagcctggagatcccttgccagggtgccagcccgagkggaggctgggttgagtatctgtggcctacccctgatctgagcttgttgtgaggtaggaggtgggcaggaggttgcctctctgtttgggaaggatttgggc

SEQ ID NO: 29752 - DNA, 201 bp, Homo sapiens
tggcatctcctcccctcacgggaagccttcctggtacccatggctactccatccctggcatcctggcactctgacgatgttgtcgtcggggtgaactgtgrccctgtgggacaagtatatagagggctgatcaagagtattggagtgagtgattgatggagaactttagccctgtgctgtgtgatgtgtgagcactgcatg

SEQ ID NO: 29753 - DNA, 201 bp, Homo sapiens
ctggatgagtccctccagaatgcggcgtccctgtcttcaaggcacgtactgtgaccagcacactaatctctgttactctagcggatggccttcagcttttrgaaccagcccggcaacctcctttccccttgctcatcagtccccgggaacgagcccagtgacctcccctcagctcactcatgtacccttggaaactggacc

SEQ ID NO: 29754 - DNA, 201 bp, Homo sapiens
cctctagactcttgtgaacccaaaccacagcttgacctgccccttgagaaaaattgttgtggcttcccactctcttctcaggcaggcatgcctggctctcycagctcacctcaggagggctcttatcattactcccatctttcctcagaggcctacatacctacccctgggagtccttgctatgccatctgcctgtgcccc

SEQ ID NO: 29755 - DNA, 201 bp, Homo sapiens
ccccgaggagggtgggggtcggcctgacccgcttccgcccgtgcttctcaggtggcagggcagtgtctggcccccaggctgctctaggtctgggttcctcrctccttgtctgcttacctccctcacctctctgccccacagtgcgtctctccgtgggccccatggcccgggacgtggagagcctggcactgtgcctgcgag

SEQ ID NO: 29756 - DNA, 201 bp, Homo sapiens
gtcaagactgggaaaaccaataagcctgtcctctctcttttaggctgccacagagcccaaattccctgctgttcgactggctttgcagaattttgacatgrcttacagtgtgcagtttggagatctttggccatcaatccgtgtcagtctcctctcagagcagaagtatggtgcactggtcaataactttgctgcctggga

SEQ ID NO: 29757 - DNA, 201 bp, Homo sapiens
tggcatgtctggcatggggctccggctggggcgcagtcttcagcatttggggctctggggtgcagggggcagaggacggccggggctgtggtgcccaaccrgtgctaaactcaagcttgggaggtcgcccacgagaaacagtcgcccttccccacccgcctgctcggcttggcggggagcgggatgtcgctgggggcgatg

SEQ ID NO: 29758 - DNA, 201 bp, Homo sapiens
gataatgacccaagagtgcttctcaagacgagagacgtgcttttctgcatgtctgattttcaaaaactggtttgccacccaggagatgttttctcccacaycaacttggatagaagagcttatggcagacaagctgactcaacactcagactgatgtcaccagatcaaagtgaaaaatatgtagctctcatgatccaaata

SEQ ID NO: 29759 - DNA, 201 bp, Homo sapiens
ggttcaagcaattcttgtgcctcagcctcccaaatagctgggattacaggcgcccgccaccatgcctggctaatttttgtatttatttatttatttatttwttttgagacggagtctcgctctgtcacccaggctggagtgcagtggcgcaatcttggttcactgcaacctccgcctcctgggttcaagcgattctcctgc

SEQ ID NO: 29760 - DNA, 201 bp, Homo sapiens
atgaccaaaagttagtcatatagtcatacttagttgtaaaagaaaggcttagccgggtgtggtggctcacacctgtaatcccagcactttgggaggccgasgcaggcagatcacctgaggtcgggagttcaagaccagcctgaccaacatggagaaaccccgtctctactaaaaatacaaaatttgccggcgtggtggcgc

SEQ ID NO: 29761 - DNA, 201 bp, Homo sapiens
cagagaatacaatttttacttctttgagtgccctcaaaaatggagacattggccggggggcggtgactcacgcctgtaatcccagcacaagctaggaggcygaggcaggtggaatacttgagtccaggagttcgagactagcctgggcaacatagacctcatcttcattaaaataaaaaaaaaggagacatttatttatgg

SEQ ID NO: 29762 - DNA, 201 bp, Homo sapiens
cacctcacctagtcccaggtacatttaatatggtaggttcggccaggcgcagtggctcccgcctgtaatcccagcactttgggaagccgagggaggcggaycacctgatgtcaggagttccagaccagcctggtcaacatggtgaaacaccatctctactaaaaatacataaattagctgggtgtggtggtgcactcctgt

SEQ ID NO: 29763 - DNA, 201 bp, Homo sapiens
ctttttctcagttcatatccttctgcaaattcctctagagcagagaatacaatttttacttctttgagtgccctcaaaaatggagacattggccggggggyggtgactcacgcctgtaatcccagcacaagctaggaggctgaggcaggtggaatacttgagtccaggagttcgagactagcctgggcaacatagacctca

SEQ ID NO: 29764 - DNA, 201 bp, Homo sapiens
aaattgagttctgtggagattaaataaataatacaagaattggaggtagagccagaactggaacccatctttctttttctcagttcatatccttctgcaaattcctctagagcagagaatacaatttttacttctttgagtgccctcaaaaatggagacattggccggggggcggtgactcacgcctgtaatcccagcaca

SEQ ID NO: 29765 - DNA, 201 bp, Homo sapiens
ttactctgctactctctgttgcctttgctcttgttaaattttctccctggaattccctcacccttggctgtccaaatccttttgactttctttttttttttctttctttttttttctctttttttcgagatggagtctcactctgtcacccaggttggagtgcagtggcacgacctcggctcactgcaagctccgcctcct

SEQ ID NO: 29766 - DNA, 201 bp, Homo sapiens
actgtctcttgttccccagctgtgtccacctacctttctgtcccccactcccccttttacttccctccctcccctccccctttcccttgcccattcttccyccacatgacttctcctttcctcattgattttccagcccggtcgccctcacccctcggaaaataccatagcgaccttgcctgcactcctgggtctccgccg

SEQ ID NO: 29767 - DNA, 201 bp, Homo sapiens
gttcaagcctgggttcaaagttcgattctcttgcctcagcctcccaggcagctgggattacaggtgtgtgccaccacgcctgactaattttgtatttttttagtagagacggggtttcaccatgttggtcagactggtctcgaacacctgacctcaagtgatccattagcctcagcctcccaaagtgctgggattataggc

SEQ ID NO: 29768 - DNA, 201 bp, Homo sapiens
atcagggatggaaatcaagttcgagttacctcatgggatggcaggaaatggggagaactggagggggacacctatgaccgggtgagtgattcttgatttargacatgcatccagcttaatgcggcctccccatcctggttctagggcctgaggggttaggatccagcccctatgtttgagcatgtagagctgtttctggac

SEQ ID NO: 29769 - DNA, 201 bp, Homo sapiens
ccactctccactacttttccctctcacacttctctggcaggcaggcaggatgcaaaagcaggagtgggcactagctggatccaagtttgcccctaggctcygaggtgggggtcaggtagtagggggtagagtcaagactgggaaaaccaataagcctgtcctctctcttttaggctgccacagagcccaaattccctgctg

SEQ ID NO: 29770 - DNA, 201 bp, Homo sapiens
acctcgttgtcagcctgtgatgcctccttgttctacccacatctattcttttatccctttgagaacaccctttgatcctcaaagtttacccattgtccccygagtccgggcctaccctgatactgtcccctgtggcctccatatctaccctgtggcctctcaaggcccttgcaaagagcctctgcagatcccctacagctg

SEQ ID NO: 29771 - DNA, 201 bp, Homo sapiens
cggtcctgagtgtctgctggaagtagacatgttgagacccagcttctaccctctgtaataaggaccataatattgctaatatttatggcatgtttatacaractaggcatttttttgaggtgctgtacatatgttatctctttttgttctgtcagcagccttatgaagtaggtaatattattgctgttttacatttggaga

SEQ ID NO: 29772 - DNA, 201 bp, Homo sapiens
gaacccaggaggtggaggttgcagtgagctgagatcgtgccaccgtactccagtctgggcgacagagcgagactctgtctcaaaaaaaaaaaaaaaaaaaattatctaccaaatgctaggcatttaagtgccttgatgaacaagccctcatagagcttccagtttagtgaggaagacagctatttaaaaacaataattggc

SEQ ID NO: 29773 - DNA, 201 bp, Homo sapiens
actcagaatgactgatgctgtgccatgcacataataaatgttcctgatgctggggtttgcattggctgggactacctgagaattggtctgactccatcagygccattgctggtggaatgtttcattgggtcatggcctctgaagtatctttatttccataggcaatcttgctgccaatgatctctccccgtcccgaatagc

SEQ ID NO: 29774 - DNA, 201 bp, Homo sapiens
ttttttttttgagatggagtctcactctgttgccaggctggagtgcagtggtacgatctcggctcactgcaacctgtgcctcctggatttaagcgattctyctgcctcagcctcccgagtagctgggactacaggtgcgtgccaccacacccagctaatttttgtctttttagtagagatggggtttcaccatgttggcca

SEQ ID NO: 29775 - DNA, 201 bp, Homo sapiens
agatggggtttcaccatgttggccaggatggtctcgatctcttgaccttgtgatctgcctgcctcggcctcccaaagtgctggaattacaggtatgagccrctgtgcctgacacctgtcaaattattttactgtgtttatttaccatgtttctttcactgtggggtctctgtccttgctgttttgtttttcttttaacttc

SEQ ID NO: 29776 - DNA, 201 bp, Homo sapiens
attttgcacatgcctgaatatggcaacacagcccaccctgtttcccccagatactccccaggagcaggaatatttactgaaagctgcatctcactctgccstcacctttccttctgtaggaccctgtgtggtgaggtttgagcattctaggcagatttccactattagcatgttcttcccttttgtcaagctcctactcca

SEQ ID NO: 29777 - DNA, 201 bp, Homo sapiens
aactataccatgccctccccggccatgaggcgggccgtgctggagaccaaacagagccttgaggctgcggggcacacggtatgactgcagggtcctggaartactggcatctcctcccctcacgggaagccttcctggtacccatggctactccatccctggcatcctggcactctgacgatgttgtcgtcggggtgaact

SEQ ID NO: 29778 - DNA, 201 bp, Homo sapiens
ccctcatattttatggagggagaaattgagttctgtggagattaaataaataatacaagaattggaggtagagccagaactggaacccatctttctttttytcagttcatatccttctgcaaattcctctagagcagagaatacaatttttacttctttgagtgccctcaaaaatggagacattggccggggggcggtgac

SEQ ID NO: 29779 - DNA, 201 bp, Homo sapiens
aataaataatacaagaattggaggtagagccagaactggaacccatctttctttttctcagttcatatccttctgcaaattcctctagagcagagaatacmatttttacttctttgagtgccctcaaaaatggagacattggccggggggcggtgactcacgcctgtaatcccagcacaagctaggaggctgaggcaggtg

SEQ ID NO: 29780 - DNA, 201 bp, Homo sapiens
agccagggtaggggaggagggtaagaggggaggggaggaggggaagggtagaggggagaaggggaagcaaggggaggtgaggaagggaaggggagaagggraaggaaggggaggggaggaagggaagggaagggtagagggggaggaggggaagcaaggggaggggaggaagggaagggtagagggggaggaggggaagcc

SEQ ID NO: 29781 - DNA, 201 bp, Homo sapiens
tggaggtagagccagaactggaacccatctttctttttctcagttcatatccttctgcaaattcctctagagcagagaatacaatttttacttctttgagygccctcaaaaatggagacattggccggggggcggtgactcacgcctgtaatcccagcacaagctaggaggctgaggcaggtggaatacttgagtccagga

SEQ ID NO: 29782 - DNA, 201 bp, Homo sapiens
ctcctgggcctgcagtccgaaccttcgatgcttcacttttgacagaggggatatcagtcgcttccctcctgccaggtaggatctggagccatgactggagyggtcctgagtgtctgctggaagtagacatgttgagacccagcttctaccctctgtaataaggaccataatattgctaatatttatggcatgtttatacag

SEQ ID NO: 29783 - DNA, 201 bp, Homo sapiens
acccaagtgctgttggggaggttggccgacgactgctctaactgcttcctgctgaattggggtgagtaggggtcgtgcagatgagatttacttgggagggstgcctttgatgtcatcaacattggagcgtgggctagcaggctggtccaggggtccacagtagatcttagtcatgggctgcatctggggctccatttgaag

SEQ ID NO: 29784 - DNA, 201 bp, Homo sapiens; identical to SEQ ID NO: 6078

SEQ ID NO: 29785 - DNA, 201 bp, Homo sapiens
ggatggaaatcaagttcgagttacctcatgggatggcaggaaatggggagaactggagggggacacctatgaccgggtgagtgattcttgatttaggacaygcatccagcttaatgcggcctccccatcctggttctagggcctgaggggttaggatccagcccctatgtttgagcatgtagagctgtttctggactggcc

SEQ ID NO: 29786 - DNA, 201 bp, Homo sapiens
ctcctcatcaagcgacaactcttgatccgaggaaaacgggatcacagaatttgtataagaagggaaattagtgtttacttagtctagccctcatattttayggagggagaaattgagttctgtggagattaaataaataatacaagaattggaggtagagccagaactggaacccatctttctttttctcagttcatatcc

SEQ ID NO: 29787 - DNA, 201 bp, Homo sapiens
gtagtacttactttctaagcttgtgtattttttcattagttcctctctttctctgtcaattggtcaagaaagattgctgagcaagttctctgaagtcagaytgaagtagggctctgatcagttgatcacatgatacacactcctcttcatctgtttacttttcctctaagattaagcccatttctttagcctaccaactaa

SEQ ID NO: 29788 - DNA, 201 bp, Homo sapiens
tgaaagggtcagatgcagaaggggctggcctcgctgactgcagcctcgcagctgtgtctggggctgagtagtttctctgatctctaggggtcctgcctagkgttgtcttctcctgacctgcccctgtcccctgtgttttccctccaggtctacaccagctctcagcccctgcgtgtggggtactatgagactgacaactat

SEQ ID NO: 29789 - DNA, 201 bp, Homo sapiens
tggcatgtttatacagactaggcatttttttgaggtgctgtacatatgttatctctttttgttctgtcagcagccttatgaagtaggtaatattattgctsttttacatttggagaaactgaggtacagagaagttaagattcttacttgctttaggtccctcagatggtaagtggtgtgactaatatttagacccagaac

SEQ ID NO: 29790 - DNA, 201 bp, Homo sapiens
ggcaggggcaccggtcccagcatggcacgggctgacccattcttggctcctccagctatgactgcagtaaccccctctttggccagaccgtgaacccatgraagtcctccaaaagcccagggggctcctcagggggtgaaggggccctcatcgggtctggaggctcccccctgggcttaggcactgatatcggaggcagca

SEQ ID NO: 29791 - DNA, 201 bp, Homo sapiens
gcttctgtcattaagagatggagtctgtttccccacctcttgaatctgggctgatcttatgatttgttttgaccagtaaagtctggtggaagggatgctgygcaacttctgcatgtaggcctcaagaagcctcgcaacttccacgctcattttggagctcttctgcggctctgtgaagaagcctggaccaacctgctggag

SEQ ID NO: 29792 - DNA, 201 bp, Homo sapiens
cggggtttacatctcaacatgagatttgggtggggacaaatatccaaactctatcagagtccttctttccttgtcttgataatcccttctctctgtactartctctttagcaaactggttgctgggccatacccttggtttcctctcccaaacatgcctttttactgtttttttttttttttgagatggagtctcgctctg

SEQ ID NO: 29793 - DNA, 201 bp, Homo sapiens
agtggcgcgatctcggctcactgtaagttccgcctcccaggttcatgccattctcctgcctcagcctcccaagttgctgggactacaggtgcccaccaccrcgcccggctggtttttttttgtatttttagtagagatggggtttcattgtgttagccaggatggtctcgctctcctgacctcgtgatccacacgtcttgg

SEQ ID NO: 29794 - DNA, 201 bp, Homo sapiens
atgtggtgagccgagatcgcgccattgcactccaacctgggcaacaagagtaaatctctgtctcaccaaaaaaaaaaaaaaaaaaaaaaaatagagatctrttgtggccaggcacggtggctcatgcctgtaatcccagcattttgggagtctgaggcaggcaggtcatgaggtcaggagttcgagatcagcctggccaac

SEQ ID NO: 29795 - DNA, 201 bp, Homo sapiens
gggcatggtggtgagctcctgtaatcccagctacttaggaggctgaggcaggagaattgcttgaatccaggaggcagaggttgtagtgagctgagagggcrccactgcactccagcctggacaacagagggagactctgtctcaaaaaaaattaaaaataataaaataaaataaaaggggatctattgtataacatggtga

SEQ ID NO: 29796 - DNA, 201 bp, Homo sapiens
agcctcccaaagtgttcgggttacaggtgcgagccactgcaccggccttttttttttcaagacaaagttttgctctgttgcccaggctggagtgtagtggygtgatctcagctcactgcaacttctgcctcccaggttcaagcaattctcatgcctcagcctccagagtagctgggattacaggtgtgtgccaccacaccc

SEQ ID NO: 29797 - DNA, 201 bp, Homo sapiens
gtggcatgatctcagctcactgcaacctccacctcccaggtttaagtgattctcctgccttagcctcccaagtagctgggattacaggcacaagccaaaaygcccagctaatttttgcattttttgtagagacagggtttcaccatgttggtcaggctggtctcgaactcctaacctcaggtgatccacctacctcggcct

SEQ ID NO: 29798 - DNA, 201 bp, Homo sapiens
tcttagtcatgggctgcatctggggctccatttgaagaacaatttgtagttttacagctttgattctggaagagacaaacttaacgaggaggttaaagatrcggggattgaaatatatggcctgcagtataggggattatttctttggcacactttacaggccctgaatatctgcttgatagttttaaaaaggcctggtcc

SEQ ID NO: 29799 - DNA, 201 bp, Homo sapiens
aggctggagtgcagtggcgcgatctcggctcactgcaagctccgcctcccgggttcacgccattctcctgggttcacgccattctcctgcctcagcctccygagtagctgggactacaggcgcccggcaccacgcccggctaattttttttgtatttttagtagtagagacggggtttcaccgtgttatccaggatggtct

SEQ ID NO: 29800 - DNA, 201 bp, Homo sapiens
caaagtgagatatttcttgaactcatgtctaccaataaagagaaaatgaaaggtagatggtaaatcagaattaggtttggttgcatttgatagaaaacctractaattggcttaaagaggaaacattaatttatctcttacataagagaagctgagatataggcactccaggtatggaggctccacaattatcagggactt

SEQ ID NO: 29801 - DNA, 201 bp, Homo sapiens
atagaaaacctaactaattggcttaaagaggaaacattaatttatctcttacataagagaagctgagatataggcactccaggtatggaggctccacaatyatcagggacttaagctccctttttccttttgcaacgtattttgttgctagtgtcagccttagcctccctccctttaagagggagaagatatgtaactagt

SEQ ID NO: 29802 - DNA, 201 bp, Homo sapiens
ttaatttatctcttacataagagaagctgagatataggcactccaggtatggaggctccacaattatcagggacttaagctccctttttccttttgcaacrtattttgttgctagtgtcagccttagcctccctccctttaagagggagaagatatgtaactagtaaagctctaaggcaaggcctcatggtccagaatgac

SEQ ID NO: 29803 - DNA, 201 bp, Homo sapiens
agctcagaagacaggatgcctgcattccagacctgtcttgtcactctgcattgggtagctttgggcaagtcccagtcccacctaatctccctattgagacytcaagcctcagtttcctcatatgaccagtaggaatccttatccttgctctgcccacctgagtcactgtgaaggtgttttatgaaagggtcagatgcagaa

SEQ ID NO: 29804 - DNA, 201 bp, Homo sapiens; identical to SEQ ID NO: 6071

SEQ ID NO: 29805 - DNA, 201 bp, Homo sapiens
tctcccagtgccatccctgcctctgtggggccattttcagggcagaggtgaggtcccaacctacatggggacacccagattgggacatctaggtagatgcygcactttgccctgatttcttgtaaccactgctgtaattttgcctttttcataaaaccactaccatctgccccagcttcctcctcctgccccatttctctc

SEQ ID NO: 29806 - DNA, 201 bp, Homo sapiens
gtcaccaagtgccagcctgtgcccctctggggcctgattttctcatccagacagtaggggtttgaacttccctctcagagctcccatggggttgtgaaggrtccacggaggggtgagatctagagggttggcagtaggggtctgatgttgctgatctccgtggctgtgaccatcatggctggtgaccacactccttctgcc

SEQ ID NO: 29807 - DNA, 201 bp, Homo sapiens
aaactaaagaaaggttgagaaatgtagtcttttggggcaattttccccttccaaaaaattggggttctattaataaggaggaagaggagaatgattttggstaaataaactgtagtatctaccaaagatgaagagagccataggtttccagaatagtgggagagcatatttttttagaaataaatattcttggctgggcat

SEQ ID NO: 29808 - DNA, 201 bp, Homo sapiens
ggcaggtgctggggccagagccaccccagccacagtccctgagttaaagagcctggggtgggctaggtctgagtgctttcacctggtgtgttgtgtcctcygcaggtgtaccgcaaaaccgtgattgcccagtggagggcgctggacctggatgtggtgctgacccccatgctggcccctgctctggacttgaatgcccca

SEQ ID NO: 29809 - DNA, 201 bp, Homo sapiens
ttagtcatgggctgcatctggggctccatttgaagaacaatttgtagttttacagctttgattctggaagagacaaacttaacgaggaggttaaagatacrgggattgaaatatatggcctgcagtataggggattatttctttggcacactttacaggccctgaatatctgcttgatagttttaaaaaggcctggtccag

SEQ ID NO: 29810 - DNA, 201 bp, Homo sapiens
aggtcctttgcacacttcccactcgtgttgtcctctctggctgctcccccaagggagaattaggcccccctcagcattggcattccagtagaaatcccacygcaggatcctccctaagccatatgaggtagctacggaaacgtggagaggacccactcactccgtccagcagtaggacttgtcatcatccacacgaacaac

SEQ ID NO: 29811 - DNA, 201 bp, Homo sapiens; identical to SEQ ID NO: 6073

SEQ ID NO: 29812 - DNA, 201 bp, Homo sapiens
attgtgcatgcaggtggccacaggtttagatgttacctgtatactatacttccctgcattctccgcaaaatcaggtttccgcatgttcactgattggtctyctggaggtgcagacttactttggtgtctaggagaaaatgtctcagctgcctgacactagttgaagatttaaaaatagctgttagcagctgtgtcattaac

SEQ ID NO: 29813 - DNA, 201 bp, Homo sapiens; identical to SEQ ID NO: 6074

SEQ ID NO: 29814 - DNA, 201 bp, Homo sapiens
tcctttatagaggagggactgtgcaaggagaaccaggggtggagggaatgctcacttttcattttgtatacctttaaagaatatatcaagaggattatctrgtgtgtttggggagaagtcttgaacccattttttcttctttgtagctccttgtgttagaaaaaaaatccaaagtaagtactctatcagttcaatgaattc

SEQ ID NO: 29815 - DNA, 201 bp, Homo sapiens
cttatgtctacttccccttcctcaggcctgggaagtgaacaaagggaccaactgtgtgacctcctatctggctgactgtgagactcagctgtctcaggccmcaaggcagggcctgctctatggcgtccctgtgagcctcaaggagtgcttcacctacaaggtatgctctgcctcagcgccaggcctccatcgtcccctcca

SEQ ID NO: 29816 - DNA, 201 bp, Homo sapiens
cataataaatgttcctgatgctggggtttgcattggctgggactacctgagaattggtctgactccatcagcgccattgctggtggaatgtttcattgggycatggcctctgaagtatctttatttccataggcaatcttgctgccaatgatctctccccgtcccgaatagccagactacagaagatccttcacagctatg

SEQ ID NO: 29817 - DNA, 201 bp, Homo sapiens
catcctagaagtccctgttttggttcacacctcaagattctgtgggccctccttatccaacctttctggggtctgggaactctcccagcatgaccctcaamcctctgattctaagcatggtggtgctagtcactgtgtgacgctaggtaagttacccacatctcttcatcaaattgaaatgttgttaatttttttttgtat

SEQ ID NO: 29818 - DNA, 201 bp, Homo sapiens
aacctttctggggtctgggaactctcccagcatgaccctcaaccctctgattctaagcatggtggtgctagtcactgtgtgacgctaggtaagttacccayatctcttcatcaaattgaaatgttgttaatttttttttgtatcttactgagctatcagttgtagtgctcacataagctagtagacatgaaagtgctttga

SEQ ID NO: 29819 - DNA, 201 bp, Homo sapiens
tttgtataagaagggaaattagtgtttacttagtctagccctcatattttatggagggagaaattgagttctgtggagattaaataaataatacaagaatkggaggtagagccagaactggaacccatctttctttttctcagttcatatccttctgcaaattcctctagagcagagaatacaatttttacttctttgagt

SEQ ID NO: 29820 - DNA, 201 bp, Homo sapiens
actctgtcttaaaaaaaaaacaaaaggaaagagagggagagaaagaaaaggagagaaaggaaagggaggaaaggggagagggaaaggagagaagaaaggcraaagtaatggggaaaggaaaaggggaaaggggaaagaaaggggagaaaggggagagaggacaggaaaggagaaaggaaaggagtcttacttggtctgctt

SEQ ID NO: 29821 - DNA, 201 bp, Homo sapiens
tgagaggcagtctaaccagctacccatcctgtagtagccttcccttatccatgtttccagctccttatgttgctcttctactgctgggaagctcactagtmactgcttctgtctctttctggtttcagggctggactccttgccaccaaaccaggaggccatgttgtctattctacctgctcactctcacacttacagaac

SEQ ID NO: 29822 - DNA, 201 bp, Homo sapiens
gggatgctgtgcaacttctgcatgtaggcctcaagaagcctcgcaacttccacgctcattttggagctcttctgcggctctgtgaagaagcctggaccaayctgctggagacatgtgctggaagctgtcttagacctcctaagctcagttaaacggttaggtgacccaaacagcatgagtgaccccagccaagaccaacct

SEQ ID NO: 29823 - DNA, 201 bp, Homo sapiens
cattctggaggcagaacgactgatgccctctgagaggcagcactgcctgcccggaggacctgtgtcccactgtggctctgttcagatccaggggcaggtgmtggggccagagccaccccagccacagtccctgagttaaagagcctggggtgggctaggtctgagtgctttcacctggtgtgttgtgtcctccgcaggtgt

SEQ ID NO: 29824 - DNA, 201 bp, Homo sapiens
ttgctgtgggccgggcgagcaagctgggaaggatgtggggatgggagtgcctggaccgagcattttgtttcccagcaaaggtgatttcgtggacccctgcctgggggacctggtctcaattctgaagcttccccaatggcttaaaggactgctggccttcctggtgaagcctctggtgagggcacaaggagtggaggggct

SEQ ID NO: 29825 - DNA, 201 bp, Homo sapiens
tgccagcctgtgcccctctggggcctgattttctcatccagacagtaggggtttgaacttccctctcagagctcccatggggttgtgaagggtccacggargggtgagatctagagggttggcagtaggggtctgatgttgctgatctccgtggctgtgaccatcatggctggtgaccacactccttctgcccagttcggc

SEQ ID NO: 29826 - DNA, 201 bp, Homo sapiens
catgcacataataaatgttcctgatgctggggtttgcattggctgggactacctgagaattggtctgactccatcagcgccattgctggtggaatgtttcrttgggtcatggcctctgaagtatctttatttccataggcaatcttgctgccaatgatctctccccgtcccgaatagccagactacagaagatccttcaca

SEQ ID NO: 29827 - DNA, 201 bp, Homo sapiens; identical to SEQ ID NO: 6075

SEQ ID NO: 29828 - DNA, 201 bp, Homo sapiens; identical to SEQ ID NO: 6076

SEQ ID NO: 29829 - DNA, 201 bp, Homo sapiens
gggagttcaagaccagcctgaccaacatggagaaaccccgtctctactaaaaatacaaaatttgccggcgtggtggcgcatgcctgtaatcccagctactygggaggctgaggcaggagaatcgcttgaacccgggaggcggaggttatggtaagccgagatcgcgccattgcactctagcctgggcaacaagagcgaaac

SEQ ID NO: 29830 - DNA, 201 bp, Homo sapiens
tgcagaagaatataagtcatttctttcttagcgtctgagggtcaaattggtcccaaatctccagaatacatcttaggggcgtttttgccttgtggggaacrtttcccattgctttggaggtcccttcgtggtcgccaaatgttactggggggtccttgctcccagagctcccaagatggtggcgggccgcttccaagatgg

SEQ ID NO: 29831 - DNA, 201 bp, Homo sapiens
ctggagtgcaatggcacaatctcggctcactgcaacctctgcttcctgggctcaagcaattctcccgcctcatcctcccaagtagctgggagtacaggcaygtgccagcatgtccagctaatttttttggtattttttgtggagacggggttttgtcatattgcccaggctggtctcgaaatcctgggctaaagccatccg

SEQ ID NO: 29832 - DNA, 201 bp, Homo sapiens
ctcaacacctcaaaccagggggtatcttgccttgcctgacctggaaggctcaacccctcaaaccagggggtgttttgccttgctgccctggaaggctcaayccctcaaactaggaggtgtcttgccttgcttccctggaaggttgacctgtttcctccctttccccctctgaaggtcctttgcacacttcccactcgtgtt

SEQ ID NO: 29833 - DNA, 201 bp, Homo sapiens
ttgcctgacctggaaggctcaacccctcaaaccagggggtgttttgccttgctgccctggaaggctcaatccctcaaactaggaggtgtcttgccttgctkccctggaaggttgacctgtttcctccctttccccctctgaaggtcctttgcacacttcccactcgtgttgtcctctctggctgctcccccaagggagaat

SEQ ID NO: 29834 - DNA, 201 bp, Homo sapiens
ctttccccctctgaaggtcctttgcacacttcccactcgtgttgtcctctctggctgctcccccaagggagaattaggcccccctcagcattggcattccrgtagaaatcccaccgcaggatcctccctaagccatatgaggtagctacggaaacgtggagaggacccactcactccgtccagcagtaggacttgtcatca

SEQ ID NO: 29835 - DNA, 201 bp, Homo sapiens
aggagaagcgggaaattacctttcaggtttccagtgattgtggttttgagtaatcagcaaaggggtggggtcctgattgacaatagctttgtaggctttgsgggggagtaggatttttttttggtttttgttatttttgttttttgtttttgagacggagtcttgctctgtcgcccaggctggagtgcaatggtgcgatct

SEQ ID NO: 29836 - DNA, 201 bp, Homo sapiens
ggacctcgctgtccctccagctgggcacattgagcctggagatcccttgccagggtgccagcccgaggggaggctgggttgagtatctgtggcctacccctgatctgagcttgttgtgaggtaggaggtgggcaggaggttgcctctctgtttgggaaggatttgggccaagggcaggatccaggcaggagggtgggggtt

SEQ ID NO: 29837 - DNA, 201 bp, Homo sapiens
gcagttattccagggtggtgaatgctctgctgatttcgatgtccttctccatactcttaggcattttttaaaatacaatgaacctgtatttatataatgaraacaaaaataaagcaaaatttgattttcattgtgagatgggaaaggcaagatgcagtactgtgtgtatagtatgattcctttgtgcaaaaaagaatatat

SEQ ID NO: 29838 - DNA, 201 bp, Homo sapiens
gcttacctccctcacctctctgccccacagtgcgtctctccgtgggccccatggcccgggacgtggagagcctggcactgtgcctgcgagccctgctgtgygaggacatgttccgcttggaccccactgtgcctcccttgcccttcagagaagaggtgagcagggctgggtgggcatgaatgtggaccgctgaacccagac

SEQ ID NO: 29839 - DNA, 201 bp, Homo sapiens
tcctccacagacggccaccagatggagcccttgcctgcatttggaaatcctcaggctttttttttttttccttttctttctttctttttttttttttttttgagactgagtatcgctctgtccctcaggctggagtgcagtggcgcgatctcggctcactgcaagctccgcctcccgggttcacgccattctcctgggttc

SEQ ID NO: 29840 - DNA, 201 bp, Homo sapiens
attcggtcatagccttctggaagtccagagggagagaagaaaaggtggggtcatgggcttaatgaatccaatgcaagagagcccagcctgtgtgctggacmattcttatctgactgaatgctgtgggaatccattagaagggagatgagtaagggtagggttacttggaggaggaggaacttgaactaggaggaggaagaa

SEQ ID NO: 29841 - DNA, 201 bp, Homo sapiens
aaaatagttcacctctctctaaactcttgagcaaatctagagaaaaatgtgtttctggtaattctgttgacgcttcacccattttttcccaccctgccccctgaataagttttgatatcttttctagaccgaagagaaggaccaccatcaatagaatagtatagctgggagagacatcacagaacacctatttatgccctt

SEQ ID NO: 29842 - DNA, 201 bp, Homo sapiens
tggccaggctggtctcgaactcctgacctcaggtgatccgcctgcctcggcctcccaaagtgctgggattacaggtgtgagccaccactcccggattcttrgctgtgtccaaggaggacacagctggatgaaggggtacctaaacaccttctgaattttcacaaaatagttcacctctctctaaactcttgagcaaatcta

SEQ ID NO: 29843 - DNA, 201 bp, Homo sapiens
ggactctgtgtcataagtttaaggaaaggtgctgtgccttgatgtgtatgtaggccagatttatgtttgactttatacaagcatctcagtgcagtaaacarcagtattgtcaccagcatgtctcacctccagccataaggtggttttctcctatctcagtaaatagaacgtaggatcgggttttacactgacacattccat

SEQ ID NO: 29844 - DNA, 201 bp, Homo sapiens
ccaaggattttgtgaatgaagccatctcccactgggaactgcagtctgagggtggccaatctgcagccccatcccctgcctcctgggcctgcagtccgaamcttcgatgcttcacttttgacagaggggatatcagtcgcttccctcctgccaggtaggatctggagccatgactggagcggtcctgagtgtctgctggaa

SEQ ID NO: 29845 - DNA, 201 bp, Homo sapiens
tgtctttacaaaaaataaaaacaaaattagccaggcgtgatggtatgcacctgtagtcccagctactctgaaggctgaggtgggaggatggcttgagctcrgcaggcagaggttctagtgagctgaaatcatgccactgcactccagcttgggcaacagaatgagactctgtctcaaaaaaaaaaaaaaaaaaaaaggaag

SEQ ID NO: 29846 - DNA, 201 bp, Homo sapiens; identical to SEQ ID NO: 6112

SEQ ID NO: 29847 - DNA, 201 bp, Homo sapiens; identical to SEQ ID NO: 6113

SEQ ID NO: 29848 - DNA, 201 bp, Homo sapiens
acgccgctgggccggccctggcagctctgcagctgctgggcctggggcctatcaggcagcgtgtgtgtaggccaggtgggcagcgggacaccagagcctgkactggggccagggctcaggccactgtcctcctcctcctcctccttctcctagggtggtagtcaagaatgaatgtatgggtccagccaggaaatgggagcc

SEQ ID NO: 29849 - DNA, 201 bp, Homo sapiens
agaggagacttctgaaggctcctgggctgccgagcccctccccagagttgtgctgcccagaactctgggcaagatggaccctctcaaacctatgccttccrgacagtggaaatcctagtcccctcccctcttctgccacacaggctgaaagttcctcctgagggctagtctgcaccctttctgttgtactgcgtcttcttg

SEQ ID NO: 29850 - DNA, 201 bp, Homo sapiens
agccactgctttgactagaacttctgatagctcaaatatatctcttaaaaatatctctaagccttaggttttacattcattttctgattctcaaatcttgtcacttcacttcccttatccttttgagctcttaatccatttccactgccttttggagattttccagcttgtctgggtttctggaacagtactgttttttat

SEQ ID NO: 29851 - DNA, 201 bp, Homo sapiens
aggaggcaggggctgtagtgagctatgattgtgccactgcactccagcctgggcaacagagcaagaccctgtcacaaagaaacaaacaaacaaaacaactyagtgggattgccttggagccaagggacccaagcagatatgttctctgaggctccatagggcacaatgagcccctgtgatggggtggcacaaggggcatta

SEQ ID NO: 29852 - DNA, 201 bp, Homo sapiens
gccactgctttgactagaacttctgatagctcaaatatatctcttaaaaatatctctaagccttaggttttacattcattttctgattctcaaatcttgtcacttcacttcccttatccttttgagctcttaatccatttccactgccttttggagattttccagcttgtctgggtttctggaacagtactgttttttatt

SEQ ID NO: 29853 - DNA, 201 bp, Homo sapiens
ccactgctttgactagaacttctgatagctcaaatatatctcttaaaaatatctctaagccttaggttttacattcattttctgattctcaaatcttgtcacttcacttcccttatccttttgagctcttaatccatttccactgccttttggagattttccagcttgtctgggtttctggaacagtactgttttttattg

SEQ ID NO: 29854 - DNA, 201 bp, Homo sapiens
cttttgttctccctcggttagccactagagaaattagtaaaagagctggggtttcctttgggggaaaaaatcagggcatataacaagtagctttaattctmtgctagggccaggtgcagtggctcacacctgtaatcccagcaatttgggaggctaaggcaggaggattgcttgagccaggagttcaagatcagcctgggc

SEQ ID NO: 29855 - DNA, 201 bp, Homo sapiens
tcggagcgtggcataccaaaagatagggggctggcgatgggggttctgggggaaggagtcattggagagactagagtctgtattggggcttgaagcaagcmggcagcaaagaactggagagacagagaaaaatgtgatcaagcagtagcgaagagaggggcgctgaggagcttgggggctggagacccgggaggttgggaa

SEQ ID NO: 29856 - DNA, 201 bp, Homo sapiens
agaagtatagaagtttgccaggagaaaaaggatataaggaattacagaacaagacccagaggtgtgaaaggatgagctcagtgtaccatggttagagtggrtggcagtggggagctgttggaggacattaggaagggaagggaaatgattggatttgcatttagaaagttaaggccttccaagtgccttctgcagctaaca

SEQ ID NO: 29857 - DNA, 201 bp, Homo sapiens
ggggtttggagaagtatagaagtttgccaggagaaaaaggatataaggaattacagaacaagacccagaggtgtgaaaggatgagctcagtgtaccatggmtagagtggctggcagtggggagctgttggaggacattaggaagggaagggaaatgattggatttgcatttagaaagttaaggccttccaagtgccttctg

SEQ ID NO: 29858 - DNA, 201 bp, Homo sapiens
attccccaatagataggttctctcttaatgctgttaaagtcaagttcataagcctggaccatgatgaatttaccaaggtaaaagtcacctctgatgccacytgtcagctggccagccagcctgccctgatgacactcctgtctcttcaagcacatttctttcagactcctgtgcttcctagccacattcatctcaatcagc

SEQ ID NO: 29859 - DNA, 201 bp, Homo sapiens
aactcttattaacatccagctgatttgcatatatctgcattcactggggcttctccattctggttttattgtaaatgaattgctcagaggaagaaagggawggattatttcactccttttttttcctcttctttccccctattcctagggtctctgtctggaaatttcccccagatgcgtgaaggtgtgtgtggtggaaga

SEQ ID NO: 29860 - DNA, 201 bp, Homo sapiens; identical to SEQ ID NO: 6120

SEQ ID NO: 29861 - DNA, 201 bp, Homo sapiens
aaagtatgtgacaaagactgtggctactgctggggaagctgccggaggaccaggccagtgggagctgagctagattatctctgaaggtctgaccttgaagrgagggaggggctggcagtcaggaatccctgaatctgctcttcagcacaaactccttctaagcagagcctcttacagcagagataccactgtggtcgctga

SEQ ID NO: 29862 - DNA, 201 bp, Homo sapiens
attttgaaaattaagcagagaaaatctttaagattatgaagcaaaactacttactctttatgatcctgccaaggatcagaacatggcagcagagaagtccsaggtctaactgaatgtccagactctgttggattcagcaccatagacagaaagcagcccaaagctgctgagggctgagggttgaatgccatagacagatac

SEQ ID NO: 29863 - DNA, 201 bp, Homo sapiens
gctgcaagtgttgctgcctccccgagggtcgcccctccttaagccaagcccaccttgcctgcctacttctcaggaatgaggagctaaggtttagcgctctrggccaccgatgccagctcattcccctctcgcagaagccctgccagctcccacagctgccccaccccccacggtttggagatctgcgggaccccttccttt

SEQ ID NO: 29864 - DNA, 201 bp, Homo sapiens
aggtttagcgctctgggccaccgatgccagctcattcccctctcgcagaagccctgccagctcccacagctgccccaccccccacggtttggagatctgcrggaccccttcctttccccaccagttgggtgttccgcccctggcctatgaaactccaccttcccaccctctgctggcggggattggttggcatcccgcggc

SEQ ID NO: 29865 - DNA, 201 bp, Homo sapiens
ctcctgggttcaagcaattctcctgcctcagcctcctgagtagctgggattataggcgtgcaccaccatgcccagctaatttttgtatttttagtagagayggggtttcaccatgttggccaggctggtctcaaactcctgacctcaagtgatccacctacctaggccttccagagtgctgggattataggcgtgagccac

SEQ ID NO: 29866 - DNA, 201 bp, Homo sapiens
gatgatggtgagcggtgagactccgccccccgctggctctggggtctgggggcattgctcagcggtgctaggctggcgcggcttgagccgccgccggactkacagctcggtctgcggaccatggagacctgcgccggtccacacccgctgcgcctcttcctctgccggatgcagctctgtctcgcgctgcttttgggaccc

SEQ ID NO: 29867 - DNA, 201 bp, Homo sapiens
attgacaaaaaggactttgcatatgtgattagtgatcttttgagatggagagattgttttagattatctggatgggcccaataatcacaatggtccttgtrtgaggggtgcaggaggagccagagtcagaggaggaggcagtgtgatgactgaggcagagattaaagtgatgtgatttgaagatggaggaggggaccacaa

SEQ ID NO: 29868 - DNA, 201 bp, Homo sapiens
ctcagagcctccaaaagaaaacagtcctgctgacaccttgactctagaccagtgaaagtggctttgggcttctgacctccagaactgtaacagaaaaatawtgtgttgttttaagccactaaatttgtggtaatatgttacagcagccccaggaactgaatacaagctccttccctactgactgtggctacctctctctgg

SEQ ID NO: 29869 - DNA, 201 bp, Homo sapiens
ggcctgttagaaaacattgagtcttcagccagttagacagtcaaaaaaaaaaaaaaaaagtgaataagtgaggagagaactggctgtctaggaacagaaaygtggcatctggatggagctaatacaggacagtggcttgcacatagtagtagatcctccaagcaatgttgttgattgattgacacagcaagcaagactggg

SEQ ID NO: 29870 - DNA, 201 bp, Homo sapiens
agggtgtgaaacataaacagagagctaaggaagcatggaagggagaacctaattctaagcatggagaaggcttcccagagaaggtgagaaggttttttttycccaggcagcttagagcattctaagcttaggaattgcatgcagaaggatggaggcagaaggaacatagcatggctgggcctatgtaactaaatgtggttg

SEQ ID NO: 29871 - DNA, 201 bp, Homo sapiens
tgagaggaggaggtttctctgggaaatgtgggagaaagagagagagagagaaagagactcaggaacccaaaccatgtctgatgagaacagaaaaaggccayttgtaatggcctcagctctgccttggggagtggggagctggggacaatgccaaggaaagcttcacaagggagatgttatttgaactggggtttggagaag

SEQ ID NO: 29872 - DNA, 201 bp, Homo sapiens
ttcattgttgtgtatctatagagcctacctagtagatgccaaaaaatatttgctgaatgaatggatcaggagtgagaggaggaggtttctctgggaaatgwgggagaaagagagagagagagaaagagactcaggaacccaaaccatgtctgatgagaacagaaaaaggccatttgtaatggcctcagctctgccttgggg

SEQ ID NO: 29873 - DNA, 201 bp, Homo sapiens
agcctctcctgatgacctttctttctgcaggtaaagaagaccaattcctcccacctactcctcctattgctactgtccagcaagtatgtctgagtgggcamgtgtgcatttactcgcacatatacacaagcacacacgcagaaatggcacatgaaagcgggttgtaaatggccagtgatctacgatgccaggaatcctcct

SEQ ID NO: 29874 - DNA, 201 bp, Homo sapiens
tggactccttgcacaaagcctctgtcccgctcacggctctgcagttggcctcgccgctgatttctcagggaaaaagaggtggaaagtcccttaatctcttmccttccctttaaaaaaatgtcagtaggaatccgaatttacttccttccctctgtctcgggaagccggatccggccctgtgtcccttacctccaaccctcg

SEQ ID NO: 29875 - DNA, 201 bp, Homo sapiens
ataactctgaaaactgtttttgttcctattttacaaagaaagaagtggaggctcataaagggtaagtggttgtgtttcataatcttaaaggttttctctgstgaattttcaaaattagtaaattaaatgctttgtgcttcctttatctaagaaaatacagtttaggccaggcatggtggctcatgcctataatcccagcac

SEQ ID NO: 29876 - DNA, 201 bp, Homo sapiens
gggtcggggggcggtggagaagccttggactctggagcccaaggagagccctgaagtcttgtggagtttccagtgagtccagtcagggccaatgagtgaayttactagatgaaattgactggctaaggaggcattagggatctatatcttaggcaccttgcacaggccttctcgtttatttattttcatggcaataaagga

SEQ ID NO: 29877 - DNA, 201 bp, Homo sapiens; identical to SEQ ID NO: 6119

SEQ ID NO: 29878 - DNA, 201 bp, Homo sapiens
ccccaatatgtcaatgtcctaatccctagaaccgtgaatgttagcttaattgacaaaaaggactttgcatatgtgattagtgatcttttgagatggagagrttgttttagattatctggatgggcccaataatcacaatggtccttgtgtgaggggtgcaggaggagccagagtcagaggaggaggcagtgtgatgactga

SEQ ID NO: 29879 - DNA, 201 bp, Homo sapiens
gtccagggaacttttactggcccttctctctccacccacccccctccacctggctggctttacttccagttgggaatttatgacacactcactcacatgakggtggtgggagggtgtgtgtgtgtgtgtgcatgtatgcttgtgtgtctgtccctgcgtaactgtggaacagctcttggggcacctctcctcccctctctt

SEQ ID NO: 29880 - DNA, 201 bp, Homo sapiens
gagtcctaaaagaggcttggagacttggggtaggggaggatgatgtgggctgtaacagcagcttggtggagtgcaaagggcactggtcagagagtcaggaractacaggcaccattcctagctccaccactaacttgatgtgcatacctggtcagatcgctctccctctggagcctcagtttccccatctataaaaataag

SEQ ID NO: 29881 - DNA, 201 bp, Homo sapiens
tgcaggagaaagagcacaagggctgaactaaggtagtggcagagatcattgagagatgaggatagatgggatcatgagttagcatccacagcacttagtgmccatgtgatacaggaggagaaaggagtcccctttgacttacatgctactggggattgaatggacagagggatcattcactagggtacagaacacaggacc

SEQ ID NO: 29882 - DNA, 201 bp, Homo sapiens
ctgaggagagcgcccctccgctgccctctcctcaccctgcctaccctccagccgaaaggggggctcccgaccttcgcaccatcggttcggtccccatgctsccatcctcggttcctcactaacctcctcccaaatcctcaccaactgccccgccactctcacattccgacctcccaagggcccccacgcccccgtctctga

SEQ ID NO: 29883 - DNA, 201 bp, Homo sapiens
tcctttccccaccagttgggtgttccgcccctggcctatgaaactccaccttcccaccctctgctggcggggattggttggcatcccgcggcggtgcctastgattggttcccatggatgatggtgagcggtgagactccgccccccgctggctctggggtctgggggcattgctcagcggtgctaggctggcgcggcttg

SEQ ID NO: 29884 - DNA, 201 bp, Homo sapiens
attgctcagaggaagaaagggaaggattatttcactccttttttttcctcttctttccccctattcctagggtctctgtctggaaatttcccccagatgcstgaaggtgtgtgtggtggaagagggtagaaaccagactccaacagtcaggtatttgccagagcatcctatgtagatttccccagataatttcccccatct

SEQ ID NO: 29885 - DNA, 201 bp, Homo sapiens; identical to SEQ ID NO: 6117

SEQ ID NO: 29886 - DNA, 201 bp, Homo sapiens
gcctggcagccccccacgcatgcactgcggcgccgacggcgagtggctggtgcctgtgggccgctgcagctgcagcgcgggattccaggagcgtggtgacwtctgcgaaggtatccagttggctgggggccgtggggtgggagtgtagagcgtaggtggcaattgagagagagtgtgccctagaggaaagaggcgggtgtg

SEQ ID NO: 29887 - DNA, 201 bp, Homo sapiens
accgccgaggaaggtgagaagactggtgagctctgctcggagcgtggcataccaaaagatagggggctggcgatgggggttctgggggaaggagtcattgsagagactagagtctgtattggggcttgaagcaagcaggcagcaaagaactggagagacagagaaaaatgtgatcaagcagtagcgaagagaggggcgctg

SEQ ID NO: 29888 - DNA, 201 bp, Homo sapiens
catctgtttggtttctgaaagatccttgtcaggttcagaggaagtctgtattttgttttagcaccgagggtcagaacctctgggctgaagtccctggagcytcagtaagaagccatgattggtgccttagagcctgctaaggggatggaacccggttttaaagaggagtgaggggtggtggagtgaggactcattttgaaa

SEQ ID NO: 29889 - DNA, 201 bp, Homo sapiens
tgagtgggcacgtgtgcatttactcgcacatatacacaagcacacacgcagaaatggcacatgaaagcgggttgtaaatggccagtgatctacgatgccakgaatcctccttacactcggcgttcaaagaggtatggactctggcagagacagcgtggttcaccagggcatccgcagcacagagcatggcgcccagtgagg

SEQ ID NO: 29890 - DNA, 201 bp, Homo sapiens
aaaaataccatctcccagaggtggaggcagggggaggggagaaatcgagcgtgaggagaatgaagatggaaaggaggtggcagtgtgagaacccttcctcrggtaggtctggttttagaagtcccgcctgcatccaaggactggagggatgccacacctccttctgcttcctcagggggcttgtctcctgtggtgtccaag

SEQ ID NO: 29891 - DNA, 201 bp, Homo sapiens
gcggagggtggggggtgggagtggccaagaaggaaggcctgatccaggtggtggtgagggcagggtctccgcactggggcgcacgtgggcggatatggggrccagcgccccggaaggcggcgtacgggggagcggagcctggacgcgccctgggggccggggcctttgatgagaagaaccaggacaactgcgagagtccag

SEQ ID NO: 29892 - DNA, 201 bp, Homo sapiens
ctgactgtttttctatcgcaattggaggagataaacgctgccctaaccaggccagtcaggaaagcggggagaaactggaggagccccctcttctcaccagycatgccctgcagcctgtcccccagggttttacaaggtgtccccgcggcggcccctctgctcaccgtgcccagagcacagccgggccctggaaaacgcctc

SEQ ID NO: 29893 - DNA, 201 bp, Homo sapiens
gggttgttcaggagtcactccacggggcagtgctgactggagtggctgagtcccctgactgtttttctatcgcaattggaggagataaacgctgccctaamcaggccagtcaggaaagcggggagaaactggaggagccccctcttctcaccagccatgccctgcagcctgtcccccagggttttacaaggtgtccccgcg

SEQ ID NO: 29894 - DNA, 201 bp, Homo sapiens
cctccaggctgcactgcggagggtggggggtgggagtggccaagaaggaaggcctgatccaggtggtggtgagggcagggtctccgcactggggcgcacgkgggcggatatggggaccagcgccccggaaggcggcgtacgggggagcggagcctggacgcgccctgggggccggggcctttgatgagaagaaccaggaca

SEQ ID NO: 29895 - DNA, 201 bp, Homo sapiens
ctttacttccagttgggaatttatgacacactcactcacatgatggtggtgggagggtgtgtgtgtgtgtgtgcatgtatgcttgtgtgtctgtccctgcrtaactgtggaacagctcttggggcacctctcctcccctctctttctcacaccagcactgcagagtttgacttattttcttccagtggtcctgagggtggt

SEQ ID NO: 29896 - DNA, 201 bp, Homo sapiens; identical to SEQ ID NO: 6115

SEQ ID NO: 29897 - DNA, 201 bp, Homo sapiens
gattatctctgaaggtctgaccttgaagagagggaggggctggcagtcaggaatccctgaatctgctcttcagcacaaactccttctaagcagagcctctyacagcagagataccactgtggtcgctgatgggcccacccacctctaggacagcagccaccctcatacacttgtggggagggagcctccagcattcttccc

SEQ ID NO: 29898 - DNA, 201 bp, Homo sapiens; identical to SEQ ID NO: 6118

SEQ ID NO: 29899 - DNA, 201 bp, Homo sapiens
ttaacaacctgtgttctgagaagtgagagaagcaaactgagtaggtgtcaagactggaaccaggtctgactcatggtccagggaacttttactggcccttytctctccacccacccccctccacctggctggctttacttccagttgggaatttatgacacactcactcacatgatggtggtgggagggtgtgtgtgtgtg

SEQ ID NO: 29900 - DNA, 201 bp, Homo sapiens
gggaagttgcactagatgattacgaagatcacatcccactctctgaactacaatcactgtgctccctgggggagatccttcatgttgagggttttgctggsttctcaggctagtgggggcattaggaacagacctctcattctctctcttgcctgtggctttggatacagagggtgatgatggggttattaatgtgtgtac

SEQ ID NO: 29901 - DNA, 201 bp, Homo sapiens
ggccagggaacaaggtgaggaccacccaagttctgagaggtagggccaggaaccaactggcccagctggtgagaaatttttttaaagtgggtgtttagcarttaccacttaaggcctgtgggggaggaacagtaattactatcattattgtgaaaatgtggttggtactgggctaggtggtttacatgttttatctcaatc

SEQ ID NO: 29902 - DNA, 201 bp, Homo sapiens
aaatgagtcagacatagtcctagctctcaagaagctcacagtctagatggagagatgcaaaaatttaaaaatcacaagagggtaatatatgctataacagrgggatacacagagtggtgggaggacaggggaggaagtgactaaatttgctctcattcctttgttcaatcatccatccaatatgaattgaggatgtgccag

SEQ ID NO: 29903 - DNA, 201 bp, Homo sapiens
ggattcaatgaattaatagacgtaatttaaaaaataataaatagagacggggtttggccatgttgtccaggctggtctccaactcctgggctcaagtgatcctccagctttggccttccaaagtgctgggattacaggcatgagccaccgcgcccggctgaaagtaaaatgtttcaaagttttccgaacacacagcgtttt

SEQ ID NO: 29904 - DNA, 201 bp, Homo sapiens
gcgtcttcttggagctggagagcagccagctaaactagaggagagggccagggaacaaggtgaggaccacccaagttctgagaggtagggccaggaaccamctggcccagctggtgagaaatttttttaaagtgggtgtttagcagttaccacttaaggcctgtgggggaggaacagtaattactatcattattgtgaaaa

SEQ ID NO: 29905 - DNA, 201 bp, Homo sapiens
tgcttgcctgtcactcactttctgctgtgcggcctggttcctaacaggccacagattcatagtgggttcgtagcggtctgtggcctgggagttgaggtccyctgactttaaaggatactggaggcgagtgtaggttatatgcaaatgctgcaccatttttatataaaggacttgagcatctgtggattttgatatctgtag

SEQ ID NO: 29906 - DNA, 201 bp, Homo sapiens
gagatgagcatggggacctgtcccagggagtcaaaggcgagtgtcattccagaaacggagaccatggccacagggcccttgacctgtccaccttcttcccrtctgtcctgtcttcctgcctcccctcttttcctaccaaatcaggcctcatgctccaccacttcaaccccaatcttaccaacaccccatccctgttctcct

SEQ ID NO: 29907 - DNA, 201 bp, Homo sapiens
agttcaattaactaaaggaaactacgcttaaataattaaaggaaggtaggatgacaagcctcatcaaataaagaatataataagaaaacagaaattagttyaaaaatcaaatggaaattctggagttgaaaagtacaataaccaaaacgaaaaattcactggaaggctcaacagtagatttgcgctggcaaacttgaaata

SEQ ID NO: 29908 - DNA, 201 bp, Homo sapiens
acacatcaaaaacaaaatgttgaaagccaaagataagaaaatcttgaaagctggccggccacggtggctcacacctgtaatcccagcactttgggaggccraggcaggtggatcatgaggtgaagagatcgagaccatactggccaaaatggtgaaaccctgtctctactaaaaatacaaaaattagctgggcatggtggc

SEQ ID NO: 29909 - DNA, 201 bp, Homo sapiens
ttcctccctatgataagtaggcaccaacaaaaggatttcatgtatgtcactgactatatacatatgtgttttatatttctataaatgatattgtgcttcaratctctttctgtacttttacttttttctcaacacgaaatttttaaggaatcatctatgttgcagtatgtataatttgcttctaactgatgtttgatattc

SEQ ID NO: 29910 - DNA, 201 bp, Homo sapiens
tcacgcctgtaatcccagcactttaggaggccgaggcaggcggatcacaagatcaggagatcgagaccatcctggctaacatggtgaaaccccgtctctaytaaaaatacaaaaaattagctgggcatggtggcgggcgcctgtagctccagctactcgggagtctgaggcaggagaatggcatgaacccggtaggcggag

SEQ ID NO: 29911 - DNA, 201 bp, Homo sapiens
actctgtacaaattctcactgacaacttctcatcctttaactaaaatgtgtatgtttgactgaaaaggctaggcacctggtatctgcctgggtttttattrtgtatgtggtatactagaaaaggacactgaggccgcatactggtttccagcctcagtctactgacagtagaaatggggagaagtttgtcttctttcctgg

SEQ ID NO: 29912 - DNA, 201 bp, Homo sapiens
taatccaacatacattcagccctccatagccatgggttcagcatctgtggattcaaccaaccttggatcaaaaatattggggaaaaaaatttgaaaatatygcaaaaggaaaactgaattttccgtgtgccgagaactacattgaatccatgagaatgaggtgatgcatagcattgtattcggtattataagtaatctaga

SEQ ID NO: 29913 - DNA, 201 bp, Homo sapiens
gtcctgcagttgcaggatgcgttttcccgagggcttctgaagccaggcctcaatgtcgtgctagaggggccgaagaaggccgtgaacgacgtggtgagcgygggcacagggtcgggggtactcggacatgggatgcgcttcaggcgctgttgggcttgggagaccgattcttgtcccaggaaagatgcaccctgcgcctcg

SEQ ID NO: 29914 - DNA, 201 bp, Homo sapiens
aaatttcacacctgttgaaactatctttcagaaatgaggataaaataaagtcattttcagacaaaaactgggagaatttattaatacattatcagtaaatrcagaaggaaaatgatcccagctggaatatctgatttgtaaagagtaatggtgggaaaaagtttggtaagtatgagagcaaatataaattaatgttgtctg

SEQ ID NO: 29915 - DNA, 201 bp, Homo sapiens
gagaaagcccatatgatgaatgctattaagaaatatcagaaaggttggtacatctctaataggggaacgagggtagcaggtactttagagttgatttgaayacttagtgctttggagccttcttggttgatgtggacctgtcggatcaaagttttgggaatggtgttggagagcaggatgtgactcttaaaatcagtgtag

SEQ ID NO: 29916 - DNA, 201 bp, Homo sapiens
actatctagcatgtagactgtacttctttttattttgtttgtcactctcccctcttagaatggaagcactgtgaggacagcattttatgtgcatatgtgcrtgtctattttgtgcctggaacacagggggtacttaatacatttttgttgagtgaacaaatgaatatgttgagcctcatcatgactctgagctgaacaagc

SEQ ID NO: 29917 - DNA, 201 bp, Homo sapiens
tcccccaacggcttcactttccatgctttgtttgttcttattagcatctatcactatctagcatgtagactgtacttctttttattttgtttgtcactctsccctcttagaatggaagcactgtgaggacagcattttatgtgcatatgtgcgtgtctattttgtgcctggaacacagggggtacttaatacatttttgtt

SEQ ID NO: 29918 - DNA, 201 bp, Homo sapiens
tttccttcagtcttcactcaaaaatcactgctcagtgagccctccccagcctccctatctacaacttcttactcccccaacggcttcactttccatgcttygtttgttcttattagcatctatcactatctagcatgtagactgtacttctttttattttgtttgtcactctcccctcttagaatggaagcactgtgagga

SEQ ID NO: 29919 - DNA, 201 bp, Homo sapiens
tggaatataaagagagttgggaattctgggaacatgctttttaagggacaggcggaggaagagccaggacagaagcggggaggaggagtcagaaaggtttwcagggaacagagtgtggtcacaaggatggtaagacagaagggagtttcaagaaggagcggtatatgcacaagtcatttccagcctggcagcggtactgtc

SEQ ID NO: 29920 - DNA, 201 bp, Homo sapiens
ttcctttccttcagtcttcactcaaaaatcactgctcagtgagccctccccagcctccctatctacaacttcttactcccccaacggcttcactttccatrctttgtttgttcttattagcatctatcactatctagcatgtagactgtacttctttttattttgtttgtcactctcccctcttagaatggaagcactgtg

SEQ ID NO: 29921 - DNA, 201 bp, Homo sapiens
aaggtaaatcatggcctgagagttacttagactataatggaatataaagagagttgggaattctgggaacatgctttttaagggacaggcggaggaagagmcaggacagaagcggggaggaggagtcagaaaggtttacagggaacagagtgtggtcacaaggatggtaagacagaagggagtttcaagaaggagcggtat

SEQ ID NO: 29922 - DNA, 201 bp, Homo sapiens
caatcaccagtgtctggaacttagtatgttcttgatatatgttgactggttttagagtttgtaaaatgcttttgcattgtttcgacccagctgatgcctcrcctctcctccttaaaacattttcgcctctcacatagatatccttttattattattattatactttaagttctagggtacatgtgcacaatgtacaggttt

SEQ ID NO: 29923 - DNA, 201 bp, Homo sapiens
cctaggcagagaaggtaaatcatggcctgagagttacttagactataatggaatataaagagagttgggaattctgggaacatgctttttaagggacaggmggaggaagagccaggacagaagcggggaggaggagtcagaaaggtttacagggaacagagtgtggtcacaaggatggtaagacagaagggagtttcaaga

SEQ ID NO: 29924 - DNA, 201 bp, Homo sapiens
cttacccactaagatggctataataaaaaagataataacaagttttggcaagaatatagagaaatcagaatgctcatatactgcttatgggaatataaaayggtccagcaactttggaaaacagtatggcagttcctcaaataattgaacatgaagttaccatatgactcagcaattccacttctaggaagagaaatgaaa

SEQ ID NO: 29925 - DNA, 201 bp, Homo sapiens
cttttatctctgtaatcccagaccttagtatagtgtcaggtacacagcagacccctctgtaaatcctaggcagagaaggtaaatcatggcctgagagttayttagactataatggaatataaagagagttgggaattctgggaacatgctttttaagggacaggcggaggaagagccaggacagaagcggggaggaggagt

SEQ ID NO: 29926 - DNA, 201 bp, Homo sapiens
atatatttatccatgggaatgacccggcctttgacatgctgtgtttgaggtccttgttcagtgtccttcctccatctattcttcacattgctgcagattawtctctccgagatgcgaatcatgttaagtcattccccagcttaaatttatgaatggtccttatgaacaatgtccagcctaatgcagggtgtaaaaggcccc

SEQ ID NO: 29927 - DNA, 201 bp, Homo sapiens
ctctccaatggcggtacgcagcacggactagattaaggaaggaccaaaggcaggatgatgagttgctggggtgggtgggcggcaactgcatagaccaggcragagacagacagggtttggactgaggtagggaaggggaccagagaggaatggagaggttggagagagtgagtttagagaggatagtgcctgactgggtgt

SEQ ID NO: 29928 - DNA, 201 bp, Homo sapiens
agacaaacacattattacaaattgtggtaagtgcccaaagctgggtggttctcagtactgccaatctgtccctcttgatgtcttcttaggctcacttttartactttaatataggtcctaactcttctgtcttgctggtttttatgcctagtatcttcttattcttcctttttttctcttttttttttgagacatggtttc

SEQ ID NO: 29929 - DNA, 201 bp, Homo sapiens
gactaattttatttaacttcctgacaatccaggaatcagtattctgctagttattctccatctatgctttgattttcttatctttttgctttttcttatcktttcattttgttttaaaataagtttctcctaatcataattctcattgtagagaatttggaaattacaaaaagtatgtaaaacaaaatttaaattatctgt

SEQ ID NO: 29930 - DNA, 201 bp, Homo sapiens
tcatccccagaagaccttatttccatttccatttccatcggagggttatctcagaaaacattaactgaatcctacttgccagtaagtgaaaactagaaagmctctgtctgcacacagggaaccccaatatcctgtgaaaaggagagcagggaagcccgtgcagctgcctttccaaggacgaggtggggagggtccatctgc

SEQ ID NO: 29931 - DNA, 201 bp, Homo sapiens
tcctgtgatgggcttctaggctttcccactggatttctaccttggttcttggataggtcctttgcttggatgaagaggatggaaattgccttttttttttkggggggggatggagtctcgctctgtcgcccaggctggagtgcagtggcccgatcttggctcactgcaagctctgcctcccacgttcatgccattctcctg

SEQ ID NO: 29932 - DNA, 201 bp, Homo sapiens
gctcctgctgtcatcctggtttcccttccctgctcactgcactccagagccccagggggctctccatgctctaggtactccaggccctaagcagtggctcmgtgtgcggctgctggtgtctcagggctccaccagctggaggcacttctatctctgggcctccgatggctttcatggccaaggagtagggcaaagggtaga

SEQ ID NO: 29933 - DNA, 201 bp, Homo sapiens
ggcacatcagctaaaaatgaggagacatatgagcttcctcctctatcctcaaaaaatctttactacattgtgctagtcatgcgctcatctcattcaagtcrgcttaagcatctcctgcttgacgaggctgacttgcaccacactgtttaattctgcaaccccttcccattcccaggacccatcacctctcttactctgctc

SEQ ID NO: 29934 - DNA, 201 bp, Homo sapiens
tcatcaaaggtaagcaacatctgaagagaaaaagggtcatggccaggaagctttcaaggccacagatgaccagggctgagccagctgttgtgcaaggcttccccccatgcaatcctgggcacagcctcacagggaggtaaacttgatcccaggtaagaatgagagaggagccctcacaggcatctgttaatgaatagaaga

SEQ ID NO: 29935 - DNA, 201 bp, Homo sapiens
ccatcagctcaaagtccctacgaagcgacccactgattattttgcggaaatggccaaatctgatctgcagatgcagaaggtaagaaatagaagttttcctytggaaagtcaaaactttgtacttaagcatattcagctggcttagaaagatagctatgagcccaataacggggagccagttgtcagaggacaattattacc

SEQ ID NO: 29936 - DNA, 201 bp, Homo sapiens
acctcatttaactttggaagaagggattgccagcatgtaatccaacatacattcagccctccatagccatgggttcagcatctgtggattcaaccaacctyggatcaaaaatattggggaaaaaaatttgaaaatattgcaaaaggaaaactgaattttccgtgtgccgagaactacattgaatccatgagaatgaggtga

SEQ ID NO: 29937 - DNA, 201 bp, Homo sapiens
cttatgttggcaatgattcttgctgcactttgtgtagataatcaggtcaagcatacgggaccgaagcctatcttgcaggtagattggtcctgctgtgattygtctttggtggaagtggcagactggagacagaaagattgtgtttcagaagaaaactctatattagcttaatctttgattcctcagtggccacatggtcac

SEQ ID NO: 29938 - DNA, 201 bp, Homo sapiens
caggttcctctccaggtgctcccgctgccgggtgtactcctgctgcaggtctgtgttcagccctgcgatctccacctgacggggcccaggagattctcagygagggagaggagaccccggaggtcagtgcatggcaggaggggaggctgagcttaccatgtctgctcgctgcacgtacttctcaaagagacctcgaacctt

SEQ ID NO: 29939 - DNA, 201 bp, Homo sapiens
tcatgacatggtgtgcagagaggacagcattcttgtgcccttgccactgtcagtgctagaacttgtagacaattacttttctctgggcctcagttttctcytctgtaaaatgagggattcttagatggttcagatatagtacaatttagagttgggtagaacttggacctcatttaactttggaagaagggattgccagca

SEQ ID NO: 29940 - DNA, 201 bp, Homo sapiens
tatttgcaaatcacatatctgataaaggacttatatctagaattataaataactgttacaactcaataataaaaagacatatgactcaattttttaaatgrgcaaaaaatctgaatagacatttcttcaaagaagaattagaaattcttgaaaagacgttcatcattaatcaccaggtaaatgcaaatcaaaaccacaatg

SEQ ID NO: 29941 - DNA, 201 bp, Homo sapiens
cacctcattacacattttgtcctacgattctcagctatcgccaagcccaggccgcagtgcttgcagtcttaccccgcctccatcagctcaaagtccctacsaagcgacccactgattattttgcggaaatggccaaatctgatctgcagatgcagaaggtaagaaatagaagttttcctctggaaagtcaaaactttgtac

SEQ ID NO: 29942 - DNA, 201 bp, Homo sapiens
ctttagagtagtcattctcttaaactatttttagcaacacccctcccctttttaaaaactagtatacggctacatttcttttagatactaaatcagtgagrcagtttttgtttgtttgttcttgctaatggaggtcagattttgagagtccttctgagcttggataactcatgattggcggtgaaaaggaacgtaaggcct

SEQ ID NO: 29943 - DNA, 201 bp, Homo sapiens
gattaaagacctagatgtaagagctagcactatgaaactcttagaagaaatacagaggtaaatcttcatggcctcaggcattggcttcttaaatataacayggaaagcacaaccaacaaaagaaaaatagataaattcaatttcatcaaaattgaaaacttcatcaaaagacaacatcaaaaaagtgaaaagacaacccac

SEQ ID NO: 29944 - DNA, 201 bp, Homo sapiens
tgctctcggtggaggggcgggggctgcaggcagaggttaatggcacagaaagggaaaagagatgcctcatctgggacttacagctgactgccaggggccayactgggcatagaaacttagacgggcacacagccaacaggtggaggcacgaaaagtcttgtgcacctgccctcggctggacacccagcctgaacagcctac

SEQ ID NO: 29945 - DNA, 201 bp, Homo sapiens
acacagctcctggagaaggttatagagacttttcaggaagctcctacatactcacaaaaaaaaaaaaaaaaaaaaaaaaaaaaaggatatgccattggcayggggggatggtagtgaaaatgggtggattgaaggttactgaggaagaagaatctacaggatgtcattggggttgagggcccaggctctggcatcagagag

SEQ ID NO: 29946 - DNA, 201 bp, Homo sapiens
aaatcttgaaagctggccggccacggtggctcacacctgtaatcccagcactttgggaggccgaggcaggtggatcatgaggtgaagagatcgagaccatmctggccaaaatggtgaaaccctgtctctactaaaaatacaaaaattagctgggcatggtggcgcacacctgtaatctcagctactcaggaggctgaggca

SEQ ID NO: 29947 - DNA, 201 bp, Homo sapiens
ttaacataaaaagactataaatatataattgctccccattctaacctcagcttctttaaaatatataaaattatataaggtaataattataagaatatgtyattggggtttgtaacactcatagatgtaatatatataacaatattaccattaaaaaggggaaagggaaggtagctatgtggcaataacatttctatatgt

SEQ ID NO: 29948 - DNA, 201 bp, Homo sapiens
acagggtcttactcttgtcacccaggctggagtgcagtggtgtgatcatggcttattgcagccttgacctcctgggcccaagtgatcctcccaccgcagcmtcccaagtaactgggaccacaggtgtgtgccaccacacctggctaatattttttactttttgtagaaacagggtctccttatgttgcccaggctagtctc

SEQ ID NO: 29949 - DNA, 201 bp, Homo sapiens
ctgctgtctatttctgtaaaactttattggaacacagccaagttaattgactaatgttttgtttatgggtggtttcacactacagcagcggtgttgattcrttgagacagaccacatggcctccaaagccaaaaatatttactacctaggtctttacagaaagagcgtgctgacccctgctgtagcaatggggagctgtga

SEQ ID NO: 29950 - DNA, 201 bp, Homo sapiens
tagttccttggcttctttgagataattatctgattccaagttctctttgtatctttattttcagtctttcatcggctcctcttctttcaccagtctcttawatgttggtcttccctctgctgtccaatattcttctcagattctacataggcccttggtgatctaatctatgcctctgacttcctctactttctaattccc

SEQ ID NO: 29951 - DNA, 201 bp, Homo sapiens
tgatcagatagatgttggtgatgatttggataaggagttaagagaagtgaagaatcaagaaagacttctgcatttctgcattaagtaactgggtggatcayagaccactaactgagagagggaaaactggaggaagggggagagaaaaatcaagaattcggttttagatcaacatggacgccactgtcagcccagcagggg

SEQ ID NO: 29952 - DNA, 201 bp, Homo sapiens
aagttttgggaatggtgttggagagcaggatgtgactcttaaaatcagtgtagcaaataacagcctcatatggtggtttaaacttttattcttaaaatacratggtgctgatcaaaactacttcttcacttacaggcttctctgataaactggatttccttgagggagatcagaaacctctggcacagcgcaagaaggcag

SEQ ID NO: 29953 - DNA, 201 bp, Homo sapiens
gtagttttcgtttgtttgtttctttgcacatacagagaaattagaaagtttagataataaaatattctttaaaaccttataaagaattggagaaatttggrtaattaacactttcatagttaaaattcttagtcttgatgaaggcaaaataagaaatattttaaacaaatgcattggcggtttggcagttcttttttaata

SEQ ID NO: 29954 - DNA, 201 bp, Homo sapiens
catgcttgttgcaacgtcaacagcaacaacaatgcttttccatgcactttttatatgagtttaaatgcatcataataaccctatggctattattatatcamaattattggctattatatggctattatattatatatatataattatatggctattataatcacaaaaacaattataaattgttattataatcacaatttt

SEQ ID NO: 29955 - DNA, 201 bp, Homo sapiens
agtccagtccagataagagatggtggctgcttgtaccagggtgatagcagcagcgggaaaggagggtttgatgtgagatatgttttggaaattgatcagayagatgttggtgatgatttggataaggagttaagagaagtgaagaatcaagaaagacttctgcatttctgcattaagtaactgggtggatcacagaccact

SEQ ID NO: 29956 - DNA, 201 bp, Homo sapiens
cattttttcccccaggcaaagactcatactactctgagaataaaaataatctgtttatagaaaaattgggaaataggtcaaatttgagtagctggctggayagccagaagcctagccccttatgtggaaacaagcatcttttcccagtgtggaaaatccatctacttttccatgtgtttttcatcacactcagagattctc

SEQ ID NO: 29957 - DNA, 201 bp, Homo sapiens
cagaccagtcaggaggctgccagtttggctgaggaggcagatgatagcgtcctaggccaaggcaatggcagctggaagagagaaagggggcttctgtttgyggggctcccgaagatcatgtctgagtgcctcattctctaaatctcaggccagcagtgacagatgaggttagcagagagggcatacaggagtatattgttt

SEQ ID NO: 29958 - DNA, 201 bp, Homo sapiens
atgcaggatccaagggcagaggctcaaatggtgagaagtttgcctttatcctgaaagctcagagagccactgaaggcttagaccaggagtggaatgatgtmatttgcatcttagagggcctgatgcagaggttctgctgaaaagagcaagacgggggccaggcagaccagtcaggaggctgccagtttggctgaggaggca

SEQ ID NO: 29959 - DNA, 201 bp, Homo sapiens
ccaatcttattcaacaaatgttaaggagtggcctgtgctaggcaggagggcacaactgtgtcctggcccacatccagaaaacctagattccattattagcyctgtgtgtactacctagctgtgggtgctgggtgaagtttcttaacctcccaatttttggggcctaatttttcttatttataacatggagaaatgggaatc

SEQ ID NO: 29960 - DNA, 201 bp, Homo sapiens
ggtggctatggagtcagagcccagagaacaggatggtcttaagcactgttctccctgagctgtgacaaacggtcctctgctgtggggaggtacctgtggarcccagaagggagcaggggtcgggctagagacaccgcaatgattcttttcctccagaaatgcttcatctaaagcacagatctacacctttagacttccagt

SEQ ID NO: 29961 - DNA, 201 bp, Homo sapiens
aactaaaaacagaactaccatacaatcctgcaatctcattactggatacttttctaaaggaaaggaaatcagcagattgaaaggatacctgcgctccaccscacccccccatatttattgtaccaccaatagtaaagatatggaatcaacctaagtgtccatcagtggatgaatgaataaagaaaatgtggtatatatacc

SEQ ID NO: 29962 - DNA, 201 bp, Homo sapiens
ctaaaaacagaactaccatacaatcctgcaatctcattactggatacttttctaaaggaaaggaaatcagcagattgaaaggatacctgcgctccaccccacccccccatatttattgtaccaccaatagtaaagatatggaatcaacctaagtgtccatcagtggatgaatgaataaagaaaatgtggtatatataccca

SEQ ID NO: 29963 - DNA, 201 bp, Homo sapiens
gacagtgtgcaaccccaggggagacagaggagaagagtgttccaggcccagagccaggaggcggcaagcagaacctaaggcaggaagagcttgatgataaygataataagagtaaccacaattgcaagggttgattggatcactgcaaatgtatcaaacagcatgcatacagtccctcagttcatccttacaccaaccttg

SEQ ID NO: 29964 - DNA, 201 bp, Homo sapiens
aggagccctcacaggcatctgttaatgaatagaagaagtaaggttacgtctacattctctgtggatttggaatctgaagagtcagctattatctagaacgwacaagaaactctcaaaactcaacagtaaaaaagccaaacaatccaatcagaaagtagacaaaagataaggagacatttcaccagggaaaatacacagatg

SEQ ID NO: 29965 - DNA, 201 bp, Homo sapiens
aactgaaactgtgggtaaggtgggactactgtactatcagagcgccccttcattccctcactcattcatgcactcattcacccacccacctacacacatatttttttttcttttattattattattatactttaagttctagggtacatgtgcacaacgtgcaggtttgttacatatgtatacatgtgccatgttggtgtg

SEQ ID NO: 29966 - DNA, 201 bp, Homo sapiens
ccttaggagggcacagtacaccgcacactgaggcacgggtagggccaaagcccatctccaggtcccgtggcaagttaactcccaagcgatttgctttcggwcagctgagcctgcagcggggccacggccttccctgttgcacccctgtggactggaggctgcacacaccttgggagcagagaggactgtgagaagagcttc

SEQ ID NO: 29967 - DNA, 201 bp, Homo sapiens
ttagagttgatttgaacacttagtgctttggagccttcttggttgatgtggacctgtcggatcaaagttttgggaatggtgttggagagcaggatgtgacycttaaaatcagtgtagcaaataacagcctcatatggtggtttaaacttttattcttaaaatacaatggtgctgatcaaaactacttcttcacttacaggc

SEQ ID NO: 29968 - DNA, 201 bp, Homo sapiens
cagcctgcacacagagaggaccagaggcatgggcagcctggcgcatctctgcaggctgcaagtggcttagggtggctgcaggagcagggatttgaagaggkgggagaggggagggagaagaggctggctgagctaggtcatgcaggatccaagggcagaggctcaaatggtgagaagtttgcctttatcctgaaagctcag

SEQ ID NO: 29969 - DNA, 201 bp, Homo sapiens
atgcctagtcacttgagtgaccagcaggggccctaaggctgcttacaggaggaggtgactgctaggcccactccagcactgtcggggctgaagcagtaaastggatgaagagactcgtgaaggaaaagggggcaccaatggggtgaatgccttcagtttccccacggagtctggatagacaaaagtagagggaggtctcag

SEQ ID NO: 29970 - DNA, 201 bp, Homo sapiens
agaaaacagaaattagtttaaaaatcaaatggaaattctggagttgaaaagtacaataaccaaaacgaaaaattcactggaaggctcaacagtagatttgmgctggcaaacttgaaatagctcaatagagattgtgcaattggaagaacagagagaaacactaatcaagaaaaattaacattaacagagtttcagagaaat

SEQ ID NO: 29971 - DNA, 201 bp, Homo sapiens
acaatatgcatataatatactgttgttgctataacatatagaaatgtaatatatttcccagtaatagcacacaaatggtgggtgggaacaaatgtgtaccrgattaaagaaatgacttcagtggtaactcaaactcaagaaacaaatgaaaagaaccagaaatgatagtaaaggttaacataaaaagactataaatatata

SEQ ID NO: 29972 - DNA, 201 bp, Homo sapiens
tagtagagatgaagtttcaccatgttggccaggctggtctcgaactcccgatctcaagggatccgcctgcctcagcctcccgaagtactgagattacaggmgtgagtgactgcgcccggacccctttcagatctttttaatgtctataggacctttagtgatatcccctttttaatcctcatattggttgttggtatctcc

SEQ ID NO: 29973 - DNA, 201 bp, Homo sapiens; identical to SEQ ID NO: 6128

SEQ ID NO: 29974 - DNA, 201 bp, Homo sapiens
ggaagccaggcttaaaaatgaaatcatattcatccctcgcagcctggaagactctgtgcatgcccaaggctgtaccctcttatgaacaatcagaaaggggycatccaaactaccagtctctggctgaacatgatgcaaaagccatcactctctgaactgtgatagcattttccaagccacacataaatctggtagtaaaag

SEQ ID NO: 29975 - DNA, 201 bp, Homo sapiens; identical to SEQ ID NO: 6129

SEQ ID NO: 29976 - DNA, 201 bp, Homo sapiens
aaacttgaaagcatctcctaagctacacaaagacccgttaacatagggcagagtctcactggcacaacgggcctaccaaacacaacagtctaccaaatgckgaacattaagctctcccgacccaggggcatctcctaggaagccaggcttaaaaatgaaatcatattcatccctcgcagcctggaagactctgtgcatgcc

SEQ ID NO: 29977 - DNA, 201 bp, Homo sapiens
ttattgctgttttttcaaaacatttttgaaataattatgtattcacagaaacttgcaaaaatagcacagagagagtggacttctggaatggcacggtaagracctcaacttgaccttctctctgacaatgtaggttaactggtaaatatgataaaaaataatcatttaaagtctttagaaggctgggtgcagtggatcaca

SEQ ID NO: 29978 - DNA, 201 bp, Homo sapiens
tggttaggctattttgtcacgcaaacatcacggagtgtatttacacaaacctagctgcgacagcctactatacacctaggctatgtggtagagcctactgstccgaggctacaaacctgaacagcatgtgactatgctgaatactgtaggcaactgtgacgcaatggaaaatatctgtgtatctaaacagaaaaggtacag

SEQ ID NO: 29979 - DNA, 201 bp, Homo sapiens; identical to SEQ ID NO: 6135

SEQ ID NO: 29980 - DNA, 201 bp, Homo sapiens
accctgccctctcccttcagttctgttcgtcctcaccctggggcagaaggcaagctgctatgtgaccagatgtggtatgtctttttctgtagaagagacckggaaaacgaacaagagagaagatgaagaacagaacacactaaatagcatctttgaatacaaagaaccaagaaaaaggaatgaagactcgcaatttcacga

SEQ ID NO: 29981 - DNA, 201 bp, Homo sapiens
tatttaaaacacacacacatggaaatgtagaaggaaatgcatcaaagaaatgatgataccattatgaggatttttttttttttttttggagacagaatctygctctgttgcccaggctggagtgtagtggtgcgatctcggctcactgaaacctccgcctcccaggttcaagcgattctcctgcctcagtctcccgagtag

SEQ ID NO: 29982 - DNA, 201 bp, Homo sapiens
ctatctcatcatttctggtctgtctcctctaccacctgtgaacgacttgacatcaaggaatggattacgcacatttctgcattcctggccagcagactagygaggatctggtgcacaggaagtactgagaagaaggataagcacaaattgcacgtgcaaagtcagagaggatggagcaggaatgcctggccagggcactca

SEQ ID NO: 29983 - DNA, 201 bp, Homo sapiens
gcacgtacttctcaaagagacctcgaaccttctccttcagcagccgcggttcctgaatataggctacgcagttgtggaggtctgttttaaaccttttgacyagcgcttccaagtctcgctcctgcaatcagagacatttccttctggtgctgtagggtgctctcggtggaggggcgggggctgcaggcagaggttaatggc

SEQ ID NO: 29984 - DNA, 201 bp, Homo sapiens
agtgaagcagcatacttcagagtgatgaggtgaatactgagaaccaccccagcccagcccctctcctgagcccccagatccgcctgcacagaggcccccamccatggaggctgccccttctcccattctccacatcctagcaggatggcactcttctcctgacctatgttggcttctgaactgccagtctttctccttgtg

SEQ ID NO: 29985 - DNA, 201 bp, Homo sapiens
gccttgacctcctgggctcaagtgatcctcccacctcagcctgccaagtagctgggactacaggcatgccccaccacacctggctaatttttatattttayattttttgtagagatggggatctcactatgttgcccaggctggtctcgaactcttgggctcaagcagtcctcctgcctcagcctcccaaagtactgggat

SEQ ID NO: 29986 - DNA, 201 bp, Homo sapiens
ggttgaagaggtcaaccaggagactcctctcctcccttcgtcagtacagaggctggcactccccccatggggctacagcacagacccctcagcctctgtayaaggactctcatgcattcactcactcattcatattaggttgtgaacagcggtattttccaacgatggcccccacagcatctcccgccccacactccagct

SEQ ID NO: 29987 - DNA, 201 bp, Homo sapiens
gagaggaataaccagagggagaagtgcatcctctctcactccagaaatggaggagcagagcaggaccctgcagaacaaagatgacaagtctagaatgacayggaggcaagggaaatgagggcagggctctacttacagttccaagaacagggtcagcagataatgtaagactttggggaatttttccaacacttcccatgt

SEQ ID NO: 29988 - DNA, 201 bp, Homo sapiens
attctccagttcagcttccatctgtagacaacaagggaaaagagtcaagaagaagaaagttagataatgaaaactgtatttgagaactgtagtctttcagwggggatgccacccctgacacccgggcatttcttttctcatccccttctgtgtcctctggatcaaaacctttcttctacttgctttcctaacagctcccca

SEQ ID NO: 29989 - DNA, 201 bp, Homo sapiens
aaatcaagaattcggttttagatcaacatggacgccactgtcagcccagcaggggaggctgatggggcaacacacgttgcagggaaaggtggcgtgtggtsgggggcatgggggacctcacaggattctcagaaacccttgtccagttgatcctgcttctaatctcgcctctctaccttcatcctgtttgcttcccagaac

SEQ ID NO: 29990 - DNA, 201 bp, Homo sapiens
cccatcataataatgtaatgggctgtcatctttgcagctgaacctctctgggggtgcctggatccttccctgctctctggatctggcttcccagtggggcragtacatgtgaagaacatgccagcaggggggaaggggctggctgctgtgacagggtgcaggctgggtcggggttgttgctcagcagacagagtctcctgc

SEQ ID NO: 29991 - DNA, 201 bp, Homo sapiens
ttagacaactcaaaaagtggctctggtgatgacaaaggcagtgatattgaagacaccaaaagaggggttcttaacatattttcatgaaattacagtgaaamaagtacttttaaattaacattttatatgtgattttaactacatatgcgtgactgattaatctagtttcataatacaagtcgccatttatttcctctacat

SEQ ID NO: 29992 - DNA, 201 bp, Homo sapiens
gccaggtttaagacagccataggtgaccagcagggaccagcagggactgtgggcttaaatatttcttatttgggtattagaggggcatctggcttctgcakgtgggagaagagagggacattggattatattcttttgctctttaatgcataaagaactatctctcccggtacctgtgtgtggctgggtctcccaggatgg

SEQ ID NO: 29993 - DNA, 201 bp, Homo sapiens
gaaagtcaacccatgagcagtgcccagactttcagtaaagtgattagggaaagatgggacaatgccaggtttaagacagccataggtgaccagcagggacsagcagggactgtgggcttaaatatttcttatttgggtattagaggggcatctggcttctgcaggtgggagaagagagggacattggattatattcttttg

SEQ ID NO: 29994 - DNA, 201 bp, Homo sapiens
ggcagtctgggcacatcttagacatgcttgaagcctaagtaggcccttgaaccccagtggtctaggagagctcaccccatgggagttcagaaagagtgaamccccgttcctggccctaagatgtcttccctttcacttctcactccgaatgcagaggaatgattataagggggtcctgcctgggcacacagatgttcccag

SEQ ID NO: 29995 - DNA, 201 bp, Homo sapiens
agtcatgccagttaccaccaattagatgcatataaaaatgacattttttctaaaatcagcaattaaggagaggaacagtgctgtgtgaagtgtggtccccraggtgaagatggcccagtgcatttcctagctggcatggtcatgacatggtgtgcagagaggacagcattcttgtgcccttgccactgtcagtgctagaac

SEQ ID NO: 29996 - DNA, 201 bp, Homo sapiens
ctagggtacatgtgcacaacgtgcaggtttgttacatatgtatacatgtgccatgttggtgtgctgcacccattaactcgtcatttacattagatatatctcctaatgctatccctccctgttccccccatcccacgacaggccccgttgtgtggtgttccccaccctgtgtccaagtgctctcattgttcaatgcccacc

SEQ ID NO: 29997 - DNA, 201 bp, Homo sapiens
ggtgggcattgggtggggtggaggccagggtgcagcatggaagtgcctagaaaacctcctaggtgagctctcagccacagtcacagccaagacgagctcaraggagaggagccaaaataagactttagggggagctactgggcccccagacacctggggagccctgaagacaggtggtctcagagggacccttgatgggat

SEQ ID NO: 29998 - DNA, 201 bp, Homo sapiens
ccagtaagtgaaaactagaaagcctctgtctgcacacagggaaccccaatatcctgtgaaaaggagagcagggaagcccgtgcagctgcctttccaaggaygaggtggggagggtccatctgcgtgagggtgcactggctggtgctcttctcccagcctgctcgctgaagatggggacaggcaggaccctggccagcaccc

SEQ ID NO: 29999 - DNA, 201 bp, Homo sapiens
tataattgctccccattctaacctcagcttctttaaaatatataaaattatataaggtaataattataagaatatgtcattggggtttgtaacactcataratgtaatatatataacaatattaccattaaaaaggggaaagggaaggtagctatgtggcaataacatttctatatgttactagcattaagttagtatgaa

SEQ ID NO: 30000 - DNA, 201 bp, Homo sapiens
tcagtgccaacgacaatcttgtcatcagccacccaggtgtgagctagatagttttggggttctcccctctgaaagctggtttgcttcagggttccctcagmaaaacggagaagcttaaacatcccatttccagtgacacacacctgagtgttatcctgtggactgaagctcacctgtaaaatgtgagagaattgaagaaaa

SEQ ID NO: 30001 - DNA, 201 bp, Homo sapiens
tttaatgtctataggacctttagtgatatcccctttttaatcctcatattggttgttggtatctccacactcttaattttttcttcatcagtcatgccaagggtttgtctatttcgtgttttcaaagaatcaaattttggctttgatgatcttttgtctgttttctattttattaacttctgctcttatctttatttcctg

SEQ ID NO: 30002 - DNA, 201 bp, Homo sapiens
agccagaagcctagccccttatgtggaaacaagcatcttttcccagtgtggaaaatccatctacttttccatgtgtttttcatcacactcagagattctcmatggggctcaggcaggagggtagaaagcattttgcaccccccaggggacctctggcaaggtctgaaggcattttttagttttaacatcctggataggggg

SEQ ID NO: 30003 - DNA, 201 bp, Homo sapiens
tcaatcaccagtgtctggaacttagtatgttcttgatatatgttgactggttttagagtttgtaaaatgcttttgcattgtttcgacccagctgatgcctygcctctcctccttaaaacattttcgcctctcacatagatatccttttattattattattatactttaagttctagggtacatgtgcacaatgtacaggtt

SEQ ID NO: 30004 - DNA, 201 bp, Homo sapiens
caggaactgatcatcaaaggtaagcaacatctgaagagaaaaagggtcatggccaggaagctttcaaggccacagatgaccagggctgagccagctgttgygcaaggcttccccccatgcaatcctgggcacagcctcacagggaggtaaacttgatcccaggtaagaatgagagaggagccctcacaggcatctgttaat

SEQ ID NO: 30005 - DNA, 201 bp, Homo sapiens
gacacatcaaaaacaaaatgttgaaagccaaagataagaaaatcttgaaagctggccggccacggtggctcacacctgtaatcccagcactttgggaggcygaggcaggtggatcatgaggtgaagagatcgagaccatactggccaaaatggtgaaaccctgtctctactaaaaatacaaaaattagctgggcatggtgg

SEQ ID NO: 30006 - DNA, 201 bp, Homo sapiens
ttcctggactggtgagcttgggcatcagaatcactttctgtactttcatccgcatctccacagtcacttgaagactaattatattgctgaagctgaggagrctcagcagctctcattaataatgtccgtgggccaggcgcggtggctcacgcctgtaatcccaggactttgggaggccgaggtgggtggatcacctgaggt

SEQ ID NO: 30007 - DNA, 201 bp, Homo sapiens
gtgtcccctcttcatcatgcttttacctgtcttccccaaccctgacctagagaaagtcatttctccttgctcccatggccctttctacatgttccatcgtyttctacctctcaatataactattatgcacatgccacaaatcaccagtcatcctcttcagcatggaaatggcaggatctgtatcagttctcgtttatagct

SEQ ID NO: 30008 - DNA, 201 bp, Homo sapiens
ctgtagtgggtcctagaactaatcctctatggatactgagggataagtatatttaaatagtaccctggggtctcaagctggattttagggagcttttgtcrtggtagtagttcaccttcttactgtgaactctgtacaaattctcactgacaacttctcatcctttaactaaaatgtgtatgtttgactgaaaaggctagg

SEQ ID NO: 30009 - DNA, 201 bp, Homo sapiens
tcaggagcgctgctgtgagtgggcaggttggttcatctacacagttgggctagtgtcccctcttcatcatgcttttacctgtcttccccaaccctgacctrgagaaagtcatttctccttgctcccatggccctttctacatgttccatcgttttctacctctcaatataactattatgcacatgccacaaatcaccagtc

SEQ ID NO: 30010 - DNA, 201 bp, Homo sapiens; identical to SEQ ID NO: 6126

SEQ ID NO: 30011 - DNA, 201 bp, Homo sapiens; identical to SEQ ID NO: 6130

SEQ ID NO: 30012 - DNA, 201 bp, Homo sapiens
ggcagcttttagaaggttttcctcattactggaagcattttgtatagacagaatagccctctgacccaaagcctggcataaaggtggcactcaaatatttsatgaatgaacgaataatggcaagtgtggtggacaaaggagagcaatagtgagggacacgaaaagagcctgaaacaccctgcttctggaagaggaatgaca

SEQ ID NO: 30013 - DNA, 201 bp, Homo sapiens
agtgatttcctgaaggaaatataatgatctgttcatcgaagtagaagatattgttggccacgtgggatcgaagaccaaaaacatgcagcgtctgagctacmacggctgacatgatctcccgccaaacagttctgctgaagaccaaggcagcgcttcagagtggagagcaccgccccgctccgaccccgcccccggcccgga

SEQ ID NO: 30014 - DNA, 201 bp, Homo sapiens
accgccccgctccgaccccgcccccggcccggactcgccctccccgccctttgctcctccccttgtctctcccctttctcctccccttgtccctccccttkcccctccccttgtccctcccctccccttcccctcccccggggtcctcctccgcgccaccccacccccgcggctcctttttctgccttttcctttgtaccc

SEQ ID NO: 30015 - DNA, 201 bp, Homo sapiens
cttttctcatccccttctgtgtcctctggatcaaaacctttcttctacttgctttcctaacagctccccacccctagactgatatgctaaaccagcatcaygtgtttccacggccaggctgggaagttttccctctgagtcactttccctttccttcaaccatgctgattattttattttcttgaattccttataaattgg

SEQ ID NO: 30016 - DNA, 201 bp, Homo sapiens
gaggccgaggcaggtggatcatgaggtcaggagatcaagaccatcctggctaacatggtgaaaccccgtctacgctaaaaatacaaacagttagccgggcrtggtggcgggtgcctgtactcccagctacttgggaggctgaggcaggagaatggcatgaacccaggaggcggagcttgcagtgagccgagatcgtgccac

SEQ ID NO: 30017 - DNA, 201 bp, Homo sapiens
agagaactgaaactcaccagatcactgcaccagatgcctccttgcccctctgtagtccttgttttcttacacattgttacatttcttccctggtaacatamacccctagttttagtcagggagatagatttgaggctgagctctcatctccttggctgcagcacctgattaaagccttcttccttggcaatacttgtcttc

SEQ ID NO: 30018 - DNA, 201 bp, Homo sapiens
gcagtggctcacacctgtaatccccacactttgggaggccgaggtgggcggattggctgagctcaggagttcgagaccagtctgggcaaacacggtgaaaycccatttctactaaaaaaaaaaaaaaaaaaaaaaaaagttagctgggtgtggtggcgtgtgcctgtagtcccagctactcgggaggctgaggcaggagaa

SEQ ID NO: 30019 - DNA, 201 bp, Homo sapiens
gggaccaaacagtctctttcctcttttcccacacctcaaatctctgccttccatttcacacccagcacaagtaccccaaggaggagccccatccccaaggkcccaaagagactggccactttgctcttagagcccacagccacagtagtcagcttgtctacagcagttcctcgtgtatgaccatacaaatacatcacctga

SEQ ID NO: 30020 - DNA, 201 bp, Homo sapiens
ggtactcctccagagaaaatttgcatttgcttctgcttggggcctagggacactactactgtggggtccttttaaggtaaattttcagccaagatcgcctyaagccacaaattgaatgcaaattctagactaaaacttgtctgagtagggacttttggttagaaattgtcatgcagagaccttgtctgaagttttttcttt

SEQ ID NO: 30021 - DNA, 201 bp, Homo sapiens
gatggtttcacctctgagaagtcaagcatgtcaggtttttttgtttttttgttttttgttttttgagatggagtctcactctgttgtccaggctggagtgyggtagtgcaatctgagctcactgcaacctctgcctcccaggttcaagtgattctcctgcctcagcctcccgagtagctgggactacaggcccgcgccacc

SEQ ID NO: 30022 - DNA, 201 bp, Homo sapiens
actacaggtgcccaccacacgcccggctaatttttttgtatttttagtagatatggggtttcaccgtgttagccaggatgatctcgatctcctgacctcaygatccacccgcctcggcctcccaaagtgctgggattacaggcgtgagccactgcgcccggctggaaattgccttttttttttttttttttttttttttta

SEQ ID NO: 30023 - DNA, 201 bp, Homo sapiens
ttttattttttcagacatgaaattttcttattttaataatcatactagctatgagtctttgttggttttattctgtagtttgatttttttgttgttgttgrttttcacttctggtggtttattttttcaagtatttaatgacttttgattgtgagctcatgttcctcagaacactatttatgggaattctttgaagcctat

SEQ ID NO: 30024 - DNA, 201 bp, Homo sapiens
agtagatatggggtttcaccgtgttagccaggatgatctcgatctcctgacctcacgatccacccgcctcggcctcccaaagtgctgggattacaggcgtsagccactgcgcccggctggaaattgcctttttttttttttttttttttttttttagcacttattctgtaccaggccagtgcctagtgccttatgtggttg

SEQ ID NO: 30025 - DNA, 201 bp, Homo sapiens
atttgggtattagaggggcatctggcttctgcaggtgggagaagagagggacattggattatattcttttgctctttaatgcataaagaactatctctccyggtacctgtgtgtggctgggtctcccaggatggcgcctgagaggaataaccagagggagaagtgcatcctctctcactccagaaatggaggagcagagca

SEQ ID NO: 30026 - DNA, 201 bp, Homo sapiens
tagttccctaacactgaagcccacgtccttggcccttggagaattccacctgccttgggccgtagtggcaggggagatggagaggagggcacggaatctgkatgtgctcaggaggatgatactacatactgggtattgaggtatctgccccacagaatgtgatgtctctgacgtctgagtgttttgtaagaaaggcatccc

SEQ ID NO: 30027 - DNA, 201 bp, Homo sapiens
tagatggactgggctgcttttcagcagggactggtcgtaagatgacatgagaccagccctgcctgggtctggcctgaatcacagtgcgctctgcccagctstgtatgaactggccaagctgggaactggtttgtttcaatctaactgcaacctgttcccattccagtattttaattatggcaataaagaaatgtgaacata

SEQ ID NO: 30028 - DNA, 201 bp, Homo sapiens
atttggatccacaggactccctagcacataggttacaatgctgctggagaaaatgttcttcccgggacttcatttgttgatggctccctctgccagccatyagggagtggcagggctgggcaggaggcccgcttgggtctcctctgctttctaccccaccctggcccagcaccctccggggcatagggaagcagaagagga

SEQ ID NO: 30029 - DNA, 201 bp, Homo sapiens
ggcaggattgtataatagggtgagtgctggctttggagtcaaacagcctgggtcatcttggctgtgcattttttcactgtgcgacttgggcaagttaactyccctgtgcttcagtttaggggataacacaaatttcaacttcactggattgttatgagacagatatatcttcatctatgaagaatatacctagatctgaga

SEQ ID NO: 30030 - DNA, 201 bp, Homo sapiens
ggaaaaaaatttgaaaatattgcaaaaggaaaactgaattttccgtgtgccgagaactacattgaatccatgagaatgaggtgatgcatagcattgtattyggtattataagtaatctagagactatttaaagaagcggtctggcactagagactagtttcgtggatgacaattttttcatgaacttggggaggggatagt

SEQ ID NO: 30031 - DNA, 201 bp, Homo sapiens
gcatcccggagtctttctctggctgtaccccttaccattaagtgggatacagtggctgcctggagtttgtcctgcctcttctagatcacgttgcaggtackcaggactctggagttccctgctcagatagtcttgagcctgctgacaagaccaacattgggggtttcttcccaggctgtctctactcaacctgggcctgaa

SEQ ID NO: 30032 - DNA, 201 bp, Homo sapiens
gcagcgcttcagagtggagagcaccgccccgctccgaccccgcccccggcccggactcgccctccccgccctttgctcctccccttgtctctcccctttcycctccccttgtccctcccctttcccctccccttgtccctcccctccccttcccctcccccggggtcctcctccgcgccaccccacccccgcggctccttt

SEQ ID NO: 30033 - DNA, 201 bp, Homo sapiens
accctgattgcatttcccaaagagagggagaagaaaggaaaagataaactcaatctcagatatattgtgtgtgaggtacactctgtggaacagttgggtayggaggtccagcaggtggacatggttctaaagctggcgggaggggttgaggctgaaaatacagatttgaggtaaaaagcataagggaaagttaaaactagg

SEQ ID NO: 30034 - DNA, 201 bp, Homo sapiens
gctacaaagcagcagtaatcaagacagtgtggtactggcataaagatagacagatcaatggaacagaattggaagtcctgaaacaaacccatgtgtcaactgatttccaacaagatgccaagactactcaatggagaaagactagccttttcaacaaatgatgctgtgacgactggatatctacatgccaaagaatgaagt

SEQ ID NO: 30035 - DNA, 201 bp, Homo sapiens
atctgttcatcgaagtagaagatattgttggccacgtgggatcgaagaccaaaaacatgcagcgtctgagctaccacggctgacatgatctcccgccaaasagttctgctgaagaccaaggcagcgcttcagagtggagagcaccgccccgctccgaccccgcccccggcccggactcgccctccccgccctttgctcctc

SEQ ID NO: 30036 - DNA, 201 bp, Homo sapiens
gatccacattgtacttcacacagtgatttcctgaaggaaatataatgatctgttcatcgaagtagaagatattgttggccacgtgggatcgaagaccaaawacatgcagcgtctgagctaccacggctgacatgatctcccgccaaacagttctgctgaagaccaaggcagcgcttcagagtggagagcaccgccccgctc

SEQ ID NO: 30037 - DNA, 201 bp, Homo sapiens
ggaaactggcccaagactcccacagactgttcttttggaggaacatagaaattgatccttctgctgttaaagcttgaaacttgtattagttttatctgagytccttcctcaggaaaggacctttaaaaaaagtatcagagaactgaaactcaccagatcactgcaccagatgcctccttgcccctctgtagtccttgtttt

SEQ ID NO: 30038 - DNA, 201 bp, Homo sapiens
cttggctcactgcaacctccgcctccgggtttaagcaattttctagcctcagcctcccgagtagctgggattacaggcaattgccaccatgcccaactaatttttttttttttttttttgtatttttaggagagacagggtttcaccatgttgtccaggctggtcttgaactcctgacctcaagtgatctgcccacctcgc

SEQ ID NO: 30039 - DNA, 201 bp, Homo sapiens
attgggaggatggaggaataataatagctaaagggtatgcgctttttttttttttgaggtgataaaaatgtcctaaggctgtctatgataaatggttgcayaactttttgaatatactaaagaccactgaattgtatactttgaataggcaatttgtatgtgaatcataactcaattaagttgttattaaaaaaaggacca

SEQ ID NO: 30040 - DNA, 201 bp, Homo sapiens
tgataaaggacttatatctagaattataaataactgttacaactcaataataaaaagacatatgactcaattttttaaatgggcaaaaaatctgaatagayatttcttcaaagaagaattagaaattcttgaaaagacgttcatcattaatcaccaggtaaatgcaaatcaaaaccacaatgagataccacttcttaccca

SEQ ID NO: 30041 - DNA, 201 bp, Homo sapiens
cgattctcctgcctcagcctccagagtagcttggattacaggcatgtgccaccactcctggctaatttttatatttttggtagagatggggtttcaccatrttggccaggctggtctcgaactcctgacctcaagtgatccacctgcctctgcctcccaaagtgctgggattacaggcgtgagccaccacacctggcctca

SEQ ID NO: 30042 - DNA, 201 bp, Homo sapiens
gaggcaggagaatctcttgaacccaggagggggaggttgcagtgagccgagattgaaccattgcactccatcctgggtgacaagagcaaaactctatctcaaaaaaaaaaaaaaagtgggctaaggacatgaatagacatttctcaaaagaagacatacaaatggccaacaggtatatgaaaaaatgctcaacatcactaa

SEQ ID NO: 30043 - DNA, 201 bp, Homo sapiens
aatgtggagaagagagaactcttatacactgttggtgggaaggtaaattagtacaaccactatggaaaacagtatgtagacttctaaaaaaaactaaaaayagaactaccatacaatcctgcaatctcattactggatacttttctaaaggaaaggaaatcagcagattgaaaggatacctgcgctccaccccaccccccc

SEQ ID NO: 30044 - DNA, 201 bp, Homo sapiens
gagactggcctcacagtatgatcttaattttatttaaaacacacacacatggaaatgtagaaggaaatgcatcaaagaaatgatgataccattatgaggatttttttttttttttttggagacagaatcttgctctgttgcccaggctggagtgtagtggtgcgatctcggctcactgaaacctccgcctcccaggttcaa

SEQ ID NO: 30045 - DNA, 201 bp, Homo sapiens
tactgttatccctagtctatggatgacggaccatctgtgtgaaaggcatttgcttcatctcatgtacctgggtgggctccagtctctgctttgactgctaygcatgggtgcatttcaaaatgagaatgggctattgctcataaatgcattcagcaagcatttattaatgctcattacataagcaaaaccatacattagtct

SEQ ID NO: 30046 - DNA, 201 bp, Homo sapiens
ctctgatggccagtgatgatgagcattttttcatgcctacacacacatttattgaatgctgtgcaccacacaatgtgccagctagtagggctgccaagagragcaaaagatggccctgccctaaaggggctttattctggcacagcactgatagctgccattgaattaggaccaggctactcgggggtacacaggagagtc

SEQ ID NO: 30047 - DNA, 201 bp, Homo sapiens
aagaatacagtggcaagcctaggtgagagcagctcactgcacagtcatgcatcgcttgatatgggatacatggttaggctattttgtcacgcaaacatcayggagtgtatttacacaaacctagctgcgacagcctactatacacctaggctatgtggtagagcctactgctccgaggctacaaacctgaacagcatgtga

SEQ ID NO: 30048 - DNA, 201 bp, Homo sapiens
ctttattttcagtctttcatcggctcctcttctttcaccagtctcttaaatgttggtcttccctctgctgtccaatattcttctcagattctacataggcycttggtgatctaatctatgcctctgacttcctctactttctaattccccgaatcttcatactcagccctgacttctctcctgacctccacacacatacat

SEQ ID NO: 30049 - DNA, 201 bp, Homo sapiens
caaagcaatagagaaaaatcaatgaaaccgaaagctgattctttaaagagataaaaaaaaatggggggaggaggaaaatcatattaatacaatcagaaatgaaggagggaatattacttttttttttttttttttttgagacggagtcttgctttgtcacccatgctggagtgcagtggcacgatcttggctcactgcaag

SEQ ID NO: 30050 - DNA, 201 bp, Homo sapiens
atgtataaaatcatccatgttctttagtttctagtggaaggcttttataagttctgaacagaaatagtacattatatattgttgtttggagaggtggatgraagtggaactgtttgagtggtgtttgtttctagtgtgagtcacttgaatcaatagtttgtgttggttttagatcttttcctttaatgaagaagaactgtg

SEQ ID NO: 30051 - DNA, 201 bp, Homo sapiens
tatagaaaaattgggaaataggtcaaatttgagtagctggctggatagccagaagcctagccccttatgtggaaacaagcatcttttcccagtgtggaaartccatctacttttccatgtgtttttcatcacactcagagattctcaatggggctcaggcaggagggtagaaagcattttgcaccccccaggggacctctg

SEQ ID NO: 30052 - DNA, 201 bp, Homo sapiens
gttacttaagggtgtatgttcactgtctgaaccctcaaggccaggcagttagtcaaggccatggtgcccagctgtggagcaggtgtccctgagaatccaarcatcctagaagatatctgaaaacctactaaggaaaacagtcccatggcacatacacagtaggtgaagagccagaaaattagcttaaaagcagcttagcga

SEQ ID NO: 30053 - DNA, 201 bp, Homo sapiens
ctgtagagggccccagtgctggacctgcatctgaatgcagtctggtaagtaattccatatccctcttcattagatccagttcttaccttttcttccatgtytgttttagtcacaagcacctcttcggcaaagcccacctccctctctcgcttgattccccggccatccttatcaaagaccttccaggtgaacaggcagcca

SEQ ID NO: 30054 - DNA, 201 bp, Homo sapiens
taccagaaaaggcagttgcaggccaaatctacataaaatggacctgtgccaggaacaaactgtgcttctacttgggacattatctcacgagtggtggctayggagtcagagcccagagaacaggatggtcttaagcactgttctccctgagctgtgacaaacggtcctctgctgtggggaggtacctgtggagcccagaag

SEQ ID NO: 30055 - DNA, 201 bp, Homo sapiens
ggatacaaaaatcctcaacaaaatactagtaaattgaatatactaatatgaaaatgattatatactatggccaagtggattttatcccaagaatgcaaggrtggtttaacatctgaaaatcacttagtataatatactatattaataaagtaaaaaacgaaaactcacacaataatttcaatagacacaggaaaaaaaaaa

SEQ ID NO: 30056 - DNA, 201 bp, Homo sapiens
cagaaaaagagggtctgataggtttacatagccctgtccaagaggaaagaaaccacatgtcaggggatgctatgtggtctcctaccaactgaacatccttyaatcacagctcttatcccaatgtacacctgctcctctacttacaatgggatcatgtcctgataaacccatcataaggtgaaaacaccataagttgaaaat

SEQ ID NO: 30057 - DNA, 201 bp, Homo sapiens
ccattatgctggtctcccaacgctgatctccagattcaaagaggaagagtttgcctgtgtcagtgccaacgacaatcttgtcatcagccacccaggtgtgrgctagatagttttggggttctcccctctgaaagctggtttgcttcagggttccctcagcaaaacggagaagcttaaacatcccatttccagtgacacaca

SEQ ID NO: 30058 - DNA, 201 bp, Homo sapiens
ccagagaacaggatggtcttaagcactgttctccctgagctgtgacaaacggtcctctgctgtggggaggtacctgtggagcccagaagggagcaggggtygggctagagacaccgcaatgattcttttcctccagaaatgcttcatctaaagcacagatctacacctttagacttccagtatattacttaatttcagtat

SEQ ID NO: 30059 - DNA, 201 bp, Homo sapiens
ttctgcataatgctgtcagtacaatgaatgtgggagcaccagcccaggaagcaccattacctctctgattcctgaatgacatccaggctctttgagccatyggtaggttccttgaccattatgctggtctcccaacgctgatctccagattcaaagaggaagagtttgcctgtgtcagtgccaacgacaatcttgtcatca

SEQ ID NO: 30060 - DNA, 201 bp, Homo sapiens
aaagaattgtatttagtctatggttataactgttaaatctgtgcttaaatatagacgaaaactagagaggaagagggaaaatgggcatagttgacttttayggtagaggggttatgagtggtttctaaagagtgctgtcttctgcataatgctgtcagtacaatgaatgtgggagcaccagcccaggaagcaccattacct

SEQ ID NO: 30061 - DNA, 201 bp, Homo sapiens
gactggtggaaattcaatcaggctggaaacaaaaaaacagcatacataatttatagagacaatcttgaggagatgaattctgctggggaggagaaagaagrctgtcactgggtgtgacagaaaccacccaatgatccccttttccacagtcaaatactaccctttggcttgggaaccgtacacaaactgcacatggccaag

SEQ ID NO: 30062 - DNA, 201 bp, Homo sapiens
aagaaaatagaaattctagagttaaaaactacaataactgaaatgaaaaatccactagaggtgctcaagaatagatctgaactggcagaagaattagtgawctttatagatcaaaaaagattagcaatttgaagaacagagaggaaaaagaattagaaatttacagagcctcagaaaaatgtgggacaccattaagcacac

SEQ ID NO: 30063 - DNA, 201 bp, Homo sapiens
acagattctggcaagaatgtggagaagagagaactcttatacactgttggtgggaaggtaaattagtacaaccactatggaaaacagtatgtagacttctmaaaaaaactaaaaacagaactaccatacaatcctgcaatctcattactggatacttttctaaaggaaaggaaatcagcagattgaaaggatacctgcgct

SEQ ID NO: 30064 - DNA, 201 bp, Homo sapiens
cttctccatctgttacgctttctttctccaatatcttcaacctgcctgtctctatgagcacattcctattagcttttacacactcaaatctctcttgtctwaaaaacaaaagcaatgctctctcttccccctctgcctgaggagtcatgcaatgatggggaatcacacaagtgggcttaccggtttcactgcaaatgcatg

SEQ ID NO: 30065 - DNA, 201 bp, Homo sapiens
caaaaaaaagaaaaaaaagttgacctcatggaagtagagagtggcatgatagatactagggaagagtgtatgggttggtggggtgctaaagagagattggytaacagatacaaacattagatagaagaaatcagttttcttttctttctttctttctttttttttttttttgagatagagtctgctatgttgcccaggcta

SEQ ID NO: 30066 - DNA, 201 bp, Homo sapiens
ctgcaagcaccaggaccttgaccaaactcctggtgtttcagcaatatattttgtttccttgaccgggaatgtcttgctcatggcagctcggttgctgtggkctgggagtctcagaagccctcctaagcagctgcccacctaattttggctggaggtgaatttccgtctctctctggccctgccacagccagccccaacttt

SEQ ID NO: 30067 - DNA, 201 bp, Homo sapiens
aaagcaatagagaaaaatcaatgaaaccgaaagctgattctttaaagagataaaaaaaaatggggggaggaggaaaatcatattaatacaatcagaaatgaaggagggaatattacttttttttttttttttttttgagacggagtcttgctttgtcacccatgctggagtgcagtggcacgatcttggctcactgcaagc

SEQ ID NO: 30068 - DNA, 201 bp, Homo sapiens
ccaactgaaagcttctaaataattaaagtttggaacactgtaattaaaataattcacataaattcacaactggggtcttgcataataaagtaggcaagccyttcattccttactttgtttcataattccaaaggcggatggatcgatccagagaacaggtggctataaggggtttgcggatgcaggtagctagaccggtga

SEQ ID NO: 30069 - DNA, 201 bp, Homo sapiens
gcagcctcctggacagggtcaatcccaggagagtccctctgcgacagggggaccatgtggtcagtgcggcaagtgagctgtccccagcccatggggaagcrcctccaaggatgcctggagcagtggagtcagctgactcggttcttattgcagcctgtcacctattgaagtgtgtgaccctgggcaagatacccagcctct

SEQ ID NO: 30070 - DNA, 201 bp, Homo sapiens
aagcaatagagaaaaatcaatgaaaccgaaagctgattctttaaagagataaaaaaaaatggggggaggaggaaaatcatattaatacaatcagaaatgaaggagggaatattacttttttttttttttttttttgagacggagtcttgctttgtcacccatgctggagtgcagtggcacgatcttggctcactgcaagcc

SEQ ID NO: 30071 - DNA, 201 bp, Homo sapiens
gggtggttgagatagtgatgtcctgggagaaagatgaggaagaaagggtctggagagctccctgaagcaaagagcagttcctgtgggaaacaaggggatargagagctggagggacccaggagtttatgtaagaaggtgagagactgaggtgttgtcttcatctcttcatgtccccagtgtctagcatgtggtaagcatta

SEQ ID NO: 30072 - DNA, 201 bp, Homo sapiens
cagctattcaggaggttaaggtggggaggatggcttgagcccaggagtttgagactgctgtgagctatgattgtgccagtgcactccagcctgggcaacagagtgagacctggtttcttaaaaaataaataaataaaataaaataaaataaaaaactggaaggatggagttgagatggtttggagttccagaaggagataa

SEQ ID NO: 30073 - DNA, 201 bp, Homo sapiens
attttattttatttcgctcctttctttctcaatttttacttctgttcctccctatgataagtaggcaccaacaaaaggatttcatgtatgtcactgactayatacatatgtgttttatatttctataaatgatattgtgcttcagatctctttctgtacttttacttttttctcaacacgaaatttttaaggaatcatcta

SEQ ID NO: 30074 - DNA, 201 bp, Homo sapiens
atggtggcgggcgcctgtagctccagctactcgggagtctgaggcaggagaatggcatgaacccggtaggcggagcttgcagtgagccaagattgcgccaytgccctccagcctgggtgacagagcgagactccgtctcaaaaaaaaaaaaaaaaaaaaaagagactggatgctttctccctaagattaggaacaagacaa

SEQ ID NO: 30075 - DNA, 201 bp, Homo sapiens
acttcagtggtaactcaaactcaagaaacaaatgaaaagaaccagaaatgatagtaaaggttaacataaaaagactataaatatataattgctccccattytaacctcagcttctttaaaatatataaaattatataaggtaataattataagaatatgtcattggggtttgtaacactcatagatgtaatatatataaca

SEQ ID NO: 30076 - DNA, 201 bp, Homo sapiens
tgaggcaggagaatggcatgaacccggtaggcggagcttgcagtgagccaagattgcgccactgccctccagcctgggtgacagagcgagactccgtctcaaaaaaaaaaaaaaaaaaaaaagagactggatgctttctccctaagattaggaacaagacaaggatctgcactcatcactgatatttgacatgatactaga

SEQ ID NO: 30077 - DNA, 201 bp, Homo sapiens
ccaaaagaaaatgactagggcaggcaccttggaggatgaggtgggaggagaagtcagggaaaccttcctgaaggagggcagggggtgaggtgagatggggrctgggtggtagatagcaggaagagcttgagccacggggtggatgtgacaaagggtacagcatagtgcgggaactgcaagcagtgggtgttgctggagcat

SEQ ID NO: 30078 - DNA, 201 bp, Homo sapiens
tttccccataacctagctcttccaaccctaaccaacgaggcctctacttgtgggctcacccatgtcctgcagttcccggctttgcttgtctaggaggtctyctatgtgctcatggtgataaacatcctgcttctctttttctgttcttaagacctaaaacagagtcacatttcctcatttacacacatctgctgaaagcac

SEQ ID NO: 30079 - DNA, 201 bp, Homo sapiens
gtctaaaatatatatataaatatatatttctatctgtgctcatgaaaaagactagcttatttttttttcttgtggtgtctttgacagattttggtatcacrattattttggcctcatagaacataactggaaagtattccttctttttccaattctctagaagagtttttttcaagattagtgatagtgttattttttttt

SEQ ID NO: 30080 - DNA, 201 bp, Homo sapiens
aggcggagcttgcagtgagccaagattgcgccactgccctccagcctgggtgacagagcgagactccgtctcaaaaaaaaaaaaaaaaaaaaaagagactrgatgctttctccctaagattaggaacaagacaaggatctgcactcatcactgatatttgacatgatactagaggttctagccatggcaactaggcaagga

SEQ ID NO: 30081 - DNA, 201 bp, Homo sapiens
agcctgggtgacagagcgagactccgtctcaaaaaaaaaaaaaaaaaaaaaagagactggatgctttctccctaagattaggaacaagacaaggatctgcwctcatcactgatatttgacatgatactagaggttctagccatggcaactaggcaaggaaaataagtaacaggcattcacagattggaaaggaagactaaa

SEQ ID NO: 30082 - DNA, 201 bp, Homo sapiens
tagaagaaatacagaggtaaatcttcatggcctcaggcattggcttcttaaatataacatggaaagcacaaccaacaaaagaaaaatagataaattcaatytcatcaaaattgaaaacttcatcaaaagacaacatcaaaaaagtgaaaagacaacccacagaatgggacatagtatttgcaaatcacatatctgataaag

SEQ ID NO: 30083 - DNA, 201 bp, Homo sapiens
tctcctaccaactgaacatccttcaatcacagctcttatcccaatgtacacctgctcctctacttacaatgggatcatgtcctgataaacccatcataagktgaaaacaccataagttgaaaatgggcaaagccatgtggccacacagcaccacactgtagagtatcttggttgttaccctagtgattgagcggctgaccg

SEQ ID NO: 30084 - DNA, 201 bp, Homo sapiens
aacttgaggggctgtgactttttcatctgttttcccagtgctggattcatcatgggcatccaataaatggttgctgaatctactagtcagagcaggaggtscttcatcaggcctcactgtggcctggttgaaatacccttctggttctacctgcctttggtctgattctggaataatcacccagcagccttctgattacta

SEQ ID NO: 30085 - DNA, 201 bp, Homo sapiens; identical to SEQ ID NO: 6147

SEQ ID NO: 30086 - DNA, 201 bp, Homo sapiens
gtttacagtgtcttcatcatacttggattcaaacggtgatataatgaaggtggtgtgctcaggaaaactgttagacaactcaaaaagtggctctggtgatracaaaggcagtgatattgaagacaccaaaagaggggttcttaacatattttcatgaaattacagtgaaaaaagtacttttaaattaacattttatatgtg

SEQ ID NO: 30087 - DNA, 201 bp, Homo sapiens
tgaatatcattaacaggaccactgtgaacaaaaataagggctgtaatgctatacaaatggttatttgcgacttgggataaagtttacagtgtcttcatcayacttggattcaaacggtgatataatgaaggtggtgtgctcaggaaaactgttagacaactcaaaaagtggctctggtgatgacaaaggcagtgatattga

SEQ ID NO: 30088 - DNA, 201 bp, Homo sapiens
aaggaggtaggagggatcctgctggaatcactcccaaggtgcaagtgtattccctgctgagcatcaaggccacggttggcccctgttactgccagagaagrtgaatggtccccccaggtgtgctggtggggaaagtaagctgaccattagcaaacaacggacccgacctgaaatgcagctgacaaatgtgtcaaatgagga

SEQ ID NO: 30089 - DNA, 201 bp, Homo sapiens
gctatatgtatcgagatgtgtgaatctcaaaagcatgacattgaactgatgcagcaagacacagaatacagggagaagcactagaactggtaatattctgyttcctatgctgggtggctgggttcacagatctacattctattgtaattctttaaatatgacatatatgtagggtacattcttttgtatgtatatgtcaca

SEQ ID NO: 30090 - DNA, 201 bp, Homo sapiens
tgagcctttattccagcctattgctcagcctcttaaggaaccagctaacttactttcgggtagactcagcaccattcacatccacccatgcttgttgcaaygtcaacagcaacaacaatgcttttccatgcactttttatatgagtttaaatgcatcataataaccctatggctattattatatcacaattattggctatt

SEQ ID NO: 30091 - DNA, 201 bp, Homo sapiens
gcaaaaatagtacaaggttcctgtgtacctttcagccacttttccccatcataagcttatgtgaccatgggacaagagacaactgacacttcagagacccmatccatagctatgggatgtttcagttcaagcctctaatctttattccttaatgtaaaccaccagaaaacaaaaacttgaaccatgttggcttaatttgcc

SEQ ID NO: 30092 - DNA, 201 bp, Homo sapiens
ggaaagactcaccttgctgatctctgtcagggacatggtgatgctgtagagttggttcttactggtgctggcaaccagagtttcctctgaggggctgaagsacaggcagagaacgtcctgtttgtcagactgacttggatcattgctctgcgggtccacaggaatctgcccaagatgcaaaacagctatcagtaatgtccc

SEQ ID NO: 30093 - DNA, 201 bp, Homo sapiens
ggtttgttacatatgtatacatgtgccatgttggtgtgctgcacccattaactagtcatttacattaggtatatctcctaatgctatccctccccctcccygcaccccacaacaggccccggtgtgtgatgttccctttcctgtgtccaagtgttctcattgttcaattctcacctatgagtgagaacatgcggtgtttgg

SEQ ID NO: 30094 - DNA, 201 bp, Homo sapiens
agtgtccagatggatgaaggctgatggaatatgcctcttcttggtattccttaaatagttccagggtgctgtgaaaaagatcaattactgaattgtaagcytagctcactaaatccttccagtcatctactgtatctgatatatattgttatcatcgtatttgagacacactactgtttgcaattgttggttcctctcttt

SEQ ID NO: 30095 - DNA, 201 bp, Homo sapiens
cccggtgtgtgatgttccctttcctgtgtccaagtgttctcattgttcaattctcacctatgagtgagaacatgcggtgtttggttttttgtccttgcgayagtttgctcagaatgatggtttccagcttcatctgtatccctataaagggcatgaactcatccttttttatggctgcatagtattccatggtgtatatgt

SEQ ID NO: 30096 - DNA, 201 bp, Homo sapiens
cctctccgcatcctctaacagagtattctttgaaagaacgtatatcatcaatgagtagattcatgaggcgtagtttgtcagcaaaccctactacaatgaartgtccagatggatgaaggctgatggaatatgcctcttcttggtattccttaaatagttccagggtgctgtgaaaaagatcaattactgaattgtaagctt

SEQ ID NO: 30097 - DNA, 201 bp, Homo sapiens
aggcagcgcttcagagtggagagcaccgccccgctccgaccccgcccccggcccggactcgccctccccgccctttgctcctccccttgtctctccccttkctcctccccttgtccctcccctttcccctccccttgtccctcccctccccttcccctcccccggggtcctcctccgcgccaccccacccccgcggctcct

SEQ ID NO: 30098 - DNA, 201 bp, Homo sapiens
agattacttttcttttaaaatatttgttaatattccacaattacagacaggacttatcatagcggggatctcacaaggttttaggttcaatgaaatagtckggtggacataagaatatggggatggaaccatatactcaataaggttgctgggaaaataactggatttcctccttccccctttttttaagccactgtagtt

SEQ ID NO: 30099 - DNA, 201 bp, Homo sapiens
gtggagagcaccgccccgctccgaccccgcccccggcccggactcgccctccccgccctttgctcctccccttgtctctcccctttctcctccccttgtcyctcccctttcccctccccttgtccctcccctccccttcccctcccccggggtcctcctccgcgccaccccacccccgcggctcctttttctgccttttcc

SEQ ID NO: 30100 - DNA, 201 bp, Homo sapiens
cattactttcttgcttaaatcctttccgttgtttctcgtcacctagagactaaagtccaattccttggcatggcatacactaccttctgcgatgcagccarcctttcctactccctctatcattgctcaaatgtgtccagtgttccagccatatgaaccaatgagcactgtcctatttcatacctccatttcatcatctcc

SEQ ID NO: 30101 - DNA, 201 bp, Homo sapiens
cggctgacatgatctcccgccaaacagttctgctgaagaccaaggcagcgcttcagagtggagagcaccgccccgctccgaccccgcccccggcccggacwcgccctccccgccctttgctcctccccttgtctctcccctttctcctccccttgtccctcccctttcccctccccttgtccctcccctccccttcccctc

SEQ ID NO: 30102 - DNA, 201 bp, Homo sapiens
agagattgtgcaattggaagaacagagagaaacactaatcaagaaaaattaacattaacagagtttcagagaaatgtgggcatccattaaatgcacccacrtatggtactgtaatgagagcactaggagaagagagaaaaacaacaaatattcaaataaataatgctgaaaaatctcaaatttgttgaaaaacattaacct

SEQ ID NO: 30103 - DNA, 201 bp, Homo sapiens
tgtaactaataagcagcttaggcaactcatgggcaaccctaggtagccaggctaaaagaaaagatgaaaaatagatctgagtagtgatatgagacactgcwcactacaggggaaacagactttacagaattagctcagccaagtcacgaaacagataatcagccaaccaaccaacaacaatgccctggggggacacatatt

SEQ ID NO: 30104 - DNA, 201 bp, Homo sapiens
ggtatgtggagaagggaggtgggcattgggtggggtggaggccagggtgcagcatggaagtgcctagaaaacctcctaggtgagctctcagccacagtcasagccaagacgagctcagaggagaggagccaaaataagactttagggggagctactgggcccccagacacctggggagccctgaagacaggtggtctcaga

SEQ ID NO: 30105 - DNA, 201 bp, Homo sapiens
tttgcttatagagtgaaagttccaagccatgaagggcaagccaaaaagaccaggggcttacatacgtgcacacacacatacacacgcatgtgcacacacaygcacacacctcaagtgtcactcacagaagtgaggatgttactcctggaaaagcaggtccccgccccagctctggtgcagtggagcaaaggttctgtctgt

SEQ ID NO: 30106 - DNA, 201 bp, Homo sapiens
tactgagaataactgtgccctaatgattcctgacccagtttgcttatagagtgaaagttccaagccatgaagggcaagccaaaaagaccaggggcttacayacgtgcacacacacatacacacgcatgtgcacacacacgcacacacctcaagtgtcactcacagaagtgaggatgttactcctggaaaagcaggtccccg

SEQ ID NO: 30107 - DNA, 201 bp, Homo sapiens
cgatggggccacaggtcacgagtatggcagacatagcacctccaccggcgcagccatagagtccagagagtgcagctgctgcctggggccaggacccctakgactgtgtgatgggcccttttagccatgtcagtctttgaagagtaaaagaaggcactttttaaacttcttttttttttggacagtctcattctgtcactc

SEQ ID NO: 30108 - DNA, 201 bp, Homo sapiens
cccctatgactgtgtgatgggcccttttagccatgtcagtctttgaagagtaaaagaaggcactttttaaacttcttttttttttggacagtctcattctrtcactcaggctacagtgcactggtacagtcttggctcactgcaacctctgccacctgggctcaagtaattctgtgcctcagcctcctgagtagctggaac

SEQ ID NO: 30109 - DNA, 201 bp, Homo sapiens
tactcaatcccagtaagaacagagtctgctgcatttaagccatgactcgctctgttacggcctcagctccagaaacttcactgctgtgcactctgggcagrtgtggccaagataagcgactccctctccccatagctcctgatcttgggctatggtttcggtctggaaagggaaactgctgggatttcttattcttacccc

SEQ ID NO: 30110 - DNA, 201 bp, Homo sapiens
gatggggccacaggtcacgagtatggcagacatagcacctccaccggcgcagccatagagtccagagagtgcagctgctgcctggggccaggacccctatsactgtgtgatgggcccttttagccatgtcagtctttgaagagtaaaagaaggcactttttaaacttcttttttttttggacagtctcattctgtcactca

SEQ ID NO: 30111 - DNA, 201 bp, Homo sapiens
gggcctggtactcattgaattccttctgcagaggcagagggtacttcatggcacgaatggttcccaccgaggtgcccacaaacatcatgcgtccagaatgygagatgacaatggcggtgtaggtgacatcaaacgccgatatctctcgaaggatctgagacacaggcagctctgctcagtgtgaggggtcgagctgtggcc

SEQ ID NO: 30112 - DNA, 201 bp, Homo sapiens
tacgcagttgtggaggtctgttttaaaccttttgaccagcgcttccaagtctcgctcctgcaatcagagacatttccttctggtgctgtagggtgctctcrgtggaggggcgggggctgcaggcagaggttaatggcacagaaagggaaaagagatgcctcatctgggacttacagctgactgccaggggccacactgggc

SEQ ID NO: 30113 - DNA, 201 bp, Homo sapiens
attcccatgggctgggcatgcacgcctgctgagcaacttgctgcatctctccttggcgtgttgtgaagcagcagcatgagggcccaacacatggggacccrtcacatcactctctagctcatcctcccttgcctcactcacgctccctgccctgggcctgtatccaccatccacttatccactagacacagtgcccaggac

SEQ ID NO: 30114 - DNA, 201 bp, Homo sapiens
aggctggagtgcaatggctcaatctcggctcaccacaaccaccacctcccaggttcaggtgattctcctgcctcagcctcccgagtagcagggattacagkcatgtgccaccatgcctggctaattttgtatttttagtagagacagggtttctccatgttggtcaggctggtctcgaactcccaacttcaggtgatccgc

SEQ ID NO: 30115 - DNA, 201 bp, Homo sapiens
catgtgccatgttggtgtgctgcacccattaactagtcatttacattaggtatatctcctaatgctatccctccccctccccgcaccccacaacaggcccyggtgtgtgatgttccctttcctgtgtccaagtgttctcattgttcaattctcacctatgagtgagaacatgcggtgtttggttttttgtccttgcgacag

SEQ ID NO: 30116 - DNA, 201 bp, Homo sapiens
tcttaaaatacaatggtgctgatcaaaactacttcttcacttacaggcttctctgataaactggatttccttgagggagatcagaaacctctggcacagcrcaagaaggcaggagccaaaggccagcagatgaggaaggggtgagaagggttttggcatggtttctttggttctgtgaggtgcgatggggccacaggtcac

SEQ ID NO: 30117 - DNA, 201 bp, Homo sapiens
atatcacaggtgcaaacggaggttcttcagaagaggcagcaggagaaagcccatatgatgaatgctattaagaaatatcagaaaggttggtacatctctamtaggggaacgagggtagcaggtactttagagttgatttgaacacttagtgctttggagccttcttggttgatgtggacctgtcggatcaaagttttggga

SEQ ID NO: 30118 - DNA, 201 bp, Homo sapiens
catatcacaggtgcaaacggaggttcttcagaagaggcagcaggagaaagcccatatgatgaatgctattaagaaatatcagaaaggttggtacatctctrataggggaacgagggtagcaggtactttagagttgatttgaacacttagtgctttggagccttcttggttgatgtggacctgtcggatcaaagttttggg

SEQ ID NO: 30119 - DNA, 201 bp, Homo sapiens
gaagaaaagtttccaggaaagcacagagtggtatttggggactcagggccaagaagaatatcctgagtgtgaaaaataagtattaggactcctgctttatrgcaaagtgaggctcggtaaggttaggtgactccccagagcacctggcaagtacgtggtgagcctgggacccaaggcaagactatcaggttccaaacttga

SEQ ID NO: 30120 - DNA, 201 bp, Homo sapiens
cagtggtgtgatcatggcttattgcagccttgacctcctgggcccaagtgatcctcccaccgcagcctcccaagtaactgggaccacaggtgtgtgccacmacacctggctaatattttttactttttgtagaaacagggtctccttatgttgcccaggctagtctcgaactcctgagtgcaagcgatcctcctacatcag

SEQ ID NO: 30121 - DNA, 201 bp, Homo sapiens
tgaacgagcaaagccatcgagatgtgaaacctcagggttttgtgaggaacagtaagcccttggtgtcactgggaatacagtgcaaagcaaggaggggtgcratgtgtttggggggacctgggctgtgggtttgccttgttgaggagcttgggctttgtcagaaggcagtggagagactaggttgtaggttgtactaacagt

SEQ ID NO: 30122 - DNA, 201 bp, Homo sapiens
ccaaagtgctgggattataggtgtgaaccactgcacccatcctaagaaggtacttttaagtatgtggcaccctttaagtgaatgctgagtaaagttgattycccatcacacagtgcgatggttgagagttcagacctagggttcagatcccgactctaccactcagtaggagggcagttttgaacgagttaccatgccttt

SEQ ID NO: 30123 - DNA, 201 bp, Homo sapiens
ttcagcagccgcggttcctgaatataggctacgcagttgtggaggtctgttttaaaccttttgaccagcgcttccaagtctcgctcctgcaatcagagacrtttccttctggtgctgtagggtgctctcggtggaggggcgggggctgcaggcagaggttaatggcacagaaagggaaaagagatgcctcatctgggactt

SEQ ID NO: 30124 - DNA, 201 bp, Homo sapiens
aagatgacagattttaaagttaggattgtgggaagaaatgaatgtgaggaagattggcgtgggtgttaagacttcgtcaacatttggacataagcacttgkgatctgggctgcagaactcttgtccacgtttggagtcatttcactgatacattctcagcaaagtaggaataggctgggatcctgtcctctacaaaaggcc

SEQ ID NO: 30125 - DNA, 201 bp, Homo sapiens
ttttcttggttttccttttttatttcatggtcatctaagaaagaagatgacagattttaaagttaggattgtgggaagaaatgaatgtgaggaagattggygtgggtgttaagacttcgtcaacatttggacataagcacttgggatctgggctgcagaactcttgtccacgtttggagtcatttcactgatacattctca

SEQ ID NO: 30126 - DNA, 201 bp, Homo sapiens
tttttcaaaacagaattctagacttcagaatccccaggaatctgtgcctgttttcccctcttccccaaaagctttccaggtgattctgaaatgcatcctgrtttgggattcactgatctatgtgataatcacgtacctgaagaaattatcataatgattgtcatccaatctgaaagattgcctgcgtgtttgaactatgaa

SEQ ID NO: 30127 - DNA, 201 bp, Homo sapiens
tctttcctgggctacaaataggcagtttgtataatgaaacagacagcacactgggagcgggaaggtgactttcaatctctggcttcactctggcacttttrgtaaagtgctcagcctgtgggccccattgtcctcaggggttggaactgatgatttataagttccgcagtttaaagaacagggaatatctgttccctgctc

SEQ ID NO: 30128 - DNA, 201 bp, Homo sapiens
tatagatataccatcttttgcttatgcattcgtctgtcgatggatgcttggttgcttccacattttgactgttgaacatagatactactttatgagaaggrtgaatggaaggacaatttacaaatgtgtactcatggtattgcccctggggtggccttttgtaccctcagggagaggtaggggccaatcttcagggctatg

SEQ ID NO: 30129 - DNA, 201 bp, Homo sapiens
ttgaaatgctcccaacacacagaaatcataaatacgcgagatggatggaaaccctaaatatcctgacctgatcattacatgctctatgactgtaacaaaayatcacaggtacttcataatatgtacaaatactacgtatcaataaaaaagccattttcagaaggccacatacagtataattccatatacagttctcaaaat

SEQ ID NO: 30130 - DNA, 201 bp, Homo sapiens
agacaggcagagtcgggtggacagtggcaatgaggaggagagcttggttgtggggacagcagatgtgcagggagccgtgggggtctgcactgggcataggrtgtagccaggctgtagagggccccagtgctggacctgcatctgaatgcagtctggtaagtaattccatatccctcttcattagatccagttcttaccttt

SEQ ID NO: 30131 - DNA, 201 bp, Homo sapiens
ggtcatgtcacagggcccacaactgtcttttcacgtgtgcatccccagtgcctagcaaatggtaggtgttcaataaacacacttaagattctggacaaacrgcaatgactgtgtagctttgcgatcctccatgagccttgtgtgtttatcatccattcagcttctcccttaggaagcgtaacacagagctatgcactcata

SEQ ID NO: 30132 - DNA, 201 bp, Homo sapiens
gggatacatgtagcctgtttttagacagagccatattccctgagacttctactgtgtctgggggactcttgagtgtttccccataacctagctcttccaaycctaaccaacgaggcctctacttgtgggctcacccatgtcctgcagttcccggctttgcttgtctaggaggtcttctatgtgctcatggtgataaacatc

SEQ ID NO: 30133 - DNA, 201 bp, Homo sapiens
gcagtgttgtattgctgctctgatggctttacttgtttctatccctcacttgactgtaagcttcctggtcatgtcacagggcccacaactgtcttttcacrtgtgcatccccagtgcctagcaaatggtaggtgttcaataaacacacttaagattctggacaaacagcaatgactgtgtagctttgcgatcctccatgag

SEQ ID NO: 30134 - DNA, 201 bp, Homo sapiens
gtaaagtgctcagcctgtgggccccattgtcctcaggggttggaactgatgatttataagttccgcagtttaaagaacagggaatatctgttccctgctcyagcgaatcctaagtagtggtcattccagattcaaatgacatgaactgacagcattttgtgttgtagattcgacagaagctgcagactaaacaggctgcca

SEQ ID NO: 30135 - DNA, 201 bp, Homo sapiens
tgtcccttctgcagcaggtcaggcccccactctcacgggcccctccctcatcctcttctccctctttgcttttcctgcagaaaattctagggagctctggragggatctccagcgaatgccaggggcttgtcaccgtgctttgtggcagtgttgtattgctgctctgatggctttacttgtttctatccctcacttgactg

SEQ ID NO: 30136 - DNA, 201 bp, Homo sapiens
cctggggcagaaggcaagctgctatgtgaccagatgtggtatgtctttttctgtagaagagacctggaaaacgaacaagagagaagatgaagaacagaacmcactaaatagcatctttgaatacaaagaaccaagaaaaaggaatgaagactcgcaatttcacgacacactttgatcccttctgttggtgtcatgttgtaa

SEQ ID NO: 30137 - DNA, 201 bp, Homo sapiens
tggggcagaaggcaagctgctatgtgaccagatgtggtatgtctttttctgtagaagagacctggaaaacgaacaagagagaagatgaagaacagaacacmctaaatagcatctttgaatacaaagaaccaagaaaaaggaatgaagactcgcaatttcacgacacactttgatcccttctgttggtgtcatgttgtaaac

SEQ ID NO: 30138 - DNA, 201 bp, Homo sapiens; identical to SEQ ID NO: 6124

SEQ ID NO: 30139 - DNA, 201 bp, Homo sapiens; identical to SEQ ID NO: 6125

SEQ ID NO: 30140 - DNA, 201 bp, Homo sapiens
aatctccaagatagtaatatgaagaccctggctatatcacatggcatcctgaggaggtctcaaatgaatatttgttaggatacttggatatatttaaaacttttttttttttttttgagacagggtcttgctctgtcacctagactggagtgtagtggcgtgatcatggctcacagcagccttgaacctctgaggttcagg

SEQ ID NO: 30141 - DNA, 201 bp, Homo sapiens
agacagatatatcttcatctatgaagaatatacctagatctgagaatatacttagagtccctaacacagtttttggcacgtagtaaatgtcagagggtagyggtattaatcatggtgttgctattaagacaatgtagacactggagtaatggtatggaatggctgtaacggtccttgtgttcatatcacaggtgcaaacgg

SEQ ID NO: 30142 - DNA, 201 bp, Homo sapiens
ctcagctgactgcaacctctacctcctgggttcaagtgattctcctgcctcagcctctgagtagctaggactacaggcacgtgccaccacacttggctaatttttttttttttttttttgagatggagtctcactgtcgcccaggctgtagtgcagtggcacgatctcggctcactgcaggctccgcccccggggttcacg

SEQ ID NO: 30143 - DNA, 201 bp, Homo sapiens
ataacaatcaggatatagattccctaatagttggaggacaaggttttttttgttttgttttgttttgttttgtttttttgagacagagtcttgctgtgtcrcccaggctggagtgcagtggcatgatcttggctcactgcaagctctgcctcccgggttcacaccattctcctgcctcagcctcctgagtagctgggacca

SEQ ID NO: 30144 - DNA, 201 bp, Homo sapiens
cagctcgctgcagcttcgacttcccaggctcaagtgatcctttccacttcagcctcctgagtggctgggaccacaggcgcatgctaccatgcctggcttgttttttttttttttttttaattctttgtagagatgaggattccctatgttgctcaggctggtcttgaactcctggactcaagagatccttccacctgggcc

SEQ ID NO: 30145 - DNA, 201 bp, Homo sapiens
ggaatagaattagagacaagtctaggctctagaggcacacgttgttattagagtcacaaatgcttcgataggctattttactggacagagctagaaaaaawatatatattttttaccttgtgaattagtatagaatatttcctatttaaatttagcattattattatttattttgagatggggtctcactctgtcacccag

SEQ ID NO: 30146 - DNA, 201 bp, Homo sapiens
agtgtccaaggtttttgatgaaagagctactggtaatttgtgggatcccctataagtgatgagtcacttctcttgctattttcaagattctctctttgtcytgggctttcgacagttttattttttatttttgagacggggtctcactctctggaatgcaatagtgcgatcttggctcactgcaaactctgtctcctggat

SEQ ID NO: 30147 - DNA, 201 bp, Homo sapiens
tgcacacctcttggaaccaaggcctaccaaccattcagcactttcctcacagcgcagagatgctggggtcccctttggtgtctgttgaggcgccggggcakaatgtgaatgaaggggggccacagttcagtatgccactgcctgagcgtggtatgagctactgcccccaagcgactctcactccttcccggatgatttact

SEQ ID NO: 30148 - DNA, 201 bp, Homo sapiens
cgagtaggtgggactacaggcgcccgccacctcgcccggctaattttttgtatttttagtagagatggggttttaccatgttggccaggcttgtctcgaaytcctgacctcaagtgatccacccacctcggtctcccaaagtgctgggattacaggtgtgagctgctgtgcctggccccttttgtatgtattctctagcta

SEQ ID NO: 30149 - DNA, 201 bp, Homo sapiens
gagatgacgattttcagtgggccccaactaatgcccgtaggagagcccaatattccaagggtagccaggcccttcggtgggaatctaaggatgccccccartgggctgccagtctcggcttccactggaatcccaataatgtcccacactgggaaccctccagtgccttaccctggcctctcgacagtaccttctgacgaa

SEQ ID NO: 30150 - DNA, 201 bp, Homo sapiens
tccttttcccagtcttggagtcaggaaattcttggtctaacttttagcaaggaatagaattagagacaagtctaggctctagaggcacacgttgttattasagtcacaaatgcttcgataggctattttactggacagagctagaaaaaatatatatattttttaccttgtgaattagtatagaatatttcctatttaaat

SEQ ID NO: 30151 - DNA, 201 bp, Homo sapiens
gtggcacgatctcggctcactgcaggctccgcccccggggttcacgccattctcctgcctcagcctcccgagtaggtgggactacaggcgcccgccacctygcccggctaattttttgtatttttagtagagatggggttttaccatgttggccaggcttgtctcgaactcctgacctcaagtgatccacccacctcggtc

SEQ ID NO: 30152 - DNA, 201 bp, Homo sapiens
gatggggtctggggatgaaaaggaggaacatgtggaactggaatttgagcaaaaatcacctgactctttttccccaaggataacgagaactcagcgcccawcttgaacatgtcttcatcttctggaagctctggagtgcacacctcttggaaccaaggcctaccaaccattcagcactttcctcacagcgcagagatgctg

SEQ ID NO: 30153 - DNA, 201 bp, Homo sapiens
gcatgttagaaagcccaagctgggaaatggtctggaggcaggataattcaagcaagagatggaaatagagggctggattaggatggggtctggggatgaaraggaggaacatgtggaactggaatttgagcaaaaatcacctgactctttttccccaaggataacgagaactcagcgcccatcttgaacatgtcttcatct

SEQ ID NO: 30154 - DNA, 201 bp, Homo sapiens
ggtccccgggtggtgagggagacatctagagtaacagatttcttgcttgcacaattgggtgacaatagtgacattttctgagagagagtgaaggatgagawggacaagattaatttgttgtttgagggaggtgggcaaagatgctagtgaattttggccatagtccattagaagagcatgtgggccatccgaaaggactca

SEQ ID NO: 30155 - DNA, 201 bp, Homo sapiens
tctgtctcaattagatttgcattttcaaaggagtgccctggtggatgtgggctggattcaaggcaacagttagaaagcttttgtgataatccaggtgagarttcaaatggcggcctacctgcagaagtgagagtggagatggagaagctaaatatatcatagattgtggagatgttttggaggcagagaccacaatcattg

SEQ ID NO: 30156 - DNA, 201 bp, Homo sapiens
taatttccacacagatttgtaaattttctagtttatctggttgtgggtcagagaagatactttgtatgatacctttttttttttatttttttctaaaagcrgcaagagaaaagtttattttgaaatctattgagacttaatttgtgatctactatatggtcttctgaagaatgtcccatgaacactttcgaagaatggata

SEQ ID NO: 30157 - DNA, 201 bp, Homo sapiens
tcctggcctcaagcgatccacctgcttcgtagtctcaaaatgctcagcctgtaacagtcttgataggttttgtgtttctaggaatttgtccattttatccmggttgtccaatttgttggtgtgcaatttttcataatattgtattataatcctttttacttctgtaaaattggtaataatgtccccgatttcatttctcat

SEQ ID NO: 30158 - DNA, 201 bp, Homo sapiens
tttttccccaaggataacgagaactcagcgcccatcttgaacatgtcttcatcttctggaagctctggagtgcacacctcttggaaccaaggcctaccaascattcagcactttcctcacagcgcagagatgctggggtcccctttggtgtctgttgaggcgccggggcagaatgtgaatgaaggggggccacagttcagt

SEQ ID NO: 30159 - DNA, 201 bp, Homo sapiens
atgactttgaaacagtaatcctgagagacattatcgcctaggaccccctcttcctctgccacggccacgtcctcttcctcttcctctgcctctgcctcttyctgcaacagcttcccttttcttagatttcaccttaggttcaacatccacaagtagtgtatccagaggtaaactgtctagtagaataaaataccgaatgtt

SEQ ID NO: 30160 - DNA, 201 bp, Homo sapiens
catgatcttggctcactgcaagctctgcctcccgggttcacaccattctcctgcctcagcctcctgagtagctgggaccacaggcatccaccagcacaccyggctaatttttttgtatttttagtggagacatgggtctcaccatgttagctgggatggtctcgatcttctgaccttgcgatccacccgcctcggcctccc

SEQ ID NO: 30161 - DNA, 201 bp, Homo sapiens
gatttttggcaagaatgcctcatgtgtatggtaggtttcatcttgcattacatcaggagacacatctggctaccatttggtgatacttgtattaaggtagygaaaagcctcattgatctctctgtagaaatttaccttgtggtcagaaagtaatctgtgtgattctgccttttgtgtatccagtgtccagttccctaccag

SEQ ID NO: 30162 - DNA, 201 bp, Homo sapiens
gtgggccccaactaatgcccgtaggagagcccaatattccaagggtagccaggcccttcggtgggaatctaaggatgccccccaatgggctgccagtctcrgcttccactggaatcccaataatgtcccacactgggaaccctccagtgccttaccctggcctctcgacagtaccttctgacgaaacattgttgggcccga

SEQ ID NO: 30163 - DNA, 201 bp, Homo sapiens
gattctctctttgtcttgggctttcgacagttttattttttatttttgagacggggtctcactctctggaatgcaatagtgcgatcttggctcactgcaamctctgtctcctggattcaagcaattctcgtgcctcagcctcctgagtagctgggattacaggtgcccgccaccacacctggctaatttttgtatttttag

SEQ ID NO: 30164 - DNA, 201 bp, Homo sapiens
ccgcctcagcctcccaaagaggtgggattacaggcatgagccgccacgcccagccgataattcctttaaattatcttagatgcaagccttattcaaatgcycctagctattcctaaaatgtacttcgtagctggtacgtccaaaccagaatttaagaccatacactgtatctggtgattatgtcccttgagtctctgaaat

SEQ ID NO: 30165 - DNA, 201 bp, Homo sapiens
tatttttcctttagtactttgaatatatcaacccatggtcttttagtgtccaaggtttttgatgaaagagctactggtaatttgtgggatcccctataagygatgagtcacttctcttgctattttcaagattctctctttgtcttgggctttcgacagttttattttttatttttgagacggggtctcactctctggaat

SEQ ID NO: 30166 - DNA, 201 bp, Homo sapiens
atggaggagtctctgggctttagatttgtcctgggccactggtgggtaattgtttgggatgagcctttcatcttccaagcttggaactaagctagactggccccccgacttgccatacaggaggactgtgccaagatgactggggcgggcactcctgattgtgttgcccctccctggttccctggaccttcccttttgaat

SEQ ID NO: 30167 - DNA, 201 bp, Homo sapiens
agagttttttttaaaaaatgaacatttttctctatagccaaaaccacataatcaaacgtatcaaaattgtatatatatatacactttcttttgagacaggstcttggtgctgttgtccaggctggggtgcagtggcaccatctcagctcactgaaacctccgcttcccaggttcaagcaattctcgtgcctcagcctccca

SEQ ID NO: 30168 - DNA, 201 bp, Homo sapiens
ggaaagtattatccatttactttccaaagtattttactttcaaggaatgatttaattctgccattcttttcctcatttccagcattgtctttttgtttgattttttttttgtagtgaaaatacatttccttaaaacacaatttccttttgtatatattctttttttttttttgagacagagtctcgctgtgttgcccaggc

SEQ ID NO: 30169 - DNA, 201 bp, Homo sapiens
gaggctgaagcagaaggctcgtttgagctcaggagttttaggctgtggtccacaacgatcacacctgggcatagccactgcacttcagcctgggcaacatrgtgagatcctgtctctaaaattaattaaataaaaaataaaacaagatcttcccaactcttctagagttttttttaaaaaatgaacatttttctctatagc

SEQ ID NO: 30170 - DNA, 201 bp, Homo sapiens
ctacagatatcaaaatccacagatgctcaagtcctttatataaaaatggtgcagcatttgcatataacctacactcgcctccagtatcctttaaagtcagrggacctcaactcccaggccacagaccgctacgaacccactatgaatctgtggcctgttaggaaccaggccgcacagcagaaagtgagtgacaggcaagca

SEQ ID NO: 30171 - DNA, 201 bp, Homo sapiens
tatttcaagtttgccagcgcaaatctactgttgagccttccagtgaatttttcgttttggttattgtacttttcaactccagaatttccatttgatttttraactaatttctgttttcttattatattctttatttgatgaggcttgtcatcctaccttcctttaattatttaagcgtagtttcctttagttaattgaact

SEQ ID NO: 30172 - DNA, 201 bp, Homo sapiens
gccaccatgcccagctaatttttgtatttttagtagagacagggtttcaccattttggccagtatggtctcgatctcttcacctcatgatccacctgcctyggcctcccaaagtgctgggattacaggtgtgagccaccgtggccggccagctttcaagattttcttatctttggctttcaacattttgtttttgatgtgt

SEQ ID NO: 30173 - DNA, 201 bp, Homo sapiens
gaatatcaaacatcagttagaagcaaattatacatactgcaacatagatgattccttaaaaatttcgtgttgagaaaaaagtaaaagtacagaaagagatytgaagcacaatatcatttatagaaatataaaacacatatgtatatagtcagtgacatacatgaaatccttttgttggtgcctacttatcatagggaggaa

SEQ ID NO: 30174 - DNA, 201 bp, Homo sapiens
ctccgcctaccgggttcatgccattctcctgcctcagactcccgagtagctggagctacaggcgcccgccaccatgcccagctaattttttgtatttttartagagacggggtttcaccatgttagccaggatggtctcgatctcctgatcttgtgatccgcctgcctcggcctcctaaagtgctgggattacaggcgtga

SEQ ID NO: 30175 - DNA, 201 bp, Homo sapiens
cgaggcgcagggtgcatctttcctgggacaagaatcggtctcccaagcccaacagcgcctgaagcgcatcccatgtccgagtacccccgaccctgtgcccrcgctcaccacgtcgttcacggccttcttcggcccctctagcacgacattgaggcctggcttcagaagccctcgggaaaacgcatcctgcaactgcaggac

SEQ ID NO: 30176 - DNA, 201 bp, Homo sapiens
tctagattacttataataccgaatacaatgctatgcatcacctcattctcatggattcaatgtagttctcggcacacggaaaattcagttttccttttgcratattttcaaatttttttccccaatatttttgatccaaggttggttgaatccacagatgctgaacccatggctatggagggctgaatgtatgttggatta

SEQ ID NO: 30177 - DNA, 201 bp, Homo sapiens
cagacaacattaatttatatttgctctcatacttaccaaactttttcccaccattactctttacaaatcagatattccagctgggatcattttccttctgyatttactgataatgtattaataaattctcccagtttttgtctgaaaatgactttattttatcctcatttctgaaagatagtttcaacaggtgtgaaattt

SEQ ID NO: 30178 - DNA, 201 bp, Homo sapiens
ttcaggcccaggttgagtagagacagcctgggaagaaacccccaatgttggtcttgtcagcaggctcaagactatctgagcagggaactccagagtcctgmgtacctgcaacgtgatctagaagaggcaggacaaactccaggcagccactgtatcccacttaatggtaaggggtacagccagagaaagactccgggatgc

SEQ ID NO: 30179 - DNA, 201 bp, Homo sapiens
gcttgttcagctcagagtcatgatgaggctcaacatattcatttgttcactcaacaaaaatgtattaagtaccccctgtgttccaggcacaaaatagacaygcacatatgcacataaaatgctgtcctcacagtgcttccattctaagaggggagagtgacaaacaaaataaaaagaagtacagtctacatgctagatagt

SEQ ID NO: 30180 - DNA, 201 bp, Homo sapiens
aacaaaaatgtattaagtaccccctgtgttccaggcacaaaatagacacgcacatatgcacataaaatgctgtcctcacagtgcttccattctaagagggsagagtgacaaacaaaataaaaagaagtacagtctacatgctagatagtgatagatgctaataagaacaaacaaagcatggaaagtgaagccgttggggga

SEQ ID NO: 30181 - DNA, 201 bp, Homo sapiens
cctagttttaactttcccttatgctttttacctcaaatctgtattttcagcctcaacccctcccgccagctttagaaccatgtccacctgctggacctccrtacccaactgttccacagagtgtacctcacacacaatatatctgagattgagtttatcttttcctttcttctccctctctttgggaaatgcaatcagggt

SEQ ID NO: 30182 - DNA, 201 bp, Homo sapiens
acttcattctttggcatgtagatatccagtcgtcacagcatcatttgttgaaaaggctagtctttctccattgagtagtcttggcatcttgttggaaatcagttgacacatgggtttgtttcaggacttccaattctgttccattgatctgtctatctttatgccagtaccacactgtcttgattactgctgctttgtagc

SEQ ID NO: 30183 - DNA, 201 bp, Homo sapiens
tcctcacagtgcttccattctaagaggggagagtgacaaacaaaataaaaagaagtacagtctacatgctagatagtgatagatgctaataagaacaaacraagcatggaaagtgaagccgttgggggagtaagaagttgtagatagggaggctggggagggctcactgagcagtgatttttgagtgaagactgaaggaaa

SEQ ID NO: 30184 - DNA, 201 bp, Homo sapiens
gagcggggcggtgctctccactctgaagcgctgccttggtcttcagcagaactgtttggcgggagatcatgtcagccgtggtagctcagacgctgcatgtwtttggtcttcgatcccacgtggccaacaatatcttctacttcgatgaacagatcattatatttccttcaggaaatcactgtgtgaagtacaatgtggatc

SEQ ID NO: 30185 - DNA, 201 bp, Homo sapiens
cacagtgcttccattctaagaggggagagtgacaaacaaaataaaaagaagtacagtctacatgctagatagtgatagatgctaataagaacaaacaaagyatggaaagtgaagccgttgggggagtaagaagttgtagatagggaggctggggagggctcactgagcagtgatttttgagtgaagactgaaggaaaggaa

SEQ ID NO: 30186 - DNA, 201 bp, Homo sapiens
aaacctgtacattgtgcacatgtaccctagaacttaaagtataataataataataaaaggatatctatgtgagaggcgaaaatgttttaaggaggagaggygaggcatcagctgggtcgaaacaatgcaaaagcattttacaaactctaaaaccagtcaacatatatcaagaacatactaagttccagacactggtgattg

SEQ ID NO: 30187 - DNA, 201 bp, Homo sapiens
tgggtaagaagtggtatctcattgtggttttgatttgcatttacctggtgattaatgatgaacgtcttttcaagaatttctaattcttctttgaagaaatrtctattcagattttttgcccatttaaaaaattgagtcatatgtctttttattattgagttgtaacagttatttataattctagatataagtcctttatca

SEQ ID NO: 30188 - DNA, 201 bp, Homo sapiens
tttcatttctcttcctagaagtggaattgctgagtcatatggtaacttcatgttcaattatttgaggaactgccatactgttttccaaagttgctggaccrttttatattcccataagcagtatatgagcattctgatttctctatattcttgccaaaacttgttattatcttttttattatagccatcttagtgggtaag

SEQ ID NO: 30189 - DNA, 201 bp, Homo sapiens
tggtcctttttttaataacaacttaattgagttatgattcacatacaaattgcctattcaaagtatacaattcagtggtctttagtatattcaaaaagttrtgcaaccatttatcatagacagccttaggacatttttatcacctcaaaaaaaaaaaaagcgcataccctttagctattattattcctccatcctcccaat

SEQ ID NO: 30190 - DNA, 201 bp, Homo sapiens
agactaatgtatggttttgcttatgtaatgagcattaataaatgcttgctgaatgcatttatgagcaatagcccattctcattttgaaatgcacccatgcrtagcagtcaaagcagagactggagcccacccaggtacatgagatgaagcaaatgcctttcacacagatggtccgtcatccatagactagggataacagta

SEQ ID NO: 30191 - DNA, 201 bp, Homo sapiens
gactctcctgtgtacccccgagtagcctggtcctaattcaatggcagctatcagtgctgtgccagaataaagcccctttagggcagggccatcttttgctyctcttggcagccctactagctggcacattgtgtggtgcacagcattcaataaatgtgtgtgtaggcatgaaaaaatgctcatcatcactggccatcagag

SEQ ID NO: 30192 - DNA, 201 bp, Homo sapiens
tcacatgctgttcaggtttgtagcctcggagcagtaggctctaccacatagcctaggtgtatagtaggctgtcgcagctaggtttgtgtaaatacactccrtgatgtttgcgtgacaaaatagcctaaccatgtatcccatatcaagcgatgcatgactgtgcagtgagctgctctcacctaggcttgccactgtattctt

SEQ ID NO: 30193 - DNA, 201 bp, Homo sapiens
atgtatgtgtgtggaggtcaggagagaagtcagggctgagtatgaagattcggggaattagaaagtagaggaagtcagaggcatagattagatcaccaagrgcctatgtagaatctgagaagaatattggacagcagagggaagaccaacatttaagagactggtgaaagaagaggagccgatgaaagactgaaaataaag

SEQ ID NO: 30194 - DNA, 201 bp, Homo sapiens
cttgcagtgagccaagatcgtgccactgcactccagcatgggtgacaaagcaagactccgtctcaaaaaaaaaaaaaaaaaaaagtaatattccctccttcatttctgattgtattaatatgattttcctcctccccccatttttttttatctctttaaagaatcagctttcggtttcattgatttttctctattgctttg

SEQ ID NO: 30195 - DNA, 201 bp, Homo sapiens
ggtaataattgtcctctgacaactggctccccgttattgggctcatagctatctttctaagccagctgaatatgcttaagtacaaagttttgactttccaraggaaaacttctatttcttaccttctgcatctgcagatcagatttggccatttccgcaaaataatcagtgggtcgcttcgtagggactttgagctgatgg

SEQ ID NO: 30196 - DNA, 201 bp, Homo sapiens
tggctgcctgttcacctggaaggtctttgataaggatggccggggaatcaagcgagagagggaggtgggctttgccgaagaggtgcttgtgactaaaacaracatggaagaaaaggtaagaactggatctaatgaagagggatatggaattacttaccagactgcattcagatgcaggtccagcactggggccctctacag

SEQ ID NO: 30197 - DNA, 201 bp, Homo sapiens
ttttttttttcctgtgtctattgaaattattgtgtgagttttcgttttttactttattaatatagtatattatactaagtgattttcagatgttaaaccayccttgcattcttgggataaaatccacttggccatagtatataatcattttcatattagtatattcaatttactagtattttgttgaggatttttgtatcc

SEQ ID NO: 30198 - DNA, 201 bp, Homo sapiens
attttcaacttatggtgttttcaccttatgatgggtttatcaggacatgatcccattgtaagtagaggagcaggtgtacattgggataagagctgtgattraaggatgttcagttggtaggagaccacatagcatcccctgacatgtggtttctttcctcttggacagggctatgtaaacctatcagaccctctttttctg

SEQ ID NO: 30199 - DNA, 201 bp, Homo sapiens
cattgtggttttgatttgcatttacctggtgattaatgatgaacgtcttttcaagaatttctaattcttctttgaagaaatgtctattcagattttttgcycatttaaaaaattgagtcatatgtctttttattattgagttgtaacagttatttataattctagatataagtcctttatcagatatgtgatttgcaaata

SEQ ID NO: 30200 - DNA, 201 bp, Homo sapiens
gtacaaagttttgactttccagaggaaaacttctatttcttaccttctgcatctgcagatcagatttggccatttccgcaaaataatcagtgggtcgcttsgtagggactttgagctgatggaggcggggtaagactgcaagcactgcggcctgggcttggcgatagctgagaatcgtaggacaaaatgtgtaatgaggtg

SEQ ID NO: 30201 - DNA, 201 bp, Homo sapiens
tgtgtgtcactggaaatgggatgtttaagcttctccgttttgctgagggaaccctgaagcaaaccagctttcagaggggagaaccccaaaactatctagcycacacctgggtggctgatgacaagattgtcgttggcactgacacaggcaaactcttcctctttgaatctggagatcagcgttgggagaccagcataatgg

SEQ ID NO: 30202 - DNA, 201 bp, Homo sapiens
gtgggttgtcttttcacttttttgatgttgtcttttgatgaagttttcaattttgatgaaattgaatttatctatttttcttttgttggttgtgctttccrtgttatatttaagaagccaatgcctgaggccatgaagatttacctctgtatttcttctaagagtttcatagtgctagctcttacatctaggtctttaatc

SEQ ID NO: 30203 - DNA, 201 bp, Homo sapiens
tgatgacaagattgtcgttggcactgacacaggcaaactcttcctctttgaatctggagatcagcgttgggagaccagcataatggtcaaggaacctaccratggctcaaagagcctggatgtcattcaggaatcagagaggtaatggtgcttcctgggctggtgctcccacattcattgtactgacagcattatgcagaa

SEQ ID NO: 30204 - DNA, 201 bp, Homo sapiens
aggtaatggtgcttcctgggctggtgctcccacattcattgtactgacagcattatgcagaagacagcactctttagaaaccactcataacccctctaccrtaaaagtcaactatgcccattttccctcttcctctctagttttcgtctatatttaagcacagatttaacagttataaccatagactaaatacaattcttt

SEQ ID NO: 30205 - DNA, 201 bp, Homo sapiens
cttggccatgtgcagtttgtgtacggttcccaagccaaagggtagtatttgactgtggaaaaggggatcattgggtggtttctgtcacacccagtgacagycttctttctcctccccagcagaattcatctcctcaagattgtctctataaattatgtatgctgtttttttgtttccagcctgattgaatttccaccagtc

SEQ ID NO: 30206 - DNA, 201 bp, Homo sapiens
ctctctgatgccagagcctgggccctcaaccccaatgacatcctgtagattcttcttcctcagtaaccttcaatccacccattttcactaccatccccccrtgccaatggcatatcctttttttttttttttttttttttttttttgtgagtatgtaggagcttcctgaaaagtctctataaccttctccaggagctgtgt

SEQ ID NO: 30207 - DNA, 201 bp, Homo sapiens
gtgtgcttaatggtgtcccacatttttctgaggctctgtaaatttctaattctttttcctctctgttcttcaaattgctaatcttttttgatctataaagwtcactaattcttctgccagttcagatctattcttgagcacctctagtggatttttcatttcagttattgtagtttttaactctagaatttctattttctt

SEQ ID NO: 30208 - DNA, 201 bp, Homo sapiens
tgcctcagcctcctgagtagctgagattacaggtgtgcgccaccatgcccagctaatttttgtatttttagtagagacagggtttcaccattttggccagkatggtctcgatctcttcacctcatgatccacctgcctcggcctcccaaagtgctgggattacaggtgtgagccaccgtggccggccagctttcaagattt

SEQ ID NO: 30209 - DNA, 201 bp, Homo sapiens
acatatagaaatgttattgccacatagctaccttccctttcccctttttaatggtaatattgttatatatattacatctatgagtgttacaaaccccaatracatattcttataattattaccttatataattttatatattttaaagaagctgaggttagaatggggagcaattatatatttatagtctttttatgttaa

SEQ ID NO: 30210 - DNA, 201 bp, Homo sapiens
gagactagcctgggcaacataaggagaccctgtttctacaaaaagtaaaaaatattagccaggtgtggtggcacacacctgtggtcccagttacttgggakgctgcggtgggaggatcacttgggcccaggaggtcaaggctgcaataagccatgatcacaccactgcactccagcctgggtgacaagagtaagaccctgt

SEQ ID NO: 30211 - DNA, 201 bp, Homo sapiens
catgcatttgcagtgaaaccggtaagcccacttgtgtgattccccatcattgcatgactcctcaggcagagggggaagagagagcattgcttttgtttttwagacaagagagatttgagtgtgtaaaagctaataggaatgtgctcatagagacaggcaggttgaagatattggagaaagaaagcgtaacagatggagaag

SEQ ID NO: 30212 - DNA, 201 bp, Homo sapiens
tcaccggtctagctacctgcatccgcaaaccccttatagccacctgttctctggatcgatccatccgcctttggaattatgaaacaaagtaaggaatgaarggcttgcctactttattatgcaagaccccagttgtgaatttatgtgaattattttaattacagtgttccaaactttaattatttagaagctttcagttgg

SEQ ID NO: 30213 - DNA, 201 bp, Homo sapiens
gggaattagaaagtagaggaagtcagaggcatagattagatcaccaagggcctatgtagaatctgagaagaatattggacagcagagggaagaccaacatwtaagagactggtgaaagaagaggagccgatgaaagactgaaaataaagatacaaagagaacttggaatcagataattatctcaaagaagccaaggaacta

SEQ ID NO: 30214 - DNA, 201 bp, Homo sapiens
gcttgcagtgagccaagatcgtgccactgcactccagcatgggtgacaaagcaagactccgtctcaaaaaaaaaaaaaaaaaaaagtaatattccctccttcatttctgattgtattaatatgattttcctcctccccccatttttttttatctctttaaagaatcagctttcggtttcattgatttttctctattgcttt

SEQ ID NO: 30215 - DNA, 201 bp, Homo sapiens
taatgcttaccacatgctagacactggggacatgaagagatgaagacaacacctcagtctctcaccttcttacataaactcctgggtccctccagctctcytatccccttgtttcccacaggaactgctctttgcttcagggagctctccagaccctttcttcctcatctttctcccaggacatcactatctcaaccaccc

SEQ ID NO: 30216 - DNA, 201 bp, Homo sapiens
ggcttgcagtgagccaagatcgtgccactgcactccagcatgggtgacaaagcaagactccgtctcaaaaaaaaaaaaaaaaaaaagtaatattccctccttcatttctgattgtattaatatgattttcctcctccccccatttttttttatctctttaaagaatcagctttcggtttcattgatttttctctattgctt

SEQ ID NO: 30217 - DNA, 201 bp, Homo sapiens
ttatctccttctggaactccaaaccatctcaactccatccttccagttttttattttattttattttatttatttattttttaagaaaccaggtctcactctgttgcccaggctggagtgcactggcacaatcatagctcacagcagtctcaaactcctgggctcaagccatcctccccaccttaacctcctgaatagctg

SEQ ID NO: 30218 - DNA, 201 bp, Homo sapiens
tagatgattccttaaaaatttcgtgttgagaaaaaagtaaaagtacagaaagagatctgaagcacaatatcatttatagaaatataaaacacatatgtatrtagtcagtgacatacatgaaatccttttgttggtgcctacttatcatagggaggaacagaagtaaaaattgagaaagaaaggagcgaaataaaataaaat

SEQ ID NO: 30219 - DNA, 201 bp, Homo sapiens
ttgtcttgttcctaatcttagggagaaagcatccagtctcttttttttttttttttttttttgagacggagtctcgctctgtcacccaggctggagggcartggcgcaatcttggctcactgcaagctccgcctaccgggttcatgccattctcctgcctcagactcccgagtagctggagctacaggcgcccgccaccat

SEQ ID NO: 30220 - DNA, 201 bp, Homo sapiens
tgttatatatattacatctatgagtgttacaaaccccaatgacatattcttataattattaccttatataattttatatattttaaagaagctgaggttaraatggggagcaattatatatttatagtctttttatgttaacctttactatcatttctggttcttttcatttgtttcttgagtttgagttaccactgaagt

SEQ ID NO: 30221 - DNA, 201 bp, Homo sapiens
tctagtatcatgtcaaatatcagtgatgagtgcagatccttgtcttgttcctaatcttagggagaaagcatccagtctcttttttttttttttttttttttgagacggagtctcgctctgtcacccaggctggagggcagtggcgcaatcttggctcactgcaagctccgcctaccgggttcatgccattctcctgcctca

SEQ ID NO: 30222 - DNA, 201 bp, Homo sapiens
atgctccagcaacacccactgcttgcagttcccgcactatgctgtaccctttgtcacatccaccccgtggctcaagctcttcctgctatctaccacccagyccccatctcacctcaccccctgccctccttcaggaaggtttccctgacttctcctcccacctcatcctccaaggtgcctgccctagtcattttcttttgg

SEQ ID NO: 30223 - DNA, 201 bp, Homo sapiens
aaaaaaaaataacactatcactaatcttgaaaaaaactcttctagagaattggaaaaagaaggaatactttccagttatgttctatgaggccaaaataatygtgataccaaaatctgtcaaagacaccacaagaaaaaaaaataagctagtctttttcatgagcacagatagaaatatatatttatatatatattttagac

SEQ ID NO: 30224 - DNA, 201 bp, Homo sapiens
tccttgcctagttgccatggctagaacctctagtatcatgtcaaatatcagtgatgagtgcagatccttgtcttgttcctaatcttagggagaaagcatcyagtctcttttttttttttttttttttttgagacggagtctcgctctgtcacccaggctggagggcagtggcgcaatcttggctcactgcaagctccgcct

SEQ ID NO: 30225 - DNA, 201 bp, Homo sapiens
tttagtcttcctttccaatctgtgaatgcctgttacttattttccttgcctagttgccatggctagaacctctagtatcatgtcaaatatcagtgatgagwgcagatccttgtcttgttcctaatcttagggagaaagcatccagtctcttttttttttttttttttttttgagacggagtctcgctctgtcacccaggct

SEQ ID NO: 30226 - DNA, 201 bp, Homo sapiens
ctttatcagatatgtgatttgcaaatactatgtcccattctgtgggttgtcttttcacttttttgatgttgtcttttgatgaagttttcaattttgatgarattgaatttatctatttttcttttgttggttgtgctttccatgttatatttaagaagccaatgcctgaggccatgaagatttacctctgtatttcttcta

SEQ ID NO: 30227 - DNA, 201 bp, Homo sapiens
cggtcagccgctcaatcactagggtaacaaccaagatactctacagtgtggtgctgtgtggccacatggctttgcccattttcaacttatggtgttttcamcttatgatgggtttatcaggacatgatcccattgtaagtagaggagcaggtgtacattgggataagagctgtgattgaaggatgttcagttggtaggaga

SEQ ID NO: 30228 - DNA, 201 bp, Homo sapiens
tagtaatcagaaggctgctgggtgattattccagaatcagaccaaaggcaggtagaaccagaagggtatttcaaccaggccacagtgaggcctgatgaagsacctcctgctctgactagtagattcagcaaccatttattggatgcccatgatgaatccagcactgggaaaacagatgaaaaagtcacagcccctcaagtt

SEQ ID NO: 30229 - DNA, 201 bp, Homo sapiens
caatgtttgtttgtttgttttcctaataactgaagcatgcacaaaaagttttaacatgaatatttcaaattagcccataaagtggattttggatcgtgacygtggaccaaagagctcttctctcaaacaggaagaatctcctagctattcttagtcaaaagaagccgctctctctactcctaggcttattctgagtgcaga

SEQ ID NO: 30230 - DNA, 201 bp, Homo sapiens
cacatataaaatgttaatttaaaagtacttttttcactgtaatttcatgaaaatatgttaagaacccctcttttggtgtcttcaatatcactgcctttgtyatcaccagagccactttttgagttgtctaacagttttcctgagcacaccaccttcattatatcaccgtttgaatccaagtatgatgaagacactgtaaac

SEQ ID NO: 30231 - DNA, 201 bp, Homo sapiens
tcaatatcactgcctttgtcatcaccagagccactttttgagttgtctaacagttttcctgagcacaccaccttcattatatcaccgtttgaatccaagtrtgatgaagacactgtaaactttatcccaagtcgcaaataaccatttgtatagcattacagcccttatttttgttcacagtggtcctgttaatgatattca

SEQ ID NO: 30232 - DNA, 201 bp, Homo sapiens
cacaccaacatggcacatgtatacatatgtaacaaacctgcacgttgtgcacatgtaccctagaacttaaagtataataataataataaaagaaaaaaaaatatgtgtgtaggtgggtgggtgaatgagtgcatgaatgagtgagggaatgaaggggcgctctgatagtacagtagtcccaccttacccacagtttcagtt

SEQ ID NO: 30233 - DNA, 201 bp, Homo sapiens
tgtgacatatacatacaaaagaatgtaccctacatatatgtcatatttaaagaattacaatagaatgtagatctgtgaacccagccacccagcataggaarcagaatattaccagttctagtgcttctccctgtattctgtgtcttgctgcatcagttcaatgtcatgcttttgagattcacacatctcgatacatatagc

SEQ ID NO: 30234 - DNA, 201 bp, Homo sapiens
gggacattactgatagctgttttgcatcttgggcagattcctgtggacccgcagagcaatgatccaagtcagtctgacaaacaggacgttctctgcctgtscttcagcccctcagaggaaactctggttgccagcaccagtaagaaccaactctacagcatcaccatgtccctgacagagatcagcaaggtgagtctttcc

SEQ ID NO: 30235 - DNA, 201 bp, Homo sapiens
atttctctgaaactctgttaatgttaatttttcttgattagtgtttctctctgttcttccaattgcacaatctctattgagctatttcaagtttgccagckcaaatctactgttgagccttccagtgaatttttcgttttggttattgtacttttcaactccagaatttccatttgatttttaaactaatttctgttttct

SEQ ID NO: 30236 - DNA, 201 bp, Homo sapiens
ccaaacaccgcatgttctcactcataggtgagaattgaacaatgagaacacttggacacaggaaagggaacatcacacaccggggcctgttgtggggtgcrgggagggggagggatagcattaggagatatacctaatgtaaatgactagttaatgggtgcagcacaccaacatggcacatgtatacatatgtaacaaacc

SEQ ID NO: 30237 - DNA, 201 bp, Homo sapiens
tatatatttatagtctttttatgttaacctttactatcatttctggttcttttcatttgtttcttgagtttgagttaccactgaagtcatttctttaatcyggtacacatttgttcccacccaccatttgtgtgctattactgggaaatatattacatttctatatgttatagcaacaacagtatattatatgcatattgt

SEQ ID NO: 30238 - DNA, 201 bp, Homo sapiens
aaagagaggaaccaacaattgcaaacagtagtgtgtctcaaatacgatgataacaatatatatcagatacagtagatgactggaaggatttagtgagctargcttacaattcagtaattgatctttttcacagcaccctggaactatttaaggaataccaagaagaggcatattccatcagccttcatccatctggacact

SEQ ID NO: 30239 - DNA, 201 bp, Homo sapiens
acatatacaccatggaatactatgcagccataaaaaaggatgagttcatgccctttatagggatacagatgaagctggaaaccatcattctgagcaaactrtcgcaaggacaaaaaaccaaacaccgcatgttctcactcataggtgagaattgaacaatgagaacacttggacacaggaaagggaacatcacacaccggg

SEQ ID NO: 30240 - DNA, 201 bp, Homo sapiens
ggagataccaacaaccaatatgaggattaaaaaggggatatcactaaaggtcctatagacattaaaaagatctgaaaggggtccgggcgcagtcactcackcctgtaatctcagtacttcgggaggctgaggcaggcggatcccttgagatcgggagttcgagaccagcctggccaacatggtgaaacttcatctctacta

SEQ ID NO: 30241 - DNA, 201 bp, Homo sapiens
aagcttacaattcagtaattgatctttttcacagcaccctggaactatttaaggaataccaagaagaggcatattccatcagccttcatccatctggacayttcattgtagtagggtttgctgacaaactacgcctcatgaatctactcattgatgatatacgttctttcaaagaatactctgttagaggatgcggagagg

SEQ ID NO: 30242 - DNA, 201 bp, Homo sapiens
aactacagtggcttaaaaaaagggggaaggaggaaatccagttattttcccagcaaccttattgagtatatggttccatccccatattcttatgtccaccmgactatttcattgaacctaaaaccttgtgagatccccgctatgataagtcctgtctgtaattgtggaatattaacaaatattttaaaagaaaagtaatct

SEQ ID NO: 30243 - DNA, 201 bp, Homo sapiens
cttttactaccagatttatgtgtggcttggaaaatgctatcacagttcagagagtgatggcttttgcatcatgttcagccagagactggtagtttggatgrcccctttctgattgttcataagagggtacagccttgggcatgcacagagtcttccaggctgcgagggatgaatatgatttcatttttaagcctggcttcc

SEQ ID NO: 30244 - DNA, 201 bp, Homo sapiens
atcccgagacccaagcggctagcagagggcggccctggccgctgctgcctgccttcagccccctactcccacgccgtggctccacgtgccaccgaatcgcyccagcgccagcaactcacagctactgctcaacttttgattgggacttccgcttccggcggcaaaccatacttccggtttgtcgttgctataggaaccgct

SEQ ID NO: 30245 - DNA, 201 bp, Homo sapiens
ggcatgcacagagtcttccaggctgcgagggatgaatatgatttcatttttaagcctggcttcctaggagatgcccctgggtcgggagagcttaatgttcmgcatttggtagactgttgtgtttggtaggcccgttgtgccagtgagactctgccctatgttaacgggtctttgtgtagcttaggagatgctttcaagttt

SEQ ID NO: 30246 - DNA, 201 bp, Homo sapiens
ggagatgatgaaatggaggtatgaaataggacagtgctcattggttcatatggctggaacactggacacatttgagcaatgatagagggagtaggaaaggytggctgcatcgcagaaggtagtgtatgccatgccaaggaattggactttagtctctaggtgacgagaaacaacggaaaggatttaagcaagaaagtaatg

SEQ ID NO: 30247 - DNA, 201 bp, Homo sapiens
tgtgatccactgcacccagccttctaaagactttaaatgattattttttatcatatttaccagttaacctacattgtcagagagaaggtcaagttgaggtycttaccgtgccattccagaagtccactctctctgtgctatttttgcaagtttctgtgaatacataattatttcaaaaatgttttgaaaaaacagcaataa

SEQ ID NO: 30248 - DNA, 201 bp, Homo sapiens
aggttaatgtttttcaacaaatttgagatttttcagcattatttatttgaatatttgttgtttttctctcttctcctagtgctctcattacagtaccataygtgggtgcatttaatggatgcccacatttctctgaaactctgttaatgttaatttttcttgattagtgtttctctctgttcttccaattgcacaatctct

SEQ ID NO: 30249 - DNA, 201 bp, Homo sapiens
ctgtaccttttctgtttagatacacagatattttccattgcgtcacagttgcctacagtattcagcatagtcacatgctgttcaggtttgtagcctcggascagtaggctctaccacatagcctaggtgtatagtaggctgtcgcagctaggtttgtgtaaatacactccgtgatgtttgcgtgacaaaatagcctaacca

SEQ ID NO: 30250 - DNA, 201 bp, Homo sapiens
aatatgtgtccccccagggcattgttgttggttggttggctgattatctgtttcgtgacttggctgagctaattctgtaaagtctgtttcccctgtagtgwgcagtgtctcatatcactactcagatctatttttcatcttttcttttagcctggctacctagggttgcccatgagttgcctaagctgcttattagttaca

SEQ ID NO: 30251 - DNA, 201 bp, Homo sapiens
acagacagaacctttgctccactgcaccagagctggggcggggacctgcttttccaggagtaacatcctcacttctgtgagtgacacttgaggtgtgtgcrtgtgtgtgcacatgcgtgtgtatgtgtgtgtgcacgtatgtaagcccctggtctttttggcttgcccttcatggcttggaactttcactctataagcaaa

SEQ ID NO: 30252 - DNA, 201 bp, Homo sapiens
cggggacctgcttttccaggagtaacatcctcacttctgtgagtgacacttgaggtgtgtgcgtgtgtgtgcacatgcgtgtgtatgtgtgtgtgcacgtrtgtaagcccctggtctttttggcttgcccttcatggcttggaactttcactctataagcaaactgggtcaggaatcattagggcacagttattctcagta

SEQ ID NO: 30253 - DNA, 201 bp, Homo sapiens
ggggtaagaataagaaatcccagcagtttccctttccagaccgaaaccatagcccaagatcaggagctatggggagagggagtcgcttatcttggccacayctgcccagagtgcacagcagtgaagtttctggagctgaggccgtaacagagcgagtcatggcttaaatgcagcagactctgttcttactgggattgagta

SEQ ID NO: 30254 - DNA, 201 bp, Homo sapiens
atgtagaggaaataaatggcgacttgtattatgaaactagattaatcagtcacgcatatgtagttaaaatcacatataaaatgttaatttaaaagtacttktttcactgtaatttcatgaaaatatgttaagaacccctcttttggtgtcttcaatatcactgcctttgtcatcaccagagccactttttgagttgtctaa

SEQ ID NO: 30255 - DNA, 201 bp, Homo sapiens
ggccacagctcgacccctcacactgagcagagctgcctgtgtctcagatccttcgagagatatcggcgtttgatgtcacctacaccgccattgtcatctcrcattctggacgcatgatgtttgtgggcacctcggtgggaaccattcgtgccatgaagtaccctctgcctctgcagaaggaattcaatgagtaccaggccc

SEQ ID NO: 30256 - DNA, 201 bp, Homo sapiens
gttctagcactgacagtggcaagggcacaagaatgctgtcctctctgcacaccatgtcatgaccatgccagctaggaaatgcactgggccatcttcacctyggggaccacacttcacacagcactgttcctctccttaattgctgattttagaaaaaatgtcatttttatatgcatctaattggtggtaactggcatgact

SEQ ID NO: 30257 - DNA, 201 bp, Homo sapiens
gtcctgggcactgtgtctagtggataagtggatggtggatacaggcccagggcagggagcgtgagtgaggcaagggaggatgagctagagagtgatgtgaygggtccccatgtgttgggccctcatgctgctgcttcacaacacgccaaggagagatgcagcaagttgctcagcaggcgtgcatgcccagcccatgggaat

SEQ ID NO: 30258 - DNA, 201 bp, Homo sapiens
gcggatcacctgaagttgggagttcgagaccagcctgaccaacatggagaaaccctgtctctactaaaaatacaaaattagccaggcatggtggcacatgmctgtaatccctgctactcgggaggctgaggcaggagaatcacctgaacctgggaggtggtggttgtggtgagccgagattgagccattgcactccagcct

SEQ ID NO: 30259 - DNA, 201 bp, Homo sapiens
ggtgggcattgaacaatgagagcacttggacacagggtggggaacaccacacaacggggcctgtcgtgggatggggggaacagggagggatagcattaggagatatatctaatgtaaatgacgagttaatgggtgcagcacaccaacatggcacatgtatacatatgtaacaaacctgcacgttgtgcacatgtaccctag

SEQ ID NO: 30260 - DNA, 201 bp, Homo sapiens
ctgtcgcaaggacaaaaaaccaaacaccgcatgttctcactcataggtgagaattgaacaatgagaacacttggacacaggaaagggaacatcacacaccrgggcctgttgtggggtgcggggagggggagggatagcattaggagatatacctaatgtaaatgactagttaatgggtgcagcacaccaacatggcacatg

SEQ ID NO: 30261 - DNA, 201 bp, Homo sapiens
ttcatactaacttaatgctagtaacatatagaaatgttattgccacatagctaccttccctttcccctttttaatggtaatattgttatatatattacatytatgagtgttacaaaccccaatgacatattcttataattattaccttatataattttatatattttaaagaagctgaggttagaatggggagcaattata

SEQ ID NO: 30262 - DNA, 201 bp, Homo sapiens
gtgacctgtggccccatcgcacctcacagaaccaaagaaaccatgccaaaacccttctcaccccttcctcatctgctggcctttggctcctgccttcttgygctgtgccagaggtttctgatctccctcaaggaaatccagtttatcagagaagcctgtaagtgaagaagtagttttgatcagcaccattgtattttaaga

SEQ ID NO: 30263 - DNA, 201 bp, Homo sapiens
ttttcttcaattctctcacattttacaggtgagcttcagtccacaggataacactcaggtgtgtgtcactggaaatgggatgtttaagcttctccgttttkctgagggaaccctgaagcaaaccagctttcagaggggagaaccccaaaactatctagctcacacctgggtggctgatgacaagattgtcgttggcactga

SEQ ID NO: 30264 - DNA, 201 bp, Homo sapiens
caggaaataaagataagagcagaagttaataaaatagaaaacagacaaaagatcatcaaagccaaaatttgattctttgaaaacacgaaatagacaaacccttggcatgactgatgaagaaaaaattaagagtgtggagataccaacaaccaatatgaggattaaaaaggggatatcactaaaggtcctatagacattaaa

SEQ ID NO: 30265 - DNA, 201 bp, Homo sapiens
aacctgtacattgtgcacatgtaccctagaacttaaagtataataataataataaaaggatatctatgtgagaggcgaaaatgttttaaggaggagaggcraggcatcagctgggtcgaaacaatgcaaaagcattttacaaactctaaaaccagtcaacatatatcaagaacatactaagttccagacactggtgattga

SEQ ID NO: 30266 - DNA, 201 bp, Homo sapiens
ccaccatgcccagctaatttttgtatttttagtagagacagggtttcaccattttggccagtatggtctcgatctcttcacctcatgatccacctgcctcrgcctcccaaagtgctgggattacaggtgtgagccaccgtggccggccagctttcaagattttcttatctttggctttcaacattttgtttttgatgtgtc

SEQ ID NO: 30267 - DNA, 201 bp, Homo sapiens
ctgatgtaggaggatcgcttgcactcaggagttcgagactagcctgggcaacataaggagaccctgtttctacaaaaagtaaaaaatattagccaggtgtkgtggcacacacctgtggtcccagttacttgggaggctgcggtgggaggatcacttgggcccaggaggtcaaggctgcaataagccatgatcacaccactg

SEQ ID NO: 30268 - DNA, 201 bp, Homo sapiens
acctcaggtgatccacccacctcggcctcccaaagtcctgggattacaggcgtgagccaccgcgcctggcccacggacattattaatgagagctgctgagyctcctcagcttcagcaatataattagtcttcaagtgactgtggagatgcggatgaaagtacagaaagtgattctgatgcccaagctcaccagtccaggaa

SEQ ID NO: 30269 - DNA, 201 bp, Homo sapiens
tgagaatgtatcagtgaaatgactccaaacgtggacaagagttctgcagcccagatcccaagtgcttatgtccaaatgttgacgaagtcttaacacccacrccaatcttcctcacattcatttcttcccacaatcctaactttaaaatctgtcatcttctttcttagatgaccatgaaataaaaaaggaaaaccaagaaaa

SEQ ID NO: 30270 - DNA, 201 bp, Homo sapiens
tccgggccgggggcggggtcggagcggggcggtgctctccactctgaagcgctgccttggtcttcagcagaactgtttggcgggagatcatgtcagccgtkgtagctcagacgctgcatgtttttggtcttcgatcccacgtggccaacaatatcttctacttcgatgaacagatcattatatttccttcaggaaatcact

SEQ ID NO: 30271 - DNA, 201 bp, Homo sapiens
actctgatttttgctctctgcctatttctgtaaactttatattctttgcttctgtagattttcttttttccttcattctcaaaacctaaaactcatagtgrcctctaccgccttcaaagaaaagacttaaaaaattcagggggaaaaaattatacgaagaagtcacagtacaaaaggaagcaattacattgtacattgtgg

SEQ ID NO: 30272 - DNA, 201 bp, Homo sapiens
aaaattgagtgctactggcagtgaatttgactctgagttccagaagagagggaactaggaggggggacttccaggggcgggttccagggactgcccacctyggcatctgcacctgaggacccgtagcctgctcctgtaccccactgcagccagagtcatgtcagtggccatattaggatgtcttttttatctctctttttt

SEQ ID NO: 30273 - DNA, 201 bp, Homo sapiens
ggctgacagaactgcataccccttgtgtgagagaacttcctaccaagactccagtgtgagggcaaaacttgagtagccaggagaatgatgaaacggaggcragagagactgggagcaccatgtctgcggattcagtaaggaggttggggtctctatggaaactggcagatgtcaggaaaaaaaactaatgccaactaacac

SEQ ID NO: 30274 - DNA, 201 bp, Homo sapiens
cctaatccagtatgacttgtgtccttacgagaagaggggattaggacacagacaagcacagagggaaggccatgcaaagacaaagggaggtagccatttasaatccaaggaatgaggtcatagaagaaaccaaccctgctaatgcccttatcttggacttctagcctgaactatgaggaaataaatttctgttggttaagt

SEQ ID NO: 30275 - DNA, 201 bp, Homo sapiens
tcagataacataaaattaaccattttaaagtgtacattttagtggcatttcatgcattcacaatgtgtgcagccatcacctttatcaagttttaagacatkttcaccaccatcccctgcaaaaaaaatcctctacccattaaacagtcattattcattccaccctcattctagctagggcaaccactaatctgctttttgt

SEQ ID NO: 30276 - DNA, 201 bp, Homo sapiens
gtcatgattaccaataaccattctaacatgatactgtgattatagcaaactgctataatcttaaactgaattgggaatatttctaaccagaacaaaagatrtgatattctgttgaacattttatcatcagttctcatgttgaatatgatgtcattttgggtgccatattattattgaattttgttgagatgagattttcag

SEQ ID NO: 30277 - DNA, 201 bp, Homo sapiens
gagctagagctttgcagtgcctgctgtggatcaaagatcaagctatggtctaggaacctatagaatttaaggactggggtcccaggcaaggctttcagggrctccaggctgggtcctttttgcctcctttcctttcactgttctgggaccctcttctgcatctctccactctacccacaatttctcctttccctctcaccc

SEQ ID NO: 30278 - DNA, 201 bp, Homo sapiens
agataaagccaaacctcctgggttacattcccaaggggttggacactgttggtcacaagatgtttagggttgagggaacaagttaatgatgctaactaackaaaagatgcttatgaaacttatgaaatgtttcagtacttgaagatcaaaaagcattcttagtttaagaataggttttgctttcatacaaaattagctggg

SEQ ID NO: 30279 - DNA, 201 bp, Homo sapiens
ctgtgtaaatattacatcagatttagtcctaagaaagattactttggctgcaacatggatagtgaattggaagagagggcaggatgagccagggacatcakgggagaggtactcaaagcaaattcatgtgagatggggtggccagaactcagacagtgaatggtaggataatagagagaaagaggtggattagaggggtat

SEQ ID NO: 30280 - DNA, 201 bp, Homo sapiens
cacagcgtaacgggaacctggaaaaggaagtgctttagtcttccctggaaggaacattcagtgaatgctccctgggggacgtgaggcttattcagcaaacygaaggatgagtctaagtttcccagatcgggagcatgggaaggagcattcagtggggcacagggtgggtttgaagaagtgctgaggggtaagcctggaagg

SEQ ID NO: 30281 - DNA, 201 bp, Homo sapiens
ttgtcacagatcatgggagagattccgatgccagggaggagtgcaggtggcagggagggggcattcacaagggtggctcctggaggaatgtctgcggaggmaagttctgttactataacccttgtgtgcccctaaggagacctggcaggaggagggggaccacctgggtcactcaccccaggccttgtgtctcatagatta

SEQ ID NO: 30282 - DNA, 201 bp, Homo sapiens
ctcccgagtagctgggattacaggcttctgccaccacacctggctaatttttatatttttagtagagacagtgtttcaccatgttggccaggctggtctcraacttctgacgtcaggtgagccgcccacctcggcctcccaaagtactgggattataggcatgaaccactgcgcctggccagattataatttttttattaa

SEQ ID NO: 30283 - DNA, 201 bp, Homo sapiens
gtcctcctgaaagagtctcagggaccccaagaggtttgccaaccatactttgagaatcactgtccagcttgattgtagtgggtttctttttttttttttttaactgaaccagctcaagttttacagaattaaaacatgtatgtttataaaggatatggaactgtaattttcttagactgttgctatctggctttgaatcaa

SEQ ID NO: 30284 - DNA, 201 bp, Homo sapiens
tctgccacactgacgttaacagttgtctttctatccttttttaaattcctaggaaagtgatcctctctggtcagctattagaggtgggagggaaggtacasacacacagtacaaatgtggctcctagaaaccagagcagttctcaggaaaaaagagaaaggcccatcggccaagcagatacccaagagactctcatatagg

SEQ ID NO: 30285 - DNA, 201 bp, Homo sapiens
gcgtgagctaccgtgcctggccgttttaatagttttttaaaaatttctttgggattttctacatataggattgttttgtgtgtgaatgataacagttttayttatcttccaatcttttttatttgtttattcctatttgtttttttatttttttgtttttttatttgtttattccttattgcactggctagaacctctagt

SEQ ID NO: 30286 - DNA, 201 bp, Homo sapiens
gaacttctgaccttgtgatccactcaccttggccttccaaagtgctggaattacaggcgtgagctaccgtgcctggccgttttaatagttttttaaaaatytctttgggattttctacatataggattgttttgtgtgtgaatgataacagttttacttatcttccaatcttttttatttgtttattcctatttgtttttt

SEQ ID NO: 30287 - DNA, 201 bp, Homo sapiens
aaaaataaaaataaaaataaataacaaatatgttgaatagccaaatcttaaatgttgtattttaattttatggattaagtttttgtctctgttgtcatccygtaccaacattggtactgaagtatgatattggagaatgatttttgaccacttacttttcttgagctttttgcctaaaccaagccactttgaatatgtttc

SEQ ID NO: 30288 - DNA, 201 bp, Homo sapiens
ttagtagagacggggtttcaccatcttggccaggctggtcttgaacttctgaccttgtgatccactcaccttggccttccaaagtgctggaattacaggcrtgagctaccgtgcctggccgttttaatagttttttaaaaatttctttgggattttctacatataggattgttttgtgtgtgaatgataacagttttactt

SEQ ID NO: 30289 - DNA, 201 bp, Homo sapiens
tattaggtgtttttgtttttttatttgtttgtttttgtttgttttgacagagtcttgctctgtcacccagggtagagtgcagtggcgggatctcggctcamtgcagcctccacctcctggattcaggtgattctccttcctcagcctcccgagtagctgggattgcaggcgcctgccactgcgcctagctaatttttctat

SEQ ID NO: 30290 - DNA, 201 bp, Homo sapiens
gacatgaccaaacttatttatataagttttattaggtgtttttgtttttttatttgtttgtttttgtttgttttgacagagtcttgctctgtcacccaggstagagtgcagtggcgggatctcggctcactgcagcctccacctcctggattcaggtgattctccttcctcagcctcccgagtagctgggattgcaggcgc

SEQ ID NO: 30291 - DNA, 201 bp, Homo sapiens
ctgactttgcatgtcaagaatcaaactgtgggtatttgttaatctttgacatgagatgacactatcaaaaaagaacagaattttttttaaaaaaataagcyttgatacttctgaggaggcctgatccttattaagtcctggctaaggaaacagctactcaggatcacttcccttatatcctggtgcccactagccagaaga

SEQ ID NO: 30292 - DNA, 201 bp, Homo sapiens
tctcctgacctcgtgatccacctgcctcggcttcccaaagtgttgggattacaggcgtgagccacagtgcctggccccagaagaaagaattagtgagctcraagacaggctatttgaaaatacacagccagaggagacaaaagaagaaaaagataaaaaggaataaaaagcatgcctacaagatctagaaaatagcctcca

SEQ ID NO: 30293 - DNA, 201 bp, Homo sapiens
ggcaatttacaaaagaaagaggtttagtggacttacagttccatgtggctggggaggcctcacaatcatggcagaaggtgaaaggcatgtctcacatggcrgcagacaagagagagcttgtgcagggaagctcccctttataaaaccatcagatgggccggacgtggtggctcatgcctgtaatcccagcactttgggagg

SEQ ID NO: 30294 - DNA, 201 bp, Homo sapiens
ggactatagaggaagtatcctgatgacagcaaaactgtggtggtaaccactgccatttctgttgcttaggtccttatttaaatatgatttgccaccattgsgggactaaacaggtttttgtgaggacaaatgtatggtcctgaggggatgtggcagggagaattattagtctaggccacccccacatgagcagggctcaca

SEQ ID NO: 30295 - DNA, 201 bp, Homo sapiens
aagcaatggggaaaggattccctatttaataaatggtgctgagaaaactggctagccatatgtagaaagctgaaattggatcccttccgtacaccttatayaaaaattaattcaagatggattaaagacttaaacgttagacctaaaaccataaaaaccctagaagaaaacctaggcattaccattcaggacataggcttg

SEQ ID NO: 30296 - DNA, 201 bp, Homo sapiens
aaactatactacaaggctacagtaaccaaaacagcatggtactggtaccaaaacagagatatagatcaatggaacagaacagagccctcagaaataacgcygcatatctacaactatctgatctttgacaaacctgagaaaaataagcaatggggaaaggattccctatttaataaatggtgctgagaaaactggctagcc

SEQ ID NO: 30297 - DNA, 201 bp, Homo sapiens
cctcagtcccctgcaatactgagagaagcctgcttggtatcaaaggaagtcacttctgttccttttctaaatccaaaattatattactttgttgtattacrcgaagctccaccatgggtagtagtcataagtatttgactaggaggtttgctacccaaagccaaaaagtggctccagtggctgtgacgggctttcttctac

SEQ ID NO: 30298 - DNA, 201 bp, Homo sapiens
ttcttttcttcagctagatttgggtttggcttgtttttgcttttctagtttctttagctatgatgttaggttgttaattgagatctttctttttgatgttragcatttagcactataaatttttgtcttttttttttttttttttttttttggagacagagtctcactctgtcgcccaggctggatgcagtggcgtgatct

SEQ ID NO: 30299 - DNA, 201 bp, Homo sapiens
ggattacaggcatgagccactgtgcctggcctctttatcccgtttcaaaagataaattaattgtgggagatcaacataacaatcatcactgatttttttttaaccatttaactctggttcaaaagataaataataatctataatccaccagtgtatacaaattttttatcacattttcccttatgttgtaaaaaaaaagaa

SEQ ID NO: 30300 - DNA, 201 bp, Homo sapiens
gaagctctttagtttaattaagtctcatttgtccattttcgttttggtcatatttgtttttgaggtcttagtcataaattatttgcctaggccaatgtccrtaagagtttttcctaggtattcttttagggtttttatagtttcaggtcttaaatttaaatttttaatccatcatgtgttaatttttatatatggtgagag

SEQ ID NO: 30301 - DNA, 201 bp, Homo sapiens
gctgagggacttagattcctcctcagtcccctgcaatactgagagaagcctgcttggtatcaaaggaagtcacttctgttccttttctaaatccaaaattrtattactttgttgtattacgcgaagctccaccatgggtagtagtcataagtatttgactaggaggtttgctacccaaagccaaaaagtggctccagtggc

SEQ ID NO: 30302 - DNA, 201 bp, Homo sapiens
tgggaggccgaagcaggcatatcacttgaagtcgggagattgagaccagcctggccaacatggtgaaacaccatctctactaaaaatacaaaaattagccrggcatggtggtgcaggtctgtaatcctagctgctcgggaggctgaggcaggagaatcacttgaatccgggaggcagaggttgcagtgagccgagatcgtg

SEQ ID NO: 30303 - DNA, 201 bp, Homo sapiens
aggaaagtaggttgttatcctgagatagctgagaagtagcattcgtaactctgctgcttggctgtgaacctccttgtatatggaactaggatcttgtttcycatttgcatgtctctttttttgttaagagatggagtcttgctctgtcacccaggctggagtgcaatggcaccatctcggctcactgcaccctctgcctcc

SEQ ID NO: 30304 - DNA, 201 bp, Homo sapiens
actggaaactccaggaataagaaaggctctagaactcagtacccgttaaagtgggagtatgtagctgctgaagatggtgggaggggcagggtctctggggwtggccatctttcttcttgatagttccatagcactaaagtaacacaatcatttctttcttttttagtcccggacgatccccagtatcctttgacagtgaaa

SEQ ID NO: 30305 - DNA, 201 bp, Homo sapiens
ttaggagtaggtccctttctaggtctttctagcctagaagaggtctttgtgaaaaccaagcctagctccatatagtaccattttgaactgaacaaggtacrctggaaactccaggaataagaaaggctctagaactcagtacccgttaaagtgggagtatgtagctgctgaagatggtgggaggggcagggtctctgggga

SEQ ID NO: 30306 - DNA, 201 bp, Homo sapiens
tggacatggtggcatgcacctgcagtttcagctgcttgggaggctgaggcatgaggatcacttgagcccagaagtttgaggcagcagtgagctatgataaygccactgcactccagccaggacaacagaacagaatcctgtctctaaaaaaacaaacaggctgggcgcggtggctcacgcctgtaatcccagcactttggg

SEQ ID NO: 30307 - DNA, 201 bp, Homo sapiens
cttgaacccaggaggcggagattgccatgagccgagatcacaccactgcactccagcctgggtgacagagcaagactatctcaaaaaaaaaaaaaaaaaaatcccctttcccataactcttcactcaaacaagtgatttttttagaaccaaggtaagtctcatctgcaaattttaagacttaactcattgctccagcttat

SEQ ID NO: 30308 - DNA, 201 bp, Homo sapiens
tctttctcatgtttgggattcttagagattcttagatttgtgatgttacaagaaaaacttgggactgcaacgtcccatctaaactgggaaggagccatgagaccaaagaatgactcagacaaatttaacttgatgagtagacgagtttattcaacttacatacaaggcactcctggacggcagcaggacagctctagagat

SEQ ID NO: 30309 - DNA, 201 bp, Homo sapiens
ttttttcatggttttgcttttggtttcatatcctaaaaattcatcgccaaacccaaggtcacctagattttgtcctatgttatcatatacaagttttatcrttttttgtttttacatttaggtaaatcttacattcggatcattttcatgacccattttgagttaatttttgtaaaaggttgtatctagattcattttttt

SEQ ID NO: 30310 - DNA, 201 bp, Homo sapiens
atcacgatcaaaattgtgaatacatctgtcatctcctaaagtttccctaggtccttttgtaattacttgcaggcaaccactgatgtgctttttgtcactcrtagattactttggattttgtagaattttatctaaatggagttatatagtatgtactgtgttttttgtctggcgtcttgtcctttgtatttccatatgaat

SEQ ID NO: 30311 - DNA, 201 bp, Homo sapiens
ttctcactgtcataattttggcaaaggcagtttcaaaattattgattttattctgtcaacaaactttaaaatggtggtaattttggcttttttttttttttgaaagagtcttgctctgttgcccaggctggagtgcagtggtatgatctcagctcaccgcaacctctacctccctggttcaagcaattcccctgcctcagc

SEQ ID NO: 30312 - DNA, 201 bp, Homo sapiens
ctcaaaaacaaacaaacgaaaccaaaaaaagaaaagaaaaagaaaaaattatagtagttatacaagtgcgctcctcccctggtaagaattgtgtagtcatrctagcatcctccccatcccctcttcctcagatcaaccagaaaaacagagaaaaagtcccacgttaagtatgagcacatacgtccttatgatcgcctgtaa

SEQ ID NO: 30313 - DNA, 201 bp, Homo sapiens
tagatactactgtcacattaatccaaagatgtcattggtctttggcaactgttaagtttaagatctttctctaataaacattccccttcccgggccaggcrcagtggctcacacctgtaatcctggcactttgggaggctgaggcaggctgatcgcaaggtcaggagatcgagaccatcgtggctaacatggtgaaacccc

SEQ ID NO: 30314 - DNA, 201 bp, Homo sapiens
gaagtggtctggtccccaatccttcagagggtattttcccagcaggagctgttaccttctttgtttcaaagtaaactaaattcctaccaaagttagttttsgcctaagctcagaaatgtacaagggcagcttggaggttagaagcaagatggagttggttaggtcagatttctttcattgtcataatattcctagtcagat

SEQ ID NO: 30315 - DNA, 201 bp, Homo sapiens
acttcgagaccattaagctcatcagcaatggcgcctatgggtaaaggcaggggtcagggtgtggccaggactgaagccgggtcagcctttgatctcttccrtgtgagagtgtatgctgcccagtcctctgggcagatgcctcggggtggaccttctcactcccagaagcctcctgggtgggcaggagttcagattcctctg

SEQ ID NO: 30316 - DNA, 201 bp, Homo sapiens
tctgcctcctgggttcaagcaattctcctgcctcagcctcccaagtaactaggattacaggcagccgccaccacgcctggccaatttttttttttttttttttgagacgaagttttgctcttgtcccccagtctggagtgcagtggcacgatcttggctcactgcaacctctgccttccggattcaaacaattcttctgcc

SEQ ID NO: 30317 - DNA, 201 bp, Homo sapiens
tgttttgcataacacatttattaattttttaaaaattattattgtttttttttgagtcagagtctctgtcacctaggccatagtgcagtggctcgatctcrgctcacggcaacctctacctcctgggttcaagtgattctcctgcccagcctcctgagtagttgggattacaggtgtgtaccatcacgcctgtgtaatttt

SEQ ID NO: 30318 - DNA, 201 bp, Homo sapiens
atttttttcagtaagtataatgtttttgagatccgtctaaattgttgcatgtatccactcagttctttccctctttgtgtgtagtattccattgtatggtbacacatcacttggttatttactcacatgttgatagattttatgtgtttgttttttgaatctgcaccactggcaatggatttttttaaagctattaacttt

SEQ ID NO: 30319 - DNA, 201 bp, Homo sapiens
ggcagatacactggtggggctggccgtgtgccacatgccacacacacttaagcaatacaaagaagtttactccatacccagaagaggggaaaagtttctgytaataaggaagaagaatctgtggccaagtgacagcttgccacacagcttccttatgagggaaagttttagacccaggccactaattgggtagtcttggag

SEQ ID NO: 30320 - DNA, 201 bp, Homo sapiens
ccatctcccagtctcaggtgatcctcctgcctcagccttccgagtagctgggatcacaggcacaagctaccatgcctggctaattttttttttttttttttaatttgtagagatggagtcttgctatgttgcccagactggtctcgaactcctgggctcaagtgaccctcctccctcagccttccaaagtgttggaattaa

SEQ ID NO: 30321 - DNA, 201 bp, Homo sapiens
cctttctctctttttcttcttgtattactgctgcatacgtatcacaccttttgtaattgtctcacagttctcggatgttctggtgttggttttttttttttcggtccttttttctttgctttttagttttggaagtttctgttatcatatcctcaagatcaaagattatttccccagcagtgttcagtctattaatgagcc

SEQ ID NO: 30322 - DNA, 201 bp, Homo sapiens
attgtaggtgtgtggctttatttctgggttctctattctgttctataggtctatgtgtctgcttttgtaccagtactatgcttttttttttttttttttttaaacactgtagccttatagtatagtctgaagctgggtaatgtaatccctgcagctttgttctttttgcttaggattgttttggctatttgagctcttttt

SEQ ID NO: 30323 - DNA, 201 bp, Homo sapiens
ggtttttgggtagacgttaatttttaacttatttgggtaaataaggagcacaattgctatattgaatggtaagagtgtatttgattttgtaaaaaaaaaamaaaaaaaaactcttcaagctgggcgtggtggctcacgcctgtaatcccacactttgggaggccaaggtgggcagatcacttaaagtcaggagttcaagac

SEQ ID NO: 30324 - DNA, 201 bp, Homo sapiens
tataggtttttgggtagacgttaatttttaacttatttgggtaaataaggagcacaattgctatattgaatggtaagagtgtatttgattttgtaaaaaamaaaaaaaaaaaaactcttcaagctgggcgtggtggctcacgcctgtaatcccacactttgggaggccaaggtgggcagatcacttaaagtcaggagttca

SEQ ID NO: 30325 - DNA, 201 bp, Homo sapiens
tgactttttaatgatcgccattctaactggtgcaagatgatatctcattgtggttttgatttgcatttctctgatggccagtgatgatgagcattttttcrtgtgtctgttggctgcataaatgtcttcttttgagaagtgtctgttcatatccttcgcccactttgtgatggggttgtttgtttttttcttgtaaatttg

SEQ ID NO: 30326 - DNA, 201 bp, Homo sapiens
cagcttcatccatgtccctacaaaggacatgaactcatcattttttatggctgcatagtattccatggtgtatatgtgccacattttcttaatccagtctrtcattgttggacatttgggttggttccaagcctttgctattgtgagtcatgccgcaataaacatacaagtacatgtgtctttatagcagcatgatttata

SEQ ID NO: 30327 - DNA, 201 bp, Homo sapiens
agcccctctggatcctgaaactctgccctgctctgtaggcagaaaagggaagatgcttgagctgatcccctaggtatagcttctgaaggtctggcttcttrctagatttgctgacctagactccatgctgctcatcctacccccttgcccatgtcctccctgtccacaggcagtgcctatgaggtgaagcagcacccattc

SEQ ID NO: 30328 - DNA, 201 bp, Homo sapiens
agggtattgaaatccaggtaagcaataaataatatatcaataataatataatggatacgtaataatatctccctttattggggagggaatatgtatttttytcccactctcacttccccatcttaaccaggacatcttggttgttactctgaaatattatagcatctggaagtgcttgactgtaaccagctccacattctt

SEQ ID NO: 30329 - DNA, 201 bp, Homo sapiens
aacacctattaaaccttgaataataacaactactttaggacagaaaaaaacaaaacaatatgtaatttctaaaccaatagagcagaggttaaaaaaaaaaacttgattaattcaaggagagttgccatcagacttggaggaaaactttaccttagagcaaagacttttctcctagttcctctgatgcctgctgcccttgcg

SEQ ID NO: 30330 - DNA, 201 bp, Homo sapiens
gtttgggaggacaagacgggcggatcacttgagcccaggagttcaagaccatcccagacaatatggtaaaaccctgtctctacaaaaaatacaaaacttaktcaggcatggtagcatgggcctgtggccccagctaccctggaggctgaggtgggaggatcacctgagcccaggaaatagaggcaacagtgagtggagatt

SEQ ID NO: 30331 - DNA, 201 bp, Homo sapiens
agtctcgctctgtcgcccaggctggagtgcagtggcgcgatctcggctcactgcaatctccgccacccgggttcacgccattctcctgcctcagcctcctsagtagctgggactacaggcacctgtcaccacgccctgctaatttttttgtattttagtagagatggggtttcaccgtgttagccaggatggcctcgatct

SEQ ID NO: 30332 - DNA, 201 bp, Homo sapiens
cttcttagtgtctttagccaaagtggcatactttaggataacatttcctggtcccctttagaagaataatacaagattcagtgtcagtgtatggaagccartcaatccccaattctgtcctggagaacacagggaaggcttcagagagaaggaaatttgagctgagaagtgaaaaattaacatgtattaggtatacatttg

SEQ ID NO: 30333 - DNA, 201 bp, Homo sapiens
tcctaaattgatataatgtcttactaaagaggtgtgacccacatttgaaaaagcactggtttgcctatgagttagtcctttgaacattaccctagaaaaarcagtttgatacgctttgtcatctaggtgaatgagagaagcccctcagagttggcagagccgctgaagcaggggacaagacttgcttctctttggctctct

SEQ ID NO: 30334 - DNA, 201 bp, Homo sapiens
atctccagtgattaagaatcttcctggtacatgagatagaacacctttacaaatgcaaatttatattacttttacaaaagggaaatttataccttacttttaggcagaaagggggaaggcagagagtttgttgcttcttagtgtctttagccaaagtggcatactttaggataacatttcctggtcccctttagaagaata

SEQ ID NO: 30335 - DNA, 201 bp, Homo sapiens
cagacttcatcaactaatgtgttatttaaagtaaaggtcacttgttaacaaaattaaaaatttttaaatggagtttgtagcttaagaaaacttaaatggtyaaaaatcatggttctgtttttgtttttgagagtgtcttactttatggcccaggcgggagggcagtggtgctatcacagctcactaaaccttgacctcctg

SEQ ID NO: 30336 - DNA, 201 bp, Homo sapiens
caacatgctaagtttctggtaaacctctcttcctggcttgcagagagtggccttcttgctgtgtgctcacatggcctttatgtggtacaccagcctgaggrtaggggcatagatctgtctcttcttctttttcttcttccttctccctccttccttattttttccttcattttcaagcccaacagtcctataggattagag

SEQ ID NO: 30337 - DNA, 201 bp, Homo sapiens
gtcctgggtttatggcctctgttctagtgtgttctagtgtgttacagctccattcgtcttgggtcatttgatgaggagtccactaatattttgtactaccrtgcccaaggattagggctcacagagagggtttttcgtctaatgggactcctgttaaccttcctgctcttagattaggagataacaaaagcaagaggagta

SEQ ID NO: 30338 - DNA, 201 bp, Homo sapiens
cctcaaactcctaggctcaagcagtccttccacctggcctcctgagtagctggatctaaaggcattataccaccatgcctgggctttttttttttttctcmagtcacttttgtttttatttattctaatattatttgtttgtttatttattttctttctagaaatgagatctcactacgttgcccagggtgatcctaaacc

SEQ ID NO: 30339 - DNA, 201 bp, Homo sapiens
aatggttatatgataggagtagacaaaggaaatagaatatttttgaggatggcagaagatgagttcaactttagttcctaaaataccctcagtgtgacagraattttaaaaaattattttaatggaaatcagaacctctttcctctgcattacagggttagtacattgggaaaagcatagggcagaaagcacacagaaggg

SEQ ID NO: 30340 - DNA, 201 bp, Homo sapiens
tttactacagccatagccacagagctgacaggtaatagcgggtataatggggagaggggctgggaaactgctatgcatggccagacaatatggtttgtgaygttgtggttggtgaaaactggttgtgatgattcttctctgactgtgggtatgaacattgggcctttcatgtcttgcaaagaggcccaaagggatctccct

SEQ ID NO: 30341 - DNA, 201 bp, Homo sapiens
ataagtcctatacatctatatttttataaaactccagtcctatacatctatatttttataaaactccactgacctagaaggtgctggattgaaatgttaaragtaaggttgttaccaagtaaacattttcagtttttattatttatttattcattcattttagacaaggtcttgctctgttgcccaggctggagtgcagtg

SEQ ID NO: 30342 - DNA, 201 bp, Homo sapiens
gagctgcaacgagtaggcttactaaagaggcgttgaggagttatccataggagtaaatagagtaagatgtaagtcaatttgatgtagtgttatcctgtttyctagaggttgtccttaaaattgtaaaaacggatgacactcccaagcattctctgatttggccatcattatacttttgtaccagtgtgttcacaatcattg

SEQ ID NO: 30343 - DNA, 201 bp, Homo sapiens
tctctgggctgtcctcttatacaacatagtaagaaaagctgctggttattggtgggatggggagaagtgtttcaaccctgccaaacagagtatcaggaatygtttgtttctgtgttactggctggcgctttggaggatcacattggtttgcaatgtcaaacaaaagacagattgaattgaacactaaggatagacccattg

SEQ ID NO: 30344 - DNA, 201 bp, Homo sapiens
ctttctcttgcctaattgctctggctaggacttcctatgtggaataggagtggtgagagtgggcattcttgttttgttccagttctcaaggggaccgtgtyttttgcccagcatgatgttacctgcaggtttgtcatagacggctcttattattttgaggtatgttcctttgatgcttagtttgttgaggtacttgattgt

SEQ ID NO: 30345 - DNA, 201 bp, Homo sapiens
ataccttcatttgttgaaagctgtgtcctggcgggaagacaaatgagtagtgggagagaaagacaaacaaatatatgtttataaattatgacaagcaccayagagggaaagagcatgatgctgcatgaaagaacaggaagagggccgggcacagtggctcacgcctgtaatcccagcactttgggaggccgaagcaggcat

SEQ ID NO: 30346 - DNA, 201 bp, Homo sapiens
acctgagaacttctctttccccttaaaacacacatgttcctggtttagcccttggatacagtgcgcagagatatatatgcaagaaacttttggattagggktcctgttgccctttgagaaagtgtgaacatttggctataccctctgactgaatgagctctttaagccttctgaatgttggttcacttgacaaagacagat

SEQ ID NO: 30347 - DNA, 201 bp, Homo sapiens
tgattccgtgtctttgctatagtgaatcgtgctgtgatgaacatgtgagtgcatatgtctttttgatagaacgacttattttcctttgggcatatttccartgatgggattgctgggttgaaaggtaattctacttttagttctttgagaaatctccaaactgctttccacagaggctgaactaatttacaattccaccaa

SEQ ID NO: 30348 - DNA, 201 bp, Homo sapiens
aagcttctgagctttaagttagcaagttacagggaacacgtgaatactaattaagaaatggcggtatgctttgtagacttgggggccttgattacgaactrtcttaaggtttactactatcctgagtccctacctgagaacttctctttccccttaaaacacacatgttcctggtttagcccttggatacagtgcgcagag

SEQ ID NO: 30349 - DNA, 201 bp, Homo sapiens
ctgtagtattctgtggtatgtgtatatgtaccatattttctttattcagtcctctgttgatgggcacctaatttgattccgtgtctttgctatagtgaatmgtgctgtgatgaacatgtgagtgcatatgtctttttgatagaacgacttattttcctttgggcatatttccaatgatgggattgctgggttgaaaggtaa

SEQ ID NO: 30350 - DNA, 201 bp, Homo sapiens
aaaaagaacagaattttttttaaaaaaataagccttgatacttctgaggaggcctgatccttattaagtcctggctaaggaaacagctactcaggatcacktcccttatatcctggtgcccactagccagaagatggggagaggtcataacagatatccctgacacagagcatggaaaacccagagttcatgcaatgttga

SEQ ID NO: 30351 - DNA, 201 bp, Homo sapiens
atactggactgcagaacctgtgccctgtggtctgtgctttccagctttggagtgggcactagacaataagcatgaagaaggaggcagaacaaacacctagsaattcattttgacgtatatggtgtttatgaagtttgcaagtatataatgttgagaaatgtatctcatgcttgtcctcctcctccttgtatgttaggtgtt

SEQ ID NO: 30352 - DNA, 201 bp, Homo sapiens
atgtttggttggttctcagggatacctgctcctcagctgggtaccattgccatgggcctagccttcaggtttcaggcagtgaacatatgtacctttaagtratctggtaaaggacccatcacacaacatgtgggtatatggtttttatcaaatttgcaaaatggtccgccattatttcttcctatcttttttctgtatccc

SEQ ID NO: 30353 - DNA, 201 bp, Homo sapiens
atgtttttccatttgtttgtgttgtctgtgatttctttcatcagtgttctttagctctccttgtagaggtctttcatcttcttggttaaatgtattcctargtattttattttggttgtggcaattgtaaatgggattgagttcttgatttgattctgagcttgaatgttggtatatagaaatgcaactgatttgtgcatt

SEQ ID NO: 30354 - DNA, 201 bp, Homo sapiens
cctggactcaagtgatcgccctcctcagcctcccaaactggcatgacaggcgtgagccactgtacccggctccctctaaactgcttttaagctaattttcwggatctttgcctactgtgtttgaacaatgatactgtttttcttgagagattctcagatactctctgggatgtttggttggttctcagggatacctgctcc

SEQ ID NO: 30355 - DNA, 201 bp, Homo sapiens
tttttagacatggggtgttttgccatgttgcttaggctggtctcagactcctggactcaagtgatcgccctcctcagcctcccaaactggcatgacaggcrtgagccactgtacccggctccctctaaactgcttttaagctaattttctggatctttgcctactgtgtttgaacaatgatactgtttttcttgagagatt

SEQ ID NO: 30356 - DNA, 201 bp, Homo sapiens
aatttttgtttttgttgcaattgcttttgaggactcagtcataaattgtttcccaaggtcagtgtctggaatggtgtttcctagtttgtttgtttgtttttccctaggattcttacagtttgaggtcttacatttaaatctttaatccatcttgagttaatttttgtatgtggtgaaaggtagggttccagtttcattctt

SEQ ID NO: 30357 - DNA, 201 bp, Homo sapiens
cacttgagccgaggagttcgagaccagcctgggcaacatagtgaaaccctatctcttatatttaaaaaacaaaaacaaaaaccacacaaaaaaacctgtamatcaataaaataaaaagatagtatgattgaaaaatggccaagggacttggacagttcacacaaaagagatccaagtggtcaataaatgcatgaaaagata

SEQ ID NO: 30358 - DNA, 201 bp, Homo sapiens
tacatcagtttgagggagaattgccatctcaacaacactgagttctaatccaagaacggaagttctctatttatttagggtttttttttttttttttttttgagatggagtttcgctcttttgcccaggctggagtgctgtggcacaatttcggctcactgcagcgtccacaccacccccaccccgggttcaagtgattct

SEQ ID NO: 30359 - DNA, 201 bp, Homo sapiens
atacatcagtttgagggagaattgccatctcaacaacactgagttctaatccaagaacggaagttctctatttatttagggtttttttttttttttttttttgagatggagtttcgctcttttgcccaggctggagtgctgtggcacaatttcggctcactgcagcgtccacaccacccccaccccgggttcaagtgattc

SEQ ID NO: 30360 - DNA, 201 bp, Homo sapiens
cacacctggctaatttttttgtatttttcctagaaacggagtttcaccatgttggccaggctggtctcaaactcctgacctcgtgatctgcccaccttggyctcccagagtgctgggattacaggtgtgagccaccgtgcctggcccaatttttcaatttctacaaaagaccttgctggcattttgataatgattactttg

SEQ ID NO: 30361 - DNA, 201 bp, Homo sapiens
tataattcctccaactttgttctttttcaaaattattttatgtgttttgggtgctttgtgttgctatataagtatgaggatcaatttttcaattttttttkgggggggtggggtcgcaggggacagtcttgcttggtagcccaggctggagtgcaatagcgcgatctcagctcactgtaacctctgcctcctggattcaag

SEQ ID NO: 30362 - DNA, 201 bp, Homo sapiens
tggcctcccaaagtgctgggattacagatgtgagccaccgcgcctggcctgttttttgttttgttttgttttgttttgttttgttttgttttgttttgttkatcttatgtgaagggaatcagtttcctgtcctgggaaattgagatagatgcattcattcattcattcattcatacattcaactgcatactaggccctctg

SEQ ID NO: 30363 - DNA, 201 bp, Homo sapiens
gggggagttgttggtggtgaagccccttggagtttgccatttacatagctaactgattgctcagctgaggaaaaccttggcttcctcttctggcccacgtwgaaagaggaattatctgtagtagtcatgcttgttatgtagactctgggactctgagaggtgagaatgcatctagaaggcagcagcttttctttcatgtcc

SEQ ID NO: 30364 - DNA, 201 bp, Homo sapiens
gggactcagctttgctgaaagggctgcagcacttctgtgcagttcattgctacactctttataatggaagatctaaacctacagttagtggcaattgacaracttagaactgttcagagcttgctgcctgggcatagaaagccatggtcactgttgtcctaagcctggaccttgtctgtctttgggcgttaaagcaggata

SEQ ID NO: 30365 - DNA, 201 bp, Homo sapiens
gttgcataataacaaattttgaaatatgtgtaaagctattgatttttaaaaaataagcacatgttaaatatttaactcattgttagtaaggaaatctggcmgatatattagccagttcaaagaagtaaaagaaccacaaagtgatatgtggtatgtgtatgtgtagtgttgaaataaatgtattatttattataaaattga

SEQ ID NO: 30366 - DNA, 201 bp, Homo sapiens
ctattgtcattgataacatcttatcaggagatagagttttgagatcaaccggtctgaccacaatttattaggcgggaatttcctcttcctaataagcctgrgagcgctatgggagactggggtctatttcacccctgcagcctcaaccataagagacaggccacgcccaggggggctgtttataagccaatacctccaggc

SEQ ID NO: 30367 - DNA, 201 bp, Homo sapiens
tcatttctcctcttacagcagggaaagcgcatcttgagagtatcttcagaagaagtgattctcttgttagagtagggaaggttttttgattttttttttttgttttttcattgaaaaggtaaaataatgaagactagtgctgtgctttaacttcaggaacccttatatgcgacagatagtttttcatagaccctggctcca

SEQ ID NO: 30368 - DNA, 201 bp, Homo sapiens
ggtaaggctgtcttcctctccttacttcttcctcatggaatctctgattgctaacctgtaggacctgatagatatttcttggttgatcaccactagtggtmactctctcttactctgatttttgctctctgcctatttctgtaaactttatattctttgcttctgtagattttcttttttccttcattctcaaaacctaaa

SEQ ID NO: 30369 - DNA, 201 bp, Homo sapiens
ctaatggttcttgtctctgtactgtctagatcagtttgatgtgttacttatctgtatttgttacagcttccttcattgacatataatagatatacctcatygggctgatttttttcgaaagtttcttatttattataatactcctgattaggtgggtgttggcttaaaaatgtctacatgttgatgatattattggacact

SEQ ID NO: 30370 - DNA, 201 bp, Homo sapiens
gtggcactgtctcggctcactgcaagctccacctcctgggttcacgccattctcctgcctcagccttccgaatatctgggactacaggcgcccgccaccaygcccggctaatttttttgtattttttagtagagacagggtttcattgtgttaaccaggatggtctcgatctcctggcctcgtgatccgcccacctcagcc

SEQ ID NO: 30371 - DNA, 201 bp, Homo sapiens
ttggatcactgcaacctctgcctcctgggttcaagcaattctctgtctcagcctcccgagtaagccggggttacaggtgcctgccaccacgcctggctaayttttgtatttttagtagagacagggtttcatcatcttgaccaggctggtcttgaactcccgacctcatgatccacctgcctcagactcctaaagtgctgg

SEQ ID NO: 30372 - DNA, 201 bp, Homo sapiens
gccagttacttgaagcttgtttttcaaatggcaggtgacatggggtcagttattctcttttttttttttttgagacggagtctcgctctgttgctcaggckggagtgcagtgacatgatcttggatcactgcaacctctgcctcctgggttcaagcaattctctgtctcagcctcccgagtaagccggggttacaggtgcc

SEQ ID NO: 30373 - DNA, 201 bp, Homo sapiens
caggctggtcttgaactcctgacctcaaatgatccacccacctcagcctcccaaagttctgggattacaggcatgagccaccgtgcctggctattttcagygttttaatcttgatgctgcttagtgggtctgttcaatttgtgaaaattcattgagttctatgcttaggtatgtgtacttttctaaaatgagtaatgtact

SEQ ID NO: 30374 - DNA, 201 bp, Homo sapiens
tggggtttcaccgtgttagccaggatggcctcgatctcctgacctcatgatccgcccgcctcagcctcccaaagtgctgggattacaggcgtgagccaccrcgcctggcctacgaggattttattagaaagagaattgttgcatattgttttgaaagaaaagtcattggtacttgcaaagtttttagaagctggcaagctc

SEQ ID NO: 30375 - DNA, 201 bp, Homo sapiens
atgtattccttatatatgtagctgggaccacaggtggatgccaccatgcctggctaattttttgacttttttgtagagacaggatttcgccatgttgtgcrggctagtctctgctgggcaaggtgtcagaacccggcagtggagagtggttggctcactggtggtaaaagaatttactgacagcagtataggtttagaaag

SEQ ID NO: 30376 - DNA, 201 bp, Homo sapiens
catttcccactatcatgtggaggaatcccgctcagtacacaatttctttctgtgtactcctatctgagctagggaagccagcaggccaactgacttctccsactaggtcagatcttcccctcctccccattcctcccgacctccaaacctcttccctctcagtttctacatagcattctgggaaagttacaacttaaatat

SEQ ID NO: 30377 - DNA, 201 bp, Homo sapiens
acattctttctaaaagaccattttttggcaatgaggaaagtccatcaaaacggtttcaaggtatttcatttctcctcttacagcagggaaagcgcatcttsagagtatcttcagaagaagtgattctcttgttagagtagggaaggttttttgattttttttttttgttttttcattgaaaaggtaaaataatgaagacta

SEQ ID NO: 30378 - DNA, 201 bp, Homo sapiens
agccaagattgcgccactgcactccagcctgggagacaaaatgagactccgtctcaaaaaaaaaaataaaaaataaaatttaagaggcaaagaaaaagttrttatttagaaatatgtggccttttccattattaagataatgctgtgaatttcctaggacatttaggtagaccaacaggactcagatgggttcttatttct

SEQ ID NO: 30379 - DNA, 201 bp, Homo sapiens
gccctcctgccctctcatgcattctcactaattgtttctgctgaaaactggcctgttggggctcagcaggacatggactgaaatgaaaaacactttgaattacattctttctaaaagaccattttttggcaatgaggaaagtccatcaaaacggtttcaaggtatttcatttctcctcttacagcagggaaagcgcatctt

SEQ ID NO: 30380 - DNA, 201 bp, Homo sapiens
ctggcacatggttttgagtatctcttgatgactatggtctcagaacacacaacctggagcaacatcttacagctttggagcttgttaaatttcatgttttkttttttttttttcatagacttactaacatgtgtggtcactgtattagtgcttcattccattcttcttttgtatccatgccatgcaaagtgccagttcatt

SEQ ID NO: 30381 - DNA, 201 bp, Homo sapiens
agtcctggcacatggttttgagtatctcttgatgactatggtctcagaacacacaacctggagcaacatcttacagctttggagcttgttaaatttcatgkttttttttttttttttcatagacttactaacatgtgtggtcactgtattagtgcttcattccattcttcttttgtatccatgccatgcaaagtgccagtt

SEQ ID NO: 30382 - DNA, 201 bp, Homo sapiens
ttacatttactcaccactcactcagtcacccagagcaagttctagtcatgcaaaccccactcatggtaagtgccctatacaagtgtaccatttctatcttttacatgtatttttactgtaccttttttatgtttaaatgcacaaatacttaccattgtgttacagttgcttacagtattcaatgcagtaacatgctataca

SEQ ID NO: 30383 - DNA, 201 bp, Homo sapiens
gtttctttagctatgatgttaggttgttaattgagatctttctttttgatgttaagcatttagcactataaatttttgtcttttttttttttttttttttttttggagacagagtctcactctgtcgcccaggctggatgcagtggcgtgatctcggcttactgcaacctctgcctcccaggctcaagcaattcttctgcc

SEQ ID NO: 30384 - DNA, 201 bp, Homo sapiens
aaccaactatccctttatttcagccttttcatatcagtttgcttttggtatatctcttgcaaatggcatacagtaggttttctttaaaaaaaaaaaaaaaagtcctgtttgtaatgaaaagtttgtctgtgtacatttattatgattaatgatatatttggacttgtttgtgccatattattttttgtattccatatccta

SEQ ID NO: 30385 - DNA, 201 bp, Homo sapiens
ataaatgtaccagtgtaggtgtctttttgataaaataattttcttatgctatgtcataaggcccaagggaaaaaaaagagctttacaattaaaaaaaaatwtttttttttaagatttcttttcccggcccagcgcgatggcttacacctgtaatcccagcactttactttgggaggctgaggcaagtggatcacaaggtca

SEQ ID NO: 30386 - DNA, 201 bp, Homo sapiens
ttataaaactccactgacctagaaggtgctggattgaaatgttaagagtaaggttgttaccaagtaaacattttcagtttttattatttatttattcattyattttagacaaggtcttgctctgttgcccaggctggagtgcagtggctctgtcatagctcacggcagcctcaacctcctgggctcaagcgatcctcctgt

SEQ ID NO: 30387 - DNA, 201 bp, Homo sapiens
tgaagaggacattaaaaaaatgaaaagatatttcatgttcatggattggaaaaatcactattaaaatgtccatagtacccaaagcaatctacagattcaayacaatccatattcaaaataccaatgacattctccacaaaaatagaaaaaacaattctaaaatttacgtggaaccacagaggactcagaatagccaaagct

SEQ ID NO: 30388 - DNA, 201 bp, Homo sapiens
tgctacatttgttacagttgatgagcctacactgacacatcacccaggcactagtttacattaagattcactgttagtggtatacattttgtgtgtctggrcaacattatcatttaccattatagtatcatacagtcttttcactgtcctaaaaattatctgtgctctgcctatttatttctttctccccttaactcctgg

SEQ ID NO: 30389 - DNA, 201 bp, Homo sapiens
cttgaacccaggaggcagaggttgcagtgagccgagatcatgccattgcactccagactgggcaacaagagcaaagtctgtctcaaaaaaaaaaaaaaaaagaatgtattccaatatcagatgacaaattctaatcatgcaaaccaccgcaattacgtttgtaccaacctagtagtactggaagtcttaactatggtaatt

SEQ ID NO: 30390 - DNA, 201 bp, Homo sapiens
ccattatgtaatggccttctttgtctctcttgatctttgttggtttaaagtctgttttatcagagactaggattgcaacccctgcctttctttgttttccrtttgcttggtagatcttcctccatccctttattttgagcctatgtgtgtattcagtattaaatatctactacataagtaggttacagtgtcagtaatgtc

SEQ ID NO: 30391 - DNA, 201 bp, Homo sapiens
tggacttctggaaatgggagtagcagtaggatttggcttgtttcctgatccaaaagctgggactacattgggtatagtgccatgggactgaattcacatcytaggctgatgcaaaaagcattaatgactaccctacatgcacctgttgtgtgatctgaggatactgctgagatacctgacattgccacgcacattcttctc

SEQ ID NO: 30392 - DNA, 201 bp, Homo sapiens
gcctcttgattaaggtggccagatgccatctcactcagaccacagcggctccatgttatccattaatacagtttgggagagagaggatatgcctgtccccscagagctcatcacatcactagagaatttcccagtccagaaccccttattacctccagaccaagacctctctctctggagtagtaccaactgagctgaggg

SEQ ID NO: 30393 - DNA, 201 bp, Homo sapiens
cggccactacactcctcaccttcaaggcttgcctcctttgcaaaactttttgaaccaccactgcactgtacagttgttagcagttcctctccaaatgcatygttgatgttgtgagttgtctcctttgctttacgacccattttgaacttattcaaaaattgctcatatttgctttttatctaacttcattcccatagtcta

SEQ ID NO: 30394 - DNA, 201 bp, Homo sapiens
atattactgtaacataaacaaataaaggtttattatcttacagagaagaatgcaaaatttgcataaattttgagaaccaaacaggctttaaggaaaccagsttgtggcaggaaattttgagcaggttacacactactctgtgagagatactgaaaaaagttgtgaatcattcatacatgtttcataaatgattcctttcaa

SEQ ID NO: 30395 - DNA, 201 bp, Homo sapiens
gatgacacttcaaaatgatgattatttgattttcactcagctcatgaggcacccacttaacgagctttttcaccttttcgatttgcttcaaatgctgaatractgtaggatggtcgatgttgagttcttcggcaacttcttgtgtagttctaagagatgattgctcacaattggtcgttgtgaacttccgatggtcggcca

SEQ ID NO: 30396 - DNA, 201 bp, Homo sapiens
atctttattaatcaaaataggaaccattacaatcaacacattttcgccaatgagaaatgtttgttcttgttgtgtaaaaatccatgctttgggatttgacraactcttggaaagaatgttctgcatcctgctggtcatggaaatgttttctctgcaaaacgttgtcgagatgcttgaagaagtggtagttggttggtgaga

SEQ ID NO: 30397 - DNA, 201 bp, Homo sapiens
acttaaacgtaaaactatgaaaaccctggaagacaacctaagcagtaccatcctggacacaggaatgggcagatttcatgacaaagacaccaaaagcgatygcaacaaaagcaaaaatggacaagtttaattaaacttaagaggttctgcacaacaaaagaaactatcaacagagtaaacagacaacctacagaataggaa

SEQ ID NO: 30398 - DNA, 201 bp, Homo sapiens
tattctctttctcagggacgttccatgctgagaataagaattcagcgatatttctcccatttgcttttgaaagaagagaaatacggctctgttctgcctgrctcaccggcggtcagagtttaaggttctctctcttattccctgaacaattgctgttatcctgttcttttttcaaggtgctcagatttcatattgctcaaa

SEQ ID NO: 30399 - DNA, 201 bp, Homo sapiens
gcacaaaacagaatctctctgcatgtgacagagtctcatatcataagaataatgcaactaacaaggaaattaagttgtttttgtcacatgtaaaatgagartaataaggccagtccaaaaacttatagcaaactgtaagagattattgcaaataagacagtgaaggttacatctgatttagaaaacatagataaacataat

SEQ ID NO: 30400 - DNA, 201 bp, Homo sapiens
gaatattaatttatcataaagccttcttaaatttactttgctgtaaatttttataaagaatctcagattggacttttaaaggcctctattatttgtatttygaggctaggaaggcaagcctaagaaataccacatttcacttgtaataactataaatttgggtgaattcctaagggtcctgggccttccaggaagtggcct

SEQ ID NO: 30401 - DNA, 201 bp, Homo sapiens
tggcctttagctattgctatatttacaccttaggtagtataactggctgattgtgtgctttatacatacctttatctgtcaaattagggaatttggattcrtgtctcctgaattttgtaggagagtaattattgtagcatgtcttatagtttggaaaaaatgattgaatttaatgtgttaaactcacttcctaaaaatata

SEQ ID NO: 30402 - DNA, 201 bp, Homo sapiens
ttttgtccatttgttcaatatgggaagtgggagtagcggggaggatgtctttgtgtagcaggtgggaggctaatttttggatcaaaggatatcctgataayaccgaagtttgtgattctcaggccacagagagaatcaggatcatttgtgaaaattcctacctccttaattttttattttgaaattttgaaatctgcagaa

SEQ ID NO: 30403 - DNA, 201 bp, Homo sapiens
tttcaggtcttccttttttgatataagcatttaaagctatatatgtgcctctaagcactcctttaactgtattccataatttggtgtgtgtgtctttattrtagtgtaattcaaaatattttctaattttctttgtcatttcatctttgaccaatagattatttagaaatatgtggtttcgtttccaaatattggaagatt

SEQ ID NO: 30404 - DNA, 201 bp, Homo sapiens
acccagcctttattttttcctcatttttgaaggacagttatgctcaagatagaattccgtatgtcatcctactcacttctggactccacagttctgatgaratatgagctgttcgtctgattcaggatctcctgtatttgacaagttgcttttctcttgctgctttgaatattatttctttgccattggctttgacagttt

SEQ ID NO: 30405 - DNA, 201 bp, Homo sapiens
atttttataaaactccactgacctagaaggtgctggattgaaatgttaagagtaaggttgttaccaagtaaacattttcagtttttattatttatttattyattcattttagacaaggtcttgctctgttgcccaggctggagtgcagtggctctgtcatagctcacggcagcctcaacctcctgggctcaagcgatcctc

SEQ ID NO: 30406 - DNA, 201 bp, Homo sapiens
ctccagtcctatacatctatatttttataaaactccactgacctagaaggtgctggattgaaatgttaagagtaaggttgttaccaagtaaacattttcartttttattatttatttattcattcattttagacaaggtcttgctctgttgcccaggctggagtgcagtggctctgtcatagctcacggcagcctcaacct

SEQ ID NO: 30407 - DNA, 201 bp, Homo sapiens
ccacacccaactaattctgtatttttagtagagatgacgtttcatgttggccaggctggtcttgaactcctgaccacaagtgatctgcctggctcagcctmccaaagtgctaggattacaggcgtgagtcactgcacctggccttgcatataacttttgactgccccgaaatttaactactaatagcctgctgttgaccag

SEQ ID NO: 30408 - DNA, 201 bp, Homo sapiens
attagacaaattaagaataagaaaaacaagtttttagtttaccttcatcacttctccagtgtgcttgcttgtttcatgtagagttcactttctcccctatrtaattttctctctgaacaacttcttttaacatttcttgcaaggcagatctactgctatagaatcccccattttttgttagggaaaatctttatttcttct

SEQ ID NO: 30409 - DNA, 201 bp, Homo sapiens
aggagactcagtaagacgttcttagttctgggttaggggagggtcagtgagaatcagatgtgatttaggaatgtttcattttacaagagcaaagtctactyaattgttaagagttatagatagcctaacaaggaatacaactggctcccttgcatattagaaaatggacattaaaataatatttcaaacaaattactataa

SEQ ID NO: 30410 - DNA, 201 bp, Homo sapiens
aacccctggcacaatacattggccagcttgagtgagtctgggcacagccttcacagccccagcaaaggcacttctcctccagatagcagccaaaaggaaayattgctgagctgcccccagggtggctctctcaagattgtggaagggcgaacttaagaggatgttatttgcagctgggtacacctaaaacatgtcccaagt

SEQ ID NO: 30411 - DNA, 201 bp, Homo sapiens
gctcaccctcagtctacctaactatcatacaatagccaggaaaagctttttaaaatgcggatttcattattagatattaatttaaacttttttggtgaaawttttttttttttgaaacagaatctcactttgtcacccaggttggagtacagtggtgcgatcacggctcagtgcagccccagccttcctgggctcaggtgg

SEQ ID NO: 30412 - DNA, 201 bp, Homo sapiens
atgatatgtctaagtgcagtttttttctgaatttatcctgcttggtattttctgagtttcctgaatttatggctttgtgtctgactttaatttggggaaawtttatgtcattattgcttcaaataattcccttcctttctctctttttcttcttgtattactgctgcatacgtatcacaccttttgtaattgtctcacagt

SEQ ID NO: 30413 - DNA, 201 bp, Homo sapiens
ctcccggagcctcaggtgagggtgctctctgcccactgttccagtgcatgtggatttcagcttgtttgcataacacagaggtgggcacactatgctataargggccaagatagtaaatatttttaggctttataggccatatatctctgtcacattcctcaactctgctgttgtagtatgaaagtatccacaaataatata

SEQ ID NO: 30414 - DNA, 201 bp, Homo sapiens
aattgaagcagctctgaatggcttttcttgcccaatgctatagtgggggcctctttttgatgattcctttcaaataggattgtttcttttgctgttgttgytattttgtttgtttttgtgacagggtctcattctttagcctaggctggagtgcagtggcgcagtctcagctcactgcagcctggtcctccctggcctcag

SEQ ID NO: 30415 - DNA, 201 bp, Homo sapiens
taatcccagcactttgggaggccaaggcgggcagatcacctgaggtcgggagttccagaccagcctgaccaacgtggaaaaaccccatctttattaaaaayacaaaattacccgggcatggtggcacatgcctgtaatctcaactactcaggaggctgaggcaggagagtcacttgaacctgggaggcggaggttgcagtg

SEQ ID NO: 30416 - DNA, 201 bp, Homo sapiens
aaaggcgtgaacctgggaggtggagcttgcagtgagccaagattgcgccactgcactccagcctgggagacaaaatgagactccgtctcaaaaaaaaaaawaaaaaataaaatttaagaggcaaagaaaaagttattatttagaaatatgtggccttttccattattaagataatgctgtgaatttcctaggacatttagg

SEQ ID NO: 30417 - DNA, 201 bp, Homo sapiens
aattagccaggcgtggtggcgggtgcctgtagtcccagctactcaggaggctgagacaggagaaaggcgtgaacctgggaggtggagcttgcagtgagccragattgcgccactgcactccagcctgggagacaaaatgagactccgtctcaaaaaaaaaaataaaaaataaaatttaagaggcaaagaaaaagttattat

SEQ ID NO: 30418 - DNA, 201 bp, Homo sapiens
acatggtggaactttctggattgatggacatgttctatattttgatagagatttaggttatctgagtatatgtacttaacagacttatcaattggcatacrtaagattaagtaatttaagatttgtacagttgaatgtttgtaaatttacctagaaaaacacacaaaagaattgcaatcaaatactgaattttagcaaaaa

SEQ ID NO: 30419 - DNA, 201 bp, Homo sapiens
cgcggtggctcacgcctgtaatcccagcactttgggaggccaaggcgggcagatcacctgaggtcgggagttccagaccagcctgaccaacgtggaaaaaycccatctttattaaaaacacaaaattacccgggcatggtggcacatgcctgtaatctcaactactcaggaggctgaggcaggagagtcacttgaacctgg

SEQ ID NO: 30420 - DNA, 201 bp, Homo sapiens
gtgagactccatctcaaaaaaaaaaaaaaaagaaaagaaaaaagcaaatctataaaatgtttagaagaaaatataagcacatatattcatgactgtgtatsagggatatatttcttacatggacagttgttttggagagcaatttggaatatccagtactttatgactcagtagttcaacatccaagaaactttttctaca

SEQ ID NO: 30421 - DNA, 201 bp, Homo sapiens
tgttctatattttgatagagatttaggttatctgagtatatgtacttaacagacttatcaattggcatacgtaagattaagtaatttaagatttgtacagwtgaatgtttgtaaatttacctagaaaaacacacaaaagaattgcaatcaaatactgaattttagcaaaaataattttataaaataagcgaattttacaaa

SEQ ID NO: 30422 - DNA, 201 bp, Homo sapiens
ccaaggggagacgttttttacttaattttttagatagtgaggactgaagattttttttttttttttttaaccttgagtggctggagtgcagtggcacgatstcagctctgcaacctctgcctcttgggtttgaatgatttttctgcctcagcctcccaagtagttgggattacagctgcctgccatcatgcctggctaatt

SEQ ID NO: 30423 - DNA, 201 bp, Homo sapiens
ggcttttgtgatgcagctggtgaaaaagctgatgattatcattgcccgcccagcacgtctcctggaatgcctggtgagtggactctaggaaagtcaggtgrgcagatttagaggaggactatagaggaagtatcctgatgacagcaaaactgtggtggtaaccactgccatttctgttgcttaggtccttatttaaatatg

SEQ ID NO: 30424 - DNA, 201 bp, Homo sapiens
agcgtgagactccatctcaaaaaaaaaaaaaaaagaaaagaaaaaagcaaatctataaaatgtttagaagaaaatataagcacatatattcatgactgtgwatcagggatatatttcttacatggacagttgttttggagagcaatttggaatatccagtactttatgactcagtagttcaacatccaagaaactttttct

SEQ ID NO: 30425 - DNA, 201 bp, Homo sapiens
tgtttactaagattctgacaattaccataaagttggaaagtttaaacgttgcttatggagtgtgtaaggaacagaatcatatcatgagaacaatctttcaytcttaaaatctaaaagattatgtattttgagccatgaattaagaaacagaagcatctttaaacttggctgaagttctactttaaaaatggcagccagtaa

SEQ ID NO: 30426 - DNA, 201 bp, Homo sapiens
aaatatttttttctcactaaaatggaaagtgaggtgattagctgagcctgaagagagaggataaagtatgatacagtcttttaaaaggatgggagaaagartacactaagaagtatggtctgatttccagtagtatgaagagccaaagttagtgatcatacacataaagtgagactagtcagcttttctatatgactttct

SEQ ID NO: 30427 - DNA, 201 bp, Homo sapiens
aacagaagcatctttaaacttggctgaagttctactttaaaaatggcagccagtaaccaaagaaacaattcttgagatcattaaagcttggataaaatgasactttttcatgctgtgcccttttagaagtctgggggaatggggagcgtttcctgtgacagcactgtaagtgataaacagctgaatgaatttgtccatgct

SEQ ID NO: 30428 - DNA, 201 bp, Homo sapiens
tggggcaggaaaatcacttgaacccaggaggtggaggttgccgcacgccgagattgcaccactgcgctccagcctgggtgacagagcgagactccatctcaaaaaaaaaaaaaaaaaaaggcaccaccaataactttagtaggcaagccacagattagaacatatttataaaacacatatgacaaaggacttgtatttaga

SEQ ID NO: 30429 - DNA, 201 bp, Homo sapiens
gttttgtttctggaaaggaaaacgtgacatggattttataagcttagtagctgtaggtggagactcttgttttgtttgctaaacctttttaataagcagcraagtcaggatatcaaagattggaatttttcccccggaaccttttgttcttttcttagtacttcaaataatttcaaccaaaggggtatgcatggaaaatga

SEQ ID NO: 30430 - DNA, 201 bp, Homo sapiens
caagggctgcagcaaaaagaccaattatgagactgttgtggtcaaaaaaagcaagaaataataacagattggaggggtgatagcagtggacgatgtggagractttcttattggccatttttacagatacgtgaagctcagtagcttcctcaaggacagacaagtaggtgtatggccaggctagatgtataggttagggta

SEQ ID NO: 30431 - DNA, 201 bp, Homo sapiens
aaggctacaatgtatatttaactcttcaatgcccagacactgacaaatacccacaagcgttaagaccattcaggaaaacatgacatcaccaaacaaactaygtaaggcaccagggaccaatcctggagagatagagatacatgacctttcagacagagaattcaaaatacccattttgaggaaattcagagaaatacagga

SEQ ID NO: 30432 - DNA, 201 bp, Homo sapiens
ttatcctgcttggtattttctgagtttcctgaatttatggctttgtgtctgactttaatttggggaaattttatgtcattattgcttcaaataattcccttcctttctctctttttcttcttgtattactgctgcatacgtatcacaccttttgtaattgtctcacagttctcggatgttctggtgttggttttttttttt

SEQ ID NO: 30433 - DNA, 201 bp, Homo sapiens; identical to SEQ ID NO: 6216

SEQ ID NO: 30434 - DNA, 201 bp, Homo sapiens
ggtggcacagtcacagctcaatacagccttgagctcttaggctcccagattttggctattctaatctatgcgtagttgtatctcatttaattttcaattcctggcggagcacgatggctcacacttgtaatcccagcactttggggaggcccaggcaggcttttttttttgagagagagtctcactctgtcacccaggctg

SEQ ID NO: 30435 - DNA, 201 bp, Homo sapiens
cttatttgggtaaataaggagcacaattgctatattgaatggtaagagtgtatttgattttgtaaaaaaaaaaaaaaaaaaaactcttcaagctgggcgtrgtggctcacgcctgtaatcccacactttgggaggccaaggtgggcagatcacttaaagtcaggagttcaagacaagccgggccaacatggtgaaatgtcg

SEQ ID NO: 30436 - DNA, 201 bp, Homo sapiens
gagggtaggacacatgtgattacagagttttcccatcattgttctggatgtctcttggcctaaagatcaatctgtaagcctttttttttttttttttttttagacggagtctcgcactgttgcccgggctggagtacagtggtaccatcttggctcactgcaacctccgcctcccaggttcaagtgattctcctgcctcag

SEQ ID NO: 30437 - DNA, 201 bp, Homo sapiens
ctcccaagtagctgggaccacaggtgcacgccgccacacccagctaatttttgtacttcttgtagaggtggggttttgccatgttgccctggctggtctcraactcctgggctaaaactacctgccttcctcggccttccgaggtgctgagattacaggtgtgagcctctgcacctggcctttggtgaattttttcttact

SEQ ID NO: 30438 - DNA, 201 bp, Homo sapiens
tggcagtccttcccttcctggctgctgtttaccaacttaattattcttcctgtttcatgttagattctataatccagtatacatcttactactcttggccrggcgcagtggctgatgcctgtaatcccagcactttgggaggccaaggcaggcggatcacctgaggtcagaagtttgagaccagcctggccaacatggtga

SEQ ID NO: 30439 - DNA, 201 bp, Homo sapiens
cctgggcgacaagagcgaaactccgtctccaaaaaaaaaaatcttactactcctctcaactcctgctattatctttgttattttcagcaaccatgtagatkaatccatccaataatatcctggcatagttgttgacctcattatcatttctagtccacttagctctctgccttgtcatacctctgaaatgttccttcacta

SEQ ID NO: 30440 - DNA, 201 bp, Homo sapiens
aaaatgttcaagtcatgattaccaataaccattctaacatgatactgtgattatagcaaactgctataatcttaaactgaattgggaatatttctaaccagaacaaaagatatgatattctgttgaacattttatcatcagttctcatgttgaatatgatgtcattttgggtgccatattattattgaattttgttgagat

SEQ ID NO: 30441 - DNA, 201 bp, Homo sapiens
tagtggctgcaaagaggccccactgctgctggcaagctctaacagcagggaagctgcttggaaaagagacttagcttggacatggacacaacatggccccrggggcctcaggattttaggagataccctgtgatctctgtgacaaaacagtctttactttggaactgctgttcacatctgcctgatagatcccaacctgga

SEQ ID NO: 30442 - DNA, 201 bp, Homo sapiens
taaatggagaagtactatgttcatgtattataagacttgatattttgagatatcacttctttccaaattgatgtataatcccagcaggcttttttttttttggtaaaaattaataattggattcaaaaattcaaatcgaaatgcaagaatctagaatatctaaagcaatcttggaaaataataaagttaaaggactgtaca

SEQ ID NO: 30443 - DNA, 201 bp, Homo sapiens
ccaactcaccatctgtgaccagacaggttcactaagcagctctccaagcacctgcctaactcccttgggtcctaaggttaagtaagaggatcctgagttaratgaaactctctctcacttaacaaacttcccggtttagaaaccagcagtgcccatacactaagtttacacagttgggaggtccagtggaagaacagagga

SEQ ID NO: 30444 - DNA, 201 bp, Homo sapiens
tagtttttagagaatagcatcttatcacttagctttagagcttcgctactggtgggttagattagaaaaatgcagtttcttcttcctatttttttttttttctcttttttgagacagggtcttgctctgtcacccaggctggagtccagtagcatgatcttggctcactgcaaccttcacctctggtctcaagcgatcctc

SEQ ID NO: 30445 - DNA, 201 bp, Homo sapiens
aagtagtcttatctcattttgtttctgtaacatattgtttgatccattcctggtcatataaagtagatgctgaataaatatttgctgaatgaaaggatgartcagtgttttagcactttcaactttctgtgttcatttgtatttcatttttgcttttaagttgcatgttattgaaggtaagaactatgtcatcattttgtc

SEQ ID NO: 30446 - DNA, 201 bp, Homo sapiens
ggtagtttttttatttgttttgttcccaagaatatgctggggcacacccaaccctattgaccaaaactaagaagacacagagaatcctactccaggggagkttatcctgggaaagccaccagtgagcttaggagtaggtccctttctaggtctttctagcctagaagaggtctttgtgaaaaccaagcctagctccatata

SEQ ID NO: 30447 - DNA, 201 bp, Homo sapiens
catttattatgattaatgatatatttggacttgtttgtgccatattattttttgtattccatatcctacatctctatgccttactgtccccttttttttttaccctttaaaaatattggtagagttttttttcttattttctttttctatttctactggtgtgttagaacaaattcaaactttaaccccctcctgaacact

SEQ ID NO: 30448 - DNA, 201 bp, Homo sapiens
cccgcccatattttctttatctagtccactgttgatgggcacctaggttgatcccatgtctttactattgtgaatagtgctgtgattaacatgtgagtacrtgtgtctttttggtagaatgatttgttttcttttgtatatttacccagtaataggattgctgggttgaatggtagttcagttttaggctctttgagaagt

SEQ ID NO: 30449 - DNA, 201 bp, Homo sapiens
atcttgaggtagttttggtaaggtatatgtttttaagagtttgtccattttgtttattttgttatttattgagatcaatttgtttatatatatatatatawaaatttttgttcttttaaacctttgctgatttgttcttctgtttctctttgtatttctaatattgggtattaagactcttttttttcattatcaagtatc

SEQ ID NO: 30450 - DNA, 201 bp, Homo sapiens
tatagaggtcagcaaaaagatctgggatagagatacaaatttgagattgtaaaatatatagagaaaggagagtgtacaagcagaactaaaaggacagtccycatttaagggtctaaggtgatgaaggatgagcctgcaaagatgtttaaatggtgtgtttgcggggataagaggaaaaacaagagaatgtggcttcatggc

SEQ ID NO: 30451 - DNA, 201 bp, Homo sapiens
gaagatctctgttcctgtgattcttttgtttgtttgtttgtttgtttgtttgtttgtttttgagacagagttttgctcttgtcacccaggctggagtgcartggtgcaatcttggctcactgcaacctccgcctcctgggttcaagcgattctccagcctcagcctcctgagtagttgggatcacaggttcctgccaccat

SEQ ID NO: 30452 - DNA, 201 bp, Homo sapiens
gtactgatctggagtcctgggcatcaaatgcaggcttttgtataggtgtaaggaagtcggaagggatggatttccacggatgcgcttccgtgcctctaaargaatgcagagaggggcatatatgcattttaggaaattttattattgttagccaaaactgtagtctaccatattacccatttaaactattcaagaagtcag

SEQ ID NO: 30453 - DNA, 201 bp, Homo sapiens
ctgttgtttccatgatatggcgtgtcttgaatgccaaggggagacgttttttacttaattttttagatagtgaggactgaagattttttttttttttttttaaccttgagtggctggagtgcagtggcacgatctcagctctgcaacctctgcctcttgggtttgaatgatttttctgcctcagcctcccaagtagttggg

SEQ ID NO: 30454 - DNA, 201 bp, Homo sapiens
ttttgcccgtagggagctccttgtgtttgcttgggaaataaaactaaacattggaaaagcacagtggcaatacaagatgaaagtcaaggcagtgaaaaaakttattccaaggaggaacacagtgctttatggaatctaactggtgccgagtgtaattgctgacccagttcagtttaaagaagtatactgtgcggcccgtga

SEQ ID NO: 30455 - DNA, 201 bp, Homo sapiens
gagtcgaaaaagttttgttctggaaggaagcaaggaaacatgggtactaatataggctttgccactaacaaattatgtgtggctttaaaacaggagctccyacttctggacctgaattgccatacttgtaaaatgaagggattggctacctgatctctatgcttagtcatctccccaaacagttaaagttccatggtacct

SEQ ID NO: 30456 - DNA, 201 bp, Homo sapiens
gactacaggcacaaaaagtgccatcacacccagctaattgttgtatttttaatagagatgtggtttcaccatgttggccaggctagtctcaaactcctggsctcaagtgatccgccagcctttgcttcccaaagtgctgggattacaggcatgagccaccacgcctggcccttgagctgggttttgaagaatgaataggag

SEQ ID NO: 30457 - DNA, 201 bp, Homo sapiens
gggtttaaattttaaattttaaattgaattgtctaggctgggtgtggtggttcacacctgtaatccgagcactttgagagactaaggcaggaggatcgctwgagttcaggagtttgagaacagcctgggcaacatagtgagaccctgtctctacagaaaaattttaaaaatcaaaaaattttgtattgtccaggaattttc

SEQ ID NO: 30458 - DNA, 201 bp, Homo sapiens
tggatggggcaccactgtgatgggcctgatgagtctctgagactgctgcaggacttggattttgtaactaaagttagttcttatttttatactttaagttytagggtacatgtgcacaatgtgcaggtttgttacatatgtatacatgtgccatgttggtgtgctgcacccattaacttgtcatttacattaggtatatct

SEQ ID NO: 30459 - DNA, 201 bp, Homo sapiens
ggtctcattctttagcctaggctggagtgcagtggcgcagtctcagctcactgcagcctggtcctccctggcctcaggagatcttcccatcacagcctccygagtagctggcaccacaggcacctgccaccacatctggctaatttttgtattttttgtagagatggggtttcactatgttactcaggctggtctggaact

SEQ ID NO: 30460 - DNA, 201 bp, Homo sapiens
atgtattctaaatataaattccttgttggatatgtggtttgcaaataacttttttattctttttaacagagtgttttgcataacacatttattaatttttwaaaaattattattgtttttttttgagtcagagtctctgtcacctaggccatagtgcagtggctcgatctcagctcacggcaacctctacctcctgggttc

SEQ ID NO: 30461 - DNA, 201 bp, Homo sapiens
agttcctgggccccagggatgtgatgtgtcaaactttgttcctatgaaactgacagtgtcatgtactttcccattctgatgcaacttgatgcctggatcartgcttctggaaaatgtgctaaaaagagataccacctgctgcatacacataataaaccctttgttgaggtatcagtggcgtctgatatagggctttaggtt

SEQ ID NO: 30462 - DNA, 201 bp, Homo sapiens
cctaaaactataaacttttaaaagttttgtatgtattctaaatataaattccttgttggatatgtggtttgcaaataacttttttattctttttaacagagtgttttgcataacacatttattaattttttaaaaattattattgtttttttttgagtcagagtctctgtcacctaggccatagtgcagtggctcgatctc

SEQ ID NO: 30463 - DNA, 201 bp, Homo sapiens
agagtgatagctttgtgttacatttaagaccctgtcttttaaaagttggtgggaagtaatttcatatagattctctaagtgtccaatgggaaggcaggacrtagcagaggttgggagggaagtagccatagtcatcactcatatccctacagggaaccagtttgttgttaaaaaatggatgtagttgttggcgagctttac

SEQ ID NO: 30464 - DNA, 201 bp, Homo sapiens
agggtctggctatgttgcctaggctggggtgcattcgcgcaatcacagctcactgcagccttgaactgggctcaagcagtactcctaccttagcccccccragtagctgggactatagacacatgccaccatacccagctaatttttgtattttttgtaaagatgggattttgccatattgcccaagctggtctcaaactc

SEQ ID NO: 30465 - DNA, 201 bp, Homo sapiens
gcaatataatttttatttatttgcctcccttgagtgtgagcttcttgaagaagacagttctgaagatacagggcttggtacacagcaaacttgtaattaaygtttgaggtcaggcatgggtggctcacatctgtaatccaatgctttgggaggctgaggtggggggattgcttgaggccaggagttcaagaccagcctggg

SEQ ID NO: 30466 - DNA, 201 bp, Homo sapiens; identical to SEQ ID NO: 6217

SEQ ID NO: 30467 - DNA, 201 bp, Homo sapiens
gggactacaggcatgggccacgatgcctggctaatttttatttttatttatttttaaacttttatttatttattttttgagacagagtttcactcttgctscccaggctggagtgcagtgactcactgcaacctccgactcccaggttcaagtgattctcctgcttcagtttcctgagtagctgggattacaggcgcctgc

SEQ ID NO: 30468 - DNA, 201 bp, Homo sapiens
ttcaaggagagttgccatcagacttggaggaaaactttaccttagagcaaagacttttctcctagttcctctgatgcctgctgcccttgcggggaattctractacctgcttctgtggaaatacattcatttgttcaataaacacttgtcgaaaacctcctatgccctgtgtactatttctaggtgattgggatacctctt

SEQ ID NO: 30469 - DNA, 201 bp, Homo sapiens
acaaagtgggagggaattcatcacagagcagctcccccagctccagcgtgcccagttccccagccggctctgggcacacacggcccagctccctccacggkctggcacccaagctccaacgccagtaccgctctccacggcgcaagtcagcaggcagcatcccactgtcaccactggcccacaccccttctcccccacccc

SEQ ID NO: 30470 - DNA, 201 bp, Homo sapiens
ccctaaaactataaacttttaaaagttttgtatgtattctaaatataaattccttgttggatatgtggtttgcaaataacttttttattctttttaacagagtgttttgcataacacatttattaattttttaaaaattattattgtttttttttgagtcagagtctctgtcacctaggccatagtgcagtggctcgatct

SEQ ID NO: 30471 - DNA, 201 bp, Homo sapiens; identical to SEQ ID NO: 6206

SEQ ID NO: 30472 - DNA, 201 bp, Homo sapiens
tgacaaaaacaagtaatgatactgggataactggctagccatatgcagaagattaaagctggaccccctcttttctttttttttttttgagatggagtctytctctgtcacccaggctggagtgcagtggcgcgatctaggctcactgcaagctccacctcccaggttcacaccattctcctgcctcagcctctggagtag

SEQ ID NO: 30473 - DNA, 201 bp, Homo sapiens
taaaattcgtatggaaccaaaaaagagcttgaatagccaaggcagtcctaagcaaagagaacaaaactgggggcctcacgttacccaacttcaaactgtastatagggatacagtaaccaaaacagcatgttactggtacaaaaggcacatagatcaatggaactttatttccggcagaaataaagctgcacacctatgac

SEQ ID NO: 30474 - DNA, 201 bp, Homo sapiens
cccaaaagctccttcaactgataaacaaattcagcaaagtttcaggacaccaaattaacatacaaaaaaccactagcattcctatccaccaacaacagccmagctgggagccaaatcaggaaggcaatcccattcacaattaccacaaaaagaatacaatacctaggaatactgctaaccagggaggtgcaagatttctac

SEQ ID NO: 30475 - DNA, 201 bp, Homo sapiens
tgatgtttgtcactgtgaatataaagacacatcagccagcatgattctgggtttttcttcagtcactctaagttcccaggtgcagttgcaaaatagatggraagcttggttgtaaagggttgggatttcgccaggactttggtgtccttgggaggtagcaacgtttcatttggagctagaatttaaagcagacactcagaa

SEQ ID NO: 30476 - DNA, 201 bp, Homo sapiens
cgccaccgcatctggctaatttttttgtatttttagtagagactggatttcaccatgtttgtcaggctggtctcgaactcctgacttcaagtgatctgccygtcttggcctcccaaagtgctgggattataggcatgtttaatcttttaaaaaatgaaagagccggctgtgcgcggtggctcacgcctataatctcagcac

SEQ ID NO: 30477 - DNA, 201 bp, Homo sapiens
taggcaagagggtgcctgtgtgagcagctccattaaaaactttggacactgagtctttggtgagctttcctggtagacaacatttcatggatatagttacyaggtgttgctggaagaaataagtgtgtcttatgtgacttcactgggagcgaactctgggaagcttgtgcttggtttcctccagactttgcctcatgcacc

SEQ ID NO: 30478 - DNA, 201 bp, Homo sapiens
gatagataatgttagacagtgaagtattcaacttagataagaactgtaggagtttagataaagtgcattcacttgagaattgctgtccttttcactcttastttttctttttgtaagaggaacttgtttctaatgccatctagtgtcttttgaagggtatatgagtaatgttaagaggttttaaaataaaagttttgaaat

SEQ ID NO: 30479 - DNA, 201 bp, Homo sapiens
tttcagataaggagttttgtcttcggatggtctgcttgattgccactaggtgatcgttgtattcttctgtgtcgaactcccaggctcaagtgatccacccrctttggcctccctaagtactgggattataggaatgagccactgtacctggctgttacttttatctgaaattgagaatacaggaaaaggaacaggtttggg

SEQ ID NO: 30480 - DNA, 201 bp, Homo sapiens
tgcagtgagctgagatcgcgccactgcactgcagcctgggagacagagcaagactctgtctcaaaaaaaaaaaaatgccaaacttagatttaggatactayccctaacccccatcaaatggtaactggtaagtgtatgtttaagtttctaaaaaattgccacataattttccaaaatgtttatactgttgtactttcctac

SEQ ID NO: 30481 - DNA, 201 bp, Homo sapiens
cttttttatgtttaaatgcacaaatacttaccattgtgttacagttgcttacagtattcaatgcagtaacatgctatacaggtttgcggcctggaagcagyctataggctatacaataccatatagcctatgtgtgtggtaggctataccatctaggtttatgcaggtatactccatgatgttcacataatgatgaaatcg

SEQ ID NO: 30482 - DNA, 201 bp, Homo sapiens
caagcaaaaatggatgagtgtaccctcctagagattttgatccagatgtctggggttagtcacaagcatctgtgttttcttttcttttctttctttctttytttttttttgagacaggttctccctctgttgtccagtctggagtgcagtgtcatgatcttagctcactgcaccctctgcttcctgggttcaagtaattct

SEQ ID NO: 30483 - DNA, 201 bp, Homo sapiens
tattttattcgttatgtggttattgtcattgggatttcattctggatttgaccctcagcttggacgtcattggagtgtagaatcactactgatttttgtaygttgattttgtatcctgaaactttgctgaagtttatcagatctaggaacctttgggcagaggctgtggggttttctaggtatatagaatggtaattgtct

SEQ ID NO: 30484 - DNA, 201 bp, Homo sapiens
gcatggcagagtgctagaactcttaggaggtaaaaaagttcaaacctcacattttacacgatgggaaaatttgagtccaaaacaagttaaatggtttgttsaggttgaggaaaatagcccttctcccatttctttctgtcttccttttcttatattcaacattatttgattacgtactatctgctaggacactgttttggg

SEQ ID NO: 30485 - DNA, 201 bp, Homo sapiens
acagactaattacgatacctcatccttaagtatttctcctaaggtgaaggatactctcctaaataactacaatatatgaccagatctaagaagtttaatasttttttttttttttttgagcctgagtctcgctctgtcacccaggctggagtgtagtggtgtgatcttggctcactgcaacctctgtctcctgggttcaaa

SEQ ID NO: 30486 - DNA, 201 bp, Homo sapiens
aggaagactcatatcatgaagatgtaaattttctccattaagctatagatttaatgcagtcccgatcaaaacccaggtagtatttttcagaaaatatcaarctgatttcaaatgtatattgaaatgtaaaggacctagaataaccaaaacaatattaaaaagaagaccaaagttagaggaatcaaacttattttatgactt

SEQ ID NO: 30487 - DNA, 201 bp, Homo sapiens
ttggtagagacagggtttcaccatattgaccaggctgatctcagactcctgacctcaggttatccacccgcctcggcctcccaaagcactgggattacagrcatgagccaccactactggccaggacttttgtttttatgctgggtgagataagtagccactggaaggtttaaataagaatgtcatgatctgacgtagatc

SEQ ID NO: 30488 - DNA, 201 bp, Homo sapiens
tgcacatttgcagaatgaaggaaagaaggcaggcaggctctactctgggcttatggaagttttgagcagaacaccatcatcatcatcattattttttttttatggagggctttatggaaagactttccagtaaaaggtacatttgagacttgaaaacttaactagattttaaaagtatattgtaattttctagtaaaacat

SEQ ID NO: 30489 - DNA, 201 bp, Homo sapiens
tagagacggggttttgccatgttggccaggctcttcttgaactcctgacctcaggtgatccacccgcctaggctttccaaagtgctgggattacaggtgtsagccaatgcgcccagtcagctatttttatatatatacattctatgatcaaatgtctgttcaaaacttttgtctatttaaaaaaaaattttttttgtctta

SEQ ID NO: 30490 - DNA, 201 bp, Homo sapiens
ctttctcatgtttgggattcttagagattcttagatttgtgatgttacaagaaaaacttgggactgcaacgtcccatctaaactgggaaggagccatgagaccaaagaatgactcagacaaatttaacttgatgagtagacgagtttattcaacttacatacaaggcactcctggacggcagcaggacagctctagagatc

SEQ ID NO: 30491 - DNA, 201 bp, Homo sapiens
ttttttgtttttaaggtgcaagggtaaatctgatctctgattccccataatgatgagaagcagaagtctagtcttgctaatattttgagctcatgcttctrtcattagttgttcttattgctttatgagattattggttgactgattcacgttgcataagcccaatagaagcagattattttaaaattattttatcttcct

SEQ ID NO: 30492 - DNA, 201 bp, Homo sapiens
cagttctcctgcctcagcctcctgagtagctaggattacaggcgaccgccaccacgcccagctaatttttgtatttttagtagagacggggtttcaccacrttggtcaggctggtctcaaacccctgacctcgtgattcacccacctcggactcccaaagtgctgggattacaggtgtgagccaccgtgcccagcctatgt

SEQ ID NO: 30493 - DNA, 201 bp, Homo sapiens
gcctcccaggctcaagtgattctccagcttcagcctccccagtagctgggattgcaggcgtccgccaccacgcctggctaatttttgtatttttagtagakacggggtttcaccatgttggccaggctgatctcgaactcctgacctcaggtgatccacccacctcggcctcccaaagtgctgggattacaggtgtgagcc

SEQ ID NO: 30494 - DNA, 201 bp, Homo sapiens
taataatttatgattttaaaaaggccaaaattttcattgtatgtgtcgagactggttgaattctatttatttgggtagtaagagcccagctgatcagcaarcatctacatctcacacgtaacttttttttccctttctcatgacatggaacagtgcttgttacagtttttattatactagtatttaagaatacgttctaat

SEQ ID NO: 30495 - DNA, 201 bp, Homo sapiens
ataagccaatacctccaggcgcgtattctctttctcagggacgttccatgctgagaataagaattcagcgatatttctcccatttgcttttgaaagaagasaaatacggctctgttctgcctggctcaccggcggtcagagtttaaggttctctctcttattccctgaacaattgctgttatcctgttcttttttcaaggt

SEQ ID NO: 30496 - DNA, 201 bp, Homo sapiens
aattgaaatgccaagtctcactccaagtagccaagtgactgggatgatttaacaccagtctttgcatgaggtagctccgggggcttccaggctaccacccrtccgctgagagttagtgtacccaactctgcagatatccagtacttcatcttactggaatgaaagaattaagacttgccctttatcttcttaggatcctgg

SEQ ID NO: 30497 - DNA, 201 bp, Homo sapiens
aagttatggagaggaaacctggccagctctctatcgggtaaatatctgattttgttgttttaagaaatgtgggaccatgtggtcaatatttaagtgtatattaattgaattggcatcttgacagtttcttctctggtagtagtcttgtatagaacatttatggtaaggctgtcttcctctccttacttcttcctcatggaa

SEQ ID NO: 30498 - DNA, 201 bp, Homo sapiens
tatgtggaataggagtggtgagagtgggcattcttgttttgttccagttctcaaggggaccgtgttttttgcccagcatgatgttacctgcaggtttgtcrtagacggctcttattattttgaggtatgttcctttgatgcttagtttgttgaggtacttgattgtctgatcattttttcctctgtgtaactaatctcctt

SEQ ID NO: 30499 - DNA, 201 bp, Homo sapiens
taagttatggagaggaaacctggccagctctctatcgggtaaatatctgattttgttgttttaagaaatgtgggaccatgtggtcaatatttaagtgtatattaattgaattggcatcttgacagtttcttctctggtagtagtcttgtatagaacatttatggtaaggctgtcttcctctccttacttcttcctcatgga

SEQ ID NO: 30500 - DNA, 201 bp, Homo sapiens
acttcactcttctttttatgtttgggcatttgtaaatcatgttttggatagtcaccaccaaccaatattagtacttacccatttttttgaactcactaatsacaatatataactgtatagaatttttttcttttttttttttttaatcttagagaactggaaatttcctccttttttgccccttgtggcttttagtattgc

SEQ ID NO: 30501 - DNA, 201 bp, Homo sapiens
gctaccatgcctggctaattttttttttttttttttaatttgtagagatggagtcttgctatgttgcccagactggtctcgaactcctgggctcaagtgaycctcctccctcagccttccaaagtgttggaattaaaagggtgagccactatgcctggcctttatgtgaatattatataaatggaaccatatagtatataa

SEQ ID NO: 30502 - DNA, 201 bp, Homo sapiens
ctttattttttcctcatttttgaaggacagttatgctcaagatagaattccgtatgtcatcctactcacttctggactccacagttctgatgagatatgarctgttcgtctgattcaggatctcctgtatttgacaagttgcttttctcttgctgctttgaatattatttctttgccattggctttgacagtttggttatc

SEQ ID NO: 30503 - DNA, 201 bp, Homo sapiens
accgcaattacgtttgtaccaacctagtagtactggaagtcttaactatggtaattagacaagaaaaagaaataaagggtatccaaattggaaaagaagtmaaattatccttgtttgcagatgatttgatcttatatttggcaaaagcttaaagacttcaccaaaaaactattagaactgataaatttagtaaagttgcag

SEQ ID NO: 30504 - DNA, 201 bp, Homo sapiens
gagaggaggtcctggagtgggtggctcctttctgcaggcaggtggtcccattatctccctatggtccctccctcctctccccaagcctggctgagtccagsggcttttatgggcctcagaggggaggaagtgcatgctggttggtccatgggcggccatgggtgggcccagggaaaagcaccacaagttgcccttgcggtt

SEQ ID NO: 30505 - DNA, 201 bp, Homo sapiens
gtgtggttttgcagtcatggctcactgcagcctccatctcccagtctcaggtgatcctcctgcctcagccttccgagtagctgggatcacaggcacaagcyaccatgcctggctaattttttttttttttttttaatttgtagagatggagtcttgctatgttgcccagactggtctcgaactcctgggctcaagtgaccc

SEQ ID NO: 30506 - DNA, 201 bp, Homo sapiens
tttttgagatggagtctcgctctgttgcccaggctgtagtgcagtggcgtaatggctccctgcaacctctgcctcccaggttcaagcgattctcctggctyagcctcccaagtagctgggattacaggtgtgtgccaccacacctggctaatttttttgttttttagtagagacggggtttcaccgtgtcaaccaggatgg

SEQ ID NO: 30507 - DNA, 201 bp, Homo sapiens
accacaagttgcccttgcggtttctgggactggcgacccatcccccaggcttcaggctttccctggcttggaggtgggtcttcactgtggaccagcttctytccacccaggagcctgtctgcctcctgctgctgttcatggtgaccaggctgttcatgctaaggggtgcctgcaggccagcactgggctgtcctcagtgca

SEQ ID NO: 30508 - DNA, 201 bp, Homo sapiens
tgaaaatgacatttgtacaatatcattaactagattatagcccttatttggtctttatatacacttgtatatgtttgtgtgtgtatgtacaagtcatgcartctcatcccatgaatagatttgtgtaatggccaccaccacaatcaacatacagaaccgtgctgtcattacaaaggaattcgcttgggctgcccttttata

SEQ ID NO: 30509 - DNA, 201 bp, Homo sapiens
ggaaatcagaatcccctaaggtaacttcagcaaagaaatggaaataattaaaaagaaccaagctgaaattttggagttgaaaaatgcagttgatatactaaggaatgcatcagagtcctttaatagcagaactgattaagcagaagaaagaatttatttatttatttattttttgagatggagtctcgctctgttgcccag

SEQ ID NO: 30510 - DNA, 201 bp, Homo sapiens
ttagagttgcatatttagttggtaaagctataaggaaatgattatcataatattgactttagatggggtaaagggaggggttttgatcaggagggattatktggagggattttggaagatggcattgttaaacctagatggtgtttacacaggtgcttgctatataattatattcctttataactagttaaactgtataaa

SEQ ID NO: 30511 - DNA, 201 bp, Homo sapiens
taaggaaatcagaatcccctaaggtaacttcagcaaagaaatggaaataattaaaaagaaccaagctgaaattttggagttgaaaaatgcagttgatatactaaggaatgcatcagagtcctttaatagcagaactgattaagcagaagaaagaatttatttatttatttattttttgagatggagtctcgctctgttgcc

SEQ ID NO: 30512 - DNA, 201 bp, Homo sapiens
gattcttctcaataatgtcattttttctggagctagaaccgtgaatgtaagtcattaataacaatcagcttagctgggcacagtgactcacacctgtaatrtcaacacctggggaagccaaggtaggggaattgcttgagaccagcctggacaacatagtgagacccccatctcttccaaaaattaaaaaattatctggct

SEQ ID NO: 30513 - DNA, 201 bp, Homo sapiens
tgcctcctgggttcaagcaattctcctgcctcagcctcccaagtaactaggattacaggcagccgccaccacgcctggccaatttttttttttttttttttgagacgaagttttgctcttgtcccccagtctggagtgcagtggcacgatcttggctcactgcaacctctgccttccggattcaaacaattcttctgcctc

SEQ ID NO: 30514 - DNA, 201 bp, Homo sapiens
cagcctcccccacatttctgaggctatggttttgttttgttttgttttgttttgagatggagtctcaaaaattgcactccagtgcccaggctggagtgcartgacgcgatctcggctcactacaacctctgcctcccatgttcaaatgattctcccacctcagcctcctgagtagctggaattacaggtgtgcatcaccac

SEQ ID NO: 30515 - DNA, 201 bp, Homo sapiens
ctgcctcctgggttcaagcaattctcctgcctcagcctcccaagtaactaggattacaggcagccgccaccacgcctggccaatttttttttttttttttttgagacgaagttttgctcttgtcccccagtctggagtgcagtggcacgatcttggctcactgcaacctctgccttccggattcaaacaattcttctgcct

SEQ ID NO: 30516 - DNA, 201 bp, Homo sapiens
caaactcctgacctcaggcaatctgcctgcctcggcctcccaaagtgctgggattagaggcgtgagccaccgcgcccggctgtaattttggccttttaagstaaatgtatattggagaaatagagaaaacccaataaaagtagcacacatttttaggccttagcatctgtggtagaataaagaatttctgtgatctttggt

SEQ ID NO: 30517 - DNA, 201 bp, Homo sapiens
gctgagtcatgtaccctggaggttcaggcttcggttacgggcagcccctctggatcctgaaactctgccctgctctgtaggcagaaaagggaagatgcttkagctgatcccctaggtatagcttctgaaggtctggcttcttgctagatttgctgacctagactccatgctgctcatcctacccccttgcccatgtcctcc

SEQ ID NO: 30518 - DNA, 201 bp, Homo sapiens
tgctgctggcctcctcagggccctccgggaaccgaggcgcatccaggaggcctgagcagcggcgtcgcactgtcattggagggcttgagtcactctctgtytgggatgactcagacaccgacagccgcttccgtaatctatgagacacaaggcctggggtgagtgacccaggtggtccccctcctcctgccaggtctcctt

SEQ ID NO: 30519 - DNA, 201 bp, Homo sapiens
cttctaacagctaacactgctctgcttttgtctgtctgtctgtctgtctctgtacaaagtgggagggaattcatcacagagcagctcccccagctccagcrtgcccagttccccagccggctctgggcacacacggcccagctccctccacggtctggcacccaagctccaacgccagtaccgctctccacggcgcaagtc

SEQ ID NO: 30520 - DNA, 201 bp, Homo sapiens
taatagagtaatactggccccatggaatgagttaggaatcatgttacaatcatctttgcttggaagagattgtagagaattggtatcatttcttctataartgtttggtagaattaatcagtgaaacatctgaaacaggtgctttttttggagatgattagctattgactcagtttctttaatggagtctttcttttttta

SEQ ID NO: 30521 - DNA, 201 bp, Homo sapiens
agtaaattctatttggtgatggtatataacttttttatacattgttggatttgatatttctaatattgagaatttttgcatctgttttcataagaggtatkggtctgtagtgtttttttcttacaatatctttatttggtttgggtaatagagtaatactggccccatggaatgagttaggaatcatgttacaatcatctt

SEQ ID NO: 30522 - DNA, 201 bp, Homo sapiens
cctccttcccaatgtatttaccttttatttccttttcttgcctttttggttttgttttgctttttaatttatgtattttttttagaaatggggtctcactrtgttgcccaggctggtcttgaactcctgggctcaagtaatccccccaactcagcctccgaaagtgccaggattacaagtatgagccactgcacccagtcg

SEQ ID NO: 30523 - DNA, 201 bp, Homo sapiens
aaggtcctttcagttggctcctttccccccttgacttacatcaatttggtggtttttgtttggttggttttggttttggtttgttgttgttttatccctttccttactatctgcgattataagatattccaggctcatgttgtatatttctgaccccagtcctagaatcagccgtttctccaagaggtctggatttttaaa

SEQ ID NO: 30524 - DNA, 201 bp, Homo sapiens
tccaagaaaaattgctgacattacagaagataaaaatttatcatcccttggagggaattgaaaaacaagtatcatgatttaataaatacagccaacaatgsacttcttccattgggagctacatgtctttgtgaggtttattttattttatttaatttttaattttttttttttttgagacagagtctcattctttcaact

SEQ ID NO: 30525 - DNA, 201 bp, Homo sapiens
ttcagcatgatgttggctgtggatttgtcataggtggcttttatttattttgagatatgttccttggatgcctagtttgttgagggtttttatcatgaagrgatggtggattttattgaaagctttttctacatctattcatctgacttccttttttctgcttgacctaatagaaaaaattttcagccctacttgaaatga

SEQ ID NO: 30526 - DNA, 201 bp, Homo sapiens
tatctaagtctcttcagctatgagcctctgaaggccaaggattgagtatacttgcacctttttgagtattttaagtgcctgacatagaaccttgcaattarctgtcattaaaaaatgactgtggaccaggtgtggtggctcctgccacaagcctttgtaatgcccagcatttagggagactgaggcaggagggtcacttga

SEQ ID NO: 30527 - DNA, 201 bp, Homo sapiens
aaaagaaaaaacagaataataaaaagataaaacaacaaccataaaaatgaccatgatgatactggtctattgaaagtggggggcctggtccttatgtagcrtctctacccatggctgcctcgtagaaactaactgtgttctaatcttttctgctatggaaatttgggcacaggccagacagctgggcaatttattgaggaa

SEQ ID NO: 30528 - DNA, 201 bp, Homo sapiens
cctgggttcacgccattttcccacctcagcctcctgagtagctgggactacaggtgcccaccaccatgcccggctagttttttgcatttttagtagagacrgggtttcactgtgttagccagggtggtctcgaactcctgaccttgtgatctgcccgcctcggcctcccaaagtgctgggattacaggcatgagccactgt

SEQ ID NO: 30529 - DNA, 201 bp, Homo sapiens
tcttttaaaaacatattaaggatacttgtatttaacaagttttttaggaaaaacattgtacaacatttatgtttttcatgatgctgaaaatgctgaattayatgtcaatttaatttatctcttagaagaaaaagtaacataattaaaatcactgggtctctaatctttagttctctctccacaaataaaacctgtcacttt

SEQ ID NO: 30530 - DNA, 201 bp, Homo sapiens
attttttgtatttttagtagagatggtgtttcaccatgttggccaggctggtcccaaactcctggcctcaagtgatccacctgcctcggcttcccaaagtrctgagattataggtgtgagccaccgcggccagcttaatttttatttttaaactttttgtagaggtgggattttacagtgtttcccagtttggtctcgaac

SEQ ID NO: 30531 - DNA, 201 bp, Homo sapiens
taacttagctataaataaatacaaaacaaaacccagttatgtaaagaaaaattgaaattagaaatgtggagattccgtaaacttctttgttcatctgggarccaacttcagattaccacttcagatttacctgtgggaaccaagcactgatgtacatggatggtccacgtgaggtgtacttctctgatgtgactcacaggt

SEQ ID NO: 30532 - DNA, 201 bp, Homo sapiens
aattgctctggctaccacttccagtactatgtggaataggagtagtgggagtggacatcctcgtgttgttccatttcttagagggaatgttttcagttttygcccattcagtatgatgctattggctgtgagtttatcatatatggttgttactattttgaggtgtcttccttcaatgcctaattcgttgaaggtttttaa

SEQ ID NO: 30533 - DNA, 201 bp, Homo sapiens
tgtctgttcatgtcttttgcctattttttaatggggttatttgttttttgcttgttcagttaaggttttttgtagattctggatattagacctttgtcagrtgtatattttgcaaatattttctcccattctctaggttgtctgtttactctgttgataatttattttgctgtgcagaagctctttagtctaattaggtcc

SEQ ID NO: 30534 - DNA, 201 bp, Homo sapiens
acttccagtactatgtggaataggagtagtgggagtggacatcctcgtgttgttccatttcttagagggaatgttttcagtttttgcccattcagtatgaygctattggctgtgagtttatcatatatggttgttactattttgaggtgtcttccttcaatgcctaattcgttgaaggtttttaatcatgaagtgatgttg

SEQ ID NO: 30535 - DNA, 201 bp, Homo sapiens
tcaggattttaggagataccctgtgatctctgtgacaaaacagtctttactttggaactgctgttcacatctgcctgatagatcccaacctggattgcatyggcccggctgagttgcatttagaacctcagttccaaagaggtcaacaacaaagggccacaatcacatttgcaaaaatggtcacctcctctgcaacttgcc

SEQ ID NO: 30536 - DNA, 201 bp, Homo sapiens
cctttagaagtttgctttgtggacaatgaaagagagtgactggttatttctctaggatttagtatgtataactttctttgtaacttcagaatatagtttartatcttttattttgttcaatatagtcaaacattacttaaagttctttgggaaatatcatcattggcagaaagtatcaaagtgtatcaatttgagggtcca

SEQ ID NO: 30537 - DNA, 201 bp, Homo sapiens
ccagaatggtctcaatctcttgacctcgtgatccgcctgcctcggcctcccaaagtgctggaattacaggcgggagccaccacgctctgcccaggttacttcttttgtctcatttttatggtgtttcctggaggacaaaagataaaagcatgtgcttggtctgccatctttaactgagaatgttttatgcattagcctctt

SEQ ID NO: 30538 - DNA, 201 bp, Homo sapiens
aaagagctgggattatagacctgagcaaccaggccaggccagatactccacttaattgcaatcccctccatgtttactatagcttatacctttctttgccyagttgcattggttacagtccatctatctgctttagatttccccacagttttttcaccccctcattatcagtgtctggctgtttctgtcattatggccttt

SEQ ID NO: 30539 - DNA, 201 bp, Homo sapiens
agctcaagcagtccttccttggcctcccaaagagctgggattatagacctgagcaaccaggccaggccagatactccacttaattgcaatcccctccatgyttactatagcttatacctttctttgcccagttgcattggttacagtccatctatctgctttagatttccccacagttttttcaccccctcattatcagtg

SEQ ID NO: 30540 - DNA, 201 bp, Homo sapiens
ccagataaaatgttggcaagcacagtagctctaaatctatccagatggctaccgggaaaacatgctcctgtgtgtgtccatctgggcctagttctctagtyccccgaccaccccagatgcagatcattgcctcaaggtctggctggaacactataaggcttcggtgacatggaagagtcattgaggagccccactgaagaa

SEQ ID NO: 30541 - DNA, 201 bp, Homo sapiens
atccaaataaatatttggcttcgctaattgctttctggtgaaatagatttcctaaaacttttccagaagatcagctaagacacagcctactttgatacctscaggtttttccgcagagtttcttggggaggtagcagaatagtaaatagggcatttagaagttccgtgacagcaaagaccttgtctattttgttcaaatta

SEQ ID NO: 30542 - DNA, 201 bp, Homo sapiens
tgttagccaggatggcctcgatctcctgacctcatgatccgcccgcctcagcctcccaaagtgctgggattacaggcgtgagccaccgcgcctggcctacraggattttattagaaagagaattgttgcatattgttttgaaagaaaagtcattggtacttgcaaagtttttagaagctggcaagctctgattggtgaatg

SEQ ID NO: 30543 - DNA, 201 bp, Homo sapiens
ggggtttcaccgtgttagccaggatggcctcgatctcctgacctcatgatccgcccgcctcagcctcccaaagtgctgggattacaggcgtgagccaccgygcctggcctacgaggattttattagaaagagaattgttgcatattgttttgaaagaaaagtcattggtacttgcaaagtttttagaagctggcaagctct

SEQ ID NO: 30544 - DNA, 201 bp, Homo sapiens
ttctagtttttggatattatgaataaagctgctataatcattcatgtataagttttttttttatgggcatatgttttcatttctcttgggtacatacccgrgattggtcagcccataaaatcagtgtcccactctgctgccacaaatgggaataacttagctataaataaatacaaaacaaaacccagttatgtaaagaaa

SEQ ID NO: 30545 - DNA, 201 bp, Homo sapiens
tgggaaagacaaatcttcaaataatcgttagtggaaacacttaagataggattgttggtgcttgagaaataatacctggttacttatttaaccgaagtgayggtaaaacatttataaacaaacatagaaagtaacacaattttaaataactgtagttttttttatgaggagccctatgcttgcttgattaaggacctgata

SEQ ID NO: 30546 - DNA, 201 bp, Homo sapiens
cccattcctgtgatccctgaatcatgttgtttctgaatattcaggggtgggagtgtcctatcacagagaaagtcttgttcatctcagtctactatatgctrtaaaaccgaagatgccagcagctttcgcttatatctgtcaccactgactatctctctcccttggtacaggagtttgaccctgaagagttctaccaccttt

SEQ ID NO: 30547 - DNA, 201 bp, Homo sapiens
tgccatttctgttgcttaggtccttatttaaatatgatttgccaccattgggggactaaacaggtttttgtgaggacaaatgtatggtcctgaggggatgyggcagggagaattattagtctaggccacccccacatgagcagggctcacatcagtgggggtcttgggggtgagaagcgtcaggagcatagcccagtttag

SEQ ID NO: 30548 - DNA, 201 bp, Homo sapiens
gtggtggtaaccactgccatttctgttgcttaggtccttatttaaatatgatttgccaccattgggggactaaacaggtttttgtgaggacaaatgtatgktcctgaggggatgtggcagggagaattattagtctaggccacccccacatgagcagggctcacatcagtgggggtcttgggggtgagaagcgtcaggagc

SEQ ID NO: 30549 - DNA, 201 bp, Homo sapiens
cttccccagttgtcaattcactgttctcaccactcttgctgcctcttcacaagttcctttgctgcccacctcttcctactggtgtgtcacagggcaccatycggcatgcctggtctcccctttctctttcctccactctctctctgatgtcttgccacctgctcccatgtcttcagttgtcatctctacgctgaggactcc

SEQ ID NO: 30550 - DNA, 201 bp, Homo sapiens
gcggcctcgctcccggagcctcaggtgagggtgctctctgcccactgttccagtgcatgtggatttcagcttgtttgcataacacagaggtgggcacactrtgctataaagggccaagatagtaaatatttttaggctttataggccatatatctctgtcacattcctcaactctgctgttgtagtatgaaagtatccaca

SEQ ID NO: 30551 - DNA, 201 bp, Homo sapiens
ttgtagtgagccaagatcgcaccactgcactctggcctgggagacagagtgagactctgtctttcaactgccccctccccactccaaaaaaaatttagtgratttgtcttatttgatgggttatataatctgttaataccattttagttttgatgctcaaaattgtatcatatctggtcaagggaagtttcttcaggctga

SEQ ID NO: 30552 - DNA, 201 bp, Homo sapiens
ttcttgcctgctggacatcaggccatagttggtctgcaggctgtagtttgctaacccctggcacaatacattggccagcttgagtgagtctgggcacagcyttcacagccccagcaaaggcacttctcctccagatagcagccaaaaggaaacattgctgagctgcccccagggtggctctctcaagattgtggaagggcg

SEQ ID NO: 30553 - DNA, 201 bp, Homo sapiens
aacaattctaaaatttacgtggaaccacagaggactcagaatagccaaagctatcttcaacataaagaagaaaactggagaaatgacattacctgacttgmaatgatactagaaagctatggtaaccaaaacaacatggtactgacataaaaacaaacagagaccaatagaacggaatagagaacccattaataaatccat

SEQ ID NO: 30554 - DNA, 201 bp, Homo sapiens; identical to SEQ ID NO: 6213

SEQ ID NO: 30555 - DNA, 201 bp, Homo sapiens
gcaccaccaagcctggctaattttttaatttttttgtagaaataaggtctctctatgttgctcaggctggtctggaactcctgagctcaagtgatcctctwgcctcagcctcttagagtgctgagattaccatacctggcaaatcatgctcttcaaatgtgggtacactgctgttggtaatcattttctctgttttactga

SEQ ID NO: 30556 - DNA, 201 bp, Homo sapiens
caagaatatggctccagcttagcctaggcctcatgctctgctccccagagtggaaacaaggtggccatttcaacaactcccctggagaacacatccattaragtggggccagctcggaagggcagctacaaggccaagatggcccgaaggagcaagaggagccgcggcaaggatgggcaagaaaggtgagccaggcgcagt

SEQ ID NO: 30557 - DNA, 201 bp, Homo sapiens
tagactctagacccattgtataaccagtttgcagagtagtaattaggggcaaaaagaaaatgaaatttgccggccaggcgcggtggcttacgccagtaatyccagcactttgggaggccgaggcgggcggatcacgaggtcaggagatcgagaccatcctggctaacacggtgaaactctgtctctactgaaaatacaaaa

SEQ ID NO: 30558 - DNA, 201 bp, Homo sapiens
cagcactttgggaggccgaggcgggcggatcacgaggtcaggagatcgagaccatcctggctaacacggtgaaactctgtctctactgaaaatacaaaaarttagccggacgtggtggcgggcgcctgtaatcccagctactcgggaggctgaggcaggagaatggcgtgaacctgggaggcggaacttgcagtgagccga

SEQ ID NO: 30559 - DNA, 201 bp, Homo sapiens
aatacaaaaaattagccggacgtggtggcgggcgcctgtaatcccagctactcgggaggctgaggcaggagaatggcgtgaacctgggaggcggaacttgyagtgagccgagatggcgccactgtactccagcctgggtgacagagtgagactctgtctcaaaaaaaaaaaaaaaggaaagaaaatgaagtttggctttca

SEQ ID NO: 30560 - DNA, 201 bp, Homo sapiens
ataccacttcacatacaggataagaatcttccatttctccccttccagcctttatatagttgttttcaaacttttgatcctcatgtgttgtaaatcccacmctattatttaatagtaataatattattattaattaaacatttactgctttttaaagagatttaaataataagaaaatgtcatgcatctttttccatgtag

SEQ ID NO: 30561 - DNA, 201 bp, Homo sapiens
ataatctcaaagcattgggtctagtagtaagggtagatgtcctctgttttttcattattttcactgtcttctccctaatctccccaaacttagaatcttayatatcattaatttgtatcatttagtacctatcattgcagctgtaaaactcttcatacattgcaattgtaaaaattttagctcttgactccaattactctc

SEQ ID NO: 30562 - DNA, 201 bp, Homo sapiens
ttagaatcttacatatcattaatttgtatcatttagtacctatcattgcagctgtaaaactcttcatacattgcaattgtaaaaattttagctcttgactmcaattactctcttcagttctactcctgtattattctttttttcagtctgtttgtgagctgtaatgtgttattcttggtggtttcgatacacccgtagttg

SEQ ID NO: 30563 - DNA, 201 bp, Homo sapiens
ggaggttcaggcttcggttacgggcagcccctctggatcctgaaactctgccctgctctgtaggcagaaaagggaagatgcttgagctgatcccctaggtrtagcttctgaaggtctggcttcttgctagatttgctgacctagactccatgctgctcatcctacccccttgcccatgtcctccctgtccacaggcagtgc

SEQ ID NO: 30564 - DNA, 201 bp, Homo sapiens
gtatcgtgaaggcagtgggtatcatccaatgtgacaaattgaaaaatgacctgatcagattttagaataataaaagtcagtaacatttatggagcatttartacatgctagacactgcattacctcatttaatttatctggttaaatcttcacaaccgtgtaagaaaggtacttaatattatttcctaaatttacagataa

SEQ ID NO: 30565 - DNA, 201 bp, Homo sapiens
gtgaaagaagagacctagaattcatttcacctcaattatctgtcttgaactacctttgtttaacccacagggctaagggagtgtacttcagattttcttcytgagtcaaactgcttgccctgagacagacaggcttcttcagtgggcttcctttgtgatgttgcccttcagtgtctgtggatgcttattgattgaattaat

SEQ ID NO: 30566 - DNA, 201 bp, Homo sapiens
actctttgtcctctctaactcagctagtttaaagcagctgaaagggctctttgtgcctctctccttgactttgagctggagttcgtttgggggataaagasactacagggacttcacttttccttctatgaatttagaaagatttggtgcatacagagccatgcttacagtcctcctcccatgtttcttccctcttgagag

SEQ ID NO: 30567 - DNA, 201 bp, Homo sapiens
tacatttactcaccactcactcagtcacccagagcaagttctagtcatgcaaaccccactcatggtaagtgccctatacaagtgtaccatttctatcttttacatgtatttttactgtaccttttttatgtttaaatgcacaaatacttaccattgtgttacagttgcttacagtattcaatgcagtaacatgctatacag

SEQ ID NO: 30568 - DNA, 201 bp, Homo sapiens
gttattccaaggaggaacacagtgctttatggaatctaactggtgccgagtgtaattgctgacccagttcagtttaaagaagtatactgtgcggcccgtgraatggtgtccctctttagttccttaaaaaccactcaaggtctctgggcccatggtgtggccctattataattcatattttgttttcattgcagttgtcgg

SEQ ID NO: 30569 - DNA, 201 bp, Homo sapiens
tgcacttctctcccactggcggacggctcagctcagcctggcccaattgtggcagttcccaggggtgggttcccagggcagtgggcctgtaggggggcttrcaaaggagggttccagggactgtccaccttggcgtctgcaccggaagacccgtgtcctgcatctgtaccccactgcagccggcgtcatggcagtgactgc

SEQ ID NO: 30570 - DNA, 201 bp, Homo sapiens
aggatggaggtccggccagtgaggcagggcttcgtcaaggtgacctcatcacccatgtcaatggggaacctgtgcatggcctggtgcacacggaggtggtrgagctgatcctgaaggttagtgctgggcgtgctgcctgcatggtccctgaatgacctcagcctgtgagtctgtgatggcagttaggggagtgggtgagtt

SEQ ID NO: 30571 - DNA, 201 bp, Homo sapiens
tagcaggcatccaaatgctggttctcccatgcagctggttgtaagtttttttgagataggatctttccctctccacattgtcttcatagaggatatccacyttagcttgatgtcttccaaggcctcctcagttctctctacctagagcttcttgctgtgcttgtcacctttgtgagtggccaaccctctttaatggattac

SEQ ID NO: 30572 - DNA, 201 bp, Homo sapiens
  misc_feature (1)...(201): n = A,T,C or G, or insertion/deletion polymorphism (see Tables 1-2)
tggcctcctcagggccctccgggaaccgaggcgcatccaggaggcctgagcagcggcgtcgcactgtcattggagggcttgagtcactctctgtgtgggangactcagacaccgacagccgcttccgtaatctatgagacacaaggcctggggtgagtgacccaggtggtccccctcctcctgccaggtctccttaggggc

SEQ ID NO: 30573 - DNA, 201 bp, Homo sapiens
atggcgtgaacccaggaggcggagcttgcagtgagctgagatcgcgccactgcactgcagcctgggagacagagcaagactctgtctcaaaaaaaaaaaaatgccaaacttagatttaggatactacccctaacccccatcaaatggtaactggtaagtgtatgtttaagtttctaaaaaattgccacataattttccaaa

SEQ ID NO: 30574 - DNA, 201 bp, Homo sapiens
aaaccaggaataacttcttaattttatttcttcgttcttccagcctcctaattacatccatggggcacatcaagctcacggactttggactgtccaaaatkggcctcatgagtctgacaacgaacttgtatgagggtcatattgaaaaggatgcccgggaattcctggacaagcaggtaaggaagggtagttgatacactg

SEQ ID NO: 30575 - DNA, 201 bp, Homo sapiens
taatgactgagaccttccagaactgattagaaacaaacaaggaacatcttgaagcatggtgagtccccactataataaataaaaataaatccccatctagmtacattgcagtactgcagagccatgaaaacaaagagaatatcttaaagaaccctcaagaattcactaaagtaaaagagctcagcaagaaagttcactcaa

SEQ ID NO: 30576 - DNA, 201 bp, Homo sapiens
ggtgtgtgccactgcacccagctaatttttaatttttttttttttttgagacgaaggcttactcttgtcccccaggctggagtgtgatggcgtgatctcakctcactgccaacctctgcctcccagattcaagcgattctcctgcctcagccccctgagtagctgggattacaggcgcctgccaccatgcccggttaattt

SEQ ID NO: 30577 - DNA, 201 bp, Homo sapiens
tacttcctacagagacattttcataacaatacagccattaaaatcagaaaattaacattaataaatattaccatctaatctacaagtttaattcatatttyaccaaatgtcccagtaatatcctttgtaacagaaggctccgatccaggatcatgtgttagaattttactgttattcgtcttctatctcctttaatctgat

SEQ ID NO: 30578 - DNA, 201 bp, Homo sapiens
ctcctggtctcaagtgatcctcccacctcagcctccctagtagctgggactataggtgtgtgccactgcacccagctaatttttaatttttttttttttttgagacgaaggcttactcttgtcccccaggctggagtgtgatggcgtgatctcagctcactgccaacctctgcctcccagattcaagcgattctcctgcct

SEQ ID NO: 30579 - DNA, 201 bp, Homo sapiens
ttgtcttttttgaatactctggtttattttctgtgtttccaatcttcagtgatagtaattgtgtaagtactttttgtgtgcagttgttttttttttttttycccaaatttaagcagactagcttatttgtagattttctctttttcctcttctaagctccactgtcttatttttctgtctatgttgggatcacaacgtact

SEQ ID NO: 30580 - DNA, 201 bp, Homo sapiens
tttgtggtggaagaaatattccttctatcactgtttatgctctcaatcccctcccttccttttcaagaataactttttttttgagaactttggctgcagartatggagagttaaatgcaagctggaagagttgtctagattcactgtctttatttcctcatctcctacccactggagttgggcttttgctcctaccactcc

SEQ ID NO: 30581 - DNA, 201 bp, Homo sapiens
tgtaatacattgcgttttatgccttgattggaaggaatgagtctgttataaacaaacgttgatgctagctcttaagtgtctcagatgggtatgatgaaccktaagaggcataataaatttcattgtgatttgggttaaattaaataaccactaacctttactccatttgcatgtcttctaagaaaatgattccagagtatt

SEQ ID NO: 30582 - DNA, 201 bp, Homo sapiens
taaggtcttaagcctctttattgactgtatcttagggatggtcttaggaccttacaaattgttgcccgtaataatttgaaggacaatgaagatacagtctkgaaatgatacccactctagctctgtaatacattgcgttttatgccttgattggaaggaatgagtctgttataaacaaacgttgatgctagctcttaagtg

SEQ ID NO: 30583 - DNA, 201 bp, Homo sapiens
acttgaacctgggagacagaggttggagtgagccaagatcatgccactgcactccagcctgggtgacagagtgagaatctgtctcaaaaaaaaaaaaaaaatttatgtgaagcaagaatcaatacatatatgacccattagggtaatttttcttggcagtccttcccttcctggctgctgtttaccaacttaattattctt

SEQ ID NO: 30584 - DNA, 201 bp, Homo sapiens
taattactagtttattttcctcaatttgttttagtaaacaaaatattgtatccttctactttaatgaaaaattttaagtttttttttttttccccaacttyagctttagggtcagggggtattgtgcagatatgttacatgggtaaattgtgtgttgtggggatttggtgtacagattattttgtcactcatgtaatgaac

SEQ ID NO: 30585 - DNA, 201 bp, Homo sapiens
ttacaggcatgagccagcacacccagcctctaatttcccttttgatttcttctttgacccacaaattattcagaagtatattgtttagtttatgaatattkggggattttccagagatgtttctgttactgatttctaattctatttcattgtagtcagaaaacatattttatatgacttgaatccttttaaaatttattg

SEQ ID NO: 30586 - DNA, 201 bp, Homo sapiens; identical to SEQ ID NO: 6205

SEQ ID NO: 30587 - DNA, 201 bp, Homo sapiens
tcttaaaaaaaaaaaaaaaagatgtaggtacacacagaacttgaatgtggcacaacagagagttttctccacaaggcagtaccctccctgactaaggcccwgggatccttctgagctgtgggtagggctgcagaatgggacggattagcctgttttctaccttcttaccccaaaccactctggggctccaatgggagccat

SEQ ID NO: 30588 - DNA, 201 bp, Homo sapiens
agagaaaaggctagagagagaggcaggaactagttcatcaagggcccttttgttatatttgggttttattctaaaggggcctagagagtcttggaagggtstgctaaccaaagatatgatagaatggcatgcccagattatggttcaggtttagaaagctcactctgccggtgaaaagagacactgagaccactgccaaag

SEQ ID NO: 30589 - DNA, 201 bp, Homo sapiens
tagatggtgagagagtagtaagagaaaaggctagagagagaggcaggaactagttcatcaagggcccttttgttatatttgggttttattctaaaggggcytagagagtcttggaagggtgtgctaaccaaagatatgatagaatggcatgcccagattatggttcaggtttagaaagctcactctgccggtgaaaagaga

SEQ ID NO: 30590 - DNA, 201 bp, Homo sapiens
tccagataaaatgttggcaagcacagtagctctaaatctatccagatggctaccgggaaaacatgctcctgtgtgtgtccatctgggcctagttctctagycccccgaccaccccagatgcagatcattgcctcaaggtctggctggaacactataaggcttcggtgacatggaagagtcattgaggagccccactgaaga

SEQ ID NO: 30591 - DNA, 201 bp, Homo sapiens
ccaaggcaggtaggtcatctgaggtcaggagtttgagaccagcctggctgacatggtgaaaacccgtctctactaaaaatgcaaaaaaaaaaaaaaaaaaattagctgggcatggtggtgggcacctgtaatcccagctactcgggaggctgaggcaggagaattgcttgaacctgggaggcggaggttgcagtgagccaa

SEQ ID NO: 30592 - DNA, 201 bp, Homo sapiens
tgtgatccctgaatcatgttgtttctgaatattcaggggtgggagtgtcctatcacagagaaagtcttgttcatctcagtctactatatgctgtaaaaccraagatgccagcagctttcgcttatatctgtcaccactgactatctctctcccttggtacaggagtttgaccctgaagagttctaccaccttttagaagca

SEQ ID NO: 30593 - DNA, 201 bp, Homo sapiens
ctagcacataggaggtgcccagtaaatatttgaaggtatacatgcaccagtagggctttgccaaagctcttgtgagccataattgagtgtgtgccaggacwgctgtggactgggcatctgaatacaccagacagtgccacctggctgatggaaagcatgggaccagatcaataggctgagctctctttagagtaaaacctc

SEQ ID NO: 30594 - DNA, 201 bp, Homo sapiens
cagtgaggtcaaagagttgctagagggtttaacccagtgtgtggcacttagtaggcactcagttattatgtgcagacaaggattgtgcttttcaatggatytccagcctctagcacataggaggtgcccagtaaatatttgaaggtatacatgcaccagtagggctttgccaaagctcttgtgagccataattgagtgtgt

SEQ ID NO: 30595 - DNA, 201 bp, Homo sapiens
gcaatacttgcctaagagcaggaagctgaagctttctaggatacttctgtttctagaactaggaaaattttatttactaaattttacattgtgttatggamaaatctcaaaaatgttcaaaagtagaaagactcatactacatccccagtatcgtctacattgtcagctcatggtatactatctcatctacatccccacct

SEQ ID NO: 30596 - DNA, 201 bp, Homo sapiens
attcttagcacttcattttgcttccattacttttttctttgcttctattacttttctcatattcttattttcccttggatatattgcctaccatatgtccatactgcagaagctccattactggcttaggtgaggcagtggcagctgggtgccctcctgccctctcatgcattctcactaattgtttctgctgaaaactgg

SEQ ID NO: 30597 - DNA, 201 bp, Homo sapiens
aaaagggaagatgcttgagctgatcccctaggtatagcttctgaaggtctggcttcttgctagatttgctgacctagactccatgctgctcatcctacccscttgcccatgtcctccctgtccacaggcagtgcctatgaggtgaagcagcacccattctttactggtctggactggacaggacttctccgccagaaggct

SEQ ID NO: 30598 - DNA, 201 bp, Homo sapiens
gagtgtgagcttcttgaagaagacagttctgaagatacagggcttggtacacagcaaacttgtaattaatgtttgaggtcaggcatgggtggctcacatcygtaatccaatgctttgggaggctgaggtggggggattgcttgaggccaggagttcaagaccagcctgggcaacctagcaatatcccgtatctaaaaataa

SEQ ID NO: 30599 - DNA, 201 bp, Homo sapiens
tccctcctcttcaattttctggaagtgtgtagaattgttactacttctgtcttatatgtttggcagaattgtccagtgaagcctctgaacctagaatttgwgggaaggttttaaattataaacttaattttgttaatagatataggattagttaggttatctgttactgagtgagctttggtagtgtatatctttcaaaga

SEQ ID NO: 30600 - DNA, 201 bp, Homo sapiens; identical to SEQ ID NO: 6209

SEQ ID NO: 30601 - DNA, 201 bp, Homo sapiens; identical to SEQ ID NO: 6211

SEQ ID NO: 30602 - DNA, 201 bp, Homo sapiens
gctgggattacaggcgtgagccaccgcgcccagcctcttatatttaaatttttatttttgctggtcatatatttagttacatagagccatttcttgtttgktttttcataacattctcctctttttttaaaaggatgcgattatcttctctttttttttttgagacagagtctcactttactgcccaggctggagtttagt

SEQ ID NO: 30603 - DNA, 201 bp, Homo sapiens
tttgcttctgtagattttcttttttccttcattctcaaaacctaaaactcatagtggcctctaccgccttcaaagaaaagacttaaaaaattcagggggawaaaattatacgaagaagtcacagtacaaaaggaagcaattacattgtacattgtggcataattcttttctttcctttttttttgagatggagtttcgctc

SEQ ID NO: 30604 - DNA, 201 bp, Homo sapiens
tttttgttttatttatgttccatgggcattgaagaatatgaaatgagtacaaggggctatatttcttttacataaaatgtattatgctttctttcaaacaraatacattatgcttctatattgcttttttttattgttaactcttcctgttgttagctgatctgctttaattggctttttgttctagtgatttcagagttc

SEQ ID NO: 30605 - DNA, 201 bp, Homo sapiens
tcactgcaattctttcctggaacagtgaatatatgacagcctggtatccaaggtccttcaacctgtgatgcttcctcacctttccagtcccatctcccccmtctccctatctcataccccagcctccagcctgccatgctgttcctcacctccaggaactttgcagttactcttctgtctctctctgcagtgccctccttc

SEQ ID NO: 30606 - DNA, 201 bp, Homo sapiens
gctagatcactaagtttattaggtacatattttgctttccatgtaactgcagacaatagtggcactaagctttctaccactacctaacaaggatgtccctyctccatgatatggtttgcatgggtcccccaaatgtcatgtgctggaaagttaatccccaatatggtagtgttgaaaggtggggacttaaagaggtgattg

SEQ ID NO: 30607 - DNA, 201 bp, Homo sapiens
ggccagaggagcctggccagattcttcatcacaaatgtactcgcagctgcatcagtgagggacagccccagggaccacagagttcttccatgcccactgcygctaattagagataatacattaaaaatacagagccgcatctgttcgttgtaacatgggtatcgaggaatttacgtggtttataatgacagagtgtgggga

SEQ ID NO: 30608 - DNA, 201 bp, Homo sapiens
ctctgtgtctccatcttctcacctgcaagccacaggttataaagggttgctgtaatagatgagtaaatacatgcgagggacttagaacagtgcctggcgtkcagtaaatactcagggcagcatctgtgtcccaagtggtacgtaagttctttatgccatgtcttctcattctattcccatatgaccctgagaaacagcttt

SEQ ID NO: 30609 - DNA, 201 bp, Homo sapiens
ttgtatgtgaatatttgtatccatgtgtttacatgtgcttgaatatgtacttgtgagtgtgcttgttatacgcagaaatgtgcatgtatgcatgggtaagkgcacagtacgagaagcagcccagtgaatattaagcatactatcgggggtgtgcattaaattgtagccagaccattgagccagccccaggttccattttac

SEQ ID NO: 30610 - DNA, 201 bp, Homo sapiens
caagaacatggcatcatctttggtcacaatgactgctccaacttttcctaagtcatgaaactgaacatcttcaagctttagggtcaagctctcttccaaayaccatgccattatagcaatagctttgtttggtctttctgtgtcaccaaagcctggagttttgactactgtagcccaaatgccaacttttatcctatttta

SEQ ID NO: 30611 - DNA, 201 bp, Homo sapiens
cccctggccaaatctagccagaaggttgtttttgtaaataaagttttattggaacacagccatgcccattcgttgacatgtgtttggtggctgtcttcatrcactacaactgcagagttgagctattgtgacagagaccctatgcaaagccaatgagatacttactttttgaccctttacagaaaaaatttacttacccct

SEQ ID NO: 30612 - DNA, 201 bp, Homo sapiens
agttgggcaacaggaggtctgtaaactccatgacattagagacaaaaattctgagggtgggtatatctttttctagggagaatatacagcaggcattagaraactcagatccccctggccaaatctagccagaaggttgtttttgtaaataaagttttattggaacacagccatgcccattcgttgacatgtgtttggtgg

SEQ ID NO: 30613 - DNA, 201 bp, Homo sapiens
gtctgtagttgggcaacaggaggtctgtaaactccatgacattagagacaaaaattctgagggtgggtatatctttttctagggagaatatacagcaggcrttagagaactcagatccccctggccaaatctagccagaaggttgtttttgtaaataaagttttattggaacacagccatgcccattcgttgacatgtgtt

SEQ ID NO: 30614 - DNA, 201 bp, Homo sapiens
agtaacatctaactgctcaattatttcttgcatatttttctcagtttgagtcttgtcaccttttccttccaagaacatggcatcatctttggtcacaatgrctgctccaacttttcctaagtcatgaaactgaacatcttcaagctttagggtcaagctctcttccaaacaccatgccattatagcaatagctttgtttgg

SEQ ID NO: 30615 - DNA, 201 bp, Homo sapiens
caaaactgcaacaacgctacacccattgagcaacaactctcctttcccccagcccatgacaatcaccatcttaatttctgtttctgagagtctattttaartatctcatataaatggaatcatgcagtaatatctttttgtgacttatttataggtttaatgacttatttattgttggtttattgcacttcatataatgtc

SEQ ID NO: 30616 - DNA, 201 bp, Homo sapiens
gcccgccaacatgcatcggtacaaagcagctgcagggtgcactctgctcttggggctcacagttgtgtgctccagaaccttccatgcacagcagctgcatsttgggcctggggccaagagaattgaaacagacaaaagttgcagaaaacccattgtttaccctgctttgcatgcatgtgtccccacacgcactcactcacg

SEQ ID NO: 30617 - DNA, 201 bp, Homo sapiens
cctcgcagaccgtgtcgcccaccgcttaaccgcggcatgttggggttcttggtcagggagggcgccccgagccagctctggctctctcattcctagctgaygggactttcttaggttctgctaagagtcatagccaccgacacccagagaggggcgcccgcggtgcgcgcgcctgggagctctggcctctcgcacacccac

SEQ ID NO: 30618 - DNA, 201 bp, Homo sapiens
actcctgtaacattcagtgtatctgactctgtttttttcattctcttccacatcatttttcccatcaaccttcagcacagctattgcatccaaaattttgycggatgttcttctagttttcctttttcatagacactaatagtaacatctaactgctcaattatttcttgcatatttttctcagtttgagtcttgtcacct

SEQ ID NO: 30619 - DNA, 201 bp, Homo sapiens
ttgccagaattttgagtgttcttttaattatttctatactaactttttactcttcattagctggagcagtgaatctaaggatgaaatgtaccaaggcaaarcacccaaatgatatctttttcaattgtaactcctgtaacattcagtgtatctgactctgtttttttcattctcttccacatcatttttcccatcaacctt

SEQ ID NO: 30620 - DNA, 201 bp, Homo sapiens
tcaccaggtttcaagcgtaacccactccttttgacaggaaatgaatttaaagcacatattcttataacagtcgttcattcactcagtcatcaaactgtcaytgggaaacttctgtgtgcctggttcagtgtcatcacagaatatagatgcacaagctcatggggcaacagctagaagaacaggacatgattttgcagtgcg

SEQ ID NO: 30621 - DNA, 201 bp, Homo sapiens
agttagctcaagcttgcgttgcatgatgacatcatccattactagaagcagcccaatgaatattaagcacagatccattaggttaggcagtctttccttgsggaggaatgagtggagagggtggacacagaaatcagaaggattatttctgggcccttgagagaggcaaggagcaggagacttttcctcagtgcaaccgtg

SEQ ID NO: 30622 - DNA, 201 bp, Homo sapiens
gaagcagcccaatgaatattaagcacagatccattaggttaggcagtctttccttggggaggaatgagtggagagggtggacacagaaatcagaaggattmtttctgggcccttgagagaggcaaggagcaggagacttttcctcagtgcaaccgtgagaagagaggaaggggaggctccctcttagcatcgcctcccctc

SEQ ID NO: 30623 - DNA, 201 bp, Homo sapiens
tctttccttggggaggaatgagtggagagggtggacacagaaatcagaaggattatttctgggcccttgagagaggcaaggagcaggagacttttcctcartgcaaccgtgagaagagaggaaggggaggctccctcttagcatcgcctcccctcatggccacacatatctcacagtgcccacatcagcccctacatggaa

SEQ ID NO: 30624 - DNA, 201 bp, Homo sapiens
gcaattgtgtttaaaattttaaggacgataatagaatagatcatcttttttctgtaaaaaactggaatttgctcagaaatttcaaaagattcataggggtstctccttcctgtctaggggcaagataattcgatacaaaagcagcatgagaggcatttctatccacgaggtcccgaggtagcatgtggcttccactctggg

SEQ ID NO: 30625 - DNA, 201 bp, Homo sapiens
gcatcagtatgctctcttgctctctggcttccagttgggctagatcaacaggagaatcagtgggagactggaggaggggaaggaagagagtgagttctgcrtattcattctttgcctcctcttgatgggcttttcacaaattggctatagccccagattgtgaaagaagatctgggtcctatatggtgtcttcttacatgc

SEQ ID NO: 30626 - DNA, 201 bp, Homo sapiens
tgaataaaaatccctgcctttgtagagcttacattgcaatgtggagtgacaaaaataactacataaatggtatagtatgttagaacattgggaagataacrttgggaaggaggcagggagagctggggttgcaggtgtcattttaatggagtggtcagggaaggcctcagtgaagaaatggtgtttgcacgaacacttaag

SEQ ID NO: 30627 - DNA, 201 bp, Homo sapiens
tggtatagtatgttagaacattgggaagataacattgggaaggaggcagggagagctggggttgcaggtgtcattttaatggagtggtcagggaaggcctyagtgaagaaatggtgtttgcacgaacacttaagggaaaaggggagcaagtcgtagagatacctgaggaaaggccttttggggaattggcaggctgaagca

SEQ ID NO: 30628 - DNA, 201 bp, Homo sapiens
ctagcctcatttaggaactgagccctctggatacttcctcttacagggggcactttgaataaggtgaatcttcatagcccaagttgcagcggtgcataagsacagtgtgggcaaggacaggactgatgccagggatttgacaaaacaaaatttaaaatgggcaagctgggtgtggtggctcatgcctgtagtcccagctac

SEQ ID NO: 30629 - DNA, 201 bp, Homo sapiens
ggaagataacattgggaaggaggcagggagagctggggttgcaggtgtcattttaatggagtggtcagggaaggcctcagtgaagaaatggtgtttgcacraacacttaagggaaaaggggagcaagtcgtagagatacctgaggaaaggccttttggggaattggcaggctgaagcagaagcatgcctggcatattgtag

SEQ ID NO: 30630 - DNA, 201 bp, Homo sapiens
atgctggggtaccagggctatcaggctcaaattgttgttgtggtgctggaactgctcctgttctcccagggatagtgaatcagagggctatccccctgccrcactgtattagctaggcttgaataatgtatgtttccctactaatgccctctgtttgatcatgtgtccatgttagtgttcattggaaattttcctgctgga

SEQ ID NO: 30631 - DNA, 201 bp, Homo sapiens
ggtgtcattttaatggagtggtcagggaaggcctcagtgaagaaatggtgtttgcacgaacacttaagggaaaaggggagcaagtcgtagagatacctgaggaaaggccttttggggaattggcaggctgaagcagaagcatgcctggcatattgtaggcacatcagagaggcccatgaggctggagaagagcaatcgagg

SEQ ID NO: 30632 - DNA, 201 bp, Homo sapiens
cattttaatggagtggtcagggaaggcctcagtgaagaaatggtgtttgcacgaacacttaagggaaaaggggagcaagtcgtagagatacctgaggaaaggccttttggggaattggcaggctgaagcagaagcatgcctggcatattgtaggcacatcagagaggcccatgaggctggagaagagcaatcgaggccaaa

SEQ ID NO: 30633 - DNA, 201 bp, Homo sapiens
tgggagtcacatggactttgatctagatcacaactctgacaccttttagcttgctggccctgggcgggttccttcatcttttttagccacaggccttcatytgtgaacaaggaaaacaaaatcttccccgcctactgattatgaaatttaaacaaggcattttctagaaagtgaccagccctgacggtggtggagggtaca

SEQ ID NO: 30634 - DNA, 201 bp, Homo sapiens
gactatgacatgaatagtcctcacatttcccacaataaatacctggaagctactttgaaagtggatcattacagagcaggtcatacttcgattgagagacratgttaaactttggagttctgctcttaactctagatcaaatataatgttatcaatagaaaagggacaatacctataaacatctataaaaatataaaatat

SEQ ID NO: 30635 - DNA, 201 bp, Homo sapiens
taatgagtgaagccccagtctccatttttggcaaatttgcagacgcattcctgtaacacacctaaaataccttttatattatctattagcaaattttacayacaacatatagatctatacatatatactaagcaaattacagaaacataaaacaacctggcttccaaaggacaaagttatcatttcctccatggctaatcc

SEQ ID NO: 30636 - DNA, 201 bp, Homo sapiens
cacactgacccaacggccagagagcagccctggggcctgccctttgccttctcctcctcctcttcccattttcctccttgtcctctttctccctcacttcscatttgaactgcagtccagggagtcattactgctacatttctctctttattttccttttgaatcacttccacctgctaagacagtcctccttcagctcct

SEQ ID NO: 30637 - DNA, 201 bp, Homo sapiens
agggaggcaggggaatgcctagtaacctcctccaagggcccctggacctggctgagcaaagagaggactggggaagtgtgggggtgggtcctgcctcgggkcaatggggaggcactgggggctctcttcttgggcatggggaggatgacatctttcagaacatgttcctgctaccagtgtttgtaaggttaataggggtct

SEQ ID NO: 30638 - DNA, 201 bp, Homo sapiens
ggaggcaggggaatgcctagtaacctcctccaagggcccctggacctggctgagcaaagagaggactggggaagtgtgggggtgggtcctgcctcgggtcratggggaggcactgggggctctcttcttgggcatggggaggatgacatctttcagaacatgttcctgctaccagtgtttgtaaggttaataggggtctag

SEQ ID NO: 30639 - DNA, 201 bp, Homo sapiens
ggcctctctgagcaggatccatttagacagagccctaaaggttaagtagaagccctctgtgccagagtgggggccaggggcgtttcagagggaagagtttraagtgtgtgttagagaatctgaaagaacacaggaaagaccaaagtgaatcgatttttaatggaaggtcctaaaaagcatgtattttctctttcaagccct

SEQ ID NO: 30640 - DNA, 201 bp, Homo sapiens
gccaggactgtgaagggcaccagagaacaaaatgctgtcctcgacctctcttgaggagctgccagatgcctgatggtgccgctaagacagatggaaggagytgttctgggtcctccagagccccttgttctggcaagacctgtcttctggaatgatgttgcttcattctgaatgttcaaggccccctcctggtctctgttt

SEQ ID NO: 30641 - DNA, 201 bp, Homo sapiens
gcctagtaacctcctccaagggcccctggacctggctgagcaaagagaggactggggaagtgtgggggtgggtcctgcctcgggtcaatggggaggcactgggggctctcttcttgggcatggggaggatgacatctttcagaacatgttcctgctaccagtgtttgtaaggttaataggggtctagttctggggaatggt

SEQ ID NO: 30642 - DNA, 201 bp, Homo sapiens
ctctttcctctgtctcatacccaacactctccatctgagtctctccagaaccatccccagattaaaagagaggagggaaagccagacatcctctcctagamtataggagaggaagtttgtgcagtttctctggaattagatatcgagcctgcaccatggcatcgaactgggaagggggtaggcttgggagtcagcagagac

SEQ ID NO: 30643 - DNA, 201 bp, Homo sapiens
cttccctcccttcctgctttctggggcctgggaagctgggttgagggtagcaaaggaggaagaggggaggagaacagaacctcagctcctctactcggcaytcaaggaccttcgcagtccagctcttgccttcctgtccagcccagctctgtcatctctgcatgtccctttcagttcagacggtcctgcctaataagtccc

SEQ ID NO: 30644 - DNA, 201 bp, Homo sapiens
tgcttctcaggtgaacacaaaaggccaggaggctgctgagtgtggggggtcaaagatgagtaaagtgatgggctgtacctaagcactgacctttaccacartgaccctgccggcagctgagatgtggtccagggactgtcagcccccaccagccagagaaacacatgtttcccttggggaggagcaagcaggggatgagag

SEQ ID NO: 30645 - DNA, 201 bp, Homo sapiens
cttgtcagtttgatcaccaacaagaaagagggcatgttttattctcacaaaaaccaggtaattaaaaaaacaaaagcgtcatcagtttgaaaagtgaaaayggtatctcattttctaatttgccttgttttattactagttaggttaaatttttataatgtgtttattggcctgtgcattttttatttgtgaatttattgt

SEQ ID NO: 30646 - DNA, 201 bp, Homo sapiens
taataggatttaacactcaccaccaattttcttgccatacattttacattccaagtgttgtattttgattgatttcttcatttgccagagtccactgtcakatacttcttacaagaaaggttcatgggtgttgtattccctgaattcatgctcgtgaatgtccacctgttgtctaaatatgtaaatgacaacttcaatgag

SEQ ID NO: 30647 - DNA, 201 bp, Homo sapiens
atttcccatgctatcaaatctatcaatgttttcttatatagttttctcctttgcttttatgctggtcaaataaatattcctctgtgttttctttcacttcytagtttcatcacactgctttaatacctttggaatttattttgatttattatttgatatagggaatctaaccatattctttcaaatatagttaatcagttg

SEQ ID NO: 30648 - DNA, 201 bp, Homo sapiens
ttgacgtagttttctgatatgtctcggaagtcaaacaatgtgggcttaagaatcacccgtactgcttacactgctgtgtgacctttggcaagctacttaamctctctggtctctggttcttcatctgtctgtcccaacaggatactgtgagaattaaaatgaggaatttaatgtgaactcttactatgcacaatgcatagt

SEQ ID NO: 30649 - DNA, 201 bp, Homo sapiens
gcttagtgagcaaatgggcacatgaagatatgaacacatgaatggatggttttctctaacagaagggtttccttgggcaagctgcccttagcattgcttargcagagtagcatggtcaaagctacctagcctgggctccagaaaggtcatgacagcctggcccagtgttatgggcataaccaaggtttgggaaaggtcacc

SEQ ID NO: 30650 - DNA, 201 bp, Homo sapiens
tgggtaatagggagggtgtctgaacattcatggggttgaatctcctgctcccacagggtcctgttctgccctgatggagggatggactgaggagagtttgmtgggtaatagggagggtatctgaacattcatgaggttgaatctcctgttcccacagggtcctattcttgcccactcacctccctcaccaccaacattcac

SEQ ID NO: 30651 - DNA, 201 bp, Homo sapiens
aggagggaggggtcagcagaaatgaaaccttggttccagatgggtgactgatcgaatacgttaatacgtcaaggacaatagaaggcaggtgtctcactgtsagagaagagggttagaactatggatagagcaaaaattataatatacccaatggtgttaaatttgaattggatgtatcagtgtgagcttatggttttcaat

SEQ ID NO: 30652 - DNA, 201 bp, Homo sapiens
gcttcagaattacctctgcctccattttagcccctgttattccagctcctggggagttccacacaggatagacatctcgactcaggaacgagcaggggttggggggcgggtagctgtgatgcaggtttctcgtaggatggcataaggcatccaagggcagagacctcccatatccatcatttccactcatcccttaggcac

SEQ ID NO: 30653 - DNA, 201 bp, Homo sapiens
ttcaaaaatataaaagttctgaaggtcaagtaaagacactggaaccattccagactaaaggagaccaaagagacatgacaatgaaatgcaacatgtgattytgaactggatcaataaattatcaaggaatttatcggaaaaacaggtgaaacttgaatgagatgtgaagattcgatggcagtaatgtgtcagtgttaattt

SEQ ID NO: 30654 - DNA, 201 bp, Homo sapiens
atttgagagcctgaacttagccatacaccagatctacctttggaccgcaaaagggacccagtgcttcatgaagctggttttttttgttttgttttgttttktttccgttgttttgtttcggctttaccaacctgactgggtgtttttcaatatccaccattcagactttcctcaacagcagaggatgtggcagtggcaaag

SEQ ID NO: 30655 - DNA, 201 bp, Homo sapiens
aataatagattcacaggagaggttccatgtacccttctcccagtttcctccaatagttacatcttatgtaactatagcacactctcaaaaccagcacactrccactggtgcaatgtgtgtgtatacttctgtgtcattttatcacatgcagattcccataaccatcactgcaatcaagacacagaatgattccatcaccca

SEQ ID NO: 30656 - DNA, 201 bp, Homo sapiens
atcatggttttttaattgtctgtattttctgatactttgacatcttgggactttgttgacctaaaatagcaaagagctctcccggaagtatgcctttcatrtgcaaactgatgatcccaattgggtagagcacaactaagtcttttattattttttttttaatttaattttttttttgagtcaggatctcacttttttgcc

SEQ ID NO: 30657 - DNA, 201 bp, Homo sapiens
atggcaccaaccggaactgggaccaccccctgcccaagtgtgaaggtatgtcgctccctcatccccagcagttcttcctggggtactcgtggagactggtycagagcaatcccatgttccacctacctgctctgtgggatctccagggctggaggtccaggcaaactgtggtccatcctgttttcacatggtgtggcccag

SEQ ID NO: 30658 - DNA, 201 bp, Homo sapiens
atctgtcttatattttgttgtgcctgtaaggtttcatctgataaaaggctgctacagccaaaagaactttagagacttctaaagggctgcacccttgtaaragtttctgttgagccatggtttcaggctcctctgcggatggtcctctgggtgccatctgagcagcacaaggtagatgcatgcaggaccctgcccccaagg

SEQ ID NO: 30659 - DNA, 201 bp, Homo sapiens
tcctgacttcctggagtcatggagagtggttcttgcatcacatattgtaagtgggagccagaagggaggtacgtgtgcagtttgaaaaagcatcttcagartgacctttactttgacttgtttttattcattttattttgaattttaaaccacattgaagaaggaggcagtcattttatgtgaatcttcatagggggtccc

SEQ ID NO: 30660 - DNA, 201 bp, Homo sapiens
tgttcacttgaaggaaggagactcttaggggaaatgacgactgttgtcaaaagctgacataagatggtggcactcaggctgtgaaatgtacattccagggraacaaacttcaagtcatttctaacacttgtgtctgtctagaactgagggtccctgtctcaggaagcaccagtgcagaagttggggcttctagggaagcac

SEQ ID NO: 30661 - DNA, 201 bp, Homo sapiens
ccttccttgcccaggacaccctttcctcacaacctggtcaaaccctcctgtgatacctgctcagattaccatgcattcaccctttgtggttttacacacgygtgtgtgtgtgtgtgtgtgtcttcttcatttatgcccatctaccccacaaggctgtaaactccttgatgacaagaactctttctcttttacttttcattg

SEQ ID NO: 30662 - DNA, 201 bp, Homo sapiens
agcatctattatgtaccaggttcaggtctgcgagctagagatagagcagagaaaaaaatggtgccccactctcatggagattgtattttactggggagggygcatcagaaaattaacaagaggaaaatatatggcagaggtgctaagtgctatcaacaaataaagcaggcaccaggaacacctggcttgagaagcaggtct

SEQ ID NO: 30663 - DNA, 201 bp, Homo sapiens
tttcccatgtacactatctttctttatagggtaggctccatcacttcataactgtatgccctgaaacaagttgcctaactcctctgagcattgcttcctcmtccatgaaaaagggacagtgacactaaacgaaggagttgttgtgaggattagcacataggcacagcatcaagcagagtgcccagtgccaataagtatttg

SEQ ID NO: 30664 - DNA, 201 bp, Homo sapiens
atctgtttgagattggtcatgagatttcagtaattcagtcacatcttcaggctccacttctaattctagttctcttgctacttttaccacatctgcagtgrcctcctccactgaagtcttgaacccctccaagtcatgtgtgaggggtgcaatcagctttttccaaactcctgttaatgttgatatttggacctcctccca

SEQ ID NO: 30665 - DNA, 201 bp, Homo sapiens
tggatgatatgtcctgggcttccctgaaggcccagggctgagatagatattagagtaaagggtctttttattttggcaattttaaggtttttattttaaartctttcgttttcaattaatcgcaattactattctgtgatttttaggacagtttaggtgaaccccaccttaagaatgaaaacgaacaaaactctttccatt

SEQ ID NO: 30666 - DNA, 201 bp, Homo sapiens
cacatccccttcttcagaacttcactccagtggtgggcactgctgagcccccagaagaggtggttttagaagcagacttcaaaggaggccaagggcagccraccagcatcactcaccactccctctaggacaccgcctttcctcttgtcagatgccaagcacatggctattttcagcctctcttctgttattttcagtaca

SEQ ID NO: 30667 - DNA, 201 bp, Homo sapiens
agacacaggcttttagtatctcaggctggagtattatcttctgtccccttagttatctacaagagcaaggccaggccagggcctgtgagaagtggctgccrcccacttccttcactgccctccctggattgactctccatgcaagacaccagtggagatccaagtatttcttcccaaaggatttaaggaagctgggcaggt

SEQ ID NO: 30668 - DNA, 201 bp, Homo sapiens
tctcttttttttctatattctgagaaatttacttttcatctctaatcctataatgcttatttcggcaatcatatttttcatttcaaagagtttgtccttgttttttttttgtttgtttttttttccttcagagcacactgattttattttatgagtaccgtatgtcaccttgactttctcaagatactactgatcagaagt

SEQ ID NO: 30669 - DNA, 201 bp, Homo sapiens
gaacagatggcggagaactggtttcaccctgaggctccctcccatatattttgagctacagcttctttgcacttctatctttattccttcttccaaacttaaaaaaagaagaagaaaaaactcttctgctgatgatcctcccattttcttttttattatgagactttaccctttaattagtttttactaataaaaggacct

SEQ ID NO: 30670 - DNA, 201 bp, Homo sapiens
gtgagtcctcgggcaatggaggcgggtgtaaggaagggctaggtaggcagctggaaagattcctgcaaggagtgagctaaaagcaaagtaatgaggggggaaaaaaaaaaacatggacatggaggttgggggatttcagaagaggaggcaggtgctgaaactgctctcagcattgataaccattgtgccctaagatgtttc

SEQ ID NO: 30671 - DNA, 201 bp, Homo sapiens
gggcatagatcccagcatttgagaggctgaagtgggtggatcacttgaggtcaggagttcgagaccagcctggccgacatggtgaaaccctgtctctactaaaaaaaaaaaaaaaaaattagccagcatggtggtgcccacctgtaatcccagctacttgggaggctgaggcaaaagaattgtttgaacctaggaggcaga

SEQ ID NO: 30672 - DNA, 201 bp, Homo sapiens
cccaggaccatgacttactagctgagtgattttggaagattattttgcctttgaggaactggattccatcttcaaaaccaacagcagaatccaagcctgcytgggttattgtcaatgtcaagcacataagggactgtacagtgtagtggttaaacccatgggttctggacctaagctgcctgtgttcacaaccttactcta

SEQ ID NO: 30673 - DNA, 201 bp, Homo sapiens
gggtggggggtatgggtaggttcactgttgggtgatgtgacatttgagatgggacttaaaaggtggagcaggtagttttcaggggaggaaaggagtgggaygtatcccaggaagagcctccaaacctcaaaaggccctatattcacaagaggaaatgagaagttctgtgtgttcgagtgttccttgtgtgtgtgtggtggc

SEQ ID NO: 30674 - DNA, 201 bp, Homo sapiens
ggagctgacatggcatttcttcttctagacaattctgggatagagcaggatgacatccccaggcccttccatcactcaagtgtgtctggacattggagagyaagaggacacagcttgaatctcagggatgctggcttccatggaggaagccagagggagccaaccggccccatgcctttgcagcatatagccaggtcaccc

SEQ ID NO: 30675 - DNA, 201 bp, Homo sapiens
gactcccaccgtttcaatgatcacctctaagtgaacaacgctgggagtgacttacaggacctactcctgggagctagagaacagacaggatgtgtccagawcatgccaagggggacatgtgactgacaaggttgaaggctagcagaggcctgaaaaagtagcatcaaggtggtaaagtcccagaacaagctgggtgtatga

SEQ ID NO: 30676 - DNA, 201 bp, Homo sapiens
cttgatggtctttacaatttggcatgttttgcagcggctgttaccagttgttcctttccatgtttagtgcttccttcaggagctcttttagggcaggcctsgtggtgacaaaatctctcagcatttgcttgtctgtaaaggatttcatttctccttcacttatgaagctagtttggctggatatgaaattctgggttgaaa

SEQ ID NO: 30677 - DNA, 201 bp, Homo sapiens
tgaggcaaaagaattgtttgaacctaggaggcagaggttgcagggagccaagactgtgccactgcactccagcctggacgactgtgcaagactccgtctcaaaaaaaaaaaaaaaaaaagccaatgtccgtgattcatgacactgttgtctttgcacactgtggtgcagactgcacagtgggatgtaaccacatatgtggc

SEQ ID NO: 30678 - DNA, 201 bp, Homo sapiens
cacccatggtaaccaccattctgctctctgtttctacgtatttgacttttggaattataatattagtttaattctatttttcttataggttatttggttgtttttttttttgaggttcctgattatttttccctttatcctaaagtctaatatttttactaggacatgcttcagagttaattattccaagacaatttcctt

SEQ ID NO: 30679 - DNA, 201 bp, Homo sapiens
gtaaagtgcaagttttccttcttaatttttgtaaggcagtttttttattttaattcttcttttggctttttatatatgggatggggccataaaataatgagaacttctcaaaaaacaatgcctgaaattagtcttaataacttcttaagggttacagaaagcaagacccaagccagatattgtagcttgtgcttgtagtcc

SEQ ID NO: 30680 - DNA, 201 bp, Homo sapiens
atttgttagcagtcatcattttaggtggaaaattcatccagactaccttcagttttctgactcccactacccttcacttttgcactgtacctcggctccarctgccccccttgtcacctcaataacctgatttagaccaacattcccagttttttgtttttgttttttttgagacacagtctcactctgtcgcccaggcta

SEQ ID NO: 30681 - DNA, 201 bp, Homo sapiens; identical to SEQ ID NO: 6234

SEQ ID NO: 30682 - DNA, 201 bp, Homo sapiens
gcccatggcaaagtcttgtacccaaaatagcattacctgaaattgtaatcctgggattaatttttggtcttgcagttcccgttccagaacctcccttttascagtgtcccagaatccagcagacccaggaagcctgtctaaaggcacatctactgcaaaacactgatttctccgtgtgcagtgataagaatacttacaact

SEQ ID NO: 30683 - DNA, 201 bp, Homo sapiens
ctctgaacccactgcccagcccacaggtctccagcagggcccctctgaccacttctgcccacagctggagcataaagaaagcaagagccaccctgaacagwcacacacacattgcaaatgagtgactagatggtaatttttttttaaataatgccaaggagaaaagctgaaattaaaataaacaccctactaaggaagcaa

SEQ ID NO: 30684 - DNA, 201 bp, Homo sapiens
aagtcgtcttttttacctttcattgaacaaataatgtatcattatcttataaagccccgttattttttaacagaggtttatttttctcacataaacaagaratctagaagtaatattatttctgcagctgctccacgagatcaggagcaatatcttggtctttccttgtggttgcaaaatggctgctgcagctcctttgga

SEQ ID NO: 30685 - DNA, 201 bp, Homo sapiens
aaagaaacaagaatgccactgacctccacacagtcactcttgctccacacctgggttctgctgggttccaggtgctggtgtgcgccatgctgtcacctccrggtcggctggggttggtggctccacatctggccagccctcagcattggccccttgccagcaggctctgaacccactgcccagcccacaggtctccagcag

SEQ ID NO: 30686 - DNA, 201 bp, Homo sapiens
tttttttatcattttatttttaactgctctctatgtaaaaagcatgtaattgtgatttttaaaccctatctgacaatcttttctttcaagtggaggatttwatccatttgcattttttctttctttttcttagtgaaatataattcacacaccataaaatgcattcttttaatgtatacaattcagtgattttagtgtatt

SEQ ID NO: 30687 - DNA, 201 bp, Homo sapiens
ggcttggagatgatcagtgatgaatctgattcactgcatgaattattgaacagtgtaagaaagaaacaagaatgccactgacctccacacagtcactcttrctccacacctgggttctgctgggttccaggtgctggtgtgcgccatgctgtcacctccgggtcggctggggttggtggctccacatctggccagccctca

SEQ ID NO: 30688 - DNA, 201 bp, Homo sapiens
atcccctctgatgatgtaaatcggggcttggagatgatcagtgatgaatctgattcactgcatgaattattgaacagtgtaagaaagaaacaagaatgccrctgacctccacacagtcactcttgctccacacctgggttctgctgggttccaggtgctggtgtgcgccatgctgtcacctccgggtcggctggggttggt

SEQ ID NO: 30689 - DNA, 201 bp, Homo sapiens
gtggaggcaacctcacagagcgcaggggcaccatcctgtcccctggcttcccagagccgtacctcaacagcctcaactgtgtgtggaagatcgtggtcccygaaggcgctggcatccaggtaggggcaagggggcgcctcggtcgggcaggtggccgtctgctcccaggtaacagctcacaggtgacaaccacaggtgctg

SEQ ID NO: 30690 - DNA, 201 bp, Homo sapiens
tgtgtctggctacttccacttaacataaaattttcaaagttcatccacgttttagcatatatcaatactttattccttttggccaaatactatttcatggyatgaatataccacatcttgtttatgcattcgacaattgatagatgaactgggactattatgaacatttccactttgggactattatgtttccatttttta

SEQ ID NO: 30691 - DNA, 201 bp, Homo sapiens
tgtgagaagtggctgccgcccacttccttcactgccctccctggattgactctccatgcaagacaccagtggagatccaagtatttcttcccaaaggattyaaggaagctgggcaggtagttgatgtaatatgacagcttagctaacctagttccactgaaggagctcatagcctttctgattagtcattaagagtctcat

SEQ ID NO: 30692 - DNA, 201 bp, Homo sapiens
tattatcttctgtccccttagttatctacaagagcaaggccaggccagggcctgtgagaagtggctgccgcccacttccttcactgccctccctggattgrctctccatgcaagacaccagtggagatccaagtatttcttcccaaaggatttaaggaagctgggcaggtagttgatgtaatatgacagcttagctaacct

SEQ ID NO: 30693 - DNA, 201 bp, Homo sapiens
gtggaaactgggcagaaaaaaaagaaacacaaaaacttgtgtacaagccaggtgtctaagaccagagtgagcaacatagtgagacccccctccccccgcasacacacatctcttaaaaaaaaataaaaataattagtcagacatagtggcacacacctatagtcccagctacttgggaagctgaggtgggaggatcacttt

SEQ ID NO: 30694 - DNA, 201 bp, Homo sapiens
gtccaagaggtggaaactgggcagaaaaaaaagaaacacaaaaacttgtgtacaagccaggtgtctaagaccagagtgagcaacatagtgagacccccctscccccgcacacacacatctcttaaaaaaaaataaaaataattagtcagacatagtggcacacacctatagtcccagctacttgggaagctgaggtgggag

SEQ ID NO: 30695 - DNA, 201 bp, Homo sapiens
cagccggtgagcaggggtgtgggaggaagacaggccatgacaagcacagacagggacctatgcgtgccaggggctccacccaacggagtcgcacacaccamatagacacacccagtaagaggagagctgtgcattgagcatcattgtgtaacaggcactgaaccaggccctttgtggatctaatatattgaatccctgcac

SEQ ID NO: 30696 - DNA, 201 bp, Homo sapiens
ttctctctccttccccagcccactctctcacctgtgtctctctccctcagagatctcattccaccacaagcctcaaatactttgtgattgtatcccctccycctcctacccacaggaagtgtccctcttaccaccgggttttggggactgcattttggcatggagatcatgagacacaggcttttagtatctcaggctgga

SEQ ID NO: 30697 - DNA, 201 bp, Homo sapiens
ttagaaaatcacagtttttgttctggctccacagcagacatcctgtcccctctcagagccccagcccctcagttagcagggtgcctactggggccacagtktctacttgtgttcttctgagccttcccagtctgcaggggagggtgaggaaggaggagaggcagcctttcagaaggagatgcttcagcttcaaccagaaca

SEQ ID NO: 30698 - DNA, 201 bp, Homo sapiens
cctcccccggagttgtcccagctctgccctcatgagctgcatggactgagaccactgtcttccacacagcacccttcacctactgcaagatggccaggcaygctgcaaaggccttagaaaatcacagtttttgttctggctccacagcagacatcctgtcccctctcagagccccagcccctcagttagcagggtgcctac

SEQ ID NO: 30699 - DNA, 201 bp, Homo sapiens
ccaaggccttggttgtggatgtagactctggaatttgggggagttctcaccctcttaacccccatccctgtgatggaagagatccccatggagagagtaaratggcttcctgtacccctgagctgactcccaaggggaagagcttacaggagggagatgggaggaaggcttccaacctctgcagaaagggcagacttttct

SEQ ID NO: 30700 - DNA, 201 bp, Homo sapiens
gccttttgatagccagcaaggtgtgtttgcggggacagctgcggagggcagacagaggctgctcctagccatggagcataggttgggagtacccaggagcrcaggcatcctcacagcatgccctcagccgctgcggccccagactgcacatttgggggtctgcatctgtcacatgagcatcagtagcaggagttatgtccc

SEQ ID NO: 30701 - DNA, 201 bp, Homo sapiens
gaattataaaaaatccctacaagcatttggcaaaaccgactcacacaggcaagtacatagtcatccctcattctataaaatattcatttacaaaaccaccmcaactaatccaaccctcctaagactccttttcttttccataataccaaagtccaaagtcagtggtgctattggcctcaagaattgttgattcagccagga

SEQ ID NO: 30702 - DNA, 201 bp, Homo sapiens
tgggacatggagctagcagtgcaggccaggggaagatgaggatggggatccagagggccaggaacagctggagctactgcctaggacgccagacaagcgtsgagccttttgatagccagcaaggtgtgtttgcggggacagctgcggagggcagacagaggctgctcctagccatggagcataggttgggagtacccagga

SEQ ID NO: 30703 - DNA, 201 bp, Homo sapiens
caaatactaaagacaccaagcctacagaccaacacccatcctcgcccttcctctattcttcccaccttttataagagatgatcaatcctttctcccatcaraaaacaatttccctataaattacccatcaaaaaatttttagcataactccatttatgctttagataaggaacctttaaaaacttttaacataacagtgag

SEQ ID NO: 30704 - DNA, 201 bp, Homo sapiens
ctctatgaaagccgggaggatggatgggcacacacccttggcaaggatgagcctaatggcattgcatcatactgtcatgcaaggctcagacttgtctggtsgtcagggaagaggaagtgtctattcatctttacatgataaagcactgtggactaaagggaaatgtttaaatggcaaatattaataacctgaatacataaa

SEQ ID NO: 30705 - DNA, 201 bp, Homo sapiens
gaagcccaggggggacttggtgtgtcccctcggaagtctgactttatcctgtagagaaggaggagagactgggtcagaggagtggttcagaaagatagacrtggtcctgatggaaaaggtggattgaaaggatgggaggggaactggatccaggaaggccagttactctttcgattcctcttaatttgcttttccctcttt

SEQ ID NO: 30706 - DNA, 201 bp, Homo sapiens
acataatgtcctccagttcatacatgttgctgcaaatgaaagaatttccttctttttaaaagctgtctagtattccatagtgtatgtatatataccctttwctttatttgttcattcattcacggacacttgggttgtttccctatcttggacattgtgaatgatgctgcgatgaacatgggagtggatatttatcagttc

SEQ ID NO: 30707 - DNA, 201 bp, Homo sapiens
cattctactctctactccaatgagttcaacttttttagattccatatataagtgagatcatatgatatttatctttgtgtgcctggcttattccacttaayataatgtcctccagttcatacatgttgctgcaaatgaaagaatttccttctttttaaaagctgtctagtattccatagtgtatgtatatatacccttttc

SEQ ID NO: 30708 - DNA, 201 bp, Homo sapiens
tcgtttggggcgatcccaacctcttgggctaggttgcctctagggccagaggcctaagtattcccacagaggcctcatcatttgtgataggcccaaataaytctccctgaccataagcccacactctctgtttacaccttcctccgccgtacggagcggcacctcgtaagcaagctctgaccactctccccaggtttttcc

SEQ ID NO: 30709 - DNA, 201 bp, Homo sapiens
ccttcttctgtcactcctttctagttccctctctatatctttttaaatattttaattttaattgacaaataataaacatatttatagagtacaatgtgatrttattctatatgtatacattatggaataaataaatcaagctaattaacatacccatcatctcacctaattatcatttttttgtgatgagaacatttaaaa

SEQ ID NO: 30710 - DNA, 201 bp, Homo sapiens
gataaatgaataaaatagtttgaaaaaggggagtctcctcacccacccataccttctcccctcaacccctttagtccttgtcctgccttgcactccccctycccctccccaccccagcctccctggagacttcccaccaattacctgctgtccctatcaatcatcctcccttttttttttttttttttttgagagggagtt

SEQ ID NO: 30711 - DNA, 201 bp, Homo sapiens
ttactcctggaccacccccacactattttcataagtgtcatttatgatgctgtttagtatcttgtgaaatgagactgctaaatttactatcttctctaaamaatgcattgtgacaatctatttttctttttttttctttttatttatttatttatttatttatttttttattattatactttaagttttagggtacatgtg

SEQ ID NO: 30712 - DNA, 201 bp, Homo sapiens
atattcatgcaataccatttcatgtcctacctgtttactcctggaccacccccacactattttcataagtgtcatttatgatgctgtttagtatcttgtgraatgagactgctaaatttactatcttctctaaacaatgcattgtgacaatctatttttctttttttttctttttatttatttatttatttatttattttt

SEQ ID NO: 30713 - DNA, 201 bp, Homo sapiens
cctgggggccatcaacttggactgaatcctcttgttaacaggcatcatggttcacctgcaccccttctccacttcctcactttcacacctcattacacccmtgcagcagtgcagtcaggcgggtggcttgcctttgtcgcacatttagcaagtgggaccacagccaagtcatgccctcaaaattgtaacgcgggtgatagc

SEQ ID NO: 30714 - DNA, 201 bp, Homo sapiens
tgtccaagaggtggaaactgggcagaaaaaaaagaaacacaaaaacttgtgtacaagccaggtgtctaagaccagagtgagcaacatagtgagaccccccyccccccgcacacacacatctcttaaaaaaaaataaaaataattagtcagacatagtggcacacacctatagtcccagctacttgggaagctgaggtggga

SEQ ID NO: 30715 - DNA, 201 bp, Homo sapiens
ccagggagcttcctggaaatggttacagtttaagataggtctggggtctttccaagtatcacatccagaactggacacagactgcagatgtggcctgaccmataccaaattcttagagactatcacatcctttcatgaaccttctacttttatttaccacattaacatgtgtattatgcaggaaacgaggctagatttggc

SEQ ID NO: 30716 - DNA, 201 bp, Homo sapiens
aacctcatttattcagcatagacctgtgaggtatgtttcagttttttccaggtttcaaatgaggaggcaaagactctgagtggtgaagttactagtcaagstcacgcagtcattaagtggcactgctgggacctgaaccttggccgtctggcccaggcccaaagcttttgcctttgctttgcctgtgagggcttcttggtc

SEQ ID NO: 30717 - DNA, 201 bp, Homo sapiens
ttctctgcctctcaaaaagtttctgtgctataaaatggggaaaataatctctacttcagagtttcaagagcaggaggaaatgaagaagtgcctatcacagyacctcgcacataagatgctttctccttctttgctccattcatcttatgaaacctaagacgataaagcattttgttcagaagtacacttgcattgagtcac

SEQ ID NO: 30718 - DNA, 201 bp, Homo sapiens
tgtagtcttagctattcagaaggctgaggtaggaggttcacttgagcccaggatttggaggttacagtgagctatgattacaccactgcactccagcctgrataacagagcaagactttgtctctaaataaaaataaattgttttaaatgaaagaaaacaaaaaatattgggacgtatcaattatccaactttgttctttt

SEQ ID NO: 30719 - DNA, 201 bp, Homo sapiens
ctattttcttgctatcgagttgttttagttccttctatatgttccttagatgttaatctcttaccagatgtgtggtttgcaaacaatttctcccattccayaggttgcctcttcactctgttgattgtttcctttgctgtgcagaagcttttcagtttgatgtaatctcatttgtctacttttgcttttgttgcctgtatc

SEQ ID NO: 30720 - DNA, 201 bp, Homo sapiens
ttctctagactctacgctgttgtcctccatttctcctttcctgctgctttccttccatcctctcctccatcctcccccatcatgcctcaaaagtttattgratcccctctctgtgccttgcacttcactagaaaagctgggatatagacatttcaaaaaacattggctcggtcctcaaggaacttaccaattaacagtggg

SEQ ID NO: 30721 - DNA, 201 bp, Homo sapiens
gaggccttgtggaggaggcatcctatcaactgcctcaaaggaagaagaaaatttaaccaggcggagaatcagaaaaagagttttgcaggcaacagtgcggkaggagttgggccatgtgaaagtggtcaagggacagacgtaggaagcaccgctgaaaggaaggggctgatgggactttgtatcttgccgcaggttggaagc

SEQ ID NO: 30722 - DNA, 201 bp, Homo sapiens
accatttccattttacagatgacaaaactaaggctcagagaaaataagtcacatgcccaaggtctgttccttagtatcagagccaggatttagatcctggrctttgtgatcccagagctcttgccactgcactattctacctccctacagatcactcattgctgtgccgtgtaaatctcaaggtcgctgatggccaaagag

SEQ ID NO: 30723 - DNA, 201 bp, Homo sapiens
atcagccaccgtgtccacaacagagtgtaatattacaactttgttcagggtattagatgaggccttgtggaggaggcatcctatcaactgcctcaaaggargaagaaaatttaaccaggcggagaatcagaaaaagagttttgcaggcaacagtgcgggaggagttgggccatgtgaaagtggtcaagggacagacgtagg

SEQ ID NO: 30724 - DNA, 201 bp, Homo sapiens
ggtctacatcctctccattgccctggtcatttgtattggaattatctccatacccacctgaccctgagttctccaggggcaggggccgtggggcaggcaaygctatacctttagtgcttagtgtggcatttggcacggtttccatgcaaaatatttgctaagctcagagtattctgtgtgttccagggactgtgctaagtg

SEQ ID NO: 30725 - DNA, 201 bp, Homo sapiens
aaagacaagtctcccatccttaaagaatttgcaatttcattgaggaaaggaacacacacacaatatttaatttgcactcttcttcacattttgtaaaatgytgtcaaatccgccatcacatttgagtgtcacaacattccagtgtgattgtggcaaggatggtcatccccactgtatccttaggaagactaaggtttacag

SEQ ID NO: 30726 - DNA, 201 bp, Homo sapiens
tagctatgtatttatggatatagatgcttttttaaatatgtttccacctgtgtgtgaatcggtgtccatgtatttggttttggggatctgtgtctgtgcayacctgtgtcagcatattgtgtgtatgtgcacttgtgcattgtgtatgttttggttgaataacaggctattgcagtagcttcagtgtactacgatgatggc

SEQ ID NO: 30727 - DNA, 201 bp, Homo sapiens
catttgcacatgctccagtaggtaatagggacacataagtgtttgaactgggaagtagtataatccgagttgcagtataggaaacagatctagccgcattmcaccaagtggattgggtagggagagatggagcccgtggttgcggggtgtcgagttgtacagtgaggggctggtggagggttaaggtagggaacataactg

SEQ ID NO: 30728 - DNA, 201 bp, Homo sapiens
tgtactaaactactttaaccactcccacccaggccatatgcctcatgagctgctacctaatttctctagagagagtgatatcaccttctcttctcctgttkggtattggccccatcagtacacacaatcctggcagtatcaatgtgacctctttttgctaacctgtttttcaatcctatgtaaacttccctgcagcattca

SEQ ID NO: 30729 - DNA, 201 bp, Homo sapiens
aacgaagggctggtgcaaaggagtgctgagggaagtgcttagcagcctgggggcctggaaaataggccagctagcaagtctgcagccccgtgagggaggayaaggaaatgtagtcaagagtgaggctaggttggaaaacagcttggtcctggtgtgtaaagttaaacattcacacactctatgacccaaaagttccacctc

SEQ ID NO: 30730 - DNA, 201 bp, Homo sapiens
gcacgaaatttaagtgatggggaaaaaaaaactcagcaattaagataaataacacttaatgcaaattttttttaaaaattaatattagtgcaaaatatccrtgttaaaacacatcaacatttgaatcaaagacaggctctgacagtgctgggactatggtgaagaccagtgaggtgagtgatctgagcatagggttggatc

SEQ ID NO: 30731 - DNA, 201 bp, Homo sapiens
atgtaccccacgtgcatatctcctgcagcaatggtggggcctcactaggaaaccttatatctgggttctgcccctggcagcaggaaggatccagctctgtyttgaaatgctgtgtaactttcaccaggtctcaaaatgcctgcagtgacagccctcacaccccaggctctcgcatcccagagagcatgtctggggacatct

SEQ ID NO: 30732 - DNA, 201 bp, Homo sapiens
aacatctccatgaaggttcttccacatcagcaggcagtgaacatttattctcaattaatctctggtttgggaaaaagacagggagcaaagcctcaactgcygtgtcatcttgacttgcctttgctgctcagaaatggactgtacttgagatctgtcgtgacattagcagttcagatgcaaggtcaggttcagtgaggaagt

SEQ ID NO: 30733 - DNA, 201 bp, Homo sapiens
atggctaatttggactccaccttctaatgatgtccttgccctagtcaggaccacattcaaggcctgggcgtggtagagcctgcagtagccatatgggttacacctaatcataaataaatcacagattggttctacaaaggggaagtggaggattcctggcaagtgagatattaggagcatttaaaagttctcttttctctc

SEQ ID NO: 30734 - DNA, 201 bp, Homo sapiens
gtctctgttttctcatcttcctgtctttcagagatcgagcagggcagttgcggtgaccctggcatacctgcatatggccggagggaaggctcccggtttcrccacggtgacacactcaagtttgagtgccagcccgcctttgagctggtgggacagaaggcaatcacatgccaaaagaataaccaatggtcggctaagaag

SEQ ID NO: 30735 - DNA, 201 bp, Homo sapiens
actgtcagggtctctgtgatgactgagagtttggtgtatgagttgatgagttgggatgaaccatggtgatgatactttttaaatgaaaaaaaaaaatcackttgtccaacaaagcattttgatgacttttgagtttatttatgtaaaaagtcttgagaggtttaaagatcaagtcacccttaaatacacattgaacaactc

SEQ ID NO: 30736 - DNA, 201 bp, Homo sapiens
tgtgtttgccatcattgttaatggcaataaccggaattacctttgcaccaacctaatacaaaagattaattcatttcactcactcattcatttaaaaatgygtactgagtgtctactatgggcaagtactgggctaggtgatggaaataaaattgaagaaaagctcaaggagggtcggacgcagtggctcacacctgtaat

SEQ ID NO: 30737 - DNA, 201 bp, Homo sapiens
cagcatttcctatcaggatgtccaaggaattagtcaacactttccctgccaggccagtgtgagtcacatacatcacttgtttcctttatgcctaaacagtsaggtactttataggagaaggaagtgtctttggtggccctgcgtggtctaaagtagacccaaacccagctaaccattagaatcactcataggccttttaaa

SEQ ID NO: 30738 - DNA, 201 bp, Homo sapiens
gacacggtgattgatataaaggggtgtgaacggggtgggttaccattttaggaaaggtggttagggaagggtgacatttgaactacggcctccatgatgaraagggctagccctgtgcagagcagggtgacattcctggctgaacgaagggctggtgcaaaggagtgctgagggaagtgcttagcagcctgggggcctgga

SEQ ID NO: 30739 - DNA, 201 bp, Homo sapiens
gcatcatcatttttaatggctttaaagaatttccttgtagatacaagttatttaatctttttgcactggtgatgaatttagattatctccaacttaatcaygttagaagcagttctgcaatatgtattcctgaaaattgcctttcttggccgggtgaggtgactcatgcccataatctcagcactttgggaggccgaggtg

SEQ ID NO: 30740 - DNA, 201 bp, Homo sapiens
acagttcagcttttgatggtgtcccgtgtgaatcactgtgcatttttgaatagatagtgatatgtatacattttctagaactggtattggctcatgctgtrcatactgtttcataacttgtattcactgataggccaccaaaacctttccatcaatacctttctacctttctttatcaatatttactgatctatgcatcat

SEQ ID NO: 30741 - DNA, 201 bp, Homo sapiens
tcccagtgctatatacatgtctgttttcatgaaaaatgacctgcacagaaaagacttctgggaaacctgtgattttctggtgagttgctttattttttatmcacctggcccagttgtatcctgaggagccccaaatctattccagggcttactctttactgagatccccagtaagcaggttctgggtcacttattcttgtc

SEQ ID NO: 30742 - DNA, 201 bp, Homo sapiens
cttgggctttcccttttatctcttagaatcaaaccccagagctcaacctgattctcttttcacttcaaagatgcagctatctgccatctttgttgcttcgytctgtccttgtacccgaccccacccagtacgggttcctgagcacggtgtagcctcacagctccaatttcttgcttctctcaagggtagtcccagttcttt

SEQ ID NO: 30743 - DNA, 201 bp, Homo sapiens
gatactacgccacaggcctgctcagccgtcactgctcggtcaatggtacctggacaggcagtgaccctgagtgcctcggtgagagctcaggccctacgggytccatggccaacagtggcccagatcctgcatgccagaggagaaggctatccatggaagatggtgcagaatggttgggatggtcggacttgaacctgaacg

SEQ ID NO: 30744 - DNA, 201 bp, Homo sapiens
ggaggattcacatgggaagcaaaaccagccagcctcttaggaccaggataagattcactgtcccccaagctgaaagaggcaggtagcagaatgccagctgrgggactgttgcttgacccctccaagagtttacttggccctttggctcttaggagcaggtttataacatccctgtaaaaccttcaccaagggcagaagacc

SEQ ID NO: 30745 - DNA, 201 bp, Homo sapiens
aagccaagcatcttctctctggattttcatgtactgacctatccaatagggtagcactccattgtggctccaaatattctaagcctctatgatcatatttrtagaaaaagatgactatgacatgaatagtcctcacatttcccacaataaatacctggaagctactttgaaagtggatcattacagagcaggtcatacttc

SEQ ID NO: 30746 - DNA, 201 bp, Homo sapiens
atacacaaatacactcttccttcatgttccaaaacattttctgtagcaagcagagacttcagaatcattttgttggcttttgagctgccctcacagtagtrgatgctcaatagatagtctttttttaatttaggtttttaagaagatgatttatctcacagtgaaaaacgttttgaaagaaaaggtggagctagcttcttt

SEQ ID NO: 30747 - DNA, 201 bp, Homo sapiens
tcatttctttgtggtgagaacatttaaaattctctcctacagctacttggaaatatacaatacatgcatcaaaacatcacttcctaccccataaatatgtrcaatgattatttgtcaattaaagataaaatgaaactttttaaaaagtaataaataaataaataaatgcccaagatcaagattcaagctaggcggttaaga

SEQ ID NO: 30748 - DNA, 201 bp, Homo sapiens
ctgcaaatgtaaggacaaggaagccttaggataaaaatactaggccagagtatagaagcaaactgctggccgagttacctgtatgaagcaacaaaggttgwcaggagttagacaaatccaagaaaggtagatttgtgacccttactggaaatctatcaatattgtatacccccaacatacaatatactggggttgaaacct

SEQ ID NO: 30749 - DNA, 201 bp, Homo sapiens
ttacctgtatgaagcaacaaaggttgacaggagttagacaaatccaagaaaggtagatttgtgacccttactggaaatctatcaatattgtatacccccamcatacaatatactggggttgaaacctcttcctaatctttacattttctctgttccttctacccgttcatttatttatccatcttgatttattgagtacct

SEQ ID NO: 30750 - DNA, 201 bp, Homo sapiens
agcccaagaatagcctcctcatgagccctctgtgtgtgtgcacgtgtttgtatttctttttcccagaaaacccgcgggagtcatgttttgatcctggttcyatcaagaacggcacacgggtggggtccgacctgaagctgggctcctccgtcacctactactgccacgggggctacgaagttgagggcacctcgaccctga

SEQ ID NO: 30751 - DNA, 201 bp, Homo sapiens
tttctcgtttaggtcacatatatattgcttgtaaactttgttagcttcactaaacttcaaatatttgtgtggccatttaaaagttgctaatttaatagctrtaagttgaatctatttctgtagcacacctttgtggactactgtgaagtgcccaaggttaagtgccacgaattcagagatgaattgggcacggtccgtgtc

SEQ ID NO: 30752 - DNA, 201 bp, Homo sapiens
ttcaaatatttgtgtggccatttaaaagttgctaatttaatagctgtaagttgaatctatttctgtagcacacctttgtggactactgtgaagtgcccaakgttaagtgccacgaattcagagatgaattgggcacggtccgtgtcctcaaggagctcttctcatgtggagatagacaccattatataaatgaagtgggcc

SEQ ID NO: 30753 - DNA, 201 bp, Homo sapiens
gtttttcaatgagaaaacattgatgctatgaatattaggttcattcttttatttaacacatatttattgagtgcctgcaatgtggtgggcatcatagtggstgctgaacagaagagcaacagcccctcttctcatggggcatagacttgacatcttctctgttagaatggttgggcccgaaagatgagaggccctgctgga

SEQ ID NO: 30754 - DNA, 201 bp, Homo sapiens
gtatagttgtcttacatttctatataaacaagtctctcagtatttgtgatttattttcaaagctgacaaagttattctgccatggatctgagaaacagttygttctatttttggttatttgtcagtaatttgattttttaaaatataatttgttactccatctggagtttacttagatgaatgtataatattgtccaaact

SEQ ID NO: 30755 - DNA, 201 bp, Homo sapiens
tggatgaaggaatgggtcacaaaggaggctgctggtgttgcctctcagaatgtacaaggaggtggagtcaattcttgtcctaccaggccagtatgggtcayatcattgcctgttacctttgttttcaaataggcagatactttatgggggaaggaagattctggattgactcatgtcctcacccaagggaatagggtgtat

SEQ ID NO: 30756 - DNA, 201 bp, Homo sapiens
ctcaccatcaagattgtttccagggagacccagttctgcctgttgtgtgaattacatcctggcaaccttcaaaagataagaaaacctagccaaatgcgatragctctcttttattaatgtttacattgaaggttgaaaatgaatccctcttccacggtgggaaacagaatggagaacatgtggttaggtagtgtctcacag

SEQ ID NO: 30757 - DNA, 201 bp, Homo sapiens
ctgggactgtagaggcaatctttccagctaggggtaagagagcaaaggtatgaacataggggaaaatacaggatctggccacgaaagggcactcacttgaygtggctggagctgcgtgcatgtgggcaaataaggctgtgtgggtaaggaggagtctttacacactgaaggccaagacaagaactctgaatggatttctca

SEQ ID NO: 30758 - DNA, 201 bp, Homo sapiens
tctagaagtttagggatcatctgcaaatgtaaggacaaggaagccttaggataaaaatactaggccagagtatagaagcaaactgctggccgagttacctktatgaagcaacaaaggttgacaggagttagacaaatccaagaaaggtagatttgtgacccttactggaaatctatcaatattgtatacccccaacataca

SEQ ID NO: 30759 - DNA, 201 bp, Homo sapiens
tccagctcttcagtgtacctggccagggtgaaatcaggcagactgaagggatggctcacgaaggaggctcccagcatttcctatcaggatgtccaaggaaktagtcaacactttccctgccaggccagtgtgagtcacatacatcacttgtttcctttatgcctaaacagtcaggtactttataggagaaggaagtgtctt

SEQ ID NO: 30760 - DNA, 201 bp, Homo sapiens
cttgcagggagctcccccaggctacctgtaaactcccttggattatcgtgtttcccctggaagaaaatccaaatgtacttccttgtgtcatggagaacaaycagcatgtattgttttccagtcttcagtgggtggtggtctgaggcatgaatggaccatggcagttctagactccttgagtgaggatgctctgacgaacag

SEQ ID NO: 30761 - DNA, 201 bp, Homo sapiens
tggcttggtctggctacgtatattttccaaagaacttatggtctgttttcaaggtaaaagctgagccccaagagtgtggactcagctacttcccagtagcmtagggcaggaggccttttttgtgctttgttccataaggtatcagaatctttcctgtgagctggggatatgagttcctcagccagccactgaggaatgcat

SEQ ID NO: 30762 - DNA, 201 bp, Homo sapiens
agcctggccttgggaaagacctctaaacatctcaatgaagagggcctaaaggccggggtaagcacctggaatggtttggtggggacaatgcattattccaraggtgtggcaagaatcagtcatggccacagggtaattccaggcagtgggtaatttccaaaggttatgctgatgaacagtcatgtaatttataccaagaac

SEQ ID NO: 30763 - DNA, 201 bp, Homo sapiens
gacagagagaaactctgtctcaaaaaaaaaaaaaaaaaaagaaaaaaaaagaaaagaaactcaagctctgtatgattaaccccttcctacctctctccccstcatcccatgccgctcttccatcaaaactcttgcctacctcaatgcctttccacttacagttcaccatgttggagtgtccctcacaagactggctccatc

SEQ ID NO: 30764 - DNA, 201 bp, Homo sapiens
ctctctccccctcatcccatgccgctcttccatcaaaactcttgcctacctcaatgcctttccacttacagttcaccatgttggagtgtccctcacaagastggctccatctcatcattccttaactgtcacattcccagagagaccatctctaaccaccttatccagaagagcgatgtcactttttatttccttcatacc

SEQ ID NO: 30765 - DNA, 201 bp, Homo sapiens
gttgataggtgcagcaaaccaccatggcacatgtatacctgtgtaacaaacctgcacattcagaacatgtatcccagaacttaaagtaaaatttaaaaacrtatatgtttctctataaataaaatgataaactataaatcttaactaaatatatgtatataaataaaatattcatgcacataaactaaatacacacataca

SEQ ID NO: 30766 - DNA, 201 bp, Homo sapiens
tcaatacttgagctaggtggagacatttcaaagaccactggatacacaggtctggcgttcagaagaaatgtctttcctgcaggcatacacttaggagttaygtgaggatgaggtgccctaaagaggacaagcaagtgagaagatgaccctgaaatggatctgttcatatttcaaaaggtaaaagccaggtagagaggaaag

SEQ ID NO: 30767 - DNA, 201 bp, Homo sapiens
gaacagaaaaccaacaccgcatgttctcactcataagtgggagttgaacagtgacaatacatggacacagggaggcaaacatcacactctagggcctattrggggtggggggaaagggaagggagagcattaggacaaatacctaatgcatgaggggcttaaaacctagatgacgggttgataggtgcagcaaaccaccat

SEQ ID NO: 30768 - DNA, 201 bp, Homo sapiens
tttttaccttgtaactttgtacacacttgcacataattgaaacatacatttcacaagcagtacttacctttactacttacattgaactcagatatttcctrtgctcttcctttattagcccattcttgcattgttataaagaaatttctgaggctgggtaatttataaagaaaagagtttgaatttggctcacagttctgc

SEQ ID NO: 30769 - DNA, 201 bp, Homo sapiens
ggtctccaggtgagtattcacaggtctgtagcagagttctcagctccagggaggtgaagaagccgagagagagagaaactagcatttattgaacatctacrtgccaagcactgtgctcagtggtctcatgcatatcatcacatctaatccttgtagtaatttgtgaggaagcaattattatttcctctctacctctgaaga

SEQ ID NO: 30770 - DNA, 201 bp, Homo sapiens
ccttttgaacccatcctttagagaccaaggcaggcaaccccattcctagggcactgcttatgcatcagatgccacttaacgatgatgtcccaggcatttcrtttattccctagcacacctaaggggcaggtactgtttgatggaagtgtgacaagtggtcacatgataggacaaaggggcatcaatgcctttgtgacctca

SEQ ID NO: 30771 - DNA, 201 bp, Homo sapiens
aatgagtctcatgttgctgaaacccagtggatcattttcagcctagatgatacatggcgctcagcagtctttcaaaacagatgtcccttcctccttctggyaaccctctttccttgtctgtatgacaccactctcctgtgttttctcctacctcttgactgcttggtccctgtctgccctgccagtcccctttctctcaaa

SEQ ID NO: 30772 - DNA, 201 bp, Homo sapiens
tggtacatggaatgaagtgtggacctaattttgtcattaactggctagccatttgttctagcatcaggtattgatcaatcaaccctctctctgctaatttsaaaagccccctttatcatatatttttggttccttttctggactttcttttccagctctgttgatctctcttttgaagtcaatatagtataaattatatta

SEQ ID NO: 30773 - DNA, 201 bp, Homo sapiens
tgttaagtctagtaagcttgttagctgtttgaacttcttttcttctgaattacctatttatattctttgcccatttaaaaattggatctcttgccttagaratcttccggttgatttgtagaagttttgtttatagtctaggtgttgccctttgttaattttagaagttgcagatagcttcttctagtctttaatccatct

SEQ ID NO: 30774 - DNA, 201 bp, Homo sapiens
ttgtaatgggctcattatccatgttttaaatatgatatttggattttgtattaggtctctataaaggactactgaaaactctctttgtttggtgacaacaccaaaagaaaaacataataaaagaggggtcttcaacaagccccttttattttctactcaagctcatgttaaataataacctaatataatgcacagtaatta

SEQ ID NO: 30775 - DNA, 201 bp, Homo sapiens
ccatttatgtagaagatgcatagcattacttacaaaagagggaaaaagtgaaaatgaaataagtggccaaccgtaagagagaagttaagctgttacatcaraatcttaattgaagtctcttgacagtcctgtagatatggttactcttaccacctccgttttacagatggagaaaacagaggctcagggaggtgaaggagg

SEQ ID NO: 30776 - DNA, 201 bp, Homo sapiens
tccagcctgcttctcaccatggcaccctcgatattcaggactatggagtttctttgttgtaaggagaggtcctccaccttgtaggatatttagcagcaacygtggcctgccagtagcccccctctccccattgcagagaagaaaaatgttctcagacattggccaatgtcccaggcagggttggggtggagcaagcttgct

SEQ ID NO: 30777 - DNA, 201 bp, Homo sapiens
atattgggaaacttacggtagtttgtgcttttcaagtttgtgcccatttcatttaatgtgtgaaatgcatgtgtgtaatttgtagtatttccttattatcrtgttgttaagtgcaggatctgttttccttagcccttgccaactctagataggtgaaaaatgagtcttggggtttcagttttcacatttttatattaatta

SEQ ID NO: 30778 - DNA, 201 bp, Homo sapiens
ggaaaatgtcttggaggaggtaacattgtaaaccaaagtctgttaatgcaaggcgttagtcatgccaaaggaagaggagaggaagctcaagccaggggaayaatgagttagtgaaggagccagtgaagcctcccagcctcatgtgaaaggcagcaaatcctcgtcttcctccaagcagtgcctcccctcttggagcacatc

SEQ ID NO: 30779 - DNA, 201 bp, Homo sapiens
agcatcatcaataacaggtcatgttgagatcacagaacccctttctgtgttgccataataacagcatctcaccgccatgatattcttcccaaaaatccatrgccaaggtctatgaaaaaacattagacaaactgaaataaagaacattctaccaaatacctgatcagtacccttcaataatgtcaagattttaaaaaacca

SEQ ID NO: 30780 - DNA, 201 bp, Homo sapiens
agtaggtaaacaaagcggctgggaagctcgaactgggtgaagcccaccacaactccaggatgctggtctgcctctgtagattccacctttggggacagggyatagccaaacaaaaggcagcagaaacttctgcagacttaaatgtccctgtctgacagctttgaagagagtagtggttctcccagcacgcagctcaagatc

SEQ ID NO: 30781 - DNA, 201 bp, Homo sapiens
atcctggcaaccttcaaaagataagaaaacctagccaaatgcgataagctctcttttattaatgtttacattgaaggttgaaaatgaatccctcttccacrgtgggaaacagaatggagaacatgtggttaggtagtgtctcacagtctgagtcgagactaggaaagggaataatcccaaggttgagaagtggaaaagaca

SEQ ID NO: 30782 - DNA, 201 bp, Homo sapiens
aaaagtggtgataatagaacattactttgtggggttactttgaggactagatgaggcagtccttgtttagaagtgatgccagtacgtctgtgagacttatrtgcacacgtattcagcttaacctgctgggcactgtccgcataagcttcctcaagccctggagcaaacctcagcctctagttgctgcaggttcttttagaa

SEQ ID NO: 30783 - DNA, 201 bp, Homo sapiens
tgataatagaacattactttgtggggttactttgaggactagatgaggcagtccttgtttagaagtgatgccagtacgtctgtgagacttatatgcacacrtattcagcttaacctgctgggcactgtccgcataagcttcctcaagccctggagcaaacctcagcctctagttgctgcaggttcttttagaagctgtctt

SEQ ID NO: 30784 - DNA, 201 bp, Homo sapiens
tttgaggactagatgaggcagtccttgtttagaagtgatgccagtacgtctgtgagacttatatgcacacgtattcagcttaacctgctgggcactgtccrcataagcttcctcaagccctggagcaaacctcagcctctagttgctgcaggttcttttagaagctgtcttgtctaatcctattgcaatcatacagtttgg

SEQ ID NO: 30785 - DNA, 201 bp, Homo sapiens
aactgagccctctggatacttcctcttacagggggcactttgaataaggtgaatcttcatagcccaagttgcagcggtgcataaggacagtgtgggcaagsacaggactgatgccagggatttgacaaaacaaaatttaaaatgggcaagctgggtgtggtggctcatgcctgtagtcccagctactcagaaggctgaggt

SEQ ID NO: 30786 - DNA, 201 bp, Homo sapiens
aaagaggggtcttcaacaagccccttttattttctactcaagctcatgttaaataataacctaatataatgcacagtaattacacatctacctgttaatawgtttcccacctttattatttgtcaacagtctgacgcttctgacttaaaagtttagtcgacatcaagatccatgagcacagtctggtcactactctgaagg

SEQ ID NO: 30787 - DNA, 201 bp, Homo sapiens
acgccttctaagactccacggtcacataggcccagggggaagtgttattctcatactgagagacatggtggggggttagtaagagcttggtctctagaatyaggctgcattgatttggctttggcgctaccatttactggccctgcattacttaacctctgtgtgcctcagtgtcttcatctttaaatggggttaataaca

SEQ ID NO: 30788 - DNA, 201 bp, Homo sapiens
aagactccacggtcacataggcccagggggaagtgttattctcatactgagagacatggtggggggttagtaagagcttggtctctagaatcaggctgcaytgatttggctttggcgctaccatttactggccctgcattacttaacctctgtgtgcctcagtgtcttcatctttaaatggggttaataacaatacctacc

SEQ ID NO: 30789 - DNA, 201 bp, Homo sapiens
atatgtcctgggcttccctgaaggcccagggctgagatagatattagagtaaagggtctttttattttggcaattttaaggtttttattttaaaatctttygttttcaattaatcgcaattactattctgtgatttttaggacagtttaggtgaaccccaccttaagaatgaaaacgaacaaaactctttccattccaaga

SEQ ID NO: 30790 - DNA, 201 bp, Homo sapiens
tggtgaaactccgtctctactaaaaatacaaaacaaaattagccgggcgtggtggcgggcgcctatagtcccagctactagggaggctgaggcaggagaayggcatgtacctgggaggcggagcttgcagtgagccgatattgcgccactgcactccagcctgggcgacagagggagactccatctcaacaacaacaacaa

SEQ ID NO: 30791 - DNA, 201 bp, Homo sapiens
tgtgaaacactgttaaactaattctgttcagccccagatacaggcagagtccatagatatagagcttttcagacttattttacatatggagcccaatattyaaaaataagtttttgcagaaccctaataaataaaacagatacaagtggagcatctctgattaaagttgggtcaggggatttctagtctcccctccatcac

SEQ ID NO: 30792 - DNA, 201 bp, Homo sapiens
aggtgctctccgaaatccctgaatgcctgcctgctgctgacctctgagttcgtgccggggctgctcactttgctttgcccagttcccattcccatagtcamatcagaatcaaagctttggagcaacacttctgttgggctcccagacttactggggacaactcttagggaatttcctcatagcccctctgagggccaccat

SEQ ID NO: 30793 - DNA, 201 bp, Homo sapiens
tgttatccagagttctattttcagatctcttctcttctttcctctcttctcctctccacttattttccctggatgacacatactgattgtactagagtacrtgccccattgctccagccctgagaatgtccctcagtcccttacctatatgtgctaatgataaagctcttatttattaaattatgtatacttgtatatagc

SEQ ID NO: 30794 - DNA, 201 bp, Homo sapiens
tagaagaaagagaacggactttggagtcaaagagatgggtttgaattctgattcctccactgaaaaatggtcgtatttaaataaatttaaaaaaaaaaacstctgagtctcagtgtccccctctgtaaaatgtgcagctaattcttcttcagtcatgctgaaggctgagtgagaacaaactagtgatggcactcagcacaa

SEQ ID NO: 30795 - DNA, 201 bp, Homo sapiens
ttccaaactgatgtcttctaggcaactgatgaaaggaggaagaagaaagggacttggaacaagcaagaaaatgagcctaatggtggcccatgtgatcaaawttgcataaggacagaagacaagaccgaaggagctgatgggtagagaggagatattgctgtcaacagagtggaggtctcagtggggaaagatgaactctac

SEQ ID NO: 30796 - DNA, 201 bp, Homo sapiens
aggtccatggtggtcattggccgggggctgacactgcctctagaattatacgtgatgatatctggagaacacttagaaatagggcttagtccatagtaaaygcccaaagcatgtcagtcatgagcatgacatttattataagaaatacccttcctctttggacagagctaaggagcatacatttgctctcactaaccagcc

SEQ ID NO: 30797 - DNA, 201 bp, Homo sapiens
tcctagacctgctgaattagaatcactaaagggatggggccccagaatctacatttttggtaggcttctgaggcgatcggatgcagtcagtgaaacaatcstccatggccaagtgtcagggaattagtgtagtctctcccataggactttaatctcctcctacatcccaactgatgatcactgaggctgagcttgaatttg

SEQ ID NO: 30798 - DNA, 201 bp, Homo sapiens
tgggtcactgtgatgaactttctatctgttgatgggatcccatggagctggctgctcagggtgatgtctgtctgtctgtccacagaacccctgactttgcycagatagcagaggaaaaaagtagctaatgcttcattttgaacctagtttaaggtgctctatgctatctgcagactgtaatattttaattaaacccctcta

SEQ ID NO: 30799 - DNA, 201 bp, Homo sapiens
ttcatgaagggaatggctcagagctttctgcagaggagctcaaagccacttttctataatcaactacatgcattacagggagtgatttttttttaattctycccaagccagattccattaatgaagccccacttaacagaagtcaatttaccaaaaagaaaaaaaaaattgagtgtaattgcttaaatacattttatgttg

SEQ ID NO: 30800 - DNA, 201 bp, Homo sapiens
atctacatttttggtaggcttctgaggcgatcggatgcagtcagtgaaacaatcctccatggccaagtgtcagggaattagtgtagtctctcccataggaytttaatctcctcctacatcccaactgatgatcactgaggctgagcttgaatttgcccagtgtcagggagctcgcctccccagacagctctctccatagct

SEQ ID NO: 30801 - DNA, 201 bp, Homo sapiens
ccagtgaatattaagcatactatcgggggtgtgcattaaattgtagccagaccattgagccagccccaggttccattttacctccactgcattgatagtamaaaacttctttttacagacaagtggttcagtataatatcattgggacaaggctagtgggtgctccatgaaaaaaaatccatgtacaaacaacatgaatga

SEQ ID NO: 30802 - DNA, 201 bp, Homo sapiens
aatcctccatggccaagtgtcagggaattagtgtagtctctcccataggactttaatctcctcctacatcccaactgatgatcactgaggctgagcttgartttgcccagtgtcagggagctcgcctccccagacagctctctccatagctagcaggcactctagatttcaagtcaacttatgttgacttgaaatctgtgt

SEQ ID NO: 30803 - DNA, 201 bp, Homo sapiens
agtgaatattaagcatactatcgggggtgtgcattaaattgtagccagaccattgagccagccccaggttccattttacctccactgcattgatagtaaaraacttctttttacagacaagtggttcagtataatatcattgggacaaggctagtgggtgctccatgaaaaaaaatccatgtacaaacaacatgaatgaat

SEQ ID NO: 30804 - DNA, 201 bp, Homo sapiens
gggaattagtgtagtctctcccataggactttaatctcctcctacatcccaactgatgatcactgaggctgagcttgaatttgcccagtgtcagggagctygcctccccagacagctctctccatagctagcaggcactctagatttcaagtcaacttatgttgacttgaaatctgtgtccctgtaacaaggatcagtggt

SEQ ID NO: 30805 - DNA, 201 bp, Homo sapiens
ggttccattttacctccactgcattgatagtaaaaaacttctttttacagacaagtggttcagtataatatcattgggacaaggctagtgggtgctccatraaaaaaaatccatgtacaaacaacatgaatgaatatatcccagaaattctctatgttctttctatgttgttcatcttcttgttttgaccttcttttctga

SEQ ID NO: 30806 - DNA, 201 bp, Homo sapiens
actgggagcattaaataaattaatacacataagatagttagaccggtgtctgatccagatgttaagcagcagttgctgctgctgctgctgctgttgtgtgatgatgatgatgatgaagatgatggtagtggtggtagtaatgctgccaccatcacattacagaatccaggatctcttacactaaggcccattctctcttgg

SEQ ID NO: 30807 - DNA, 201 bp, Homo sapiens
taaaaaacttctttttacagacaagtggttcagtataatatcattgggacaaggctagtgggtgctccatgaaaaaaaatccatgtacaaacaacatgaaygaatatatcccagaaattctctatgttctttctatgttgttcatcttcttgttttgaccttcttttctgactgggtctgctggtagtgcactctggagtt

SEQ ID NO: 30808 - DNA, 201 bp, Homo sapiens
actgacacctcacacagccgggtactcctctgagacaaaacttccagacgaacgatcaggcagcaacatttgctgttcaccaatatctgctgttctgcagscttcgctgctgatacccaggcaaacagggtctggagtggacctccggcaaacaccaacacacctgcagctgagggtcctgactgttagaaggaaaactaa

SEQ ID NO: 30809 - DNA, 201 bp, Homo sapiens
gacacctcacacagccgggtactcctctgagacaaaacttccagacgaacgatcaggcagcaacatttgctgttcaccaatatctgctgttctgcaggctycgctgctgatacccaggcaaacagggtctggagtggacctccggcaaacaccaacacacctgcagctgagggtcctgactgttagaaggaaaactaacaa

SEQ ID NO: 30810 - DNA, 201 bp, Homo sapiens
gtgtatgatgagagaggagttctagatccttccagcagcctcccacctgctctctgtgctccccaccatcacaggtctcgtcagagtcctccggagccacyttcatctaccaaggctctgtcaagggccaaggctttgggcagttcggctttcaaagactgggtaactagtgcttgtcccccggaagtgtgggcccgggtg

SEQ ID NO: 30811 - DNA, 201 bp, Homo sapiens
ctgggtgcccagcctcagactctggtggggggaggggtctggtttctcagaagcaggggagggggaaacaggaggcagccgcaggtgcgtgacagcctctstgtaccccaggcactgacacctcccatcgccggggcccttgcctgccaaggcagtccactccatgtcctctggctccaagctcctgaaagcttctctgga

SEQ ID NO: 30812 - DNA, 201 bp, Homo sapiens
tgcagactgtaatattttaattaaacccctctaagcccttaaagtggtaactgcctttttggcctgttctctctcattaccttcagcatgtttcaacagamtgcaaatataccatctaattcttggaaacaagtacaagataaattgattctgaagctgagggctttgggcagcaaaatctgactttccggaagaggtgta

SEQ ID NO: 30813 - DNA, 201 bp, Homo sapiens
ctggtggagctttgtaaggattctctgcagggctagagttctgagtccacaggtcctctttgcaaaggtgggacggaatcagggctttgattgtcttattytaatttgtttagtaatgttgccagtctcaagtgtacttgtgggggaaaaaaacctatgtccagaaacttcaggaaaggcagaaaaaggatccttagcctt

SEQ ID NO: 30814 - DNA, 201 bp, Homo sapiens
cagccatggatcctggtctccactggaaagctgccatcctcagaacaacaggggtgaaaatagagcctggcttcggagacatttagtaagagaactgtgaygcccctgctggaggaaggcagggaacatgcttggtagagactgagcaggaaagagtatcttcccatgcagaggagggaagaaggaagggaactcatcttc

SEQ ID NO: 30815 - DNA, 201 bp, Homo sapiens
gggctagagttctgagtccacaggtcctctttgcaaaggtgggacggaatcagggctttgattgtcttattctaatttgtttagtaatgttgccagtctcragtgtacttgtgggggaaaaaaacctatgtccagaaacttcaggaaaggcagaaaaaggatccttagccttgagagaaatcctgggcatagagaaacaga

SEQ ID NO: 30816 - DNA, 201 bp, Homo sapiens
gtccattagaatgcagtgggattaggtgctcgggaaggcaggaaatcaagtttaatgagcacctgcttaatgccgaggtcctagaatgcctagctctcccrccaacatggcaagttcttggggaggtggtggagttctagggtttcccatcccaaggaagctaattttctttagggattcttctctactccagcaatgtct

SEQ ID NO: 30817 - DNA, 201 bp, Homo sapiens
ccctcatgctggaatagcaggggcttcataaggccactgtgcgtaggaatttaaattataaccagagattaaagtagagaaacggctctggattgtcaggyatcaaaagcacctcttctttcaaatgagaactctcttcggtatcacagccattaagatccctgtttccagctcctgcccaggggagctccggcagcccaa

SEQ ID NO: 30818 - DNA, 201 bp, Homo sapiens
gtgtttctcagtacagaatgaaaggagcaatcagatatacatgggggaatggagtgggggttcccccaggacttgttcaaacttgattgaacagattcttsagctcaggatgagggaggaggagatccttccagtgcaggactacagtgagaagaaatctcctcccaggaggtgatgagctaacaaaaaggaggtaacaga

SEQ ID NO: 30819 - DNA, 201 bp, Homo sapiens
aggaaccctcaggaattagtaactgcacaatcctcctctccacctgccaccctcctgaatcaagtgctcttagactttagctctgcgatgcattgaaaccytcaaggccatgtatgaacacatgagataatttgacctttgttaatggatcttcaagtggctcactattttttttttttctttgagacggagtcttgctgt

SEQ ID NO: 30820 - DNA, 201 bp, Homo sapiens
atatacatgggggaatggagtgggggttcccccaggacttgttcaaacttgattgaacagattcttgagctcaggatgagggaggaggagatccttccagygcaggactacagtgagaagaaatctcctcccaggaggtgatgagctaacaaaaaggaggtaacagacctgtcccaaaagccccttgcaaataaccctctg

SEQ ID NO: 30821 - DNA, 201 bp, Homo sapiens
aattttgccagttgcttccctgggaggttgtttaacacaattgtctctcttttatgttccctttaattggcagtaagatctagaaacttaatcagattgarcttccatttttttagcgagaatatcttgtaggcaatgtcttcaacagaatcatatgatatttgggtatctctcttttggggtcattaggaaccattaatg

SEQ ID NO: 30822 - DNA, 201 bp, Homo sapiens
gtggcccttcagagaggaggggctatgtcagacacttttttctccccacacttttcctggcccatagtaggcactcaataaatgttggaatgaatgagctragcgcaggaatgagtgcatgaaatgagaagagattcattatgtctaggagctgcagaacctgcttcccagaccctcctaggaagggtgtcctgggaaagg

SEQ ID NO: 30823 - DNA, 201 bp, Homo sapiens
ctcctccaaaggaacacagctcctcaccagcaatggaacgaagctggacagagaatgactttgacgagttaagagaagaaggcttcagatgattaaactaygatgagctaaaggatgaagttcgaacccatggcaaagaagttaaaaaccttgaaaaaagattagacaaatggctaactagaataaccaatgcagagaagt

SEQ ID NO: 30824 - DNA, 201 bp, Homo sapiens
ggggctatgtcagacacttttttctccccacacttttcctggcccatagtaggcactcaataaatgttggaatgaatgagctgagcgcaggaatgagtgcrtgaaatgagaagagattcattatgtctaggagctgcagaacctgcttcccagaccctcctaggaagggtgtcctgggaaaggtttatcatggccctttcc

SEQ ID NO: 30825 - DNA, 201 bp, Homo sapiens
ttttttttttttttgaaatgtatttttgtttgttttttttttgttttttttgttttaatttattttattattattatactttaagttttagggtacatgtrcacattgtgcaggttagttacatatgtatacatgtgccatgctggtgtgctgcacccactaactcgtcatctagcattagttatatctcccaatgccatc

SEQ ID NO: 30826 - DNA, 201 bp, Homo sapiens
ccctgggaggttgtttaacacaattgtctctcttttatgttccctttaattggcagtaagatctagaaacttaatcagattgaacttccatttttttagcragaatatcttgtaggcaatgtcttcaacagaatcatatgatatttgggtatctctcttttggggtcattaggaaccattaatgatcataccctaggaatt

SEQ ID NO: 30827 - DNA, 201 bp, Homo sapiens
cctgggaaaggtttatcatggccctttccacacatggcaaggagctctaggatatttggccccatcagaggaaactaggtttgacaccactttcattttayatagttaagcttgttgagtttgctcactatttctttactgttaggcactttgcctacaattaggataaattgccatgtgggcagcatgagaacaggctct

SEQ ID NO: 30828 - DNA, 201 bp, Homo sapiens
tatagtcctttgggtatatacccagtaatgggatggctgggtcaaatggtatttctagttctagatccctgaggaatcgccacactgacttccacaatggytgaactagtttacagtcccaccaacagtgtaaaagtcttcctatttctccacatcctctccagcacctgttgtttcctgactttttaatgatcgccattc

SEQ ID NO: 30829 - DNA, 201 bp, Homo sapiens
agtttattgatttgcttaatctttcattttaattatttaaaatatttacatagttccaaagctaaatatataaaaaaggtatattctgagaaagcctagcwtctatccctatcttctctaccctgttccctccgtccttctgtgaataatcttttagtttttggtttatcctttcagtgattgttaatatgagtgaatatg

SEQ ID NO: 30830 - DNA, 201 bp, Homo sapiens
agagcttaattagattaagctgtgattgataacactttatatctacttgagtagaacacttctaattcaccttgaatctttatgcttccagtcaaaagccrgtttcagggataagctgagtgtggagacggatttgggaagcagtgaaatcactctgggggcctggcactgagctgagtcaggggccttggcagagctctt

SEQ ID NO: 30831 - DNA, 201 bp, Homo sapiens
tatgtaatggccttctttgtctcttttgatctttattggtttaaagtctgtattatcagagactaggattgcaacccctgcctttttttgttttccatttkcttggtagatcttcctccatccttttattttgagcctatgtgtgtctctgcacgtgagatgggtttcctgaatacagcacactgatgggtcttgactctt

SEQ ID NO: 30832 - DNA, 201 bp, Homo sapiens
cctcatgtgtcattaaactttggattttgcctatctgatggatgagaaacaatatttcactgtgcttttaatatgtatttttatgtttaagagtgaggtcratcatcttttcaaatgtgaaagagacattgcatttaagaatcctcccctccaacatcacactctggggactgttgtggggtggggggaggggggagggat

SEQ ID NO: 30833 - DNA, 201 bp, Homo sapiens
atcagagactaggattgcaacccctgcctttttttgttttccatttgcttggtagatcttcctccatccttttattttgagcctatgtgtgtctctgcacrtgagatgggtttcctgaatacagcacactgatgggtcttgactctttatccaatttaccagtcgatgtcttttaattggagcatttagtccatttacatt

SEQ ID NO: 30834 - DNA, 201 bp, Homo sapiens
ccccagtcttgttcagggaatttttggcatctgatagctccatagtaagggagtacaaaggagcagaggttcctttgacatgggaggcggcttagcttaaratctctggatttacgctgtcttgcctaggtctgaatccaagctctgcaacttgctaacccaaggctagttactcaacctccgtaagcctcagctttccta

SEQ ID NO: 30835 - DNA, 201 bp, Homo sapiens
agcctaatctggcaagtgcttttatgcctttgaacacatcaaggcctccaaatttcccatggccaaagcaagtcacaaggccaaacccaaagtcaaggagkgggggaatgtactccacctctgtaatggagggagctaaaaaatcacattgcaaatggtgagaatacaatgagtagtgacaatttgggcccatattctgat

SEQ ID NO: 30836 - DNA, 201 bp, Homo sapiens
tcccttcctgaaacaatgtcgtcttttgcagtggcatctcctgccagtcctatgaaatacacattcatgaattccaggtcaaagtttttagtctcattgtktgcaagcagtggacccaactgttgcacaacaaaacctcttaagtccttgagtcatacaccactgggccaccaaggctatggagagatttctggagtttga

SEQ ID NO: 30837 - DNA, 201 bp, Homo sapiens
gcccaggatgggacatgtggacagaggcataaataacagactttgcaagaccagagacagccagcagctgtgcctaggcctcccagtgtcctgtggagttmcctgccttggactgtattcattcatcctgtcattaactcattgattcatccaaccagcaatcattgagaaacaactgtgtgccaagcaccatgctcaata

SEQ ID NO: 30838 - DNA, 201 bp, Homo sapiens
agtaaggattactccccattcctgtccctcagtagccaacaggaaagcaatgctgtaaacacaagcagctggttttgagtaggcagagaagactggaattaaaaaaaaaaaagaaagggagaaacacttcttgcctccataattcagacagtaaactgatcgctgagatttaagtttgcttgtttcctggggaagcttgaa

SEQ ID NO: 30839 - DNA, 201 bp, Homo sapiens
ggttttggctgtcaggaatcttattacagaaggaatctgggtggatggccagactttgtgtgagattccctaatcggtggacttgggacatttatgcacttgtgtgtgtgtgtgtgtgtgtgtgtgtacacttgggagagggaggatctgtggatctactgaatgtcttctaaaagggatctattcatttatttaaataat

SEQ ID NO: 30840 - DNA, 201 bp, Homo sapiens
gagggaatcagacctcagaacccttatatctaccctaacaggtagaaagcacagcaagacaaggtcccaatggagcttcagcttctggtgggctgagcccygccttatcccctcagtcagccctgaccatgcccagggattgcaaaactaggaggggcacaactttttaggtcaacctatggccagagtcctgtccagaca

SEQ ID NO: 30841 - DNA, 201 bp, Homo sapiens
gttttggctgtcaggaatcttattacagaaggaatctgggtggatggccagactttgtgtgagattccctaatcggtggacttgggacatttatgcacttgtgtgtgtgtgtgtgtgtgtgtgtgtacacttgggagagggaggatctgtggatctactgaatgtcttctaaaagggatctattcatttatttaaataata

SEQ ID NO: 30842 - DNA, 201 bp, Homo sapiens
gggtgacagagctcccatttttgtcttgtgtatactctgcgtaccaccttcctgcccagagacatcatgagtatgaggaaatagggagaggtaagcataasaggcaagagagaaaacaatctaatgttattgtatatctgctacatgctgagaaggtattattcctcatttcatagatatggaaaactgtcccctgagtgg

SEQ ID NO: 30843 - DNA, 201 bp, Homo sapiens
ttttggctgtcaggaatcttattacagaaggaatctgggtggatggccagactttgtgtgagattccctaatcggtggacttgggacatttatgcacttgtgtgtgtgtgtgtgtgtgtgtgtgtacacttgggagagggaggatctgtggatctactgaatgtcttctaaaagggatctattcatttatttaaataatac

SEQ ID NO: 30844 - DNA, 201 bp, Homo sapiens
cacattgtgctaggatcagatatatggagactagacattcatgccctcaagggactcgtgtgttcaaacaagtcacagcacaggctggtaaagtcagcaayagcgatttgtgcaagggagtaccagaaagggagtaatcaatctgggaagaggtgggaggagttctctaaggaggtgatgtctagctggacatggaaggat

SEQ ID NO: 30845 - DNA, 201 bp, Homo sapiens
gattaaaaccattttcaaaagagcccaaccctgttcaagtcagttcaaatgcgtcagttttacaattgacaagctttgctgtgggaggcacattgtgctasgatcagatatatggagactagacattcatgccctcaagggactcgtgtgttcaaacaagtcacagcacaggctggtaaagtcagcaacagcgatttgtgc

SEQ ID NO: 30846 - DNA, 201 bp, Homo sapiens
cagaggcaacactgcagtggggcatgcagccctgcaatgttggggatagcctccctcctcaacagctgagagcagccgagaacattgctccctgcagacarctaggtccctagaaaaagaagggatgctgagccaaacatgccagctcattactcccaagttgcacagatcaaagtgcactaactgaactcccttgccatg

SEQ ID NO: 30847 - DNA, 201 bp, Homo sapiens
actccatgagaccagggtgccaggctgggacgaaatagaactaaggactaaggatcaaagcagaagcctaggcatccatccattcatgcacttactcattygctgattcactcagcaaatatttatcacactcctgctgaatgtcaggcactggtacatacaccaaggatgcagcaataagcaaaaccaagtccctgacct

SEQ ID NO: 30848 - DNA, 201 bp, Homo sapiens
actgacacctcccatcgccggggcccttgcctgccaaggcagtccactccatgtcctctggctccaagctcctgaaagcttctctggactgagccacggtstgctcccaccctttcccacccacactgctcctcccccggagttgtcccagctctgccctcatgagctgcatggactgagaccactgtcttccacacagca

SEQ ID NO: 30849 - DNA, 201 bp, Homo sapiens
agctcctgaaagcttctctggactgagccacggtctgctcccaccctttcccacccacactgctcctcccccggagttgtcccagctctgccctcatgagstgcatggactgagaccactgtcttccacacagcacccttcacctactgcaagatggccaggcacgctgcaaaggccttagaaaatcacagtttttgttct

SEQ ID NO: 30850 - DNA, 201 bp, Homo sapiens; identical to SEQ ID NO: 6223

SEQ ID NO: 30851 - DNA, 201 bp, Homo sapiens
ctgctttccttccatcctctcctccatcctcccccatcatgcctcaaaagtttattgaatcccctctctgtgccttgcacttcactagaaaagctgggatrtagacatttcaaaaaacattggctcggtcctcaaggaacttaccaattaacagtgggaaacacacgcccaaaattgcagcacccgttgctataacaacag

SEQ ID NO: 30852 - DNA, 201 bp, Homo sapiens
actgaggggcaggcagaacctggaatgaggtcagactcctagttaagcagcattaggtccacagcagcactcagctggtttggagaattggagtgcaaatygggaaacagacaggtcagcagagtaaggcgtgggctgcttaggtgtccataggtgcctgcgatccacctagctttatgtcaacctgacaggttctagccc

SEQ ID NO: 30853 - DNA, 201 bp, Homo sapiens
gaaggttgggctttcgagagatgggggatggggtcccaggaggatgacgggggtgctccctgaggccctctggtctttcactgccctcttcactccttctrtagctctctgtggtggcttcattcaaggctccagtgggaccatcttgtcgccagggttccctgacttctaccccaacaacttgaactgcacctggattat

SEQ ID NO: 30854 - DNA, 201 bp, Homo sapiens
tagggtttctttaatggcttgcaataaacttgtataattttttccattacagatcttatgtatttcttaatatatttactcctaaatatcttatatttatygttgctattataaatcaaatcttttaaaattgcacattctacttgtttcttgctggtgtttagaaatgcaattgattttgtactttgatttttatattag

SEQ ID NO: 30855 - DNA, 201 bp, Homo sapiens
ttgccagtaattttgatgcatgcttttaattaagaacctctgatctagaagaattaacatgcagaagagccaaaaaactaattttaaaggaagattaatcyttccggatattaaaatgttgttatgggctaaattaatgttaacaatgtggtatgagtacaagagtggacatacaaataagacgtggagaataattgtcca

SEQ ID NO: 30856 - DNA, 201 bp, Homo sapiens
aataaaatagctggcacagcctcatagtccttacctgtctcagcctcattctgagccctctaaactaagttctagctacacaaaacttccttcagtttctrgaacttgccaggcttcccttctcctctagagctttacacatttgtacaatgttcttctctctggaacacttcgtctccccaagcaaggggaatgggaatc

SEQ ID NO: 30857 - DNA, 201 bp, Homo sapiens
ctgtgttattagagcatcaaagttaaaactcagaattatatatcttcctggtaaattgaactgtttcaaaaataattatgtagtaactctctttatctgtrgtaatgtttttaaccttaaaggctttttccctccatccattgcatcagttttctcttggtctttgtctaataaatattttctattctcttactgttaact

SEQ ID NO: 30858 - DNA, 201 bp, Homo sapiens
acatcaccatccttcaggtggacgtgccactggatgtcatgttatttctcctttgcattaagtgcctgctgtcttggctaccctaccctgacccctgaagsctcatggccatctcctgctcttgctccttctgccaagccccatcctctcccagtgcagagcagccaccaatataactgatctccctccctgctctccctc

SEQ ID NO: 30859 - DNA, 201 bp, Homo sapiens
gtgcaaatacatgctttaaaatttattttcttgtcaatgataaactctattagttcttgtttgtctttttaaaaaataatttcaatttttattttagattygggggtacatgtgcaggtttgttacatgggtatattgcatgatgctgaggttggggtacggatcctgtcacccagtctgtaagcatagaacctaatgtgt

SEQ ID NO: 30860 - DNA, 201 bp, Homo sapiens
ctcagtatggaggtttcaaaccacccaagtaatatgaaggctgcaaacccatgtgaaaactgacttactgttgtgaattctcagtggaaacatttttcttrtctactcagtgtcaaggtctaagataaacagtcagcctccagatcctcccagagggtggtagtgacaggtgagaaggagataggctcatttctaattcac

SEQ ID NO: 30861 - DNA, 201 bp, Homo sapiens
tttggctgtcaggaatcttattacagaaggaatctgggtggatggccagactttgtgtgagattccctaatcggtggacttgggacatttatgcacttgtgtgtgtgtgtgtgtgtgtgtgtgtacacttgggagagggaggatctgtggatctactgaatgtcttctaaaagggatctattcatttatttaaataatacc

SEQ ID NO: 30862 - DNA, 201 bp, Homo sapiens
gtgttgaggcatacagagaaaaattaagtcagcttagaaagtgctggagctagggttgctcttttatcatggccagaaaaggcctctctgatgagttgacrtttggccagagatagatatctgggagaagagggaacagaggaccaagacccaaaccatgagcatgctcagcatttgaggaacagctcagaggccaagctg

SEQ ID NO: 30863 - DNA, 201 bp, Homo sapiens
attttaaaattttacctaacactttaaaattgtttggtccgggtgcctggaaccacagtgctgggaacactggaagcagatttcctctgcacaacattttrcaaagaaagattcacatttaattaaattatttcatgatgtacctagttaatgggaaaggacacttcagccacatggggtgagggtggaggctaggccaga

SEQ ID NO: 30864 - DNA, 201 bp, Homo sapiens
gtctgtgtttgagctgaagtcccagctttgaactttgactgcagctttctcttacattctttaccgtttctgatcatgcacccaccttttatttaactttstttgagtcatttctccatctggggctgaggtggggggctcatttcatctagagtctccaccccagatctgaagcataggcgtggtggggggaggtcacca

SEQ ID NO: 30865 - DNA, 201 bp, Homo sapiens
gcttccttgtttataaaacagagataacagcatccaattcacaggctttactctaccttagatgacatcatttacataaaccaagaggtggcatataattwtcagcattttgccaataacatttttatctgtatttatcaataaccaattattgttattttgccaataaccttttacaatctcagaaaggaaacattaaaa

SEQ ID NO: 30866 - DNA, 201 bp, Homo sapiens
tgcagagcagtgtttctaatatctctgtggggccttggtgggcttcaggtagtgctgagggagcccagaaaggctgaagagaaccctatcctgatccaggygggaggagacccagggaacatacaatgcaacaaggagggtctaagtgtggaaactcaaagtctaagactgaggaatagaagttgtcttctgggaaacagc

SEQ ID NO: 30867 - DNA, 201 bp, Homo sapiens
gatgatatgtcctgggcttccctgaaggcccagggctgagatagatattagagtaaagggtctttttattttggcaattttaaggtttttattttaaaatmtttcgttttcaattaatcgcaattactattctgtgatttttaggacagtttaggtgaaccccaccttaagaatgaaaacgaacaaaactctttccattcc

SEQ ID NO: 30868 - DNA, 201 bp, Homo sapiens
ctaccttagatgacatcatttacataaaccaagaggtggcatataattatcagcattttgccaataacatttttatctgtatttatcaataaccaattatygttattttgccaataaccttttacaatctcagaaaggaaacattaaaacaaagagctacagaattccatttctgaacaattaaataaccccagggtttac

SEQ ID NO: 30869 - DNA, 201 bp, Homo sapiens
caaaaagcatagtctctaagctcacagtatgttttatgagatgagcattcattcattcattgatgtagatatggcctctgcccttgaggagtgtgcacgtragagtgaagaacaggtctgaaaaaaaaaaaaagagtgcaggtaagtcctgatggaggcatgtccagagcgctatgggaaaactcagggaagagctgctaa

SEQ ID NO: 30870 - DNA, 201 bp, Homo sapiens
gctgaaccttcacatccatcatctcatataatttcatcctcaccatatctcaatgaggtggtatcatttgtcccattttacagatgaagaaacaaaatcagagagattttctaactcatccagacttaagcgaccagcaaatggatttagatccagaaggctaagttcataaattttaaaacctgacctcgctttaaccat

SEQ ID NO: 30871 - DNA, 201 bp, Homo sapiens
ctgtatttatcaataaccaattattgttattttgccaataaccttttacaatctcagaaaggaaacattaaaacaaagagctacagaattccatttctgarcaattaaataaccccagggtttactccgtctcctataaccatccccaaaggcatccacccaccctgatctggccacacacactcagaaacacatagaacc

SEQ ID NO: 30872 - DNA, 201 bp, Homo sapiens
ctgaaccttcacatccatcatctcatataatttcatcctcaccatatctcaatgaggtggtatcatttgtcccattttacagatgaagaaacaaaatcagagagattttctaactcatccagacttaagcgaccagcaaatggatttagatccagaaggctaagttcataaattttaaaacctgacctcgctttaaccatg

SEQ ID NO: 30873 - DNA, 201 bp, Homo sapiens
tctggccacaccaaggactgggtgcttcctcttcttacacccccgtccccattatcaccatttgggtcttaggtgggatcctcatggatttaagtattggrcaaagagaacatcccttatagttcctaatcttcccacaaattaaaacccagaacaaagcgagaggcctggcaaaagcatcaggtgggagttcaactccat

SEQ ID NO: 30874 - DNA, 201 bp, Homo sapiens
atttgtcttctgtttcacatgttattaataatgcacagtagttatagtcacctctaattaccaccagccctgctgccgaggctcaggctggaggcatctcrggaatgcccaccgggggctgctcccagtcgccatgcaaattggatgatttagtccacatagtgctaccaggaacatttccagccgagaaggagatgaaca

SEQ ID NO: 30875 - DNA, 201 bp, Homo sapiens
tgaaccttcacatccatcatctcatataatttcatcctcaccatatctcaatgaggtggtatcatttgtcccattttacagatgaagaaacaaaatcagagagattttctaactcatccagacttaagcgaccagcaaatggatttagatccagaaggctaagttcataaattttaaaacctgacctcgctttaaccatgc

SEQ ID NO: 30876 - DNA, 201 bp, Homo sapiens
acaccagatctggccacaccaaggactgggtgcttcctcttcttacacccccgtccccattatcaccatttgggtcttaggtgggatcctcatggatttargtattggacaaagagaacatcccttatagttcctaatcttcccacaaattaaaacccagaacaaagcgagaggcctggcaaaagcatcaggtgggagttc

SEQ ID NO: 30877 - DNA, 201 bp, Homo sapiens
gtatatgggtatctaagaatatggttttagagtttgtttagaagctgcctgctatcaaatgcatgtgtaattgagtatgggttgactgcataataaaagayaataatttagcttagggaacatggcaaagccccatctctacaaaaaatacaaaaattagctgggtgtggtggtgcatgcctgtagtcccagctactgggt

SEQ ID NO: 30878 - DNA, 201 bp, Homo sapiens
atagcaaatattgccttttctcatgtcaaaccaaccttgcattcttaagattaacataacttgatcatttagtattgtcatttttatacatgcctatatadtgtttagtaatttgtttctattttgttagtgagcttggcctgttatttgttttttcatattgcctttgccaatttttgtgtcaatatattgctagcctca

SEQ ID NO: 30879 - DNA, 201 bp, Homo sapiens
atgtcccctgctcttcctggctccctccactggagtcagggttgctactactgagatttacagaagagaactagcccagaaaacaccagatctggccacascaaggactgggtgcttcctcttcttacacccccgtccccattatcaccatttgggtcttaggtgggatcctcatggatttaagtattggacaaagagaac

SEQ ID NO: 30880 - DNA, 201 bp, Homo sapiens
aataatccactgaagatatttgttaagtgcccaccatgtgacagacactggaatatggccgtgaacaaaactgaacagctgcccttctgaaatctatattmtagtggaggaagacagaaaaaaataaggtcaatatagagtcgatgagagagtattaactgcagtggagagaaatatagcagaggagggtgttgggggcat

SEQ ID NO: 30881 - DNA, 201 bp, Homo sapiens
ggattatcactgtcactgtttcctttgtagacctgaagaactgagaattaattctccaggcaggtgatcggcagctagtgcaaatgtcagggacatactcgttggcccatttgttcactcacttattcattcagcaaacatttactcaaacaccctctctgtgccaggccctgtgcaagacacctgcgatcagaggtttgc

SEQ ID NO: 30882 - DNA, 201 bp, Homo sapiens
ctttttaaaagttccacaataatccactgaagatatttgttaagtgcccaccatgtgacagacactggaatatggccgtgaacaaaactgaacagctgccyttctgaaatctatattctagtggaggaagacagaaaaaaataaggtcaatatagagtcgatgagagagtattaactgcagtggagagaaatatagcagag

SEQ ID NO: 30883 - DNA, 201 bp, Homo sapiens
gattatcactgtcactgtttcctttgtagacctgaagaactgagaattaattctccaggcaggtgatcggcagctagtgcaaatgtcagggacatactcgttggcccatttgttcactcacttattcattcagcaaacatttactcaaacaccctctctgtgccaggccctgtgcaagacacctgcgatcagaggtttgcc

SEQ ID NO: 30884 - DNA, 201 bp, Homo sapiens
acaattgtggaggctggcaagtccaaaatcaccagcataggctggcagggtagagacccaggaaagaatcacagttcaagtctgaaggcaggctgctagcygaattccctcttcttccagggatagcaggctgccttttctctcaaggccttcaactgattggatgaggcccacccacattatggagggcctcataatcta

SEQ ID NO: 30885 - DNA, 201 bp, Homo sapiens
aaacatcttaaacaacagaaaacagggttcgagagcagagaactggtctgacctcagatttaccagggtgggtttttttcgccaccctaataagcctgagrgtactgcaggagaccagggcttatttcagtccttgtctcaaccacataagacagacactcccagagcggccatttatagacctccccccaggaatgcatt

SEQ ID NO: 30886 - DNA, 201 bp, Homo sapiens
aatcaaaagtctcgaaaatatattgtaagggacttaggaatctgcagattttggtatccaagggtggtcctggaacaaatcccctgcagatacagagggamaactgtacctgcctttgcatctagcaattccacttactggaatttatctgaagaaaataagtaaaactctacatcaagatttagcttcaaagatttcccc

SEQ ID NO: 30887 - DNA, 201 bp, Homo sapiens
gaaagcaagaataaaagaacaaatatttgtaagtgtttactctgtgctaagcactgtgttagctgccagtacatacaaagtcaaggtttccaatgtcaacmagactctcaaaattttccagctgtcctcttcatttcctcagtcagttcccttgccctttctccatacagctgtttgacaattctgcctcctttctgaaga

SEQ ID NO: 30888 - DNA, 201 bp, Homo sapiens
ttacttccccagggtccttccctgcacatcaagcccaattactctcagcaaagctcttcctatgacaggatggaggattctagtaacagtcccaagggcayctctaagccttgcacaaggagcaggttttcctgtgaggcccaaccacactcaccacagctccacctctctgaagtgggatcccgtgaccggccccactca

SEQ ID NO: 30889 - DNA, 201 bp, Homo sapiens
caggggcgtttcagagggaagagtttgaagtgtgtgttagagaatctgaaagaacacaggaaagaccaaagtgaatcgatttttaatggaaggtcctaaaragcatgtattttctctttcaagcccttggaagtaacactgtgggcctggaagctacggccacacctgctaccacccctattcccaccacctgctgctgtt

SEQ ID NO: 30890 - DNA, 201 bp, Homo sapiens
ccactgccaattgctgagacagttctttctcagtttctgccctgctttgtcactaaaactgaccttgctaaaattgacagcaacctccaggttgcccattycagtgtcgtttctccatcttcatctgactcagcctcttggcaacacatgacactgatcaccagtccttcttgaactatttccttctcttggctcctatga

SEQ ID NO: 30891 - DNA, 201 bp, Homo sapiens
attcaggaggctgaggtcggaggatccattgagcctgggaatttgaaacaagcctgggcaacataatgagatcccatctcaaaaataataaaaaataaagwtccatctgtattcagtcactctttcagatgtgtctaaataaaacatgtttagtttcacccagaagaacatgcagatgccctcaggaaattggtgcacgat

SEQ ID NO: 30892 - DNA, 201 bp, Homo sapiens
ctctccaccgtgttcctgctgaaaataagccctgcacagttctccaggcctgccccactcgcctacccctaccccacagcaggagaggcctgggagagtcrggtgggccagcagcatgacgctggggcatctccttgagcctgtggtccccagccctggccttgctcagggcgttgttgctgcctgagacccgtctcatgg

SEQ ID NO: 30893 - DNA, 201 bp, Homo sapiens
tctgctctctgtttctacgtatttgacttttggaattataatattagtttaattctatttttcttataggttatttggttgtttttttttttgaggttccygattatttttccctttatcctaaagtctaatatttttactaggacatgcttcagagttaattattccaagacaatttccttaggtattctatgggtcttt

SEQ ID NO: 30894 - DNA, 201 bp, Homo sapiens
accattgatcagaggcacttctattctgaattcatcctcctgggtggctttaccctttgctaaaaggaaacaaagaacagcagggatcctgtgttttggayacagttaccaaaatggagtcacagggaggtttatgtctttctccaggccacggatatcaacagaaccagtggggtggaaggacctttattctcatatacc

SEQ ID NO: 30895 - DNA, 201 bp, Homo sapiens
ttttgagatagggcctcactttttcctccaggcttcagtccagtggcacgatctcagctcactgcagcctcgacctcctgggttcagcctcctgcctcagsccctgaagtagctgggaccgcagacacgcgccaccacagccggctaatttctttgtatttttggtaaagatagggtttcaccatgtttcccaggctggtc

SEQ ID NO: 30896 - DNA, 201 bp, Homo sapiens
gattagcacataggcacagcatcaagcagagtgcccagtgccaataagtatttgatatgtactttgatccacccactttcatcccacctcctttttcctaygtcactggtattgcatttgttgtgcctttgtttggaagggagaatggggctaacccaggggaacacggtacatgttcttttctgtttactgaagatgtaa

SEQ ID NO: 30897 - DNA, 201 bp, Homo sapiens
ttcccagttttagaagctcttgatgaaatgcaaaggggaattaccagtgaaaacctgtgtttgtaggggtgtgtgtgtgtgtgtgtgtgtgtgtgtgtgtrtgtatggtgtgtgattatgactaatgtccatcaattacctgcaaattactagatgatgcctgtaatgatagttctgtttttagcttaatggtttatgtat

SEQ ID NO: 30898 - DNA, 201 bp, Homo sapiens
tctacgctattatctctttttgaccttttagtcttccctaattatcccaaatcccattatctaaatcccagctcccttccttgcttgatttgtgagcttgrcaagtattatctcttggaacatcatctacaaattgttgctagtaataattatgttgcaggaggttaagattaaaagatattttatacatgcatattttat

SEQ ID NO: 30899 - DNA, 201 bp, Homo sapiens
tatgacttaacatttgcgtgaccttggataaagcattgaacctcttgaagcctccatttcttcctttataaaacgatggtaggaaaattcctgcttcatakaaatgtaaagatcagtgagtccacacatgaaagtccttggtacagtgcctggcacatatcatgcattctgtaatgttcaagtatcattagtagtagtaag

SEQ ID NO: 30900 - DNA, 201 bp, Homo sapiens
tgggatccagcctgttctagcccctggaggctgggctggcaaacagcagaggatgctgccgcattaaaatttggtagaaagtaatttgtcagtgagatgtrctctctaaatacatagcttttgcaaacggtaagctttagtttggggctaatgcagacagcttggaggctacctccatgtcctttgtttccagcctccttt

SEQ ID NO: 30901 - DNA, 201 bp, Homo sapiens
aagggacataccacttgttgaaagcctgctatgtgccatagctttatgttcattatctcagggttttcacagtgtcttgcaaagacctgcggtaccctccrgggacctccatggtaggatagggcatgcccaggatggagggttctgaccaccctgcctctgtttcttctcctttcttctcttttgctctttgtaagcctt

SEQ ID NO: 30902 - DNA, 201 bp, Homo sapiens
ttctcaccatggccttgcatgggctttcctgggtgcatgcacacacaggagagagagagagagagagagagagagagagagagagaatgagagaatgagcmtggtgttgtttcttcttagacatccatcctctcagatcggggccctgcccttatgacctcatttaaccttaattacttccttagaggccccatcttcaaa

SEQ ID NO: 30903 - DNA, 201 bp, Homo sapiens
tcccagtgtggtcccagctgtgtaagcttgagtcttgtggtctctctgagcctcagttccccgacttgtacaatggaaataatgatgccaatctgagagcrttgttaggagagtgaaatgagatctcaaagctccttgcacattgcctggcatagagatggtgccttccctgggggtgtcaccaaagtttctctccagcca

SEQ ID NO: 30904 - DNA, 201 bp, Homo sapiens
gtcagcatgtggaagggttgggtcagggaagggcatctcaggcagaggcagcagcaggagcaggagctggcaagagcacagctcagtgctcctgctgcagyaaaggatggggaggtgcagtgaggggttggcaggggattggtcatggggtgtcctgagggtccctggaagttgcttggaatctaggctgcaggcaacaga

SEQ ID NO: 30905 - DNA, 201 bp, Homo sapiens
tgtaatctcatctccttccccagtacctgcatgaccttgggaaaattgcttaacctttttcttcctcaagttcctcatccatataatgggaataataaagyctccaccttgctgagttgctgcaaggataaacaacacacttaaagattttagacagggctggcccagatgagctctcagcaagccttagtcctccttaga

SEQ ID NO: 30906 - DNA, 201 bp, Homo sapiens
ccaggtgggatagtctgagtctgtgaaacttctcaggaggttccttatatctttattttgtaactggccaggttccagagtcccagccccagataagagtygagggttctggccactggtgcccactgccttggccaggaaagggtccacagtgaaggctctcccctggttccaggacacttgttctatctaccaagttgc

SEQ ID NO: 30907 - DNA, 201 bp, Homo sapiens
ataagatgccgatacaacatgattgattccctatcagcatcccctccttgtcttagtattttttttttccatcaacaagtatttgttgagtttctgtgacwtgtcaggtgttgttttaattgctgggcatcagtcctgaataaagtggaacaagtccctgctctcatggagaccgtggcttagccacaggagacaacaact

SEQ ID NO: 30908 - DNA, 201 bp, Homo sapiens
tggaacaagatctcagagtagatgaaaggggctgggcttcacctcagtgggatgagcctggaaggacgaggatcactctatctcctgaactaaagcaatascaggaagatctgagtttttggaaaattactctagcagcaatggagaagtttagaggtggatactggaaggagaaagaccagttaggaggatgaagcagtt

SEQ ID NO: 30909 - DNA, 201 bp, Homo sapiens
tcctccacctccccttctacctcctctctcttctcttcctgttttagctgttttcagtgtggtacttctttttctttcccagctcatctttcatggttttygcttatcttacaatttttcttttaggtccttgaaacttttctttgaattcctttttaaaaactctgcaatttctttgagattagacaacagtggttttct

SEQ ID NO: 30910 - DNA, 201 bp, Homo sapiens
agccagggtgttctgtgtggggactggtgggtagaaccaggtgcagccatcctcagcttggcctccccttccgcatcccacccaacctccctgacaggatrattagttctgggagctgggatttcctcaggaaggcatctgaattctcaggtgggtaccgaggccctgcacttacgtttgtgttccctccctggcagtccc

SEQ ID NO: 30911 - DNA, 201 bp, Homo sapiens
gtgaaggtacaggagaagagggatggtgacagaagggagattctggagtgagagggccacgggattgagaatgcagggctccctttgcgaggagcaggggkagaaagatgctgttgttagaaggagctgaaaggtttgcttgtgggagtgtaagagggacatgtgtccccttgctctcctcatagtcatggaatgattatg

SEQ ID NO: 30912 - DNA, 201 bp, Homo sapiens
tcaagacccatttccttgtttccctaaagatacagtttctactcctctgtatttttgttcttgttgtcagtggatttcaagagagattaaaaaatgtaaawaccttcactggacatctttaaaaagaaatctcccttttcagtgttgtttaatagttatacagaattccactatgcaaatatagtaacatttactaaaatt

SEQ ID NO: 30913 - DNA, 201 bp, Homo sapiens
aggcatgcaccaccacgcccggttgaatctttttttagtagaggtggggtttctccatgttgaggctgatctcaaactcctgacctcaggtgatccgcccrcctggcctcccaaagtgctgagattacaggcgtgagccaccacgcccggctgaatttctgccttttcatggattcttagtgtgatctgaggaaagccact

SEQ ID NO: 30914 - DNA, 201 bp, Homo sapiens
cctacatcaagacaccagcattaactgagcatctatgggctgtgcgcctctgcactgtgggaacaggaagaacttacagtcttattggagaggcaagttarggatatgtctgtactcaataaactaggagtaagggaaataaaaacaccccagtgcatcctcctggaaacttcatagattcaaggaacagaggaaagaagg

SEQ ID NO: 30915 - DNA, 201 bp, Homo sapiens
aaaaatttttaaaaagtatctagttaccatacacctggatgcaagctcaaccttgagacatccgtttcaaagctgtccagcctgccacagccctgcctctytgttcatctcagggaagacccttcccactgcccgtcctctccaattttattgcctcctcctctggcattgcagtcttgtagatttagcccctattctcaa

SEQ ID NO: 30916 - DNA, 201 bp, Homo sapiens
gttgaataacaggctattgcagtagcttcagtgtactacgatgatggcctggtgtggcagtggggttaaagaaagtgagtttgagacatatgtaagggaargaaatgataggacttggattacagagaaggtcatagagagggatttgttaagacactgagcatatatgtcttatgtttctttgcataaatacaaagaata

SEQ ID NO: 30917 - DNA, 201 bp, Homo sapiens
atccataagtgaatgagtccaagggcttactgctctcagaaccaccaaaatgaaacctcaggtagtgaccaaagttccagaacctctgacccttcttagtmcctgctggaggcctctgtccttgaactcctgggagttcaggtcttcagccttcctactggcctcccctcctcctcaccccaggagttaattctctagctc

SEQ ID NO: 30918 - DNA, 201 bp, Homo sapiens
accttccaaagcctcttcttcaatgtccttattaaggacagaatccgggagcctgggctgtttatgcaacccagatatttagacttcctaagttgaggatmaactctctgggggcatccacacatcaactacaaataattaagtatctaacaggtagccagagccagcttcatagatatctgacctatgcagtcatacagg

SEQ ID NO: 30919 - DNA, 201 bp, Homo sapiens
aaaattcctctgcagaagcttaaaaaacacaccgtttattttctccacataccaaaagtccagaggcagaaagtccagggctggcttggtggttccctcckggtctcatgctccttgtatttttccctctgctgcttttcatatgactctcatcctcatgatcacaagaaggttgctccctctctgtcctcacatctgtat

SEQ ID NO: 30920 - DNA, 201 bp, Homo sapiens
ccttccaaagcctcttcttcaatgtccttattaaggacagaatccgggagcctgggctgtttatgcaacccagatatttagacttcctaagttgaggatcractctctgggggcatccacacatcaactacaaataattaagtatctaacaggtagccagagccagcttcatagatatctgacctatgcagtcatacaggg

SEQ ID NO: 30921 - DNA, 201 bp, Homo sapiens
agggtcttaattattaatattccttgttaggaaaagaatttagcaatatcttccctacttgcacatccatttataggttctctgcaacaagaaaaatatgrctctattctgcccaaccctgcaggcagtcagaccttatggttgtcttcccttgttccatgaaaattgctgttattcttttctttctcaaggtgcactgat

SEQ ID NO: 30922 - DNA, 201 bp, Homo sapiens
ctggagtacctttatggaaccctggggtacctgggagcccagtttgaaaaccattgctctagggaagccatcagcaaacttcttctgtaaagagctagacmataaatattttaggctttaaagtccatgtaaggtctctgttgcatattcttctatgttgtaggttttgttttttcactcattgaaagtgtaaaaaatcat

SEQ ID NO: 30923 - DNA, 201 bp, Homo sapiens
gtagctggtcctccatgtaccagacacaacaccaggctctttcacctgtgccagctgaggctgccacagggagaagcagagaactggatctgagggctgcyaggctaggagtctacagatctgcaggctgcagtctgagcagcgttgcgtgagaaaagcagcaaagttaacgaagctgggcagacagaaggacacctggac

SEQ ID NO: 30924 - DNA, 201 bp, Homo sapiens
attttatattaataaaatggataatcaatccacagtaaaactttatgtgccaaataacatagcacgaataaattaaataaaaaccgctggaaatgtaaaamaatttaataaagttacagccatcatggaagattttaatatacctctgtaagtctgtgacatatcacctaacttaacgataaataaagatttgggtagctt

SEQ ID NO: 30925 - DNA, 201 bp, Homo sapiens
cagaagggccaaggaatccccactcactattgacaaatcccatctcctctttaataactcgctccaaacactgattgctacaggctcacaccccgcctcamctagacgttgctgcaggcccacatcctacttcacctagaccttgctacaggtccacatcccacctcacctagaccttgctacaggcttacatcccgcctc

SEQ ID NO: 30926 - DNA, 201 bp, Homo sapiens
cagtctacatctcccgggactctagcttcccacaagactgccctgagctggcagatcctctgcaggcttgtgcaggctttgggcacatgctggcagcaccyggagtcctatcttttggctaatcctggacagcacgtggcaaggggagaatgttctccagggcctccagtgggtgtcctccagggtcccactccatctccc

SEQ ID NO: 30927 - DNA, 201 bp, Homo sapiens
aggagaaagatacttttaaagataaaggcagaaatgactagagaaacaaaactaaaaagcaatagcaattgtcaaccaaaccaactgtttttttttttttwaaataataaagtagacaatactagcagaactgatcaaggaataaagaagccacaaatatgtaatattaggaattgaaaagggacataatcaaagatatag

SEQ ID NO: 30928 - DNA, 201 bp, Homo sapiens
ccttgctacaggtccacatcccacctcacctagaccttgctacaggcttacatcccgcctcaccttgaccttgctacaggtccacatcccgcctcacctaraccttgctataggtccataccctgcctcacctagacattgctacaggcccacatcccacttcatctagaccttgctacaggtccacatcccgcctcacct

SEQ ID NO: 30929 - DNA, 201 bp, Homo sapiens
tagcctgggctgagcccacacacacccttctccatcccgccaggcccagacccacctcctctatggacccccttccatctctctcctctttgcactcctcyagcactcaccatcagcaccatgtcctgggcatttagattctactctaaattgtcaggcaagcaagataacttatgggaagcagctagctctgggcttggc

SEQ ID NO: 30930 - DNA, 201 bp, Homo sapiens
ttcagaagagagaaaaataaagaaccatctcccaactcattttttcttaatgaggcaagtagaaactttggtatcaacgagtaaaattatggttaccaggkgattgagggaatggggagataatggtcaaagtatagaaagcatcaattagacagaagaattaagggtttctttttcctttgagatgtattgcacgttaca

SEQ ID NO: 30931 - DNA, 201 bp, Homo sapiens
aatgccagctgagggactgttgcttgacccctccaagagtttacttggccctttggctcttaggagcaggtttataacatccctgtaaaaccttcaccaagggcagaagaccttgaagtgctgcccagcaggcccttggtgtccacaagcagggccggcagcctccagtgagctgggcactgcttgcaaacagctgagaag

SEQ ID NO: 30932 - DNA, 201 bp, Homo sapiens
tattgtgctgtattgggggaacctgcccctaatatttagacatcgattctttctattttccataagtgtcagctggctgagaaataaagagaaagagtacraagagaggaattttacagctgggcctccagggatgacatcacataacagtaggaccgtgctgtccacctgaaccttaaagccagcaagttttattaagga

SEQ ID NO: 30933 - DNA, 201 bp, Homo sapiens
tcagaagagagaaaaataaagaaccatctcccaactcattttttcttaatgaggcaagtagaaactttggtatcaacgagtaaaattatggttaccagggkattgagggaatggggagataatggtcaaagtatagaaagcatcaattagacagaagaattaagggtttctttttcctttgagatgtattgcacgttacag

SEQ ID NO: 30934 - DNA, 201 bp, Homo sapiens
gatgctgtgggaaatggccctactggccctctgctagtatcttcctgtcctttactctgacttcctccttacttatcccaccttctgttctggtgacacamacacacacacacacacacacacacacacacacatgcacgcacacattccgggatgaattgggtaatgggatctgcaagaatctggtctctcccatggacc

SEQ ID NO: 30935 - DNA, 201 bp, Homo sapiens
attttttcttaatgaggcaagtagaaactttggtatcaacgagtaaaattatggttaccaggggattgagggaatggggagataatggtcaaagtatagamagcatcaattagacagaagaattaagggtttctttttcctttgagatgtattgcacgttacagtgaatatagcaaataataatgtatcatacatttcaaa

SEQ ID NO: 30936 - DNA, 201 bp, Homo sapiens
aggcagcagtgggttctgggagaagccactgggtttgggcctatgcaaaagggacatgttccgtagatacattgacgcacacataaacacccacacacacrcgcgcgcccacactgcaggactgggtacttgggtttgtaatggttcctataggggttggctgttgcctaatggatatgaatgaagaagggaggtgggttt

SEQ ID NO: 30937 - DNA, 201 bp, Homo sapiens
gtccccagattgtgatgttccccttcctgtgtccacgtgttctcattgttcaattcccacctatgagtgagaacatgtgttgtttggttttttgtccttgygatagtttactgagaatgatgatttccagtttcatccatgtccctacaaaggacatgaactcatcactttttatggctgcatagtattccatggtgtata

SEQ ID NO: 30938 - DNA, 201 bp, Homo sapiens
cggcccccatctgggcttagtctttcacccctatattctccaggggtgggaaaaaagggaaccagcattctttttgcacctcatctatttccaaccactastcctcttctctttttctatgagggtcattcctaactctatttcaacctcatagctatcagctggtatcttccttcactccacttcactaaagaggattct

SEQ ID NO: 30939 - DNA, 201 bp, Homo sapiens
gatgatgctaagccactcatgaagaatctaaccccattatccaaatacctccccccaggccccatgtccaacattaaggattacatttcaatgtgctattyggaggagacaaatatccaaaccatatcattctgtccctggctccccaaatctcatgtccttttcacattgtaaaatacaattatcccttcccaatagtcc

SEQ ID NO: 30940 - DNA, 201 bp, Homo sapiens
tttggctcgtggttctgcaggctgtacaggcatggcaccaacatctgctcagctcctggtgagggtctcaggaggcttacaatcatggcagaaggcaaaayggagccagcgtatcatatggtaaaagtaggagcaaggtagggtgggggcaccacactcttaagaaaccagatttcatgtgaactaccagaacaaaaattc

SEQ ID NO: 30941 - DNA, 201 bp, Homo sapiens
agagggatctgcccccatgagtcccaccaggcccaacctcaaacattggggattacatttcaacctgagatttggaggagacaaaaaaccaaactatatatttttttgtttgttgtttgttttgtttcttaacatgaaatttatgaccagctaataacgggttgcaatccactgtttaatacatttagctataaattcttc

SEQ ID NO: 30942 - DNA, 201 bp, Homo sapiens
actttgggagttcacactcagtccattacctaagccatccaggtagtggtaattgttatgagaaaaataaagcagagcaactggcagagtatgacaaggcrcaatcaatggaacctttttgggaagtgatacctcacttgttttcacatgtcagtcccttaaagcttgccactgtcttcagggtttcatgttttcttctgt

SEQ ID NO: 30943 - DNA, 201 bp, Homo sapiens
ttaaagtgcctgagccattaatagtcctgcctggattgagttgttctggtttttcattgatcttaatcataggccatgataatactaagagataacctaarggatcttctttattccagacataatcttccttacctccattgtgtagtagcagtcccatttctgtttggtagtgagaatcaatcaccctggctagcatag

SEQ ID NO: 30944 - DNA, 201 bp, Homo sapiens
aaattttgcatttaatttctatgggtggactcacaaactacttgaaactcatctttgagccccagggtaacaactcatgatttagaggttgtgcatatagrtggcaataatgataataggaatttaaactatttttgagcatttactgtgtcctgggtacagtgctaaaggctttccatgaattaccttgcttacaacatt

SEQ ID NO: 30945 - DNA, 201 bp, Homo sapiens
aagtcctcagtatcatcaacaggttcttggaaactgttgactttaagtaaaacaaagtatagcaggtcttcaaatgtttccttcaatgtcatttcattatrttgtttttgttttgttttgtttctgagacaaagtttcattctgtcacccaggctggagtacagtggcacaatcttggctcactgcaacccttccttcctg

SEQ ID NO: 30946 - DNA, 201 bp, Homo sapiens
tccatgaactcacgggaccagagctgtcttgttcaccactgcagacagagacctcagcacactgctttgtacatggggggtctcagcaaattcttgcccartgaatgaataaatagttgaataccctgtatatttaggcctccctaaaagtagatgacaccagtacagagtaaaagaaggggttccaaagagttgccacat

SEQ ID NO: 30947 - DNA, 201 bp, Homo sapiens
atgcctagcaagctgcaattccatatattgtaagtgataaaactgtaattgtttgttgacagtgtacattagctattcacagcttgcatcaatatagtacygagaaactagggtctaggaatctttaatggcagtgcaaaaatatactggaactaagttggggaataaaatcaacaatttctgcttagtgagaggaatgcc

SEQ ID NO: 30948 - DNA, 201 bp, Homo sapiens
ggactctgcagagtccagaggagatgcagggcaccatccagcacagagcaagagacctgagcattctaatgtgctagctgaggtctctcttaattttcttrtaaagccaccagttcctttcccatgcttgcctattaatccattaacccattagcccattaatccgtgaatggattaatccattcatgaggacagagcctc

SEQ ID NO: 30949 - DNA, 201 bp, Homo sapiens
gcagaggagatgcccatcctatcttgctggactgcaccctgatgacagaggcttcgagaaaagaaggcattccttagattgccactacatttttctcccakcactagtcacattactgaagcaaaggagcccagttccagtaaatatgcagacagatcctcgcatttcatcctagctaactgtggtgggaagatggcctcc

SEQ ID NO: 30950 - DNA, 201 bp, Homo sapiens
aatttgcctggtgggagggtgggactgagagaggggaggaagacagggaacaggagctacctctgttggccaggcccaccatgcaaatgagctgggatgcrgtcccaacatattaaatggatcagagcagcttctcattcacatgtgcaaattagattaatcagaccagatgcagaaagaggagaataataatgccgttac

SEQ ID NO: 30951 - DNA, 201 bp, Homo sapiens
cctctgacactttttcatccctctccgagttttattttggtggacactgtgtgtccaggattggggcagaaggaaagtgtggcagatccagccagagggcrtggtgattgcatattgctctgattaccagtgaggttgcgcatcttttcatgtttattggccatttatatttcctttgctgtgaattttctgtccatatcc

SEQ ID NO: 30952 - DNA, 201 bp, Homo sapiens
acaaattcagaactactgataagggtctatgttcagctgtgcaggtattgtcttgataaacatcttaaacaacagaaaacagggttcgagagcagagaacyggtctgacctcagatttaccagggtgggtttttttcgccaccctaataagcctgagggtactgcaggagaccagggcttatttcagtccttgtctcaacc

SEQ ID NO: 30953 - DNA, 201 bp, Homo sapiens
aatattccttgttaggaaaagaatttagcaatatcttccctacttgcacatccatttataggttctctgcaacaagaaaaatatggctctattctgcccawccctgcaggcagtcagaccttatggttgtcttcccttgttccatgaaaattgctgttattcttttctttctcaaggtgcactgatttcatattgttcaaa

SEQ ID NO: 30954 - DNA, 201 bp, Homo sapiens
tggatcttaaaggagagagtaggagacagacattaatcaaggagcccctaaacatatgtaaaagacaactgtgaaaacggccatccatggtgctgtgagcrtgggattgggagagctggcctagtgggaggcagtggtcactcagctagctctggaggaagaggggactcatcagggggaagacaggccttcccagctcaa

SEQ ID NO: 30955 - DNA, 201 bp, Homo sapiens
atggctgtctcatctactggaaggacaggattgagggtttagcaatgtagagatgaatgctttcagcctgtctctctgaagaaacagatggtttgacaagyaggcaacccaaacctggcctccccaggctgctaaagagtaagctggtgctatatgggcattgcgggaacaagaacaaatctccactggaaagattagaat

SEQ ID NO: 30956 - DNA, 201 bp, Homo sapiens
cctgccctccaggagttcatggtgtagtggaggaataagtaaacagacccatcacagtccagcaggtaagtgctaaaacagacgagaggaaggggctgagmaggggctgctccccttgtcaaggttagtcagagagaactgagacaagtcaggctcacagatgagaagaaatattctagggcagtgacagggagcaggaag

SEQ ID NO: 30957 - DNA, 201 bp, Homo sapiens
ttccatcgttcacctgcactaccaaaaaagcctgcaaccatcctcaccaccagcctcactcctgccaatgagttccacacatactgccacactgacatttyctcaaacacctatgcgtccctgtcacccactatttaaaactctactgctcctcccctggcataaattctaattttggagggtagaggtatgagacctttt

SEQ ID NO: 30958 - DNA, 201 bp, Homo sapiens
accagccctctcctgccttcccctctcagaggtttatagggttcatggattgatgcgtaaccttccaggttcttttctatacattcacagcactgtaaatrtatctagatagagatatatacatagacacagacatatacatatatagagacacatacatgtgcacacaatacacatatacatatgcagacacagtcatac

SEQ ID NO: 30959 - DNA, 201 bp, Homo sapiens
actaccaaaaaagcctgcaaccatcctcaccaccagcctcactcctgccaatgagttccacacatactgccacactgacattttctcaaacacctatgcgwccctgtcacccactatttaaaactctactgctcctcccctggcataaattctaattttggagggtagaggtatgagaccttttgaaccaaactccaggaa

SEQ ID NO: 30960 - DNA, 201 bp, Homo sapiens
gggcagttctccaatgggaagagaaatgctggacaaataaaagcaacagctgtccactcttggatcagcctgaaaggcctcggaccaagacttcttccatstaaagctcaatctgagacttgacttttaccacttctgtttgaggaaaggccagtctagactagaccattggaatgacagaggacaaggagaggaagaggc

SEQ ID NO: 30961 - DNA, 201 bp, Homo sapiens
actggacttattgggttcactcaagcagtataagagcatttaaacttagacttacactagaaccttggaggccttccccattgagactgcctctagcctgmtaggggattgaggctgtgtatttgagattatgtgcatatttttgtatatgtcatgttgtggtcgacttcatcatggtctaccacaaatgactgctatagc

SEQ ID NO: 30962 - DNA, 201 bp, Homo sapiens
cagtatcctgcaatgttcctagtttcagcaataatccttctacctctctctactctgaccaaggggaaaagagcactgggcaccttctcactgaattcatrtgaaatgtgaatagaatgagcagtctgttagggggcaggggagatcgaggttttgtggatgaacctggagccttccactggctggctgcttccatgcaga

SEQ ID NO: 30963 - DNA, 201 bp, Homo sapiens
cagcccagaaaggattgagaagaggtaattgctgaggaagaaggagagcgagtgaggattggcaagtccagagccagatggggaacactctcagaacaacrtcaagctcctacatgtaggagagagttggaaataatagattaggtggaattaagatgctatttgaccaggccataggaatacttggaccctacctcaggc

SEQ ID NO: 30964 - DNA, 201 bp, Homo sapiens
gtcctgtgtgaaaccaacgggtccatgaaatgtttgatgtgtcctttatagcaacaggtaggggtcagtcttccatctgtgaccctgatcccttcttctcmtatttctagcatcttgcctaatcaactattccttttcctaaatagctctgcaatgaacatcctcctcttcatttgtactcattctcccttgattcagacg

SEQ ID NO: 30965 - DNA, 201 bp, Homo sapiens
gagggatctgcccccatgagtcccaccaggcccaacctcaaacattggggattacatttcaacctgagatttggaggagacaaaaaaccaaactatatatttttttgtttgttgtttgttttgtttcttaacatgaaatttatgaccagctaataacgggttgcaatccactgtttaatacatttagctataaattcttcc

SEQ ID NO: 30966 - DNA, 201 bp, Homo sapiens
ggagatgtctcattgaaagaatggcttgggttccaactggagaaatgggtttctgtgaggggaaacccacataaagacagcaaggaggtgggggtggcggyggtcttttctgcaatacaggtcacacaagagatcaaaagttgcaagaatgtagacaccctcttgattggatttggctccaactatccctgtcccctgagc

SEQ ID NO: 30967 - DNA, 201 bp, Homo sapiens
aaaggcccagaaagatcagggcggcacagtgtctcctggcttcagctctcagatgctaccctggagtatgcagagttcactgtggaaggcccttccacctycccccacccccgaccctcaattcagggggctgaggcaagaattggaggtgagcaagtagagaagggtgtctggtcacctcttataggacattaaaatgat

SEQ ID NO: 30968 - DNA, 201 bp, Homo sapiens
aactcacatgtataatcactgcaattctttcctggaacagtgaatatatgacagcctggtatccaaggtccttcaacctgtgatgcttcctcacctttccrgtcccatctcccccctctccctatctcataccccagcctccagcctgccatgctgttcctcacctccaggaactttgcagttactcttctgtctctctct

SEQ ID NO: 30969 - DNA, 201 bp, Homo sapiens
agggatctgcccccatgagtcccaccaggcccaacctcaaacattggggattacatttcaacctgagatttggaggagacaaaaaaccaaactatatatttttttgtttgttgtttgttttgtttcttaacatgaaatttatgaccagctaataacgggttgcaatccactgtttaatacatttagctataaattcttcct

SEQ ID NO: 30970 - DNA, 201 bp, Homo sapiens
acagccaaggggaagacaggatgagtcttcccagcacagggagagcatgctgctgggctccagagtcagaaacacagtggggcccagaatttgcccgagcrggcctggatcctggatagtcctttaaatgtcatcggtcaggcaatcattctattcgggtgtcatggtggagagcacacctctaaatatctctctcctgcc

SEQ ID NO: 30971 - DNA, 201 bp, Homo sapiens
agacaggccttcccagctcaatgaaatttgcctgcctgtcactcattctcccttcttcctctcgctcacctaccccactcccataacccaaagcatacccsctggatccaatggattattatgtcctatttattctacctctgaaaaatccctcaaatttaaccacccttttcagatctccctactggctctgcctcaatt

SEQ ID NO: 30972 - DNA, 201 bp, Homo sapiens
atcactgcaattctttcctggaacagtgaatatatgacagcctggtatccaaggtccttcaacctgtgatgcttcctcacctttccagtcccatctccccsctctccctatctcataccccagcctccagcctgccatgctgttcctcacctccaggaactttgcagttactcttctgtctctctctgcagtgccctcctt

SEQ ID NO: 30973 - DNA, 201 bp, Homo sapiens
ttttatttctttattgtttaatcatgaataaagctatgaattttctccttactacagctttggtctagtatcatcatcattataagaagtctgtattggcygggcgcagtggctcacgcctgtaatcccagcactttgggaggccgaggcgggtggatcatgaggtcaggagatcgagaccatcctggctaacacggcgaa

SEQ ID NO: 30974 - DNA, 201 bp, Homo sapiens
cagagaagggagcagacatcttttcaggaacatctgaaaggggatcaggaaagcgctttgtcacaaaagtgagcctaaagtcctcagaatgactaggtggstactagggagacaggcccagggagcggggagaaggtgtcccttcagtgtggctcacacagcatacccccagtgtaccataggttcctcctgctccaggac

SEQ ID NO: 30975 - DNA, 201 bp, Homo sapiens
cccagaacttcagaactaggccctgccattgtcacaagacaaggcctcctggtagaagccacctagtcagcttgtaaacaggaattatgatttaatttttwaaaatgacccatgtctattttaagcattcaagcaatacagtaagaatataaatatgagatattttataatcactactcacaattcaacattccagaagta

SEQ ID NO: 30976 - DNA, 201 bp, Homo sapiens
ggtcaggagatcgagaccatcctggctaacacggcgaaaccctgtctctactaaaaatacaaaaaaattagccgggcgaggtggcaggtgcctgtagtccmagctactcgggatgctgaggcaagagaatggcgtgaacctgggggggtggagcctgcagtgagccgagatcaggccactgcactccagcctgggtgacag

SEQ ID NO: 30977 - DNA, 201 bp, Homo sapiens
gcagatcctggttctgtcactttctagctccatggcaggtcatggaacctttctcaggatctgtttcttcatctgtgaaacagagataataatacaacctrggtctcaagggtcctgtgaagatggttagattaagaaatgtgaacataagaaatgttgcaaattgcaaagcaattagtgagtaactaatgagccagtaca

SEQ ID NO: 30978 - DNA, 201 bp, Homo sapiens
caatcatggcggaaggggaagcaggcaccttctttacaaggcagcaggagagagaaaagtgagagaaggaggaacttcataagttctgatggaacttatamaaccatcagatctcgtgagagctcactcactatcatgagaacagtatggggaaaactggccccatgatccagtcacctcccaccaggttcctccctcaat

SEQ ID NO: 30979 - DNA, 201 bp, Homo sapiens
ggctaacacggcgaaaccctgtctctactaaaaatacaaaaaaattagccgggcgaggtggcaggtgcctgtagtcccagctactcgggatgctgaggcargagaatggcgtgaacctgggggggtggagcctgcagtgagccgagatcaggccactgcactccagcctgggtgacagcgagactccgtctcaaaaaaaaa

SEQ ID NO: 30980 - DNA, 201 bp, Homo sapiens
agggaaaacgagataacttgctcagttgatagcttccctctgccatcttccttgcatctgataactcactgtgcctctgatagttgttaccagtgctaaastccaggactgtgggttgtggggtaaggaggtgttgttcaacataaggccatgctgacgacattgggttgggggtctctcctgtgtccaggtttatgatgg

SEQ ID NO: 30981 - DNA, 201 bp, Homo sapiens
gggtaaggaatgggagatagataggggtaaagtatagcctggttatggaccatcttaaatgccagtaactaagagggagccatggaaggttcttgagcagsgtcggtccaccagggttatttgcagtgtagagagctcatggggagacaccatcaggagtctgttacaatgatccaggaagtaagtgctaaggatttggaa

SEQ ID NO: 30982 - DNA, 201 bp, Homo sapiens
tactaaaaatacaaaaaaattagccgggcgaggtggcaggtgcctgtagtcccagctactcgggatgctgaggcaagagaatggcgtgaacctgggggggyggagcctgcagtgagccgagatcaggccactgcactccagcctgggtgacagcgagactccgtctcaaaaaaaaaaaaaaaaaaaaaaaaagaagtctgt

SEQ ID NO: 30983 - DNA, 201 bp, Homo sapiens
caaagtcaagtgcaaatgtcagctcacccgggaggtcatccctcaccccctctcttgcggggctcctaggagtcctttctgcctcttttgaacttccattrcctgttgcatatattttcctgatgacactgaccacttttctcctttatttatgctcatgccttacctcccctcctggagctgtggtctctgcctgattca

SEQ ID NO: 30984 - DNA, 201 bp, Homo sapiens
tctgccttggacttgctcagcaggccctgtgacttgccccctctgccttcaaggtctttgcctttgggttttgattcctcattatttgcattatgttcccaactgaactcccacaaagctggagacaagatggctgtgtgggggcatccatgtccagcctagagactcccaattcagtgctaatgtaatatttcaagtcga

SEQ ID NO: 30985 - DNA, 201 bp, Homo sapiens
agcatttttgcaatcagaaaaattaaatgttgtttcattttgaacgcctacgaccctgatatagtttttatttgggggcttatgtccagtctttatccatwtataaacaaatatttaatagctataatcaaaagcatgcatataattttatgatctactgctttatttaaaattatgtttaacattctttctacagggtca

SEQ ID NO: 30986 - DNA, 201 bp, Homo sapiens
ttataaacaaatatttaatagctataatcaaaagcatgcatataattttatgatctactgctttatttaaaattatgtttaacattctttctacagggtcwtatttatcactttaatgattgcagtcaaactgtatcacattaaaggctataatttacctcacattattgggctgacatatagtttgttcacatttttcct

SEQ ID NO: 30987 - DNA, 201 bp, Homo sapiens
cagaatttgtgctcaggattgtatgacttccaaatcaatgccctttccacaactctcaccctcagtccaacctgcccacttcttggctgtctagaaggatstgcagcttgcacccactcccatctgggcaaccatggtttagtaagctcaaaaggacccctcgactaaccctgagcagtaggagccttcctgttggcgagg

SEQ ID NO: 30988 - DNA, 201 bp, Homo sapiens
ctctataataaaattatgtcattgtaaacatctttggctaggtggctctttttcttttgaattaattcctagagattactgagtcagtctttgagtagttytgtggctctggatgcgaacttacatactcccttcaaaaaggatcatatcagttttgctctgcaattggcaataaatgcatgtatgagattccatgaagcc

SEQ ID NO: 30989 - DNA, 201 bp, Homo sapiens
agaaagcctcctctgcaatcctctctttctatctttccctgggacaggagatgagagaagcctagatgcctggatgactgcatggagcagaacccacctcstcccctatctgctgctgattgattgaattttacataagtgagaaataaacttttatgtaaacttagacctcacgtattactgcaccagttgccccaggag

SEQ ID NO: 30990 - DNA, 201 bp, Homo sapiens
gtatgccaacattgctttcttagtcgtgacaaatgcaccgtggaaatgtaagatgttagcaatagaagaaatggtgaaaggtctatgggaacaccgtattrtctttgcaacttttctgtaagtctaaaattattccacaataataaaaaaaattaattaacagagagagtcacacaggcttgtagccaaggtatctttggc

SEQ ID NO: 30991 - DNA, 201 bp, Homo sapiens
gtcccttccttgcccaggacaccctttcctcacaacctggtcaaaccctcctgtgatacctgctcagattaccatgcattcaccctttgtggttttacacrcgcgtgtgtgtgtgtgtgtgtgtcttcttcatttatgcccatctaccccacaaggctgtaaactccttgatgacaagaactctttctcttttacttttca

SEQ ID NO: 30992 - DNA, 201 bp, Homo sapiens
ttttgagggaacaatatatttgcgtgctcattgaaaaaaactctggaagcatatgtaccaaacctactattaattgaatagctctggagaacaggttggcwgtgtgaaagagagacttttttaaaattcagtacatctgtatattgtttgccttttctctgccttgagtatgtcttatttttaaaatttaaaaagatattt

SEQ ID NO: 30993 - DNA, 201 bp, Homo sapiens
gcctccaggtcttatctcatgttattaaatccaaagaaagcactctcctttcacgccacctaaacttcaggtctcatttccttttgccttccctgatgagygtggcccacaccgatgtcttttctgagagcacgtacagccacaccacacggctggcactcggtctcctcttggctgctgatttcacagtgcattgatcac

SEQ ID NO: 30994 - DNA, 201 bp, Homo sapiens
cggctattatgttccagccaccatgctggacacttgtgttcatgctctcatggtaatttattctacatttattgaatgcctaacaggaatgccaggtatcrgagacacaacagttaacaagacagcttctgccttcaaggaacttaacgatatctttagggagacagttaaataatcagggtataagtgctatgactgggg

SEQ ID NO: 30995 - DNA, 201 bp, Homo sapiens
catgggctaatgtgaaagtgccttatacacagtggttgttatggaaacacgttttccttcatgtctatttagtccccatattcttgcttttctcagcttcstgtcagactggggtttcattcgttcattcattgattcactcactcattcattcagttgttcaccctcaggatttcacatggcctctagagtcagtctcta

SEQ ID NO: 30996 - DNA, 201 bp, Homo sapiens
agacacagctgataattttttagtgagtttgtgtctggggggttattgcccatctccagaagctcccggagaatggcaccctgtctgtcatcttcactgtwatacagcagcaccccgcatatgggaggcgcttaagtgaatgagtgccgaaaggggcttgaactttagcctctgtcctttccgttgccaacttgtattgtt

SEQ ID NO: 30997 - DNA, 201 bp, Homo sapiens
taaatacacagataaatgaagttggtgagtattttctgaatattagattagtgcaaaagtaattgtgtgtgtgtgtgtgtgtgtttgccatcattgttaayggcaataaccggaattacctttgcaccaacctaatacaaaagattaattcatttcactcactcattcatttaaaaatgtgtactgagtgtctactatggg

SEQ ID NO: 30998 - DNA, 201 bp, Homo sapiens
caccaagagtgatcgcaaaatgtaaatcggaacctgtcagagctcagcttaaaatataccaatgacttccctcagctcctatagtacacaccaaacatctycccccatccacggagtcccgccagccctgcccctgcctacctctcctggcccagtgtcgcctccatggcctttccattgtgacctttgcacatgctctcc

SEQ ID NO: 30999 - DNA, 201 bp, Homo sapiens
ctccatgccctcccttcgactgggatgtcctcgggcaatgttgacctcaccttgggcatttgggttatctcagtccttataatattaatctgacattaacrtctgcctacaataatttttcccaaatttcatcagaaatgccttggagacactttaaaaccacagattcccaagctcttttccccaaagatctgattcagt

SEQ ID NO: 31000 - DNA, 201 bp, Homo sapiens
actcaagaccaaagccgtcttcatgttctgaatcacattttagattcctccattcactgtgttgagtattccttattacactaatgtagtctactcaggckactgtaacaaaatactgcccactagatagcttagacaacagacatttattttctcaccattctggaggctagaagtccatgatcaaagtgcaactaaatt

SEQ ID NO: 31001 - DNA, 201 bp, Homo sapiens
ttctaatgcacttgagtttattctgttgttctttttctagcatcttaattttgatgctttgttcattatttttcaatctgatttaagcatcaaaggctacraatttccctctgaggactactttggctacattcctacagatttttacagttatttattttctgttatagtttagttctgaatattttttaatttacatta

SEQ ID NO: 31002 - DNA, 201 bp, Homo sapiens
tggatttaggagttaagcgctactatatgctagttaaccctccaggagggtgtgagatcactcagggagaggcagtttcagtggggagggcagtggttagygagggagtcttgggagagacccagggcaggcagaggaagaggcttacatggagggaccatcactgaggtcccaggagagctgggagtagattgagcagat

SEQ ID NO: 31003 - DNA, 201 bp, Homo sapiens
ttgccaacggtttgaataagaagtaaatagcgtgaacttgaaagggatgacaatactagtcagcaaacagagtgcagaaagatctgggtggggtagagccrttgactaaattagtaggaaaagataaagtgggaataaatatcaagtcatgatttaagacttaaaaagaaattagctactggaatttatcccaggaagtta

SEQ ID NO: 31004 - DNA, 201 bp, Homo sapiens
gacgaggaggccagaagtcaggcagtggcagtggagatggagaagaagagaaaattcaggggacattcaagtgatcacaccaacttttctcaactactgtktgtgacaacaatacaccaagtacctgcgtacctaccgcctacacccaaatggcgttactattttgccatatatgcttatgtgctttctttgttcttctct

SEQ ID NO: 31005 - DNA, 201 bp, Homo sapiens
taaggagaggatttaaggcaattcctgtaagaaatgttgatggcccccgaatgtttatgcaggagaagaagtggacttgggagatttgagagctgtgtccrgatatctgaagggctttcatgtgggaaagaggaattagatgcatttggtgtgatcttgttggaaaagaaagggacataccacttgttgaaagcctgctat

SEQ ID NO: 31006 - DNA, 201 bp, Homo sapiens
gaaagggacataccacttgttgaaagcctgctatgtgccatagctttatgttcattatctcagggttttcacagtgtcttgcaaagacctgcggtaccctycagggacctccatggtaggatagggcatgcccaggatggagggttctgaccaccctgcctctgtttcttctcctttcttctcttttgctctttgtaagcc

SEQ ID NO: 31007 - DNA, 201 bp, Homo sapiens
ctactgtttgtgacaacaatacaccaagtacctgcgtacctaccgcctacacccaaatggcgttactattttgccatatatgcttatgtgctttctttgtkcttctctttccatccttttgttttcctttttgctgagctgctggaaagtacactgtcaacatcatgatacttcatttctagatgctttggcacacatcgt

SEQ ID NO: 31008 - DNA, 201 bp, Homo sapiens
tttaaacaaatttataaactcgaaatgaaacgtttccacaatcttactctgtaatcttactcctcctcacaccccacataaaataactattaatgtctgtytgctctacttattcttttggatattttgtgtgccaatatgtacataaagcaaatgtaatgcacatgtttctaaaccaagttcatccacatgcatggctta

SEQ ID NO: 31009 - DNA, 201 bp, Homo sapiens
tgcgaacttacatactcccttcaaaaaggatcatatcagttttgctctgcaattggcaataaatgcatgtatgagattccatgaagcctcaacaatattgsattctatattttttctttattttttctattgaaatggactgtgttgtcatattaattctattttctttcatatgaatcctctaagcactctctttactca

SEQ ID NO: 31010 - DNA, 201 bp, Homo sapiens
gctaccaggaacatttccagccgagaaggagatgaacagccctgggctttaatgcatggtgtgacgtgggtggcggggagggaggtgacatagcccctgayatcaggggcccctgaatttgatgtagaagagacagccctgaccccaggggaccccagtctgcagcaagagacatggccctgtccttgggaatcctggtgt

SEQ ID NO: 31011 - DNA, 201 bp, Homo sapiens
tcacagatgccagaatcagccacagcacttacctgtggttgtgactgtttgtttctctggaacatttatttgtttccatttgtgcctgtgtttggcttctragttcatctgttcacctcccctgttactttggagactctcccggaagcaagtgccccgtccctctatccctcctgtcccctccctggtgcccaggacaaa

SEQ ID NO: 31012 - DNA, 201 bp, Homo sapiens
tagaggccccatcttcaaatacagtcacactgggggctaagagcctcaatacaggaatttgggggagttgggggaacacacaagttcagtccgtaataccrtccaaaaccaagctcgccatctctgcccccacacctgtgacctgcacctgtgtaccccatcttcacgaacagcaccaccatccatgccatccctaggcct

SEQ ID NO: 31013 - DNA, 201 bp, Homo sapiens
ccaagcccatgtttaagggaagccagctgtcgagaattaggcagagggcaagaggcatcaggaaccatgagggtgctgtgagcctcgggcagctaatgcaygcttcccatatgcttctcaggctttctgccagtcccagaatccaggcagttagggttccaaatggaagcaggtaatccatgtagattcacctgggacatt

SEQ ID NO: 31014 - DNA, 201 bp, Homo sapiens
tgaatggttatctttccagggtctcatgaggactcagtatagtcaagcacccagcatagggcctgacatttagtaaatgctcagttggaagcttactcccytctctgctctccaaggcctacagctcttcttccaacctacatcattacccgaagcttcagaattacctctgcctccattttagcccctgttattccagct

SEQ ID NO: 31015 - DNA, 201 bp, Homo sapiens
tatatatatgcatgtgtgtgttcatttgtgtagctatgtatttatggatatagatgcttttttaaatatgtttccacctgtgtgtgaatcggtgtccatgwatttggttttggggatctgtgtctgtgcacacctgtgtcagcatattgtgtgtatgtgcacttgtgcattgtgtatgttttggttgaataacaggctatt

SEQ ID NO: 31016 - DNA, 201 bp, Homo sapiens
cagtgttctctggaaccctaaagattcaaggactgtgtatcaggagccacctggaatcaggttgccagatgttccaattggaagtacaggacacagccatrggaggtggctgatgcctgtaatcccagcactttgggaggctgaggcaggaggattgcttgaggccaggagttccatgccagctgggaaaacatagcaaga

SEQ ID NO: 31017 - DNA, 201 bp, Homo sapiens
cagagttcagggaggactaacagaggatgcaggagcccaggtagtgcacacacatacgtgcacacacacacgcatacacaaacacatgcacacacatgcayacgcacacaatgcacacacgcacacacacatacacacgcacgcacaaacacatgcacgcacacacacacacacgtacatgcacacacacacacactcttt

SEQ ID NO: 31018 - DNA, 201 bp, Homo sapiens
agttcagggaggactaacagaggatgcaggagcccaggtagtgcacacacatacgtgcacacacacacgcatacacaaacacatgcacacacatgcacacrcacacaatgcacacacgcacacacacatacacacgcacgcacaaacacatgcacgcacacacacacacacgtacatgcacacacacacacactctttagc

SEQ ID NO: 31019 - DNA, 201 bp, Homo sapiens
ttcaaaatcactaaaagagtaaatttcaaatgttctcaccacagaaaaagataagtatttgaggtgatggttatgttagtttgatttactaattccacatygtattcataaatcataacatactttctactgcatgaatatattcagctataatttatcaatttataatttaaaataaaaattttaaaaagaacagaaatc

SEQ ID NO: 31020 - DNA, 201 bp, Homo sapiens
gtgcctagtatgctatctgaacctagtacttactatttatagatttaaagtatgactatcagtatcactgtaggctcagggaacctacagggctggatttwaaaagtgtgagaccatggttgcagtatcccagtttctcccagatttagattcagcagtgagctctggcccaggttctgtgtggctagattctatgtcttt

SEQ ID NO: 31021 - DNA, 201 bp, Homo sapiens
tgggcgtggtggcgggtgcctgtaatcccagctacttgggaggctgaggcaggagaattgcttgaacccggaaggcagaggttgcagtgagccgagattgygccactgcactctagcctgggtgacagagcaagactgtctaaaaaaagaaaaaaaaaaaatggagtaaagtatacatgctttgacatggatgacccttga

SEQ ID NO: 31022 - DNA, 201 bp, Homo sapiens
gcctgctattggttggtgggggcgtgggtgtggcagtgggaggtggaactctgaaaacactttgaggaaaggcatgtggagatctcagacttgaacagggwtatctgcacatcccagggtgtccctgcagccagcaatgaagtcaagatccagcccccgcagagcaagcagaatttcagggcagccccaccaaggaatggg

SEQ ID NO: 31023 - DNA, 201 bp, Homo sapiens
ctccctgaccctcgctgtcctttgctcagggagattggtcacttctgctgctacttgttgttaggatacctagcacacagtgtggctgtcttctctactasacagtaaactcttccaggggagggcagtatcctgttgatctctgctgtcctggcagccagcagaggtcctgttgctatcaagaagcaggttgaagtactt

SEQ ID NO: 31024 - DNA, 201 bp, Homo sapiens
agcagggaggtgggaatcatttgtttgtttgtttttgtttttgtttttaaaaaatacctagtgtgtccaagtttccttcagactaaaagaactgaggaccrtgatctcagaagcaagttttgcctgtgggcagcacttgagagggacgggcccctgcagtgaaaatccactgtcctcccagcttcttagatttaggctctg

SEQ ID NO: 31025 - DNA, 201 bp, Homo sapiens
agagataaactgcctataagcagggaggtgggaatcatttgtttgtttgtttttgtttttgtttttaaaaaatacctagtgtgtccaagtttccttcagastaaaagaactgaggaccatgatctcagaagcaagttttgcctgtgggcagcacttgagagggacgggcccctgcagtgaaaatccactgtcctcccagct

SEQ ID NO: 31026 - DNA, 201 bp, Homo sapiens
tgtaaatattgccttatttggataaagggtctctgcaggtgtgattaaattaaggattttgaaatgaaggggttatcctggattatctgggtgaaccctakatgccaccacatgcaactttgtaagaagaagacagagggagattttatacacgtagaggagaaggtgattcaaagacagaggtagaggttagagtgatat

SEQ ID NO: 31027 - DNA, 201 bp, Homo sapiens
ataggttttctgtatatcataaaaaccagttagaaaaaaataatgagaaaaatgacattcactagtgcggcaaaaagtgcataaaatgtctgtgaataacyttaacaagatgtgactgggacttaaagaaaagcatctaatctttactgaaagattaggtggtgtttgctgtgccaggttctgtactgaacatttagcaac

SEQ ID NO: 31028 - DNA, 201 bp, Homo sapiens
gatcaatagaagatggatgatgaaatgcaggaggagagattctgaaatagacagacagtgattaaggtaagaaaggaatgcgaagaaattaaacacacagyaacaactaaaatccacaatagcagcatttgccttgtaagaaataaaagcattgaagtagtagacaagctagactctaagtaatgaaaagtagacaaacat

SEQ ID NO: 31029 - DNA, 201 bp, Homo sapiens
ctgactttcattaggaactccaatatggctaagaattagaccagtcgttctcaactagaggtgattttccccctaggggacatttggcaatatctggagarattttggttgtcacattgggaggtgctactggcattcagtgggtagaggtcagggacgctgctaaacatcctatatgtacaggacagcctcccacagtga

SEQ ID NO: 31030 - DNA, 201 bp, Homo sapiens
tctcactctggacactcggatttctgctatgcccataaagctcatatttggctaatagtccttgttttttaacttcagggatacttcttaatgattaacayacagggaaaactgaaaactccattcttggattttggtcaccatgcagcaggcattggcgggcatggttttgattaaccaggacccctgcccagtggagct

SEQ ID NO: 31031 - DNA, 201 bp, Homo sapiens
cttctggcattcacaccacacagtaattcatgggcctgggcgggggtggcatgtcttttggtggcacgactctctgaagtcttccaattcttttttcgtcktctgaaatgatgatgattctttccctccttctccttcactgactttccaccctcattccccttaaatactggagggcccagctcggcctcttctctgggg

SEQ ID NO: 31032 - DNA, 201 bp, Homo sapiens
cgttttcaaaagcagaggtccctgggaggtgctgagctttgtgtcatctctttgatccacaagagggaagatcatgtggatttcagcaacaggcctctgayttatgagggccattggccctggatcaaagaaggctgcatggggaagtgacggaattcatatgcactggggactgagaggcaggtggtagggagaaagctg

SEQ ID NO: 31033 - DNA, 201 bp, Homo sapiens
cagaccttatagatgggttggatggctgatagaataaagggccaaagttgactcctaggcttttcctggagggctggtgggtggggatgccaatgaccaakatggagatgactggcacagagggcaggaagcatgtgccctaaagggaagcaagacagctcactttgtccaggtaacgtttgagacgcctgtgagacatcc

SEQ ID NO: 31034 - DNA, 201 bp, Homo sapiens
ctaatgtttctctttggcccctgcttactttccacctgagtgcccctcccttcccaccttctcttctttcaggtatctttgcttctgcctgctccatacakgtctgttcagtccccagccttctccactcctgtggtgggagcttccctctctgtcctgctgattccctgcctcacagtctctgggatcccaggcccatag

SEQ ID NO: 31035 - DNA, 201 bp, Homo sapiens
gcttgctcggaacaatattggcaaatctcccacttgttggctggctcctgtggcttatctccctggtaatgttcatggtgaatttatttacatcagaaggmgacaaactctgcctcagatgtcagacatcatagcctcctgccagagagatactcaaggcagaaatactgtgcaacttgataaaacaaatcaacagcacca

SEQ ID NO: 31036 - DNA, 201 bp, Homo sapiens
tagcacaatctcggctcactgcaaactctacctcctgggttcaagcgattcttctgccttggcctcccgggtagctgggactacagatgtgcgccaccacrcccagccaacttttttttttttttttgtatttttagtagagacagggtttcatcatgttggccaagctggtattgaactcctgacctcagttgatccgcc

SEQ ID NO: 31037 - DNA, 201 bp, Homo sapiens
ctcttgatgctcttcaacggtgccaggcctctgcaccctggtgacctttgcatttgctgctctatcttccgtgaatgctcttcccccaggtaaccatgtgwcttcctctctcattccttcaagtcttggctcaaatgtcaacttctcagtggggtcttccctgaccaccctttctgaaatatccacacccccactcccaac

SEQ ID NO: 31038 - DNA, 201 bp, Homo sapiens
gggcagccgaccagcatcactcaccactccctctaggacaccgcctttcctcttgtcagatgccaagcacatggctattttcagcctctcttctgttattytcagtacacctctatttcttgtcttttccccataaactggaaggcccaaacattccaactttggccaagaatgtcactaacatgttcctaagatgcccgc

SEQ ID NO: 31039 - DNA, 201 bp, Homo sapiens
aatgaatgaataagtgaatgaatatattaacacaaattctgtctcttccataaagcccttcctaactatgtgctatcactgcgccttgagcatccccatcrtaactattctgtgttgccattgctggcttgcctgcccacctcctccctcagaagcatttgaaggcagagaggaaatcaagcttttcacattgtagtgctg

SEQ ID NO: 31040 - DNA, 201 bp, Homo sapiens
gggtggatgtgggcatgtgcgcagggctgtgcctacacgatgggaaggctgggcagattccttcatcccccttaggatcccctttttcttaagccaatcayagcctcagactagctgctgtgggcaggaacacaggcacatgtaccccacgtgcatatctcctgcagcaatggtggggcctcactaggaaaccttatatct

SEQ ID NO: 31041 - DNA, 201 bp, Homo sapiens
ctgtaaagaacattagtaagaatagttcagagctgctaaacaagatcacttttatctctagcccagatggctcctatatatctgttaatctgatctcaccrttggaggccccacagacatacccacttctgcgtgtccaaaactgaactcctggttgccttccataccacaaggagctcccttcctgggttttctgcctca

SEQ ID NO: 31042 - DNA, 201 bp, Homo sapiens
ccctgtcaggatcacacacaccaacttcagggactgtggctctgacagcccatgatggtgtctaccgaacaggcagggtccctttttcctgagaatcctargtagtgtccaaaaaactcccctgatgactctgggcccctctctcccaaatctcgggactcatacagtcctcacctcaccgtctggcactggcttcatgac

SEQ ID NO: 31043 - DNA, 201 bp, Homo sapiens
agtagcttgttttctgttttacctcttaatcatatgtcaccatctcatcatgtcaatgtctatagacctacctcatcctgtttgatgggtacagagaattytattgtatgtaccaccataatttatttaactattcccctgttgaataagtgaatcttttcagcttttcactccaacattcttattcctgaatcttcgaac

SEQ ID NO: 31044 - DNA, 201 bp, Homo sapiens
atattcattgttattctcatctgtttgttgttcaagattaattttagaatcattttgtcagagtaaaaaaaacatcctattgggatttttgtatgtgcackcctgttaaaatataaattaacttgaagaaaataggcatttttataatacacagccctcatatccagacacatgtttttgttcgcctacttccgtctttct

SEQ ID NO: 31045 - DNA, 201 bp, Homo sapiens
ttcttttgagaagtatctgttcatatccgttgcccactttttgatggggttgtttgtttttttcttgtaaatttgtttgagttcactgtagattctggatrttagccctttgtcagatgagtaggttgccaaaattttctcccattctgtaggttgcctgttcactctgatgttcgtttcttttgctgtgcagaagctctt

SEQ ID NO: 31046 - DNA, 201 bp, Homo sapiens
gggaaggcttgagctcttggattacatcatgccaagagacttttttcctagctaatacttgtgtcatgccaagatacatggggttgtgatacatgtggtgwtacgttgtgttcatatgctgttgctattaagttggccaggctgagctgccataactcagttattaggatgattgtagtctcccagggtccgtgggatgtt

SEQ ID NO: 31047 - DNA, 201 bp, Homo sapiens
ggggttgtttgtttttttcttgtaaatttgtttgagttcactgtagattctggatattagccctttgtcagatgagtaggttgccaaaattttctcccatkctgtaggttgcctgttcactctgatgttcgtttcttttgctgtgcagaagctctttagtttaattagatcccatttgtcaattttggcttttgttcccat

SEQ ID NO: 31048 - DNA, 201 bp, Homo sapiens
tatgtactggccattacactcagcaccgggcaagtgatgaagatgattcaaacatggttcttgccctccaagagctcatagtctagtgagtaagataagcrtgtgcttttattttaaagcagtctctgaattattgcacatagatgtggtcacaaagtgctaccagaatgtagaggaagaaaaattcattccaactggcag

SEQ ID NO: 31049 - DNA, 201 bp, Homo sapiens
gggttgtttgtttttttcttgtaaatttgtttgagttcactgtagattctggatattagccctttgtcagatgagtaggttgccaaaattttctcccattytgtaggttgcctgttcactctgatgttcgtttcttttgctgtgcagaagctctttagtttaattagatcccatttgtcaattttggcttttgttcccatt

SEQ ID NO: 31050 - DNA, 201 bp, Homo sapiens
atgtttgtaggaatttatccattttttctagattttctagtttatttgcatagaggtgtttgtagtattctctgatggtagtttgtatttctgtgggatcrgtggtgatatcccctttatcattttttattgcatctatttgattcttctctcttttcttctttattagtcttgctagcagtctatcaattttgttgatct

SEQ ID NO: 31051 - DNA, 201 bp, Homo sapiens
atcagtggtgatatcccctttatcattttttattgcatctatttgattcttctctcttttcttctttattagtcttgctagcagtctatcaattttgttgmtcttttcaaaaaactagctcctggattcattgattttttgaagggttttttgtgtctctatttccttcagttctgccctgatcttagttatttcttgcct

SEQ ID NO: 31052 - DNA, 201 bp, Homo sapiens
cttctctagttcttttaattgtgatgttaggatgtcaattttggatctttcctgctttctcttgtgggcatttagtgctataaatttccctctacacactkctttgaatgtgtcccagagattctggtatgttgtgtctttgttctcattggtttcaaagaacatctttttttctgccttcatttcgttatgtacccagta

SEQ ID NO: 31053 - DNA, 201 bp, Homo sapiens
caattttggatctttcctgctttctcttgtgggcatttagtgctataaatttccctctacacactgctttgaatgtgtcccagagattctggtatgttgtrtctttgttctcattggtttcaaagaacatctttttttctgccttcatttcgttatgtacccagtagtcattcaggagcagattgttcagtttccatgtag

SEQ ID NO: 31054 - DNA, 201 bp, Homo sapiens
ctttagagagaatagtaacatcaatactgattagtgcgaatataaattgaaacaatcacttgagaggataatttagcaagatttattttaaaatttttatktattttattttctttttatttatttatttatttatttttgagacggagtctcgctgtgtcgcccaggctggagtgcagtggtgcaatcttggctcactgc

SEQ ID NO: 31055 - DNA, 201 bp, Homo sapiens
catggtcaaagctacctagcctgggctccagaaaggtcatgacagcctggcccagtgttatgggcataaccaaggtttgggaaaggtcaccttccctgttrctgtcatcagttagcaaataccaggactactctagggaagagagaacggctcaccccatgttaactttatagtgtgtatttgacaggggattgtacagaa

SEQ ID NO: 31056 - DNA, 201 bp, Homo sapiens
tttctttagggatgaggccagttccaccagataaaacaggagccatgtgtttttaatggataaagaaacaaatgaaaagaaaaaagaaagacaccgttgamaagcagacaaattaatccatttacttgacaaatattaatggagtgtctatgaaatgccaagccttgtgttgggatttaacagtgagtcaggcgtggtcct

SEQ ID NO: 31057 - DNA, 201 bp, Homo sapiens
tagggttttgttttctttttctctctctcatttttaaaattaattttcaaatatgtctcacataagggcacagggcttgaagttgcctattttctttaggratgaggccagttccaccagataaaacaggagccatgtgtttttaatggataaagaaacaaatgaaaagaaaaaagaaagacaccgttgacaagcagacaa

SEQ ID NO: 31058 - DNA, 201 bp, Homo sapiens
ctctcccttttgataggaacaactttcaaatcaccatcagtgctcatacaattcaaacgtgtagttgggggcatcaaaacacaaaaccctttcctttataygtaaaatgagcaacacgtctgctgaagattgggaaagcaaagtgaaattgcagatgacctttgaatgccttaatttaaagaatgatctggattgatcttg

SEQ ID NO: 31059 - DNA, 201 bp, Homo sapiens
agccacaggactgtaagggccatgagggggcgccagggatttacaattataaaggtcttgttgggccataataaagtccctctcagctaacaggtgaccayggggcatgtgatggtcttgctttgttcacccatgtgcgtcttgcatattattcatgctatggatgaacatgtgctcctagccatttcaaggttagacatg

SEQ ID NO: 31060 - DNA, 201 bp, Homo sapiens
gccacagatgcttttcccctagacgactacattttcacaggatctttaacactgttatacaatggagggtctaagtggaccctctgcaagtggacagaccraaacagtagcctttatggaacctctagggtcttcctctccctttgcctttgacctggtcttcaggcatatctcccctttcgccctccatctctttttata

SEQ ID NO: 31061 - DNA, 201 bp, Homo sapiens
tcagcagaagccacaggactgtaagggccatgagggggcgccagggatttacaattataaaggtcttgttgggccataataaagtccctctcagctaacargtgaccatggggcatgtgatggtcttgctttgttcacccatgtgcgtcttgcatattattcatgctatggatgaacatgtgctcctagccatttcaaggt

SEQ ID NO: 31062 - DNA, 201 bp, Homo sapiens
ccactgcccctcagcagaagccacaggactgtaagggccatgagggggcgccagggatttacaattataaaggtcttgttgggccataataaagtccctcycagctaacaggtgaccatggggcatgtgatggtcttgctttgttcacccatgtgcgtcttgcatattattcatgctatggatgaacatgtgctcctagcc

SEQ ID NO: 31063 - DNA, 201 bp, Homo sapiens
tcttaaggcagagtccccacatgtgtggtcgagtctttgttttctgacacttggttttctttctttctttttttttttttttccaggaaacttaagatttyatttgcataagccacagtaattaagaaattcaatttggttttgaaatggagattgacatacagaaacacaaccccatacacacattctcacacagtctgt

SEQ ID NO: 31064 - DNA, 201 bp, Homo sapiens
ttctgcctgctggagttatttaagcttgtcctgctcttaaggcagagtccccacatgtgtggtcgagtctttgttttctgacacttggttttctttctttytttttttttttttttccaggaaacttaagatttcatttgcataagccacagtaattaagaaattcaatttggttttgaaatggagattgacatacagaaa

SEQ ID NO: 31065 - DNA, 201 bp, Homo sapiens
ttcctgagatggggacagcaacaggaggagctggaagttaagattcagtttggccctataaaattttagatgtctattagatatccaggtggagaaggcayttaacgtgcacttgaatatgtggtttttgagttcaaggccgtcagggctagagatacaaaattgggagactaggactggatggtgcctaaaacgtaagac

SEQ ID NO: 31066 - DNA, 201 bp, Homo sapiens
tggtatcccatgtaggtatctagggaaagcttctaggctaagggcacaggaaatgtaaagggtacagggccaccgtttggaggatggtcttgctgtggcasagcccactttggccaagccagtcatgttgactaggaagacctgcagttttggaatcctcattctagatcatcccaggtgttgtttttatgctctgctagt

SEQ ID NO: 31067 - DNA, 201 bp, Homo sapiens
ttctggagattctgcttcctaaatatctctcaaataagtcctctcccaccctccacacgaccttagctcgatctcatccagcctcacctggactgtggtgrttttggtgataccaagagcatcccatgcgcttccctgactcagacctcctttataccatagccagtgttctttctaaaatgcaagtttaatcacatttct

SEQ ID NO: 31068 - DNA, 201 bp, Homo sapiens
cttcatccatgtccctgcaaaggacattaactcatccttttttatggctgtgattgctggtttttatagggtggtcagggatggtctttcccaggggaaaragagctatgagcagagagctgaatcatggaatatcatgtatggtgtggtatcccatgtaggtatctagggaaagcttctaggctaagggcacaggaaatg

SEQ ID NO: 31069 - DNA, 201 bp, Homo sapiens
cacttcccagactgggcggctgggcagaggggctcctcacatcccagacgatgggcagccagttagagacgctcctcacttcctagacggggtggcggccrtgcagaggcggcaatgtcagcactttgggaggccaaggcaggcggctgggaggtggaggttgtagcgagctgagatcaggccactgcactccagcctggg

SEQ ID NO: 31070 - DNA, 201 bp, Homo sapiens
tctggagattctgcttcctaaatatctctcaaataagtcctctcccaccctccacacgaccttagctcgatctcatccagcctcacctggactgtggtggytttggtgataccaagagcatcccatgcgcttccctgactcagacctcctttataccatagccagtgttctttctaaaatgcaagtttaatcacatttctt

SEQ ID NO: 31071 - DNA, 201 bp, Homo sapiens
ctcctcacatcccagacgatgggcggccagttagagacgctcctcacttcctagacggggtggcggccgggaagagacgctcctcacttcccagactgggyggctgggcagaggggctcctcacatcccagacgatgggcagccagttagagacgctcctcacttcctagacggggtggcggccatgcagaggcggcaatg

SEQ ID NO: 31072 - DNA, 201 bp, Homo sapiens
attgacttccagctggaggatggttacgactttctggaagtcactgggacagaaggctcctccctctggtaagcacaacatcaccttcctttcctaccctrttctctgcaactgtgaattactgggatgcttgcagtctcctcagtgcctggacctgcagccagaggcctcttagccacttccttatacctactgttagag

SEQ ID NO: 31073 - DNA, 201 bp, Homo sapiens
tgcatatatatttttttatacttgcattgcgtatgtgcatatctatgcatattacaagtccacattgcctttttaaattgaagattgaagaataacttacwgaaaaagtagcacacaaaattatacatatggtgttatctcaccagtgtgaaatatgcatggaaaaaaatctcagaaaaatgaaaatattaacagcagttg

SEQ ID NO: 31074 - DNA, 201 bp, Homo sapiens
gctcctcacttcccagacggggtggcggccgggtagagacgctcctcacctcccagacggggcggccgggcagaggtgctcctcacatcccagacggggcrgccgggcagaggcgctccccacatcccagatgatgggcggccaggcagaaacgctcctcacttcctagacgggatgacggccgggaagaggcgctcctca

SEQ ID NO: 31075 - DNA, 201 bp, Homo sapiens
aaagctggtgattttaagctaggagttgggttgaaggttaaggtgagtcttcactcaactggaatcctgatgatctgcgcagtgtgaagacccttggaccyctgcctcttttgtaaaatacctgtttactgactgtaagtgtaatgcatatgctccttgtagaaaacatggaaaatctacaaaggtatggaaaaattaaaa

SEQ ID NO: 31076 - DNA, 201 bp, Homo sapiens
cagacggggcggctgctgggcggaggggctcctcacttcccagacggggcggccgggcagaggggctcctcacttctcagacggggcagccgggcagaggygctcctcagttcccagacggggtcgcggccgggcagaggcgctcctcacttcccagacggggtggcggccgggtagagacgctcctcacctcccagacgg

SEQ ID NO: 31077 - DNA, 201 bp, Homo sapiens
gctccttgtagaaaacatggaaaatctacaaaggtatggaaaaattaaaattattacaattttgatgtactcccctttgaccttttttcttggcctagatyaagctagctggctatttatatatatttaatatgaccaaattaggatctaaaaatatctgtagttatatatttttagctaattattgtgtcatgaaatgtt

SEQ ID NO: 31078 - DNA, 201 bp, Homo sapiens
cccagacggggcggctgctgggcggggtcgccccccacctcccagacggggcggctgctgggcggaggggctcctcacttcccagacggggcggccgggcrgaggggctcctcacttctcagacggggcagccgggcagaggcgctcctcagttcccagacggggtcgcggccgggcagaggcgctcctcacttcccagac

SEQ ID NO: 31079 - DNA, 201 bp, Homo sapiens
tgggattcaaccccaggttaatctgatactaaaggctgtcttccaagccatgacagcatgctattatgacatgcgatatctgtgatgagttttccgggctrtgtagcattcccttgtaagactgtagcatagtttactcatcagacctcttgttaggtggttcccaagttttcacttctataaacaggtgccaagacgaat

SEQ ID NO: 31080 - DNA, 201 bp, Homo sapiens
aaaatgaacctaattttgattttgagaaatctattgaatgttccactcataattaatttacaacaatgaacaaaataagggaaaaaatcatcacttaaaasacagatatatagggttgaacagagagtgacaaagagcgagagctagaagattctttgggggcccctctttcctacatctcagcctctctggttctatcag

SEQ ID NO: 31081 - DNA, 201 bp, Homo sapiens
gttctcttgcattctgtgccaaggcatagaaaaacaacagatcctgttagcaaagatggatttggacaactgggcacccccttcacctatcaagaagacargaattcctttgagagaaaaaaaaaatccactacctcccttaccagataacaagttcccactgattcagaagggagagtggcatgcaatgtccctgactca

SEQ ID NO: 31082 - DNA, 201 bp, Homo sapiens
cctgatgggaagcccgtgtggaacaatccccggccagtctgcacaggtggtggaagcctggggatggcaggggtctgaggaactgagggcatgccaggggyagagggtgctgtgggctggggaagggaggggggcaaggtcctcaagcccggctcctccaagcctggcaaacctgggtttgccgtggatgtgtatagaagt

SEQ ID NO: 31083 - DNA, 201 bp, Homo sapiens
ttgtgggaagactaaatccttctccctgaattcttcttcccaactagcctaccacttggtatcaatcgtatggccatggagatgaaacaagttacttgatrgaagagaagaaatcaaaacatatggagggtgcttgtccagagagcataaatgactcttcattataataagggaaccaaagtctcaaattaaaaataaaag

SEQ ID NO: 31084 - DNA, 201 bp, Homo sapiens
gatgggggcagcctaggcctaagctttaattcgtactgatggcaacagagaggttcttaaggttttctttttatttcctttttttaaaaattaatctttcraattattatgtattctcatgagagtcacccagaagaccataggttctgtgtttgcctgtgccttggtggtaaggaacttacttttataatgtgggctcct

SEQ ID NO: 31085 - DNA, 201 bp, Homo sapiens
atcctttgggtatatacccagtaatgggatggctgggtcaaatggtatttctagttctagatccctggactctcatgatttttaaaagaccttgccatccractctcataatttttagaagaccttgtcatcctctttagtttgtcttgtgttccttgctccatctgtcaccctgcttctacctaccatgctggcctccct

SEQ ID NO: 31086 - DNA, 201 bp, Homo sapiens
aagccagggtgttataagtggatgaatgaatgaattacaatgtacaacaaagtgcaggaattgaagcgcaaggaaacccccacgtaactccttagatgggstccaaaaaaacccaatcatgtaaaatgtgggcttgtgagattgcaacattaacaaaatgaacagagggagcctgcctatttcatgggccaggagattcag

SEQ ID NO: 31087 - DNA, 201 bp, Homo sapiens
cctcccttctgtccctcacatgcaccaagctcattcccaccccagggcctttgcccttgtaattctttccccctgcagtgaaccttccttagaatgattgrttccttatcatcagaccacagtccaaaggccacctcctcagacaggccattcctgctgccttattaaaagcagcccacctctatgccattcattcctttt

SEQ ID NO: 31088 - DNA, 201 bp, Homo sapiens
ggccattcctgctgccttattaaaagcagcccacctctatgccattcattccttttttcgtcacctcttagaatgtaaacttcagaggggctaaggacttkcttatccatcttggtggctgctgatcccatacctagaatagggacagacacatagcaggtgctccgtcactccatcaatacttgagctaggtggagacat

SEQ ID NO: 31089 - DNA, 201 bp, Homo sapiens
tttagcccaggagttcaggactacagtgagctaggattgcaccactgcactgcagcctagagacagtgagacccctttctctaaaaaattgtttaaagaawaaataacttgggcacaatttatggtttttggactggattatatcaaatatgaatctaggaggacatacatgtgctcaggaaatgtgcagccagtattgcc

SEQ ID NO: 31090 - DNA, 201 bp, Homo sapiens
ttatttgtcttattagtgagttataagattacatatatatgtgtgttttatttctatataattcatatatattaatatactataatttgtttatgcatccatatatatatatatatatatatatatatatatgtatatatatggagagagagagagatttttacctgtcccaaagccatgaaggttttctcttgttttctt

SEQ ID NO: 31091 - DNA, 201 bp, Homo sapiens
attgtcttggatgttagcacttggctccctttcagtaatgctaatctctctagcaagtggttgctctacagactgcttagattctttctttaccacagggycaggttgcaaattttccaaacttttgtgcttttcttctctttcaaatgtaagtcccaactttaagtcatctctttgctcctgttctgatcatgagctgtt

SEQ ID NO: 31092 - DNA, 201 bp, Homo sapiens
tatttgtcttattagtgagttataagattacatatatatgtgtgttttatttctatataattcatatatattaatatactataatttgtttatgcatccawatatatatatatatatatatatatatatatgtatatatatggagagagagagagatttttacctgtcccaaagccatgaaggttttctcttgttttcttc

SEQ ID NO: 31093 - DNA, 201 bp, Homo sapiens
aaaagccctaggatatggacttaatgcagccaagttatttgctagggagtagcaagggtgacctctacaccaattccccataagttcctcatttccatctragacctgttagcctggccttcactgtccctatttctatcagcattttggtgacaaccttttaaacagtctctaagaaattacaaactctccctcattttc

SEQ ID NO: 31094 - DNA, 201 bp, Homo sapiens
actcaaaaatgctgaaataaccaccctactttccattttaacatcctctaatgacagtgctcagcaataaaaaagaatgaactactgatacatgcaacaaygtggatgagtcccaaaaatattatgctgagtgaaagaagacagacataaaaaagtacataatgtatgattcaactcctataaaattgtaggatcagcaaa

SEQ ID NO: 31095 - DNA, 201 bp, Homo sapiens
agaaggcaaaacggagccagcgtatcatatggtaaaagtaggagcaaggtagggtgggggcaccacactcttaagaaaccagatttcatgtgaactaccaraacaaaaattcactcatcaccaaggggatggcgctaagccattcaagagggatctgcccccatgagtcccaccaggcccaacctcaaacattggggatta

SEQ ID NO: 31096 - DNA, 201 bp, Homo sapiens
aaaagaaaaaaacccattaccttgacctttgctccacttttgctttgactgtacacttccattccctggtagccattgctttgattgtgctttgtcttccrgattgtactggtaaatccatgttccatctcctgttcttgggagaaatgtttcaggatcttgatcccacattttttaaatttccactgaaagctctgcttt

SEQ ID NO: 31097 - DNA, 201 bp, Homo sapiens
tatgttttttcacctctttattaaccaactttatttattctttgttggttgcctcttaatttccttggccaatatttctatgttgagtgtacatctttctrtcaaattccaattcttcatagatgaaggatagtaaatatttaaatgtagtaacttgcacatattttctctccatttgtctctcattattcagcttttgtt

SEQ ID NO: 31098 - DNA, 201 bp, Homo sapiens
agctgatctaggcacaatggttttgacacccatcaagtagaaagtttgatcaaccttaattttttagtcaaaattgtgtaatctgaaccagtcgagatgtmtatggtgttggctttcgttagtgctattaatcattggtcctattcaattaggacacaaacaagattaatttttttcctctccaactgatgtggaggtccg

SEQ ID NO: 31099 - DNA, 201 bp, Homo sapiens
tctaggcacaatggttttgacacccatcaagtagaaagtttgatcaaccttaattttttagtcaaaattgtgtaatctgaaccagtcgagatgtctatggkgttggctttcgttagtgctattaatcattggtcctattcaattaggacacaaacaagattaatttttttcctctccaactgatgtggaggtccgccttgg

SEQ ID NO: 31100 - DNA, 201 bp, Homo sapiens
aggcacaatggttttgacacccatcaagtagaaagtttgatcaaccttaattttttagtcaaaattgtgtaatctgaaccagtcgagatgtctatggtgtkggctttcgttagtgctattaatcattggtcctattcaattaggacacaaacaagattaatttttttcctctccaactgatgtggaggtccgccttggcag

SEQ ID NO: 31101 - DNA, 201 bp, Homo sapiens
aatagagtcagcaaataaatacatagcagcactacctggtcctgatagttatcagtgtaatgtcaattaagacaatgaaatggcactttatccctattaarttaggctgaagaacttcggtgggtatgatgcagtgctggagtggtggcaaagacacagacacactcgcacatggctggtgctgatgtaaattagtccttt

SEQ ID NO: 31102 - DNA, 201 bp, Homo sapiens
gacacccatcaagtagaaagtttgatcaaccttaattttttagtcaaaattgtgtaatctgaaccagtcgagatgtctatggtgttggctttcgttagtgmtattaatcattggtcctattcaattaggacacaaacaagattaatttttttcctctccaactgatgtggaggtccgccttggcaggcttcatcttcatta

SEQ ID NO: 31103 - DNA, 201 bp, Homo sapiens
agaaagtttgatcaaccttaattttttagtcaaaattgtgtaatctgaaccagtcgagatgtctatggtgttggctttcgttagtgctattaatcattggkcctattcaattaggacacaaacaagattaatttttttcctctccaactgatgtggaggtccgccttggcaggcttcatcttcattatcatcccctccctt

SEQ ID NO: 31104 - DNA, 201 bp, Homo sapiens
aggtgagatcaaggttggcctagaattgcagtcaagaaggcttcactgctggtgggctggcagaatctggagtcaagaccagaggctcaaggctggactcyttggattaggaaactccctggaagttcagggagccatgtaggtttcctgtcctgtaagatttgggtcttgcatcatttcttacgggaagtgatctctgac

SEQ ID NO: 31105 - DNA, 201 bp, Homo sapiens
aatcattggtcctattcaattaggacacaaacaagattaatttttttcctctccaactgatgtggaggtccgccttggcaggcttcatcttcattatcatsccctcccttcgtgaaacaagttatccatttgtaaactgctgatttctttgggtcattgtccccataaactttttgtaaagcatcagtgatgtcaccattc

SEQ ID NO: 31106 - DNA, 201 bp, Homo sapiens
tcccccactgcccctcagcagaagccacaggactgtaagggccatgagggggcgccagggatttacaattataaaggtcttgttgggccataataaagtcyctctcagctaacaggtgaccatggggcatgtgatggtcttgctttgttcacccatgtgcgtcttgcatattattcatgctatggatgaacatgtgctcct

SEQ ID NO: 31107 - DNA, 201 bp, Homo sapiens
taacacacatattggtctattttatggggtcctctaagttccttaggctttattcacttttgttcattcttttttctatttgttcctctgacttaataatytcaaatgacctgtttttgagttcactgattcttttttctgcttaagtctgttattgaacccctccagtaaaattttaaattcagttattatagtcttcag

SEQ ID NO: 31108 - DNA, 201 bp, Homo sapiens
ctttgtgcagtggaaagtgcctggcttcagagtgttgtgaggtgaactgggtggaggcattaagcatctggcatcatggctgactcagggtggctgttccrtccatagagtaccctcttcatttgccttattagggacactcaaagatgaaaagtgtgcagtcatctgagtttgctcttgtagaaggggccaggaagctcc

SEQ ID NO: 31109 - DNA, 201 bp, Homo sapiens
aaagctttcagtttttcaccattcagcataatgttagctatgggccttttatatatggtctttactatattgaggtaatttctttctattcctagtttgtygagtgtttcttcttttttattttgagacagagtctcactctgtcgactgggctaaagtgcaatggcatgatcttggctcactgcaaccttcgcctcctgg

SEQ ID NO: 31110 - DNA, 201 bp, Homo sapiens
cttaatgcacgaaatagggagatgggggtagcggagagcgaagagtaactgcctgcagactagaggaggctccttagaggagatgaactgagcctgggacygtgagttagatttgctaggttgagaaggttgcagtggaagggcgtatgaggcaaagggccaagcactgcaggtgacaaattagtggtgtgactgaggcac

SEQ ID NO: 31111 - DNA, 201 bp, Homo sapiens
gatcgattttcagtatattttaaaaactatatttcaatctagctgatttcctttgcaattctatgtattttgttttacatattttaagacaccatttgagrtggtgtcacgaggctccaaggagggcatggcacgacaaagatggaggacttcaggtcatggaggtccagggataggcttttttggcctgctaatcccctg

SEQ ID NO: 31112 - DNA, 201 bp, Homo sapiens
tgtatcaggcccactgctagatcttattaataatgcattaataaaggagcacttattagtgtatgatcgattttcagtatattttaaaaactatatttcartctagctgatttcctttgcaattctatgtattttgttttacatattttaagacaccatttgaggtggtgtcacgaggctccaaggagggcatggcacgac

SEQ ID NO: 31113 - DNA, 201 bp, Homo sapiens
gtattagcagtacctgtgaatttgtcactggtaagatcacagatatttccatagaacattacagttgttacaattatcttgaagtagcatttatgcttcaractacaatatgtatcaggcccactgctagatcttattaataatgcattaataaaggagcacttattagtgtatgatcgattttcagtatattttaaaaac

SEQ ID NO: 31114 - DNA, 201 bp, Homo sapiens
aatccactgtgaactccttgagggcatggaccatattatatgcaatctgcccctcccatctcccccaactccctactgcccattaacacccccacctatamaccctggaactaagccatccattccccagatttgctgactgaaagactgaatttgtcttggacctctggggttcttgatagaatccatggggtccctaac

SEQ ID NO: 31115 - DNA, 201 bp, Homo sapiens
tgctaagctcttttcaataaatcccaggctctgacccctggtgctgggtgcagagtggaaccagaactatagctttgagagtatgtcctgagatgatgtgwgtgaaatatttgcagcctggcagagggaagggtggtagggttgagagcctgggttttgcttttgtacagatctgggtttgaatctcagcttttccattgc

SEQ ID NO: 31116 - DNA, 201 bp, Homo sapiens
ggtggtgcttctttaaagaatcccaggtggaagagaggaagccatgggttctgtggttaggaagcagcaaggagagttctgttctgacagcctctctgtgrcccctctggtgcaatgatggatgtctttgcagccccagctagtctaggttggaggaaaggggccaaggagagctctgactggatgtgggttgggaatcct

SEQ ID NO: 31117 - DNA, 201 bp, Homo sapiens
gtgaaccttctggattcccagtagatgtccagtctgaagctgtcagaggaatgagggggttgggctgctatggagaaacaagaggatgcatccaacagctsgtgaccacatgtcatgccctccttgatgctggccctcatgctttctgatttcaagtcttaccacccctcatctctagagagttagcctcccacctgtcct

SEQ ID NO: 31118 - DNA, 201 bp, Homo sapiens
cttgggcaggggcagcagagcctggcccagagcagggctcccaccctgggggaggttaaggagataacaaggctagttatgcagtctgttaggacagcccyggcaagggatagagtaaccttccaggtgtgcagcctcaccaatagttataaaccccagcctcaaggcaggaccctccagccaggttcagagcctcctcct

SEQ ID NO: 31119 - DNA, 201 bp, Homo sapiens
gcagatgacctttgaatgccttaatttaaagaatgatctggattgatcttgccctggatctgctgccactgtcttcatgagtgaaccttctggattcccartagatgtccagtctgaagctgtcagaggaatgagggggttgggctgctatggagaaacaagaggatgcatccaacagctggtgaccacatgtcatgccct

SEQ ID NO: 31120 - DNA, 201 bp, Homo sapiens
agtttcctctcctgtccaatgggcacagtatccacctcagtgctattatgagcattaaatgagaaaggattaagtgtgaagtttgtcatagaagtggtccrtaagcgatggtgcttatgctgaaggaggaagtgaggaggatgaggattcacaggacaccctacgggaactcaagtgcaccacacgttgaatccctgtctt

SEQ ID NO: 31121 - DNA, 201 bp, Homo sapiens
gtggcgccatctcggttcactgcaacctccgcctcctgggttcacccgattctcctgcctcagcctcccgagtagctgggattacaggcgcacaccaccaygcccggctaattttttgtgtatttttagtagagacggggtttcactatgttggccagactggtcttgaactcctgacctcgtgatccgcccgccttggcc

SEQ ID NO: 31122 - DNA, 201 bp, Homo sapiens
cttgcatttcagtttgcagctgggtaggactattcacgaatgattcttattaggctgtacgggaggtctttagaattcaaagcaacagaccgctccctggmtcaacaagagcagtgtaggtctaagggatgccgcctgcctggcagagccagggtgcatcccatgttctggctcctggggccatctgccctccccagccac

SEQ ID NO: 31123 - DNA, 201 bp, Homo sapiens
tcttgcatttcagtttgcagctgggtaggactattcacgaatgattcttattaggctgtacgggaggtctttagaattcaaagcaacagaccgctccctgkctcaacaagagcagtgtaggtctaagggatgccgcctgcctggcagagccagggtgcatcccatgttctggctcctggggccatctgccctccccagcca

SEQ ID NO: 31124 - DNA, 201 bp, Homo sapiens
ggagacacacatccccttgggtctgatcaacaacatccagccaatgtaggaagaacatgcaggaggctgcatggaggtttttatgggctaagcctggccayggcctgtatcacttttgcccatggtccacctaactgcagggaggtctaggaaaggttgtctagctgtgtgccccaagaagggaagatggaattttggtgg

SEQ ID NO: 31125 - DNA, 201 bp, Homo sapiens
tttgttggttgcctcttaatttccttggccaatatttctatgttgagtgtacatctttctgtcaaattccaattcttcatagatgaaggatagtaaatatytaaatgtagtaacttgcacatattttctctccatttgtctctcattattcagcttttgtttatggtgatttttgaaatctaaaatcttccatttctgtag

SEQ ID NO: 31126 - DNA, 201 bp, Homo sapiens
ttggcacaggttgaggctgcaggacagacagactgtgcgaggattcaggggcatgtgagagaagctggttctggctgtgtagcagagaatgggtaggccayggctctgcaaatttaaattcatttattgctcatgtatctgtcctgggcaggtgtttaatatggtggggagctctactccacctggaaattcagggataaa

SEQ ID NO: 31127 - DNA, 201 bp, Homo sapiens
ttttgttgtttttgttgtgtaggtcatgttggcttattgttgtagggctgaatttgattttctagcactttgcatgaaggattttctatactgtaggtgtrtcattgtgttggtggatatgattgtgtgtgtatcatacatatcattgttatgggagtattgtatcaaaatcaatttaaatagcatggctattacaagttt

SEQ ID NO: 31128 - DNA, 201 bp, Homo sapiens
tgctcagcctcctgcgtggaagctgacaccgcgtttgcttggcgacaagtcacaacaaagctcggcacactcccaccccgccccactcaggcggcgcctcktgggggaaaataagataaaacaaaatcaagctgagctcctaattcacattccatctctggcagctccttgatgatgaataattctggaattggaaatgag

SEQ ID NO: 31129 - DNA, 201 bp, Homo sapiens
ttggtctgagcaagagggtagatagagattccatcttcagagcaactctaagctgtgatgttttctgcactgcataacttaaaaagcagacacacaatggyctgacacctgctacagcatggatggctctcaaggacattatgcgaagtgaaggatgccagtcacaaaaggataaaaacgatatgattccacttatatgca

SEQ ID NO: 31130 - DNA, 201 bp, Homo sapiens
ttttcttattgatgtctagtttatttgtactgtgaacagaaaatgtggcccaacagtttttgcattgtgatagaatttatggggattttcttatagcctamtgtaaggtcaattttgtaatagtccatgggcacctgtaaagaagtttgcattccttgtttgaagactacagagtttcatataatatacacactcataata

SEQ ID NO: 31131 - DNA, 201 bp, Homo sapiens
gggataaattacattcatgaactctaatattcaatttgctcaactaagtttttaaaatggatttttctctcataccagggtcagaatagctaagggttagsacatttgtgggtgctaggcgtggggcaatagcagaccctgaggagagctggagcactggcttgggatgaaggcacaaagctagggtccttcatggtaaca

SEQ ID NO: 31132 - DNA, 201 bp, Homo sapiens
ctctaatattcaatttgctcaactaagtttttaaaatggatttttctctcataccagggtcagaatagctaagggttaggacatttgtgggtgctaggcgtggggcaatagcagaccctgaggagagctggagcactggcttgggatgaaggcacaaagctagggtccttcatggtaacaggtcccttcctccctgagaat

SEQ ID NO: 31133 - DNA, 201 bp, Homo sapiens
agacatccccgcccggggttgcggggcacctggtctgtggcttcagtttctccagcctcccagcccccacggtgctaggctttttcccgataaactttccrggagccctactcccccggctcctgattctgccaggcacgctggtcctgggggctggagaggaaccgtgcgccccctccccatttctgcgtctgcaaggtc

SEQ ID NO: 31134 - DNA, 201 bp, Homo sapiens
ggggtcttcaacaagccccttttattttctactcaagctcatgttaaataataacctaatataatgcacagtaattacacatctacctgttaataagtttyccacctttattatttgtcaacagtctgacgcttctgacttaaaagtttagtcgacatcaagatccatgagcacagtctggtcactactctgaaggaggaa

SEQ ID NO: 31135 - DNA, 201 bp, Homo sapiens
gtattatctcttggaacatcatctacaaattgttgctagtaataattatgttgcaggaggttaagattaaaagatattttatacatgcatattttatatatgtgtgtgtgtgtgtgtgtgtgtgtgtgtgtgtgtgtgtgtgtgtgtataatgctccatatgtactaaacactctacagatgctctgggaatgatagattt

SEQ ID NO: 31136 - DNA, 201 bp, Homo sapiens
acacatctacctgttaataagtttcccacctttattatttgtcaacagtctgacgcttctgacttaaaagtttagtcgacatcaagatccatgagcacagyctggtcactactctgaaggaggaaggtgcctgatctccttcttttaacctgggtgattgagggtgatgagatccaattacaactttttaaaaatccctca

SEQ ID NO: 31137 - DNA, 201 bp, Homo sapiens
tattatctcttggaacatcatctacaaattgttgctagtaataattatgttgcaggaggttaagattaaaagatattttatacatgcatattttatatatgtgtgtgtgtgtgtgtgtgtgtgtgtgtgtgtgtgtgtgtgtgtgtataatgctccatatgtactaaacactctacagatgctctgggaatgatagatttt

SEQ ID NO: 31138 - DNA, 201 bp, Homo sapiens
atatatatatatatatgtatatatatggagagagagagagatttttacctgtcccaaagccatgaaggttttctcttgttttcttctggaagtgttatagwtctagcttgtatatacactcagttgtatgattccttttgtgttaatatttgtgtatggggtgaagtgagagttgaggttcattttttccctgtgtgaata

SEQ ID NO: 31139 - DNA, 201 bp, Homo sapiens
tgctgtgaaggcctctctgagcaggatccatttagacagagccctaaaggttaagtagaagccctctgtgccagagtgggggccaggggcgtttcagaggraagagtttgaagtgtgtgttagagaatctgaaagaacacaggaaagaccaaagtgaatcgatttttaatggaaggtcctaaaaagcatgtattttctctt

SEQ ID NO: 31140 - DNA, 201 bp, Homo sapiens
gtgtgtgttagagaatctgaaagaacacaggaaagaccaaagtgaatcgatttttaatggaaggtcctaaaaagcatgtattttctctttcaagcccttgraagtaacactgtgggcctggaagctacggccacacctgctaccacccctattcccaccacctgctgctgttatgggtcattcttcttaaatgcaaattag

SEQ ID NO: 31141 - DNA, 201 bp, Homo sapiens
aattggtgaaggaagacatgggaaatgatagacttgggctgaagtttctattgtgatggcaaaccatgaatctgtcgtgataccacagttctcctggtagycccccagcccccaggattagagatggaaaaggtgagtggtagaattgatggaaagcaggcatttcaccaagcagatatgagagcgatgaggaagatgtag

SEQ ID NO: 31142 - DNA, 201 bp, Homo sapiens
ctgggtctgtgaaacaaatgaacttcatccagctgcttcagaaagaattaaacaggtcccaggatgctcatcacctgaaagaactgaagcatgcacctggaaaaaaaaaaaaaaaaaaaaaaaagacccaggacagctagaagcagaccctgcagggtaaagggtaggacagggacctctgagactccttccagcagatat

SEQ ID NO: 31143 - DNA, 201 bp, Homo sapiens
tgaggcaggagaatggtgtgaacccgggaggcggagcttgcagtgagccaagatcgtgccactgcactccagcccgggcgaccgaacaagactctgtctcaaaaaaaaaaaaaaaaaccatcacaaaattatctgcaacttggaaacaatctgcatgttcatgagttggggagtgaactgtatggttggataattcataaa

SEQ ID NO: 31144 - DNA, 201 bp, Homo sapiens
catttctgcggtcttcgtttcctcatttgtagaaacaagatcatgatagtactatacctacttcgactctcaggggagggggttgaaggagataatactakccctaggtctgtgccaggtgccttgcatggattatctgcctgggtccacatagcaaccctaaggggtagttatattattatcctctttatagatgaagaa

SEQ ID NO: 31145 - DNA, 201 bp, Homo sapiens
ccttactctactacttcctagttgtatgaccttggacaacttacttggtctcttactgtttagggaaaagctctcttaagccatgttgttgtttttttttyctgctctcacacagccaccaccaacacaacaacaatcatcaatacagaggaagacttctgtgaccaaaagtgtgggttttttttctccacacattaagca

SEQ ID NO: 31146 - DNA, 201 bp, Homo sapiens
tgccaatttgcattaatttaaatactgccaatagtatttgaaagttctttgtaacgctacattttcgagtacatcagaatcacctggagatcttgttaaamtacagattgcttggcccaggagtttctgattcagtgaatctgtgatcaaataggtctgcagtagagtagatttgggatgagatctgagtatttgaatttc

SEQ ID NO: 31147 - DNA, 201 bp, Homo sapiens
tgtgtgagatttcaacatgagggcagatgtctatagaatggatttgttgcctcaaaggatatatgcatttgataaacttgccaatttgcattaatttaaayactgccaatagtatttgaaagttctttgtaacgctacattttcgagtacatcagaatcacctggagatcttgttaaactacagattgcttggcccaggag

SEQ ID NO: 31148 - DNA, 201 bp, Homo sapiens
tggaataaaccaggttttggctgtcaggaatcttattacagaaggaatctgggtggatggccagactttgtgtgagattccctaatcggtggacttgggamatttatgcacttgtgtgtgtgtgtgtgtgtgtgtgtgtacacttgggagagggaggatctgtggatctactgaatgtcttctaaaagggatctattcatt

SEQ ID NO: 31149 - DNA, 201 bp, Homo sapiens
tggaccactcgcatcatgccctggtggtgttgcctccattgcttctgccttgggtcagggattcctgatccacagccctgctctgagctggagtagattcygtgaacctccctgggtcagatggtgctccaggaaggcagagagggcatcccacatcctgctgagatagtgctgcaatggtgggttggagccagcggagaa

SEQ ID NO: 31150 - DNA, 201 bp, Homo sapiens
aggcatagattggagattgggagagacccaggcttaaatcctgtccctgcttggtactagcctgtgtaaggggcatagtaatctctttaggcctcagttcyccatctctaaaacaggaacagtagtgcctcattcacaaaacctttgtaacaatgcagtgagatgatatacatgatgcatttacctaggcctggcctggta

SEQ ID NO: 31151 - DNA, 201 bp, Homo sapiens
tattcctgtgttggtttgctaaggataatgacttctagcttaagatggagatcttaatatatatgcttcattcatgttcctgcaagagacatgatcttggktttttttttatggctggatagcattccatggtgtatatgtaccatattttctttatccagcctactatcgatggacatttaggttgattccatgtttttg

SEQ ID NO: 31152 - DNA, 201 bp, Homo sapiens
atcccagccccacgtgaaaaacttataagtcaccctgggaggagggtatgaaatctttgcttaggacctcagagaaaagtgttgttctctgttctatattytcagaggcatagattggagattgggagagacccaggcttaaatcctgtccctgcttggtactagcctgtgtaaggggcatagtaatctctttaggcctca

SEQ ID NO: 31153 - DNA, 201 bp, Homo sapiens
gatcctcaatgatatagtggtaaaaaaggcagaccatgctctgtgtccccaaggaactcagtctggtggggagatggttatggaagtcatgggcaagtggcattcaggatccttccttcccagattttcattgtgggctgggtttctgggtctgtgtgctaccagacagagccacaccaactggtttggtttcctaggcct

SEQ ID NO: 31154 - DNA, 201 bp, Homo sapiens
gatgggacttaaaaggtggagcaggtagttttcaggggaggaaaggagtgggacgtatcccaggaagagcctccaaacctcaaaaggccctatattcacargaggaaatgagaagttctgtgtgttcgagtgttccttgtgtgtgtgtggtggctggggctgcaggaagtgaggctggagggggacaggttgtagaggagg

SEQ ID NO: 31155 - DNA, 201 bp, Homo sapiens
ggctggagtgcctatagatagagctgtctgctgcagtgtggaggcggttggacagcaggtagttatataggctggggctgcagctgacaagactggggaakcccagggtgagcaaaggccattaagggcagaactgggcatctggggaaatggccatggcaatgtcttctaaacagaagtctgaggtcactgggctgggtt

SEQ ID NO: 31156 - DNA, 201 bp, Homo sapiens
agtagagcttagctcacaatggtggggttgaagctgggtcctaccttcccatccatgtccttctttttctcctttctcccgtccaagtactaacaaggccygaacctgcttagcttccgagatcagacaagatcaggcacgttcagggtggtatggccgtagatctctttttctcctttctataaattccttgctttccta

SEQ ID NO: 31157 - DNA, 201 bp, Homo sapiens
ctttgttcacccatgtgcgtcttgcatattattcatgctatggatgaacatgtgctcctagccatttcaaggttagacatgttttgagaggatgttgcatmtgtgacaactgtcaggagtcacaggtcctgggtcgctgctctgccacccatgtgtgacacctctggctctctcaactcatgcgttttaagacccacactt

SEQ ID NO: 31158 - DNA, 201 bp, Homo sapiens
aatgctgtcaaatccgccatcacatttgagtgtcacaacattccagtgtgattgtggcaaggatggtcatccccactgtatccttaggaagactaaggttwacagagttccatgcagcctgtcctgagtaaatgcagaagccagaactcggatccagggtcttctgactctgaatcagccaccgtgtccacaacagagtgt

SEQ ID NO: 31159 - DNA, 201 bp, Homo sapiens
cactttgagcttgcctggggtactgtaacttcttaactggtttctagagttctcataaaggcttttttggactgtgtattgttgttaagtcagtgtttctrtggggcagaatgtctggggcttcctattctgccatctagctgatgtcactcccaagcccctggcacctcctccaggcacctttcccccactgcccctcag

SEQ ID NO: 31160 - DNA, 201 bp, Homo sapiens
ggttgacatgaaacaatttttcttatgcatttcaatatggtggcttttcactttgagcttgcctggggtactgtaacttcttaactggtttctagagttctcataaaggcttttttggactgtgtattgttgttaagtcagtgtttctgtggggcagaatgtctggggcttcctattctgccatctagctgatgtcactcc

SEQ ID NO: 31161 - DNA, 201 bp, Homo sapiens
gtggaatcagggagctcagttagacctttggagacaccgggtgaaggagactggggcttgggccacggaggtagcacaggagccaaagaggagtgcttggrttaaggtatgctcagcagggctgactgatggtgtgggtgtgggggtggaacatagagaggattctggaatattcctaagattttggtctgagcaagaggg

SEQ ID NO: 31162 - DNA, 201 bp, Homo sapiens
gttctgggggctttccttgggatatatattctctgagcttgcatgtgtactttcttaattaaagaggtttactgggtcttgtttgtttttccttcaagggyttgtaatttcttgctccctctggtgtctgattatggtactcaggttctctggtgttgcaaaaagccagtgaactgtcttttgttctccatggcccccagg

SEQ ID NO: 31163 - DNA, 201 bp, Homo sapiens
tagctgctgtgtgaagagtggctgtgggggcaagagtggaatcagggagctcagttagacctttggagacaccgggtgaaggagactggggcttgggccayggaggtagcacaggagccaaagaggagtgcttgggttaaggtatgctcagcagggctgactgatggtgtgggtgtgggggtggaacatagagaggattct

SEQ ID NO: 31164 - DNA, 201 bp, Homo sapiens
ctcccactggcttatccttccagctccagccctgcctgcccttcctagaccttctcatgtcagcaatcttagtgtctttggccaacctgggagtgggatargattgtgtagaactcattgacattaagcctgaacacacagacctataaggcatgaaacttgttcactcacagcccctttgatgaattccagctcctttga

SEQ ID NO: 31165 - DNA, 201 bp, Homo sapiens
tttctttctgctgcataaaaaaaatcaccacacacatagcagcttaaaccacatttactaccgcacagtttccatgggtcagaagtccaggcatggctgarctaagttctctactaagggtctcacaaagctgtcatccaggggcagctaaggctgaggttttatcagagacctgagggcctctctcaagttcacatgatt

SEQ ID NO: 31166 - DNA, 201 bp, Homo sapiens
ggccttgtgtgggcagaggggtatcatatccacaagcatgaacatctcttaaacactaactgtttcagctttctttctgctgcataaaaaaaatcaccacrcacatagcagcttaaaccacatttactaccgcacagtttccatgggtcagaagtccaggcatggctgaactaagttctctactaagggtctcacaaagct

SEQ ID NO: 31167 - DNA, 201 bp, Homo sapiens
aataggcagctacaacacagcatggcgagggccttgtgtgggcagaggggtatcatatccacaagcatgaacatctcttaaacactaactgtttcagcttkctttctgctgcataaaaaaaatcaccacacacatagcagcttaaaccacatttactaccgcacagtttccatgggtcagaagtccaggcatggctgaact

SEQ ID NO: 31168 - DNA, 201 bp, Homo sapiens
caaaccctggctgcaatttgggatcacctggggaactttttaaaatcggtgatgccctgagcccagtccaccaattaaataggaatatttgagacttataytgataaattacagcactcttctaatgtaaagcctgagctatcttggcccattcctttacttttgagtattcagagtcactttgtcttagctgtgtgtttt

SEQ ID NO: 31169 - DNA, 201 bp, Homo sapiens
ggtcagagaggtacagtgtagttctcaaagtcacacagctaaggtggatgcccaggcctatctgattccagaaccgtgcttggaaccacaccatgacattrccactccctcccagatgtcactgagatactggcctcctttgccttccaagcaggacagggcatgcaaggccagaagactcctgtcccagtgagcgcagct

SEQ ID NO: 31170 - DNA, 201 bp, Homo sapiens
gtgtgctctgtggctaattaaagtcgggttctcctcatgggcactggagcccaagaatagcctcctcatgagccctctgtgtgtgtgcacgtgtttgtatytctttttcccagaaaacccgcgggagtcatgttttgatcctggttccatcaagaacggcacacgggtggggtccgacctgaagctgggctcctccgtcac

SEQ ID NO: 31171 - DNA, 201 bp, Homo sapiens
caatttgggatcacctggggaactttttaaaatcggtgatgccctgagcccagtccaccaattaaataggaatatttgagacttatattgataaattacarcactcttctaatgtaaagcctgagctatcttggcccattcctttacttttgagtattcagagtcactttgtcttagctgtgtgttttgtcccaaagagag

SEQ ID NO: 31172 - DNA, 201 bp, Homo sapiens
aaatatttgttgttaaaataaagtgtgtacactttaaatatatgccaattataacctcaacaaggctgtaagagagcccatgctgagacctcatccaagaycaaataaatcggaatctttgggagtagaacccagacatctgtattttaaagttcctcagagattccaatgggctgtcaaggtgcagaagagcagatgcag

SEQ ID NO: 31173 - DNA, 201 bp, Homo sapiens
attatcactgtcactgtttcctttgtagacctgaagaactgagaattaattctccaggcaggtgatcggcagctagtgcaaatgtcagggacatactcgttggcccatttgttcactcacttattcattcagcaaacatttactcaaacaccctctctgtgccaggccctgtgcaagacacctgcgatcagaggtttgccg

SEQ ID NO: 31174 - DNA, 201 bp, Homo sapiens
ttgagtattcagagtcactttgtcttagctgtgtgttttgtcccaaagagagggttgtatattactgggagattaacctgtatacatttattgtcataacygatgttttatcttttttaaagcatcttacgttacaacccccctaccccatgcttccttgttgtttcctttgaatttcttttttcctccctgaactacttt

SEQ ID NO: 31175 - DNA, 201 bp, Homo sapiens
aaagagcctaacatgtgccaagcacgttttactggggactaggagtgcagagattcaaagagaattacagatatggatgagatgctgatcatgtgccaggrgctgatttaagtacattctatgtacttctttcttcacaatagccctgtgaggcaggcactgttattatcatctccatgttatagctgaacacattgagac

SEQ ID NO: 31176 - DNA, 201 bp, Homo sapiens
cgttacaacccccctaccccatgcttccttgttgtttcctttgaatttcttttttcctccctgaactactttgctttttcccctttggtaattttgaagayaagctatttcatattctattactaattacacttaacatctttaaaagcatgctccaacctatatttctctaattaaccacagaaactacaaaacaggatt

SEQ ID NO: 31177 - DNA, 201 bp, Homo sapiens
cctttgaggtgtgaagaagaatagtaaattcctgagtttcctgagtgctttccatgtgctacttgtcacagtgctaaatgcaagttctcatctgatcctcyatagtcttgctagagaggtgttatgagcactaccatttcataaacgaggacacagagcacagagaggtccagtgatgtgtccccagtcactcagctgata

SEQ ID NO: 31178 - DNA, 201 bp, Homo sapiens
tgtttcctttgaatttcttttttcctccctgaactactttgctttttcccctttggtaattttgaagacaagctatttcatattctattactaattacacytaacatctttaaaagcatgctccaacctatatttctctaattaaccacagaaactacaaaacaggatttcttgcaagatgagcaaattagcatatctcct

SEQ ID NO: 31179 - DNA, 201 bp, Homo sapiens
acagacactgtcacctggaaatcatgagcagggtctgtagttgggcaacaggaggtctgtaaactccatgacattagagacaaaaattctgagggtgggtrtatctttttctagggagaatatacagcaggcattagagaactcagatccccctggccaaatctagccagaaggttgtttttgtaaataaagttttattgg

SEQ ID NO: 31180 - DNA, 201 bp, Homo sapiens
attaaccacagaaactacaaaacaggatttcttgcaagatgagcaaattagcatatctccttgctccaactttactctttgtgtcagtagaatctggaatrttctaccctagagtttgggcaggaataacgtcttatattttctgttccaaggaatatttgttacgcttgcatttcattttataactatgtttacataaat

SEQ ID NO: 31181 - DNA, 201 bp, Homo sapiens
gactgacacatgggggaactggccgggccctaggctctcatggtgccctcatttctcagtcctggtcgatctttgaggccctggcttccctgaggcttgargaaaaaggtgtccctgcccacactgccctgttaggggcacaagcacttctcattaagcagagcagatctgagggcacattcagagtcccgtgaaaacaga

SEQ ID NO: 31182 - DNA, 201 bp, Homo sapiens
actaccttttttatgcttgtatatattaaaagatgtttagaatgaacctacagcatttttgcaatcagaaaaattaaatgttgtttcattttgaacgcctrcgaccctgatatagtttttatttgggggcttatgtccagtctttatccatttataaacaaatatttaatagctataatcaaaagcatgcatataatttta

SEQ ID NO: 31183 - DNA, 201 bp, Homo sapiens
cgagtagctgggactacaggcacccaccacctcgcccagctaattttttgtacattcagtagagacggggtttcaccgtgttagccaggatggtctcgatmtcctgaccttgtgatccgcccacctcggcctccaaaactgctgggattataggtgtgagccaccgcgcccggccgtcatgataatttttaaagtgattat

SEQ ID NO: 31184 - DNA, 201 bp, Homo sapiens
tggctcgtggagcggctcgcagcctgagtgtggaggtaatgtatgtgaccattctgcttctcccctttgcccagccccagagctcgcccctgctcctgctsttattcccaggcacctgcgctcacagaaaaaaaccgtggccccatttgaaccctcagcctggctgataggactgcaacagataattcatgtgcattttca

SEQ ID NO: 31185 - DNA, 201 bp, Homo sapiens
cactaggagaagcctcttcagaagcttcctaaagtctgtctggccattagctccttccacaataggttggccttggggacattgactgcacttgggacccrgggccaggaaaagggagactgggtcagggacactagaagaggtgccagcaaagatgctgggagtgactgacacatgggggaactggccgggccctaggct

SEQ ID NO: 31186 - DNA, 201 bp, Homo sapiens
caaatgtttacggaatggaaggatccatgaatgagtaaatgctttctcttgccctggcggagtaggaagaacaaggataaaaggtatcctggggagcacayttatccaggatggtgagggccaagaagtcatgtgggtttgcagcatgtgtggacactgagtgggaacttgggaggaggaggcagctgatggcccaggggc

SEQ ID NO: 31187 - DNA, 201 bp, Homo sapiens
gtggaggttgccatgagccgagatcgcaccattgtgatccagcctgggcaacaagagcaaaactccatctcaaaaaaaaaaaaaaaaaaaaaaaagataawtaaaagcttcaaatgaaaggccaattcagcacacccagcagcttgaggaataacattcccaggaagacgacagggaccattgctcacaatggctgctgct

SEQ ID NO: 31188 - DNA, 201 bp, Homo sapiens
ggaagagtctgccttgaatgtcccctgccctagagttctgtagcaataacatggtggatacagtgggataccatcaatgtggtaagagtatatgtgtgtgtgtgtgtgtgtgtgtgtgtgtgtgtgtgtgtgtgtgatgggaaatagggagggcgtgtctgtaaaagacccaagatcctacagcaaaatcttcacaatgct

SEQ ID NO: 31189 - DNA, 201 bp, Homo sapiens
gaagagtctgccttgaatgtcccctgccctagagttctgtagcaataacatggtggatacagtgggataccatcaatgtggtaagagtatatgtgtgtgtgtgtgtgtgtgtgtgtgtgtgtgtgtgtgtgtgtgatgggaaatagggagggcgtgtctgtaaaagacccaagatcctacagcaaaatcttcacaatgctt

SEQ ID NO: 31190 - DNA, 201 bp, Homo sapiens
aagagtctgccttgaatgtcccctgccctagagttctgtagcaataacatggtggatacagtgggataccatcaatgtggtaagagtatatgtgtgtgtgtgtgtgtgtgtgtgtgtgtgtgtgtgtgtgtgtgatgggaaatagggagggcgtgtctgtaaaagacccaagatcctacagcaaaatcttcacaatgctta

SEQ ID NO: 31191 - DNA, 201 bp, Homo sapiens
agagtctgccttgaatgtcccctgccctagagttctgtagcaataacatggtggatacagtgggataccatcaatgtggtaagagtatatgtgtgtgtgtgtgtgtgtgtgtgtgtgtgtgtgtgtgtgtgtgatgggaaatagggagggcgtgtctgtaaaagacccaagatcctacagcaaaatcttcacaatgcttat

SEQ ID NO: 31192 - DNA, 201 bp, Homo sapiens
tgacattcagcaggagatatctgtactttcaaaagggtcatgtacttgaatcttcctagttaaaaaagaaaaagaaaaaaaacgtaaaagatgcatatataaaaaaagatttcattgcagctttattttaaattgcaaaactttggaaacctaaatggttaacagagtatctgttaaatacattctagtaaatctgtatga

SEQ ID NO: 31193 - DNA, 201 bp, Homo sapiens
tcacacaccatccctgctttactgatgcgcggatgcactcaaggtgctgtgtgccaaaccaggcaactgagagaccacagcagtctttattccagtgtacmatgccttgacagaaatgaattcgcttcagcgagtcaccccaattaagatcaaaaaatagtctccactcatcaggcatctgacctaagtaaggcaaggtac

SEQ ID NO: 31194 - DNA, 201 bp, Homo sapiens
ctttattccagtgtaccatgccttgacagaaatgaattcgcttcagcgagtcaccccaattaagatcaaaaaatagtctccactcatcaggcatctgacctaagtaaggcaaggtacctgattgtcctgccctcagccttcccttctataaactgaggataatgatagtacttatgccatggcggtattaaatgggttaat

SEQ ID NO: 31195 - DNA, 201 bp, Homo sapiens
taccctctcttctatttccttgccccagtgtccacagcaacgtcctgcaatgaccctgggatcccgcagaatgggagtcggagtggtgacagttgggaagscggcgactccacagtgttccagtgtgaccctggctacgcgctgcagggaagtgcagagatcagctgtgtgaagatcgagaacaggttcttctggcagccc

SEQ ID NO: 31196 - DNA, 201 bp, Homo sapiens
tttattccagtgtaccatgccttgacagaaatgaattcgcttcagcgagtcaccccaattaagatcaaaaaatagtctccactcatcaggcatctgacctaagtaaggcaaggtacctgattgtcctgccctcagccttcccttctataaactgaggataatgatagtacttatgccatggcggtattaaatgggttaata

SEQ ID NO: 31197 - DNA, 201 bp, Homo sapiens
cagagctgagggtggaagctgcaaacagctgagaaagtgcttatgaacagctggggctgtgactgcacactcctgaggataaggcctgcaaataagtgggragtgagtgcaaatagctggaatgttgaactgcaaacaaccgggagtaaggactgcaaaacaaccagagcagaggctgcatctggggagcagaagagcttc

SEQ ID NO: 31198 - DNA, 201 bp, Homo sapiens
atatctacgacggacgggactctctcagccctctcataggaagcttctatggctcccagctcccaggccgcattgaaagcagcagcaacagcctcttcctygccttccgcagcgatgcatctgtgagcaatgctggcttcgtcattgactatacaggtaagggccctggtgccagagagtactgaggacaggtccagctaa

SEQ ID NO: 31199 - DNA, 201 bp, Homo sapiens
ttggagaggtttcctcaaccccctcatccacagtaatcccttccttcgcttaccctgctctggcttccttcatagttcttagaaccacccaacataggatrtatgcattttgaaacatttactgacttctcaagcaaatcccatgagatcaaggagcttgtctatcttgttctctgtggtatgcccaactcctagaacagt

SEQ ID NO: 31200 - DNA, 201 bp, Homo sapiens
gcctctgtgccaagcattttgtatacaccatctaatataaaccttaaaacaggtccgtaagagagatggcattattatccccatcttgcagaggggcagaycgaggttcaatcatgttaagtaatgtcacaaaaagtcacacatggttggtaaatgttggagttacatccagggctgcatgactccaaagcccatgctgct

SEQ ID NO: 31201 - DNA, 201 bp, Homo sapiens
gcatggtttctttttcctttcagtactttgaatatatcacctctttggcctctgggcttgtaatgtttatgctgagaaatctgctgataatcttatgagarctcttttgtaggtgatgagtcatgtttccttgctgctttcaagattctttccttccttgtctttaactttttcttgtctcaatattgacttctttggggt

SEQ ID NO: 31202 - DNA, 201 bp, Homo sapiens
cttatattctttggtgcatcttctatagttatttgctttgtggctacaatggggattacataaaatattttataattataataatatgtcttagactgatmataagcctcagttgcatataaaaacttcacgctattacaccttctttctccctacacactttgtattagcaatatcacgaatttcaccttttacaatttt

SEQ ID NO: 31203 - DNA, 201 bp, Homo sapiens
gattttgttccttttgataactctaggtttagtttgttctttctctagttcttttacatgtaaagttaggttattgatttgagatcattcttttttttaaygcatgtgcaatgtgctgctgtaaacttctgtcttagtaacacttgctgcatcctgtaagtttttggcatgctttatctttattttcattcgtctcaagat

SEQ ID NO: 31204 - DNA, 201 bp, Homo sapiens
tgcattgagatgatcatgtggttaacatgggatattatattgatggattttcatatgctgaacaaaatttttgcatttcaaacataaattccatttggtcwtgctgtacaatccttttaatatattgttgaatttcatttgctagtattttgttgaggatttttgcacctgtattcatcaggtatattggtctgtagtttt

SEQ ID NO: 31205 - DNA, 201 bp, Homo sapiens
gtcttaaccactaactatacagcacagtagtgttaactatatgtgccttattgtgcacatagaactctagaactttttcattctgcaaaactgcaacaacrctacacccattgagcaacaactctcctttcccccagcccatgacaatcaccatcttaatttctgtttctgagagtctattttaaatatctcatataaatg

SEQ ID NO: 31206 - DNA, 201 bp, Homo sapiens
tgtgcctagatgtctaatatcaatgtagcattagatgagaatcccagaaggcaaggaccccagttatggagcacttcctgatagcacccagcatcaagccraggcacaagggcatccttcaccatcacacttaccccgtggccttggctggagcaacttgaaagtatggagagggtcaccagcacccaagaggacccttca

SEQ ID NO: 31207 - DNA, 201 bp, Homo sapiens
ccagagcaggtgagctacttccactaagctcatgccattccacctcgttccttggccactggacttattccctgtgctgtgcttactgctggtttctcccrtctctgcatcctgcattagactgtgattccctgagaagggactctgcctgctcattcattctgttgccagtcatatggcttatggaaaggatgtgcttct

SEQ ID NO: 31208 - DNA, 201 bp, Homo sapiens
ttttcttctaatggaaagatatgaaactaaagttaccaggccaggtgtggtgcctcacgcctgtaatcccagcactttgggaggctgaggtgggcagatcrcctgagatcaggagtttgaaaccagcctggccaacatggtgaaacaccgtctcttctaaaaatacaaaaattagccgggcatggtggcaggcacctgtaa

SEQ ID NO: 31209 - DNA, 201 bp, Homo sapiens
gcacgatgtttcccgaggccctgcagatctcccagcctgtgagcagtgtcagggctggacccagtggctgccccaccataaggccggaggaagattggtcrcgggcatgcatttccatgaagccgccacactggctcacccatgcacatgagacacttttgccggcctcagggagtctagaggtcacagctaatgtggccc

SEQ ID NO: 31210 - DNA, 201 bp, Homo sapiens
accaaactggcaagacctagtggtcatagcctccatcttttgcttaagcagaagagacccgggacagggactgtatagtagatggatcttcctcatccttsgtacttctcaagctgatctggctgcccccacaagcccaatgaaaagacatctgtccttcctagtctgttacatgtcttcctccctctcctcttttctatc

SEQ ID NO: 31211 - DNA, 201 bp, Homo sapiens
tggctctgctctcacccacgcacagcacagaaaagacattggaatgtgcctggctttgcacaaaagctgaagcaaccaggatcaggggaaagacctgagcsaggcacgatgtttcccgaggccctgcagatctcccagcctgtgagcagtgtcagggctggacccagtggctgccccaccataaggccggaggaagattgg

SEQ ID NO: 31212 - DNA, 201 bp, Homo sapiens
ctctgaggaaccaagctgggagggtgaagtcaggtagaatttgggttccttggaggcaccccctctcacccacctcccaaaacaggcacccgcccaacctrccgaaggcacttgaaccaatcccacatgaccctcccaagcttgcagagaaggcaaagaagtaatcagctgcttgccactgggctccacggggaaaaccca

SEQ ID NO: 31213 - DNA, 201 bp, Homo sapiens
tgacggctgattgcttgacctaagcctgtgcttcatcctgcctgcacagagctgttgccagggcactgagggtccagatatgtggtctcagcagctgagcyggacaaggaaacttgcctaagactagaccatattttgaatttttccaggttcattcccagggttccaagacttcagtgttcatcttctgtaaaagaaaga

SEQ ID NO: 31214 - DNA, 201 bp, Homo sapiens
cgcggtccctgccccagcctggaacatccttaaggggtggctgtcgtgaatgttagcaatgctttcacctcctacgcagcagtcctttgaggactagcttycctagggagtaccagtgatggaaatatcaatattataagtatttgtctcctgggctggaagaagtatcgagctgtgatttagtcagttgtgctgcctctc

SEQ ID NO: 31215 - DNA, 201 bp, Homo sapiens
ctcccgcggtccctgccccagcctggaacatccttaaggggtggctgtcgtgaatgttagcaatgctttcacctcctacgcagcagtcctttgaggactarcttccctagggagtaccagtgatggaaatatcaatattataagtatttgtctcctgggctggaagaagtatcgagctgtgatttagtcagttgtgctgcc

SEQ ID NO: 31216 - DNA, 201 bp, Homo sapiens
ttagcctcgaggacagcaagggctgggccacattcccctttttcttttctctgttctctcaagccctgttcatcccactgccccctctgctgtccagaagwccccagggagtccgtttctgcagtttcccaccacctactcccgcggtccctgccccagcctggaacatccttaaggggtggctgtcgtgaatgttagcaa

SEQ ID NO: 31217 - DNA, 201 bp, Homo sapiens
tcacagctcctattactgactccaatcctcctgcccccctcttataaggacacttgtgattacattggacacatcaggataatccaggatgacctccccayctcatccttaacttaatgacatctgtagtctcttttgccatgtaaagcagcatatttccatgttctggaaatcagggcatggacatctttgggtgggggt

SEQ ID NO: 31218 - DNA, 201 bp, Homo sapiens
tcccattccatttcagaccccatctcctgtgcaggaagccccttggcctccctagtgggtagcaatgtcccctctcagctgtctgcactgcctcctcctcygagtctgcttactggcattgagtgttcttcctgctgtcaacacagcttggggacatgccagcgtgctgggcaataggcccagcacatcctaaggcagata

SEQ ID NO: 31219 - DNA, 201 bp, Homo sapiens
ccgggtgtggtggctaacacttgtaatcccagcactttgggaggacgaggcgagtgaatcacttgaggccaggagtttgagaccatcctgggcaacaggamaaaatcccgtctctactgaaaatacaaaaattagccgggcatggtgttacacacctgtaatcccagctacttgggaggctgaggcacaaaaactgcttga

SEQ ID NO: 31220 - DNA, 201 bp, Homo sapiens
ccaaatgtatttctggtaaaccccactggactcatggctagttagatttggtgggagtgggaggggatggggttgaaggagatgaaggagtcagggatgartctagcttaagtggttttagcaaaatgatattaacaaagatggtctggggcagaaacagatgggggatgaagtttgcttgggacacattgattctgggta

SEQ ID NO: 31221 - DNA, 201 bp, Homo sapiens
agaggcccacaggcctaatatatttactatcaggccctttacagaaaaagtttgccaacctagaggcaagtctgccacctagagaaaagcaagcaggatasgtagcgagcactgagactggaaagtgtggtagtggtcaagttgtgaaagtctcagtagagttgggcttgattccatgagtcatagatgagaagtgatcag

SEQ ID NO: 31222 - DNA, 201 bp, Homo sapiens
tggtctatggctgctttagcactgccagggcagagctgagcagtttatgactgacacaagaggcccacaggcctaatatatttactatcaggccctttacrgaaaaagtttgccaacctagaggcaagtctgccacctagagaaaagcaagcaggataggtagcgagcactgagactggaaagtgtggtagtggtcaagtt

SEQ ID NO: 31223 - DNA, 201 bp, Homo sapiens
aattaggtggatcattaatttgtattgtatcttttgctcttttcctcctgtttaccgttttcttactgatttgtaagaactttttctaggttataaatacraatcctcctcctgtcacatattcgtaacctttcaggttgcacttttctcattatcttttacagttttttgtcacacatacatgcttttaattttcatgta

SEQ ID NO: 31224 - DNA, 201 bp, Homo sapiens
tgacttccacaggcctcccatactgccctctctgccctttctcagccctccctctgaagcatctgcacaggggaccccttccacctgggggtgcttcttaycctgcagccccatcccagcagaacctcactgtgcccattcctcagctctcagctccagactcattgtcccaggggttctcctctgatggcctgtccagcc

SEQ ID NO: 31225 - DNA, 201 bp, Homo sapiens
gaaaactggtagtcattttggccactgatctctccatcacccacttctgtttgccttctgaatgtttctgacatctgtccactttccacttttcttcaccrtcctgtcacccactagcctgaggttccatcttgtctcacctggacagctatggtagctctaaattgccttctctgccttcacccatgccctcggcacaaa

SEQ ID NO: 31226 - DNA, 201 bp, Homo sapiens
ctaagctttcagtctttctaatatatcacctgcagagtggacagataattacacagataatttaaaagcaatgtggtgagcatcacaataaagtttaacayggggcaaggagaggggttatgggagcacacaggaaggtcaggagtctagccagcgcctatcagggatgacttcctgaaggaggcaatgttaaactgagac

SEQ ID NO: 31227 - DNA, 201 bp, Homo sapiens
tctccttggttaactccttgatagaaactgatgtcagattagggccgggcatcacacatttgctttgcagacaaggggccaaaattgacttgaataatagrcccaaggcaagaggagcaggctggagatgacagagacagttactagtataaagcagtagcaacaccaagacttttcccctccttccttccttcttttttt

SEQ ID NO: 31228 - DNA, 201 bp, Homo sapiens
gagtgtgatctgagaagcagctgcatgggcaccccctgagagcttgttagaaatgcagaactcagcccccaccccacaccgagtgaaatagaacctgttgyactttcaagatccacaagtgatctctacactgttgaagaagcactgccttagtctaaatcaggatcactgaggagcttgtcaaaatgcagattccctggc

SEQ ID NO: 31229 - DNA, 201 bp, Homo sapiens
tggcaccgcctgcagctggaggtaactgggacaggcaggacctgtcccacccaatcaagaggaatggtaggagccccacccaccttggactcagctgtagmtaccagacagccttggaggtttctcaaagctgttatccagactgagaggagatgttgactaagacattgatcatctggcccgcttatctctgtggcatat

SEQ ID NO: 31230 - DNA, 201 bp, Homo sapiens
aacatgttctctcctaacactgcatggtgaatctggacctgagctggttggcaccgcctgcagctggaggtaactgggacaggcaggacctgtcccacccmatcaagaggaatggtaggagccccacccaccttggactcagctgtagctaccagacagccttggaggtttctcaaagctgttatccagactgagaggaga

SEQ ID NO: 31231 - DNA, 201 bp, Homo sapiens
aacacttctccttctacaatggaagcagtccagtgttatctaactgccaccagggtagttggcttatcatgccagggaagggtaccattttgggaaccccrcttctggtaccaaaatctgttttggtctctttgggctgccatcagaaaatactcgtagactgggtggcttaaacagtagaaatttattttctaactgtcc

SEQ ID NO: 31232 - DNA, 201 bp, Homo sapiens
ctcaagtttggaatgaactgcctaaaaaacacaagaggagtcacatggagagatcaaaatgtcagcttcattaccttaccgataacgctgattggaagacrtggctttggatatgtggcaaaattgtcttgttaatacatcactcttgaattgaagaagttacccactcattcaccagcaaaggaaacagcctcaggcttc

SEQ ID NO: 31233 - DNA, 201 bp, Homo sapiens
agcactcaggacatctgcagagttagggctaggattgtgcctctcgagaagcctcagtgtccactttcccagccagctcttggcacgagaatgatgggggkcttgttctactcatcagtttcaggtagaacaggcgtctggtcccttggaagccctccctagcctgggcagaaaggaggtccccctctcctctgtgtgctg

SEQ ID NO: 31234 - DNA, 201 bp, Homo sapiens
tagagttagcgaccttggaagagcccctggagtgctggttctcaacctcggccataccatagccagggtcccactcccagagggctaattttaattaattyaatttaattgggacactgtgattttacaaagcttcccaggtgccacatggttgagaaccagccactataagcaagaatttatatcagtatcacctggaag

SEQ ID NO: 31235 - DNA, 201 bp, Homo sapiens
tgagtgtgatctgagaagcagctgcatgggcaccccctgagagcttgttagaaatgcagaactcagcccccaccccacaccgagtgaaatagaacctgttkcactttcaagatccacaagtgatctctacactgttgaagaagcactgccttagtctaaatcaggatcactgaggagcttgtcaaaatgcagattccctgg

SEQ ID NO: 31236 - DNA, 201 bp, Homo sapiens
cagtttgttataaaggatatacaaaggatacagatgaacgttagatgaagaggtgtgtagggcaaggtgtagggggaggggcttggagcttccatgccctycctgggcacacaaacctccaggaatctccacgtgttccgctctctggaagctctctggaccccgtcctcttgggtttttagggaagcttcattacgtagg

SEQ ID NO: 31237 - DNA, 201 bp, Homo sapiens
tcctagtccacccaccagcctgtggcatgtcccccaaattttatgtgagttccaagcagacataaattcaaaatggttgaattttctctggatcctcagcwcacagaacaagcctcactggcaggaagcatcaatatatgtgtgctgagtgcatgatggatggatgaatgaatgaatgaatgaatggataaatggtgccat

SEQ ID NO: 31238 - DNA, 201 bp, Homo sapiens
aagttgggatgccaacctcgcattgatccactgggggagcacagaccccttcttgtttctccccatgctgtgcttatgaatgggaagttctgagcaagccmatgagaagacaaatggggagaaaacaaggcaacatgaaagtgtgcaagtgtgcaccaggaggcagggtgtcacctggatcatctgacccaggtgactagc

SEQ ID NO: 31239 - DNA, 201 bp, Homo sapiens
cctagttggtctttgtttttattttccatctttacaaaaaaatgtgagatgttcactcttgcagaacaaatagaactgtgacttttgtttcacaatttatrtggctgattttgtctgcttttgacagttctgttgtgttcctgacagttacaatttggtttctctctgggaccttggaatgataagttgggatgccaacct

SEQ ID NO: 31240 - DNA, 201 bp, Homo sapiens
acctctgccaggaagccatccctgattccactatagagggatttgtcactccctgagttggccttctttatttggtctggcctggctctattctaattacrttagctggatatatgatggtcaagggcagggactgggtcataatcatttctgatgattgacacactcattcccattgtaagactccctgagtgtttactg

SEQ ID NO: 31241 - DNA, 201 bp, Homo sapiens
agtgcatggggtcaatgaatatctgaatgaatgagtgaataatggaacccagctttagcttctatgctgacccttctcccattccatttcagaccccatcwcctgtgcaggaagccccttggcctccctagtgggtagcaatgtcccctctcagctgtctgcactgcctcctcctccgagtctgcttactggcattgagtg

SEQ ID NO: 31242 - DNA, 201 bp, Homo sapiens
aattttattcatcttttaagacccaatgcagatgttacctctgccaggaagccatccctgattccactatagagggatttgtcactccctgagttggcctyctttatttggtctggcctggctctattctaattacgttagctggatatatgatggtcaagggcagggactgggtcataatcatttctgatgattgacaca

SEQ ID NO: 31243 - DNA, 201 bp, Homo sapiens
ctcctcagtgcatctgcctagagagcctgtccctgctcaggcaccctgggggctcttccttctcgtgtaggagtcctgtctccccagccagctcttacgtrctaaagggcagggtgcatggccattcctcttaggctccttctaccctcaagtgcattttcctgcactaacaggcaggcaagaaagagaagagaagaatca

SEQ ID NO: 31244 - DNA, 201 bp, Homo sapiens
taaagactgaggcttttacctgagctctgccctggtcactccccattccccaaactagaaggcaccttctcctcagtgcatctgcctagagagcctgtccmtgctcaggcaccctgggggctcttccttctcgtgtaggagtcctgtctccccagccagctcttacgtgctaaagggcagggtgcatggccattcctctta

SEQ ID NO: 31245 - DNA, 201 bp, Homo sapiens
tttcttcattcatccagcaattacctccaaagagcctaacatgtgccaagcacgttttactggggactaggagtgcagagattcaaagagaattacagatwtggatgagatgctgatcatgtgccaggggctgatttaagtacattctatgtacttctttcttcacaatagccctgtgaggcaggcactgttattatcatc

SEQ ID NO: 31246 - DNA, 201 bp, Homo sapiens
tgggggatgggcagtggctgcaggctgggccccccatgaaatgcttcagctgtgccacctcccataaccgtggccttagaggatcacagagcctgtgctcrtgggcaaggatccttgggttctgcctagccccattacagggaggtagtttagttcaggtctcaaccagcagcaggaggtatgtgctaggtgggctcagcc

SEQ ID NO: 31247 - DNA, 201 bp, Homo sapiens
ctgcagcagaagaagggaagtggccagcacatccatgtggctgagcagagggcagttctgctcagactgcagcagcccattattctgattcatccgttgaytcttcctacccctctcagtgtgttgacgtctttcctataaagactgaggcttttacctgagctctgccctggtcactccccattccccaaactagaaggc

SEQ ID NO: 31248 - DNA, 201 bp, Homo sapiens
aggggctgcagcagaagaagggaagtggccagcacatccatgtggctgagcagagggcagttctgctcagactgcagcagcccattattctgattcatccrttgactcttcctacccctctcagtgtgttgacgtctttcctataaagactgaggcttttacctgagctctgccctggtcactccccattccccaaactag

SEQ ID NO: 31249 - DNA, 201 bp, Homo sapiens
tcctctgtatgctgctgggttatcagtttctggaaccatgtgagatttgtgcgagcccatgtgaccaacagacagttcttcaggctgctataaagcagtckccaacacctgtccctgtgagccgctgcattgtgtatttgagcctttgatataccggggatgtttgccaagggagagaaatgttattggacatttttcgtg

SEQ ID NO: 31250 - DNA, 201 bp, Homo sapiens
tttgcaatatataaagcacttaacacagcattcagtaaaacttgctccttggggacagacagcctgactggctcatgtctgagtccctagtgcttggcccyatgcctggctcagaggagcatttccagaagaaaggcagaatgagcacgcagtgggaggaatctcctctgtatgctgctgggttatcagtttctggaacca

SEQ ID NO: 31251 - DNA, 201 bp, Homo sapiens
tggagtgccttctgggacttttgcaatatataaagcacttaacacagcattcagtaaaacttgctccttggggacagacagcctgactggctcatgtctgwgtccctagtgcttggccccatgcctggctcagaggagcatttccagaagaaaggcagaatgagcacgcagtgggaggaatctcctctgtatgctgctggg

SEQ ID NO: 31252 - DNA, 201 bp, Homo sapiens
cttccgttctgtgggacttggaggctttaatgtgcaatgtaggaattggatcctgagatgggccttatctgactttcaagctcatgctcaaacacttgccrgtattctcctgcagtgtgctttgtgtcgagccctgtgctgagatgagtaactctcagcctctgactttgggacactcacagttccatgcaagcaaagcac

SEQ ID NO: 31253 - DNA, 201 bp, Homo sapiens
actgattcttcccagccttccttcctacacctagcctggggccagcctcctgaaggaaagggtgggagcttgcccagccaggggcagtctgagcagagctktgtgcagtggaaagtgcctggcttcagagtgttgtgaggtgaactgggtggaggcattaagcatctggcatcatggctgactcagggtggctgttccgtc

SEQ ID NO: 31254 - DNA, 201 bp, Homo sapiens
gaccccatcactaatttgcttgagcagagggagctgatttgagctctcccttttgataggaacaactttcaaatcaccatcagtgctcatacaattcaaamgtgtagttgggggcatcaaaacacaaaaccctttcctttatatgtaaaatgagcaacacgtctgctgaagattgggaaagcaaagtgaaattgcagatga

SEQ ID NO: 31255 - DNA, 201 bp, Homo sapiens
aactctagataggtgaaaaatgagtcttggggtttcagttttcacatttttatattaattaggtggatcattaatttgtattgtatcttttgctcttttcytcctgtttaccgttttcttactgatttgtaagaactttttctaggttataaatacgaatcctcctcctgtcacatattcgtaacctttcaggttgcactt

SEQ ID NO: 31256 - DNA, 201 bp, Homo sapiens
tgggaccgtgagttagatttgctaggttgagaaggttgcagtggaagggcgtatgaggcaaagggccaagcactgcaggtgacaaattagtggtgtgactsaggcacatgctgtgcaggggagaggggctaaaatgaggctcagtgccagcatccctaatgacctagttcttggtcctttcctaaaggatcattgtagaga

SEQ ID NO: 31257 - DNA, 201 bp, Homo sapiens
caagtttgtgcccatttcatttaatgtgtgaaatgcatgtgtgtaatttgtagtatttccttattatcatgttgttaagtgcaggatctgttttccttagyccttgccaactctagataggtgaaaaatgagtcttggggtttcagttttcacatttttatattaattaggtggatcattaatttgtattgtatcttttgc

SEQ ID NO: 31258 - DNA, 201 bp, Homo sapiens
caccactggcctatgatttaattaatcatgcctatgtaatgaagattctataaaaactcagaaagactgggctcaaggagcttccagatagcagaacacayggaggttcctggagactgatatgctcaaagaggatgtggaaactccatgcctcttcctccataccttggcctctccatctcttcatctggtgttcattgg

SEQ ID NO: 31259 - DNA, 201 bp, Homo sapiens
tatatggctggtgtggtattgtgaaatatacatttggtctttgtctcttgtcctgacatacggctgctgaaatccttggaatctccaaagtgatacacatsttatgaatgctaatgggttgactgttggcttgccatccctaaatatcttcaagaccggggttggttactgggaagaccaagccatgattaaagagttggg

SEQ ID NO: 31260 - DNA, 201 bp, Homo sapiens
gacagggaatagctcatgtaggacctaggaggccacaggaaggagttcgggccttactcacaagaaggggaccatcgctgaagggtcttaggcagggaagyggctccgtgagatttatgctttagagacattggggagagcaggggcagactgcggggaaggaaaccagtcacaggaggcaaagcagggaccactgtcgag

SEQ ID NO: 31261 - DNA, 201 bp, Homo sapiens
ctgtaattgaggcctgattaagagttcctgggctagagataaaagggcaattagttttgccagaaggatttaaggaaagccaaaaaagaggcagtgacttmaatgtgggtctcagaaagatgccagacagaccatgggaagatatgttccaggtcaagcaaaggcaagaaagcatgaaactaccacatctaatgaaccaca

SEQ ID NO: 31262 - DNA, 201 bp, Homo sapiens
ttcgtttctgtttcccatcttgatggaaacactgcaacgtttacctcacctcagagcaaatggaaatgggactcctttgccagtttaccaaactgatttcyggacttttgtcagttttgatagcagtccaccccaacccacctttatatgtagaagttattagaaagagttattagactggggctcagcctctggtgggaa

SEQ ID NO: 31263 - DNA, 201 bp, Homo sapiens
caaaaagaagtaaacttaaaataaaagataacctacaacatagtacattatattctggtctcagtccaatcagaatttaggatgtctgtggccagacacarttttacctaataccacagggtatcagaaggcctgagttctagtcgggctctgcttcggactggttatcaggaggtaggcaactgtgttcagtttaacaag

SEQ ID NO: 31264 - DNA, 201 bp, Homo sapiens
taatcataatagttaataccagatgcctgctaagagccaggcacagtgctaggcacttggcaagtaccatctcctttaatcttcatcattatcctgcaaakgaaacacggtcatcacctcactttatggacaaggaagctaaggcccagagaggttaagccaatttcccaaggccatctgaactcctgccttttgagtctg

SEQ ID NO: 31265 - DNA, 201 bp, Homo sapiens
ggatcagtttcacccacagtcagctttgtggcactatagtcttaagtgatttatggcacttcagagctaatgattaccaacttctaatggtattgacagakattttttcccagataaacaaaaagaagtaaacttaaaataaaagataacctacaacatagtacattatattctggtctcagtccaatcagaatttaggat

SEQ ID NO: 31266 - DNA, 201 bp, Homo sapiens
aagtcctgagttttgagtctccatagtgaaagggagacagcccagggctccatccctccaggacagcttcccctccatcgacctgctggtgaagccttgargctgtggcattgcgttactgcacacacttggcttgaatatgatggattctgaggtccatgtacgatagcaatgggaaccgttaacgccacacgtctgcct

SEQ ID NO: 31267 - DNA, 201 bp, Homo sapiens
gctgtgactacttcccagggaggggtggggtggatggggaaggaaggctaagtcctgagttttgagtctccatagtgaaagggagacagcccagggctccmtccctccaggacagcttcccctccatcgacctgctggtgaagccttgaagctgtggcattgcgttactgcacacacttggcttgaatatgatggattctg

SEQ ID NO: 31268 - DNA, 201 bp, Homo sapiens
tggggctctgatgagtagggtaaagacctagaataatggtcaaagggaaaagtactgattcatttattaatagccaggcgtgtgcctgatacccctcaggrcacaggtcctgagctgggctctggtggtacattcctgtaatcctggtgactcgggaggctgaggtgggagattcacttgagcccaggagtgatcatgcca

SEQ ID NO: 31269 - DNA, 201 bp, Homo sapiens
tttactctttagaatggaagaggagggacaagacaaatgtcaatgagaagttggtacctcttgaagaactggcaaagagtttgaagcttttgggttaagastggctttggaaggtgcttaaactgatatgccactaacacctgctccctgctggggctctgatgagtagggtaaagacctagaataatggtcaaagggaaa

SEQ ID NO: 31270 - DNA, 201 bp, Homo sapiens
cccacatctgtcctagcttcttccaataggtggttcctgcttcagtcagacaaagggagtgactttactctttagaatggaagaggagggacaagacaaakgtcaatgagaagttggtacctcttgaagaactggcaaagagtttgaagcttttgggttaagagtggctttggaaggtgcttaaactgatatgccactaac

SEQ ID NO: 31271 - DNA, 201 bp, Homo sapiens
cttcattggaccaaccagatcaatatttgctccactttgggggatcaagtggtgcgtttccatccttccaggaacttgccccaaccgtgacatgaatagayatttttttctgacttccaaacttcccgcagtgtggtctgtacaacctcatctgccattcttcctcagtgcaatcagcacttttggaaagaacagaagctt

SEQ ID NO: 31272 - DNA, 201 bp, Homo sapiens
atatatatgtgtgttttatttctatataattcatatatattaatatactataatttgtttatgcatccatatatatatatatatatatatatatatatatrtatatatatggagagagagagagatttttacctgtcccaaagccatgaaggttttctcttgttttcttctggaagtgttatagttctagcttgtatatac

SEQ ID NO: 31273 - DNA, 201 bp, Homo sapiens
ttagaaatcccaaagggtgtagattttgaagcaaaatgggagcacagcaccttttgtgtcccacacataatacttgggggatgggcagtggctgcaggctrggccccccatgaaatgcttcagctgtgccacctcccataaccgtggccttagaggatcacagagcctgtgctcgtgggcaaggatccttgggttctgcct

SEQ ID NO: 31274 - DNA, 201 bp, Homo sapiens
tcccagctgtagaattaatgggcttaggttaagtaactagacctagacctcaggtccctcactggcaacaggggaataagtatgcatatctgatggagttmtttgctggtgaaacaggtcaccgtacaaagcatccatgcagaacccagtctggagggttgtgaatcggtggtctttcaccttcctacagaccagccccct

SEQ ID NO: 31275 - DNA, 201 bp, Homo sapiens
gttgtgaagctgtgcgtggcttcttggtgtctcactctgggtcatgccctcgttgccttccgctatccctatctggtctctctgttcctgtctgcctcttkcctgtgtctctgtcacttttccgtctctctgtttctttttctgtcctcttgcatctccctggcttgcggtctcactctctatctgccgttgtgtctcttt

SEQ ID NO: 31276 - DNA, 201 bp, Homo sapiens
gtagatggggtttcgttgatatgtatgcactgagtggagagtggcctagacaggcaatggagactgcatgatctgtagctccccgggcagtaaatggggaratcacagtccaacaaccagagatgctgggcctgtgctgagatggagccaagaaagagtccctcctcactgctgagatgcaaacctgtattgtaacaatgg

SEQ ID NO: 31277 - DNA, 201 bp, Homo sapiens
tggggggtcggatgccgctgacggagcctttgttgtgaagctgtgcgtggcttcttggtgtctcactctgggtcatgccctcgttgccttccgctatcccyatctggtctctctgttcctgtctgcctcttgcctgtgtctctgtcacttttccgtctctctgtttctttttctgtcctcttgcatctccctggcttgcgg

SEQ ID NO: 31278 - DNA, 201 bp, Homo sapiens
ctcagcatccctcaggtcatgggagcttagagttgttcacaaccttcacgctaggcccttgcgtgcagacctcctggcaggtgattgggtgccgccacgcygggcactctgggatcagaacatttgactgaccatgaagttaacccaagatggcatctcacacccacacttgtccttcctcatcacctcccacattcatcc

SEQ ID NO: 31279 - DNA, 201 bp, Homo sapiens
tcccacaaattctaccaagagtcaccactgagttgagccggagaggttttccgcctcagtctctgcactcagtccttcaggtgctctggggaggagcctcrgaagcttccagtgctgggggctaagtggagcaggcaggggtcagctgcctgggttttgcttggagagaagccctcaaaaaggtccagattgagctcagag

SEQ ID NO: 31280 - DNA, 201 bp, Homo sapiens
ccagagtcttctcatccctttgaatggtagaacttgttcaataagtattgttgagattctaaaatctccctgctggaagagctcttagaggttaccagctrtccaatctcactcagtacaggaaccttctctaaatcactccctgcaagatggcaacacgccagctcagctcaccctctgcctaaacatgcctgatgtggg

SEQ ID NO: 31281 - DNA, 201 bp, Homo sapiens
tcctgggaacaaaagccggtctactcactccccgatgacccaggatatgagtctgcacttgacaaccatgcctggtaacagccagggctcaacaaggccgrcagctgcacagagcctgccaggctgtgtgggtccttcagggaggcgggggcctggtgctctgtgctcagcaagacaggtctatgcctctgcctgaacttc

SEQ ID NO: 31282 - DNA, 201 bp, Homo sapiens
tctgatcatgctcattatatgatctactgttgtttacttgtttactgtctgtctcccccactagacaacaagctgcatgaggatgactacagggactctgyacccccagtgccacacacagcacttgataaatatttatcaattgcatgaatgaaaggcacagggtggagtggaagggagagaatgagtggtaattaatgt

SEQ ID NO: 31283 - DNA, 201 bp, Homo sapiens
gacagagatttgctgggtaatagggagggtgtctgaacattcatggggttgaatctcctgctcccacagggtcctgttctgccctgatggagggatggacygaggagagtttgctgggtaatagggagggtatctgaacattcatgaggttgaatctcctgttcccacagggtcctattcttgcccactcacctccctcac

SEQ ID NO: 31284 - DNA, 201 bp, Homo sapiens
ctctgatcatgctcattatatgatctactgttgtttacttgtttactgtctgtctcccccactagacaacaagctgcatgaggatgactacagggactctrtacccccagtgccacacacagcacttgataaatatttatcaattgcatgaatgaaaggcacagggtggagtggaagggagagaatgagtggtaattaatg

SEQ ID NO: 31285 - DNA, 201 bp, Homo sapiens
catgtggaagggttgggtcagggaagggcatctcaggcagaggcagcagcaggagcaggagctggcaagagcacagctcagtgctcctgctgcagcaaagkatggggaggtgcagtgaggggttggcaggggattggtcatggggtgtcctgagggtccctggaagttgcttggaatctaggctgcaggcaacagagcacc

SEQ ID NO: 31286 - DNA, 201 bp, Homo sapiens
cggtcacccctcccactgcatacacacagttgaaaccatcccgatttgatctggccttgactgccagtctacccacgcttcccctcccaccactcctgcaygcttctccataccccaggtgtacttgcctttttgcttttactggaaaacaacaaacttttttttttttttttttttttgcctccagacatttcttcctgc

SEQ ID NO: 31287 - DNA, 201 bp, Homo sapiens
gttcctcatccatataatgggaataataaagtctccaccttgctgagttgctgcaaggataaacaacacacttaaagattttagacagggctggcccagawgagctctcagcaagccttagtcctccttagaggtgtgctccacctcacacctgcccttcccacattgtgaatcgtgtcagccccgaccgggacccctgcc

SEQ ID NO: 31288 - DNA, 201 bp, Homo sapiens
cttgcgtatccttcaggtgtcaaacttagacctctctctgcccgggaagcccttcctgaccctgaccctgcaggtctggctgaaaagcctcctctcagagytcccacggctgtctatacagctcatcatgatctttctcgccctggagtgggttgcgggtctacctgtctgccctctgtgatgtgtcatgctcagcaccga

SEQ ID NO: 31289 - DNA, 201 bp, Homo sapiens
tcttattgactatgtgatgtggctttgggcaagttacttaactctctgtgcgtcagtttcctcttctgtaaaatagagatggcaatagtactcacttcttrgagttgttaagaggatttagtgagataattttgcaaagagcttagtatgatgcctggaatatcatagacatgcaataaatgttagctctcattcctggaa

SEQ ID NO: 31290 - DNA, 201 bp, Homo sapiens
ttcaaagatgccataggaaacctgctaggaaaacacaaaataggcttgtctggctctctgcactgacaaccacccctactccaccctgcttcagacacaasgaggaagggaacctgggcagctgtgacggggccaggtcctactgggcacagccaccctgggcatctcactggcaggggatctggcatggggtgggcaagg

SEQ ID NO: 31291 - DNA, 201 bp, Homo sapiens
cccaaagggggatgaaaattgcaaataacgaggatggcaactgcacacagctggaagggactatacagagctgagggtggaagctgcaaacagctgagaargtgcttatgaacagctggggctgtgactgcacactcctgaggataaggcctgcaaataagtgggaagtgagtgcaaatagctggaatgttgaactgcaaa

SEQ ID NO: 31292 - DNA, 201 bp, Homo sapiens
ttggtgttaattcttctttatatgtttggtagaattctctagtgaaatcatctaggcctagatatttcttttttgggagttttaaaattactaattcaatytccttaatagttatagggctattcaagtgatctgtttcatattgggaaacttacggtagtttgtgcttttcaagtttgtgcccatttcatttaatgtgtg

SEQ ID NO: 31293 - DNA, 201 bp, Homo sapiens
ctcataatatgagtttggaaatgtttgttcttcttttctggaagagattagagtagaattggtgttaattcttctttatatgtttggtagaattctctagygaaatcatctaggcctagatatttcttttttgggagttttaaaattactaattcaatctccttaatagttatagggctattcaagtgatctgtttcatat

SEQ ID NO: 31294 - DNA, 201 bp, Homo sapiens
agagcaaggaaacagaggccctgctctgtcctgctccctgccctgggatctctggctggcattaccaccaggctcccttgctctctagcagtccacagagrtcagcttcttggggcacagaacagggcagagaggtttaaagaatggacctggaagggcaggggaagaatcactggcattggatcagtttcacccacagtc

SEQ ID NO: 31295 - DNA, 201 bp, Homo sapiens
taaaatctccctgctggaagagctcttagaggttaccagctgtccaatctcactcagtacaggaaccttctctaaatcactccctgcaagatggcaacacrccagctcagctcaccctctgcctaaacatgcctgatgtggggaggccaccaacccgttcaacagatgggcacctactatcatttttgcacagatgctttc

SEQ ID NO: 31296 - DNA, 201 bp, Homo sapiens
accttctctaaatcactccctgcaagatggcaacacgccagctcagctcaccctctgcctaaacatgcctgatgtggggaggccaccaacccgttcaacaratgggcacctactatcatttttgcacagatgctttcttctaatagtctattaggtgtctctgaaaatgtttttcttgtattgcatcctggaggagcatca

SEQ ID NO: 31297 - DNA, 201 bp, Homo sapiens
ccgctctccacccaactccatgtcctaggtaggagggaaaggacgtatatttcctaagctgtatagactgagaacagttttctcatttgcagacatgtttrtatgtcaggagtagagcatgcacgtgggcacatgcacccacaagccttttcacatcaaggattttgacccccgtgaagccttcccaaccagtgaggcata

SEQ ID NO: 31298 - DNA, 201 bp, Homo sapiens
actccatgtcctaggtaggagggaaaggacgtatatttcctaagctgtatagactgagaacagttttctcatttgcagacatgtttgtatgtcaggagtakagcatgcacgtgggcacatgcacccacaagccttttcacatcaaggattttgacccccgtgaagccttcccaaccagtgaggcatagttcccattcttcc

SEQ ID NO: 31299 - DNA, 201 bp, Homo sapiens
tggatgggcactaggtgggcctgtaggaggggtatatgacctttgcccagggggagtccccatctggaggagtagatgggtgcttttactaatccaatggyggtgctcactcttagagacgccttaggaaggcttcatccattcagcaggggaggacaaaaggaacaggggcggggtcatttatagatgacccactacatc

SEQ ID NO: 31300 - DNA, 201 bp, Homo sapiens
attcattcattcattcattcattcattcagtaaatatttattttacagacaatccaggctaagccttggaaattcatagattcatccagcatgaccctagycctcaagttactgacagtttaggtgggggacacaggacaggcagcaagcaatcaaggtgcaatatgggaggtgctcagatacaggaaggaacagggaggg

SEQ ID NO: 31301 - DNA, 201 bp, Homo sapiens
agaagtgggtaacaagcaagatggttctcggtgggtgccacctgttacccaccagggcctgggatgaattccacaatgtcacatggtaagagtgaatcggsgctttattaggggaagggaaagctgactaagggtcagcaggacgaggtgccacaggtctcccattctcccttatgtccatggaggggtgtgctggggcca

SEQ ID NO: 31302 - DNA, 201 bp, Homo sapiens
accctgtctcaaaataataataataataataataataataataataataagttcggttggagcagccaatggatccagttttccattttgagccctgaccrtcaacatggatgatgaagagctcatagaacatgtatatatatgcatgtgtgtgttcatttgtgtagctatgtatttatggatatagatgcttttttaaat

SEQ ID NO: 31303 - DNA, 201 bp, Homo sapiens
aatttgcctcttctctgtctatttcttctttcggggacctcaatgaattggatgaggcccacccacattggtgagggttgatctgttttatttagtctccygattccaatgctaatattttcctgaacaccttcacaaacacatccagaaataatgttttcccagctatctgggcatcctttagcccagtcaagttgacac

SEQ ID NO: 31304 - DNA, 201 bp, Homo sapiens
gaaaactgatggtgtaattcagtctgagtctgaaggcctgaggaaagggatgtgggatagtgggggtgaaccctggtgtaagtcccagagtgtgaaagccytaaaattaggagctctgatatcttatggcaggggaatatcccagctcaaggagagagaatttgcctcttctctgtctatttcttctttcggggacctcaa

SEQ ID NO: 31305 - DNA, 201 bp, Homo sapiens
cgagataacttgctcagttgatagcttccctctgccatcttccttgcatctgataactcactgtgcctctgatagttgttaccagtgctaaactccaggastgtgggttgtggggtaaggaggtgttgttcaacataaggccatgctgacgacattgggttgggggtctctcctgtgtccaggtttatgatggcaacaaca

SEQ ID NO: 31306 - DNA, 201 bp, Homo sapiens
gatttcaccatgttggccaggatggtctcaatctcctgacctcgtgatccgcccacctcggcctcccaaagtgctgggattacaggtgtgagtcaccatayccagcctgcccgagttttatattcacactccctacccttgggcatgctctctttgactaagtagcaagatgtactatgggaaaggaacacaagggatggg

SEQ ID NO: 31307 - DNA, 201 bp, Homo sapiens
gcatcacagcacacaaatgctccctcctatttctgcctgtttggctgccagagctgctcagtatttttttttttttttttttttttttgagacagagtctyactctgtcacccaggctggagtgtagtggtgcaatctctgcctccccggttcaagcgattctcctgcctcagcctcctgagtagctgggactattggcac

SEQ ID NO: 31308 - DNA, 201 bp, Homo sapiens
atggcattgtttctatttttcttactgatttataagaactctttgcatataaaagacactggctctttaatctgtagtagcatggcaaatcttttttgcartttggacctgtgtttacactctgtggtatctttattttattttttgcatagagagattctacatatttatgcacttaaatttgtcagtgttttggcttct

SEQ ID NO: 31309 - DNA, 201 bp, Homo sapiens
gcttgcacctactgtgccacattgcaatcaggggctgcatgtccgtgccttggtcccagaacagaggaggaaaggagccctggagtccatgctgacagagrtctgtttaccttcatgcccagtgccctgagttacgctccaggtgtcccatttggagaagagaagctagtcaggagccctgtctgagagactgtggcagct

SEQ ID NO: 31310 - DNA, 201 bp, Homo sapiens
aaggctgtcttctactgggggataaaggtctgtgcattcattggctacttgatgaacttagcccctctgggcagaggggttccaatgcctggctaagcccycatccctgctgtgccatcggccatggctagtatcttctacctgcaacctggagccagcagaccctgcagcccctcctgcaagccttacacacacacacga

SEQ ID NO: 31311 - DNA, 201 bp, Homo sapiens
ggccaggctggtctcgaatgccggacctcaggtgatctgccagcctcagcctcccaaagtcttttttaaatcactcttattgatatgtaattaatatacartaaaatacaccattttggagtgtacagtttggtgcgttttcacaagttcatgcatccatctagctaccaccacaatcaagacataaacatctccatcgcc

SEQ ID NO: 31312 - DNA, 201 bp, Homo sapiens
ccccaaaagcaggcctgagacaagggttcaagcacaagtgttctattaggaagcacaggtgacactagcagataagagggacataatacagggaagagacwgtagctaataaagggtggtcataccagctaccacaatgggggtctgggccataatcccacagggacactctaggaaacccaggtctgcagaacccagatc

SEQ ID NO: 31313 - DNA, 201 bp, Homo sapiens
ctgattctcctcttcatagcctctccccagggtgtggaagagacagccccagagcagcaaagagtgtgaggagataggcctatcagaaccgggctttccaygtgcagaaagtgtggggtgaggggagagtaatgtgtttcgtgcaacactctcatcaccttaaatggggtgaatcctcattaattccaattaaataactgt

SEQ ID NO: 31314 - DNA, 201 bp, Homo sapiens
agaatgtaaggtacgaagagatcaagtgacttggcagagctgaagtttggatcaagataggtctgatagaagagcccattgtttttcccaagtcccttgartttggggtgactgattctcctcttcatagcctctccccagggtgtggaagagacagccccagagcagcaaagagtgtgaggagataggcctatcagaacc

SEQ ID NO: 31315 - DNA, 201 bp, Homo sapiens
aggtacccagctctgccactatacctcgaaagtaaccatagaaaatacctaaaccaatgagtgtggctatgttccaataaaaccttatttttaaaaaatargctgcaagctgggggtcgtaaatctgccaactcctcgtctacagatgtgagttcagtattttcaaacatcttgattgcagtctgcaataagaaatacatt

SEQ ID NO: 31316 - DNA, 201 bp, Homo sapiens
tttgtcacagttcttgctaagcagaagcagccatgtccctcctcttggggctggcttactgagcatcttgtgatcattttagtcatctcctgtggagagckcccgattccccccaatggccaccgcatcggaacactgtctgtctacggggcaacagccatcttctcctgcaattccggatacacactggtgggctccagg

SEQ ID NO: 31317 - DNA, 201 bp, Homo sapiens
gatccccatgttttagataaggtcactaagtctcagagggtttctgtagttttcctgagctcacacagctgatccctccagagctcaagtttcttcactamtaggccacattgccccctttgaggagttatcttaaggaaaccacacacttctataactgaattataatttgaataaaatgttgtggcatcacagaggaag

SEQ ID NO: 31318 - DNA, 201 bp, Homo sapiens
ttaaataagaaaataaattgttaatttttctctacccttcattgtcccctggaagagtaaatggagaatatatttcaactaggtggattgttaggaaatgrgacaatggtttaaaatgcatcagctctggagtcagacctgattctccttggttaactccttgatagaaactgatgtcagattagggccgggcatcacaca

SEQ ID NO: 31319 - DNA, 201 bp, Homo sapiens
gagatcatcgaggcccagaaagaatgaatgaccttccttgagatctgacaattacccagtaatgtgggattggaacatgttccgtctaatgtcagtctttkctctttcccatctgccattcaggctgtggtctgattccatctaacaaaatatgcaatgattacctgctctgtgccagagactgtgtgatgctgtgcagtc

SEQ ID NO: 31320 - DNA, 201 bp, Homo sapiens
tcaacagtttcttctgaattacttcagaaattttcaaaacatgtaagaaaatgtaaatggaacacaaattatatttcacaaaaatgggatcattgtagatmtatcatatacattactctgtaacatgcttttttctcttagaaatgtctcttatacctctttctgggtaggtgtacatagatttatctcattcctcttagt

SEQ ID NO: 31321 - DNA, 201 bp, Homo sapiens
tctctcctgcttgctccttctcttccctttaagtttaattagttataactactttttaattactatagaagtaatacatgctcagggcaaaaattcgaatkgcatagaagagcatatggtgaaaaaagcccttctccccactgcagagcccagtcccacttatcaacagtttcttctgaattacttcagaaattttcaaaa

SEQ ID NO: 31322 - DNA, 201 bp, Homo sapiens
caatgaaatgagatggctgaatgaaacaaatgatggaatggacagcaagtagattcatgggatgagtagacatatagacagatgaatgtacaagaggaaasacccatggttggtagatggaaggatgattgaataatagatggatcggagttttcataatttattgtttaagcaaactcatttggggattggctggacaaa

SEQ ID NO: 31323 - DNA, 201 bp, Homo sapiens
tctctaaaaaagaggaaaaaaaaaaaaacccaaaacacccagttaagtttgattttcacataaataacaaacactattttaccataaatatgtcccatacratattctattataagtatgacccatgcaatatttacttacactaaaacattattcatttttatccaaaatcagatttagctgggattgtatattttatct

SEQ ID NO: 31324 - DNA, 201 bp, Homo sapiens
gtttgattgatgagtgggtaaagtggaagaatagatgggctagatgggatcaatggatggaatggatgagtgaatggaaagatgagtggaagggtgaatgyatggatggcaggattggcttgatagagattatagcaatgaaatgagatggctgaatgaaacaaatgatggaatggacagcaagtagattcatgggatgag

SEQ ID NO: 31325 - DNA, 201 bp, Homo sapiens
atgcatggatgactaggatggaaggatgtgtttgattgatgagtgggtaaagtggaagaatagatgggctagatgggatcaatggatggaatggatgagtraatggaaagatgagtggaagggtgaatgcatggatggcaggattggcttgatagagattatagcaatgaaatgagatggctgaatgaaacaaatgatgga

SEQ ID NO: 31326 - DNA, 201 bp, Homo sapiens
gaatcatctacttggcagcctctgatggtgacagtgtcgtagtcctgcagctgagggcttaacttgggtgagtccaactttggtaaagccaaagaccccaygtgcatatacaactgggacttgtcattttgtgagaagcgaagacagcagagtcgtccaagtgtggacttcgttggagtcttgctggatccacttgtggat

SEQ ID NO: 31327 - DNA, 201 bp, Homo sapiens
tttgggaggctgaggcaggaggattgcttgaggccaggagttccatgccagctgggaaaacatagcaagaccctgtctctacaaaaaatgaaaaatatcarccagacatggtggggagtgcctgtagtcctagctacttgggaggatcgcttaagcccaggagttctaggctgcagtgatctaagattatgcctctgtact

SEQ ID NO: 31328 - DNA, 201 bp, Homo sapiens
ccaattggaagtacaggacacagccatgggaggtggctgatgcctgtaatcccagcactttgggaggctgaggcaggaggattgcttgaggccaggagttycatgccagctgggaaaacatagcaagaccctgtctctacaaaaaatgaaaaatatcaaccagacatggtggggagtgcctgtagtcctagctacttggga

SEQ ID NO: 31329 - DNA, 201 bp, Homo sapiens
gttggggtttcaacagaggtctgaaggaagtcttgaggagggcaatgacttctacctgagagatgtagacacccatagggaggcaataacatttgagtgargtcctgggtacctacaaataagaggtagccaggcagagaaggggaggaaagaatgtcccaggtagagaaaacagtattgcttaggccgcataggctatca

SEQ ID NO: 31330 - DNA, 201 bp, Homo sapiens
ggtaaactaaaaggtttcagtgttctctggaaccctaaagattcaaggactgtgtatcaggagccacctggaatcaggttgccagatgttccaattggaartacaggacacagccatgggaggtggctgatgcctgtaatcccagcactttgggaggctgaggcaggaggattgcttgaggccaggagttccatgccagct

SEQ ID NO: 31331 - DNA, 201 bp, Homo sapiens
acatttactaaaattctctcttgaaggacattaatgctatttccttttcttcttcttttttttgagtataaacaaggctatgatgaatatcttggagtgtrtgtccagttatcctcatcatattttaaagaactggggaaaagccttagagaggttcaaggatttgcccagggccaagaatctagtttctggttaggcatg

SEQ ID NO: 31332 - DNA, 201 bp, Homo sapiens
aagccttagagaggttcaaggatttgcccagggccaagaatctagtttctggttaggcatggcagcttatgtatctgtaatcctagcactttgaatgactrtggcaagaggatcacttgggcccaggagtttgagaccagactgggcaatataatgagaccctgtctaccaaaaaaaaaaattagctgggtgaggtggtgc

SEQ ID NO: 31333 - DNA, 201 bp, Homo sapiens
aaagcctcttcttcaatgtccttattaaggacagaatccgggagcctgggctgtttatgcaacccagatatttagacttcctaagttgaggatcaactctytgggggcatccacacatcaactacaaataattaagtatctaacaggtagccagagccagcttcatagatatctgacctatgcagtcatacagggccctgc

SEQ ID NO: 31334 - DNA, 201 bp, Homo sapiens
aagaaggcattccttagattgccactacatttttctcccatcactagtcacattactgaagcaaaggagcccagttccagtaaatatgcagacagatcctygcatttcatcctagctaactgtggtgggaagatggcctccttctttctcccctccaactctctctttctctcttttctttcttctgttttattagctgca

SEQ ID NO: 31335 - DNA, 201 bp, Homo sapiens
cttttagttggctgcttgtccctaccttgtcaattgtatttcccacaaagtgacctcagcgaggggtgcatcagcaccagggtgtgcacatcagtaaagayagttggagtcacacctgggaataatatccatcaggtgcatatcaacagaaaaatctagatgaaccactgctcccggttactgaatatgaacacaactgga

SEQ ID NO: 31336 - DNA, 201 bp, Homo sapiens
ttcattttgtgttcagttcacactgttgaatttaaaagatgctcaggactgaaccgtctcccttcctcggctcagtgatcactggataaatgaataaaatrgtttgaaaaaggggagtctcctcacccacccataccttctcccctcaacccctttagtccttgtcctgccttgcactccccctccccctccccaccccag

SEQ ID NO: 31337 - DNA, 201 bp, Homo sapiens
aaaccctggttccttttagtggaaactgatatttaaaatttgggcactaggggtactttttattattgacttcgttcctgtttctaagccttttcaatgarcacagctaggaaacagtttttaaaagaaaattcgtcatgggtttatttcatttccaatgtaaaaacactttttcttttttacttaacttctttaatatca

SEQ ID NO: 31338 - DNA, 201 bp, Homo sapiens
cttccgagtagctgggattacaggcgaccgtcaccacgcccggttaatttttgtatttttaggagagatggggtttcaccatgttggccaggctggtctcragctcctgacttcaggtgatccgcctgcctctgcctcccaaagtgctgggcttacagatgtgagccaccgcgcccagcccagtacatttctttttaagcc

SEQ ID NO: 31339 - DNA, 201 bp, Homo sapiens
gcacagtcactgttgtcatcttgatgggggtatctctcagctccccaacatcccgactgcatgagaagcttcttaagaagaaatgcttcccacaaaatctkctctgagctcttcttcatgaagggaatggctcagagctttctgcagaggagctcaaagccacttttctataatcaactacatgcattacagggagtgatt

SEQ ID NO: 31340 - DNA, 201 bp, Homo sapiens
acaggcttttcagggactccctatatctagggaaccacagtgggagtggccctcacttgcgagcacagtgccttttacaaaatatgtgcttggtgattgcrtgaatgaatgttctcctgaagatgtcagttttcagggatgctaagatttaaactaagatctcctaacactcctccccctcgacttacaattaggcagcaa

SEQ ID NO: 31341 - DNA, 201 bp, Homo sapiens
aactctctaccttgccatcagttctgaccacccacccacctgtgactccctgcgttgggtagaaggtggtgccttcctgagcacattgcggcttctccctygccatagtggccctcccagagtagagtaaggattactccccattcctgtccctcagtagccaacaggaaagcaatgctgtaaacacaagcagctggtttt

SEQ ID NO: 31342 - DNA, 201 bp, Homo sapiens
gagggagagatagaggaaaggaaatatttagttaggtttataggatcagtgatattttcccaagtagccaggtggggcaacaggaaaagggcattacaggyagagggaatagcatgtgcaaaggtctggagacacgaaagtactagtcgcattccaggatgtacaagccattctgtgtagctggatctcaaagtgtgtgtc

SEQ ID NO: 31343 - DNA, 201 bp, Homo sapiens
gacaagagtaggatgaacatgttctctcctaacactgcatggtgaatctggacctgagctggttggcaccgcctgcagctggaggtaactgggacaggcargacctgtcccacccaatcaagaggaatggtaggagccccacccaccttggactcagctgtagctaccagacagccttggaggtttctcaaagctgttatc

SEQ ID NO: 31344 - DNA, 201 bp, Homo sapiens
gaaaactgatattccaatcaaatcagtattatttatcctgtggtttcaagaacctccttgccctagagtgccctgagcacaggctatgagggatgacatasctggggactgggaccgggccccgctgtcagctctgggctgtggaggcagccagggttgttccagctcttgagattcctttctctggactaactcttgcac

SEQ ID NO: 31345 - DNA, 201 bp, Homo sapiens
cagtaattattccactctattccaacatttactgttacagacaaattggggtccaacgtgattctttgtccttgtaagtaacctgtgcttttctgtctatrtgattttctttttttgttgttgttaattaaaaagcccactgggaggtgttgtggtggaggtctcttctcactaattctaccttgcacttggcaaatattt

SEQ ID NO: 31346 - DNA, 201 bp, Homo sapiens
ggttgggccaggttgggccaggctggaacaggctatacactgggccaggagcgctggtgtcatggctagggcttcaccccaggctagagttcaaaggcagragggtgaaggagggaagggagcatagttagctgggcccagaatggacactggaggttacagggtagttttgagcctgatgtgtttactcttactggtagc

SEQ ID NO: 31347 - DNA, 201 bp, Homo sapiens
caaacccttaaaaccttgatctgggacctgcttaaccatagtatgtggagggaccccccagaaggatcataaaagggacttcactttcttttaaataaatwgaaagcttgtttagccagcacctgacatagacttaccacttagtaaatactacaacttatgattcacatgattgtgttttcttggttagagaatcagttc

SEQ ID NO: 31348 - DNA, 201 bp, Homo sapiens
ctgagccacggtctgctcccaccctttcccacccacactgctcctcccccggagttgtcccagctctgccctcatgagctgcatggactgagaccactgtyttccacacagcacccttcacctactgcaagatggccaggcacgctgcaaaggccttagaaaatcacagtttttgttctggctccacagcagacatcctgt

SEQ ID NO: 31349 - DNA, 201 bp, Homo sapiens
tttgcatatgccgattcctctgtctggagtattatcttcccctttcactgcattaaccatggctcaagtttcacttcctcagagaaggccccctgcccccrcagtctaaatcattctcatagaattgtgtgtcttgcccttggataacttatctcagttgatcatgatacattgatcaaagccattaatttattattatca

SEQ ID NO: 31350 - DNA, 201 bp, Homo sapiens
ggtaaaggatggagctgggactgttgttaccacataacagcatccacatgcggtttcttaatcatgtttttacagctgtttccacacagcacacagtgtcrcagccctagatagagtccagcagtggcacaaatcacaaaccatttcaataataatagcactgataatatcatcttcatgtatggagtccctaccatgagc

SEQ ID NO: 31351 - DNA, 201 bp, Homo sapiens
cagcaggtaaaggatggagctgggactgttgttaccacataacagcatccacatgcggtttcttaatcatgtttttacagctgtttccacacagcacacartgtcgcagccctagatagagtccagcagtggcacaaatcacaaaccatttcaataataatagcactgataatatcatcttcatgtatggagtccctacca

SEQ ID NO: 31352 - DNA, 201 bp, Homo sapiens
ggttctagggtgaagggcattttaactaagaactaactaaattccttttttttaagatgaatatttatggaatatctaccatgtgctgggtactgagttgrgctctggaaatataatgaaaaacaaaaataagtacaatccttcctttcatggatcttaaaggagagagtaggagacagacattaatcaaggagcccctaa

SEQ ID NO: 31353 - DNA, 201 bp, Homo sapiens
cctcattattgcgggcttcgtgctctatctctacaagcacaggtaccgtgcaggaaggaggcagggcgggcatcaggcaggcctccctctctccctccagsgccccccgcaccagacccctaagcctctctgtgtcgctcttttcatgccgtgggcacttcctcttttatcgccaggagaagacccaaagttcctttcaat

SEQ ID NO: 31354 - DNA, 201 bp, Homo sapiens
gtcaagtggttgtcagatcaaactgaacatgctggagactgctttcgggagcagcaaagatgcaattttccttttgttttctgttgctgcaccaaattacrgcagatttttcagagtgaaggattgctgagagactgggcaaggggccggtggaggtttttgatgcagagcaatgagatagttgctctgtgtctgcctgtg

SEQ ID NO: 31355 - DNA, 201 bp, Homo sapiens
taggtggaattaagatgctatttgaccaggccataggaatacttggaccctacctcaggccatctcgttctaaaaagccccctagggagatttcatatatyctcaattgcaagatgtactccctcccctcctacaccctaaccaatagtttaaccttttggaaatcaaaacaaatcttactatcaacaaatgcagtttatg

SEQ ID NO: 31356 - DNA, 201 bp, Homo sapiens
cattcattcatttattcagccattcctggggtttcattcattccttgggtttgaggaagtaaagtagggactagtaaataaatgctcggggagggcaaagstttcatgaccagatgagtgtgggaaacactagacccttggcttctgaggtgtggttcaaggccttgccaggaagctttttagaaatggagcctcttggac

SEQ ID NO: 31357 - DNA, 201 bp, Homo sapiens
gaggtaattgctgaggaagaaggagagcgagtgaggattggcaagtccagagccagatggggaacactctcagaacaacatcaagctcctacatgtaggagagagttggaaataatagattaggtggaattaagatgctatttgaccaggccataggaatacttggaccctacctcaggccatctcgttctaaaaagcccc

SEQ ID NO: 31358 - DNA, 201 bp, Homo sapiens
gaagaaaaatgtagatttccaggtcttcctctgattttctgaatcagaggatctgagagcagggtgcagggatctgcgtctttaatgagttcttcctgctyaccttctgatgaccctggtcttaaccccactcaggaatgactagaagaagggctcaggtcctgggtgtctttgagcaaaggctctgcctccacaagtcag

SEQ ID NO: 31359 - DNA, 201 bp, Homo sapiens
catgtcagcatgaagagccactgatggaaagtggtgggggattctacagctgctgagccatccatgcccattgtcttcaggggtaattgtcgaatgacccmcaggtcagggctcagcccagcccagaaaggattgagaagaggtaattgctgaggaagaaggagagcgagtgaggattggcaagtccagagccagatgggg

SEQ ID NO: 31360 - DNA, 201 bp, Homo sapiens
atgggtttcccatgtcagcatgaagagccactgatggaaagtggtgggggattctacagctgctgagccatccatgcccattgtcttcaggggtaattgtygaatgacccacaggtcagggctcagcccagcccagaaaggattgagaagaggtaattgctgaggaagaaggagagcgagtgaggattggcaagtccagag

SEQ ID NO: 31361 - DNA, 201 bp, Homo sapiens
ccagttcctgaacttctccaccgagcccaaccacgactacatagaaatccggaatggcccctatgagaccagccgcatgatgggaagattcagtggaagcragcttccaagctccctcctctccacgtcccacgagaccaccgtgtatttccacagcgaccactcccagaatcggccaggattcaagctggagtatcaggg

SEQ ID NO: 31362 - DNA, 201 bp, Homo sapiens
agcacatgacccgtcattgcccaggaagtaggtctttcactctccctctgcctcttggccaaggcagagagggtctccctagctgaatgtgcttgggtttrggagctcttcctattactctgggaagatttctctctctcgtatctaattagctttcttattgagaggtcactttctttaaatgggaactctgttcatggg

SEQ ID NO: 31363 - DNA, 201 bp, Homo sapiens
agataaacaggaccaagtcttttggtgacttgtaggagctcacaagtaagacagacaaacctgtcaaccagcaattgcaaaacaatgaagtgtttgataarccctagaataatttctttctgaggctctggaaacccaggctactcacctatctttatctgttatttatactctagagaagttcctctggaaacagtgtgg

SEQ ID NO: 31364 - DNA, 201 bp, Homo sapiens
atgagaaggcagagagcatgaacttcctgagcctagtacccaagaatgaactgtggctcatttgcttattcatcccaccttgcattgtgctagttattagrtggaaaaaaaatgaagataaacaggaccaagtcttttggtgacttgtaggagctcacaagtaagacagacaaacctgtcaaccagcaattgcaaaacaat

SEQ ID NO: 31365 - DNA, 201 bp, Homo sapiens
tgtttttcaatatccaccattcagactttcctcaacagcagaggatgtggcagtggcaaagacaaggggatggggggagacgaaagggaaaggggcctgcmtgaaagaccatgtctgtcttcctgctggtgccagttccctgaacctcatcttgttgttcagccccttactgcagcctgcccagggctccactccatggct

SEQ ID NO: 31366 - DNA, 201 bp, Homo sapiens
agagaattgacagcaaatttcagaattctgatttggttttgcgcactccataaagcataattatttgttggtttaagtgagatctccaggctttttcaaakagtcaaacaatttatactcaaactgcattttgacagccagccttggatatgctcatcttttttcaagaccacatgtcttgcttttacagattgtgttaca

SEQ ID NO: 31367 - DNA, 201 bp, Homo sapiens
cactaaaacattattcatttttatccaaaatcagatttagctgggattgtatattttatctggcaaccctaatctggaggagacaggaaagggtaggaggyaactgggtgagctcagtaggctcacccctggcctcaacctaaggctggcactgtttaaatgtcttagatttttagatttaagaatgtaaggtacgaagag

SEQ ID NO: 31368 - DNA, 201 bp, Homo sapiens
tgccagcctcagcctcccaaagtcttttttaaatcactcttattgatatgtaattaatatacaataaaatacaccattttggagtgtacagtttggtgcgttttcacaagttcatgcatccatctagctaccaccacaatcaagacataaacatctccatcgcccccaaaagtttctttgtgccggttcttagtcattctc

SEQ ID NO: 31369 - DNA, 201 bp, Homo sapiens
aataaatattttgggctttgcaagtcatcgtcttgcacaactccttaactctgtcattgcaatgtggaagcagccacagacaatttgtaaatgaatgaatrggcatggttgcaatctggtaaaaccatatttacaaagacaggcagcaagctatagtttgccaacccctgttctatgaaatgtatttgttctgtgtgccag

SEQ ID NO: 31370 - DNA, 201 bp, Homo sapiens
aaccaactacatcatctgtgaggcttctatggtaggaattagcaaacttttttttctgtaagaagccagaaaataaatattttgggctttgcaagtcatcrtcttgcacaactccttaactctgtcattgcaatgtggaagcagccacagacaatttgtaaatgaatgaataggcatggttgcaatctggtaaaaccatat

SEQ ID NO: 31371 - DNA, 201 bp, Homo sapiens
aaggccaaacccaaagtcaaggagtgggggaatgtactccacctctgtaatggagggagctaaaaaatcacattgcaaatggtgagaatacaatgagtagygacaatttgggcccatattctgatctaccataccctgtcagggctgactcagaattgaggtagagaaaaagctgtggagaagcagaggtgggctgcaagg

SEQ ID NO: 31372 - DNA, 201 bp, Homo sapiens
cctggatttaaacctagtctaattctagagcccataggcttaaccactgtacaggtttcccagttaaaaatgtagattctggccaggtgcagtggctcacrtctgtaatcccagcactctgagagactaaggtgggagacttgcttgaggccagtagttcaagaccaacctgggcagcatagtaataccctgtctctacaa

SEQ ID NO: 31373 - DNA, 201 bp, Homo sapiens
gctcctttggtcatccctctttcctggcctcacagaactccccctgaggatccctggcaggctttataatgtgagtcctttcaggctgggattttttgttytgttttttttgtttgcttgttttttgagacagagtctcactctgtcacccacgctggagtgcaatggcatgagctcatctccctgcagcctccacctcct

SEQ ID NO: 31374 - DNA, 201 bp, Homo sapiens
tgtcattttgcagttgaggaaactgaggtttaaggaaattaaattacttgctaagaccacacaagtagggagggggagagcctggatttaaacctagtctrattctagagcccataggcttaaccactgtacaggtttcccagttaaaaatgtagattctggccaggtgcagtggctcacgtctgtaatcccagcactctg

SEQ ID NO: 31375 - DNA, 201 bp, Homo sapiens
ctcctgcttcagcctcctgagtagctggggctataggcacatgccaccacccttggctatttttttttctaaacttttttgtagaaatgggggtcttgctmtgttgcccgggctagtcttgcactcctgacctcaagtaatcttcccccttcagcctcccaaagggccaggattacaagcgtgagctgcagtccctggttg

SEQ ID NO: 31376 - DNA, 201 bp, Homo sapiens
ctgtcatcaaggtggctttttaaggcctttagctgctcccgtctgcctaggagcattgggactggctcatggaacactcactgagtacctagtgcagtggycctgggttgggggtcatggacacaaataccttttaaaaccaagttccttcccccagggacagttataagctactaaaggccaaaggagctccaagcacag

SEQ ID NO: 31377 - DNA, 201 bp, Homo sapiens
gtcctgctacttcccaagaaaccaggattccctctcattgtaagtcatcctcctccccatcctcagccttgccatctgtgagagcctcttcctgacctttsaccttgctgcctccaccctcaccccagccaggaccctcccctccgtggccttttctttaaccaggcttcaaccccatacctctgtcatcaaggtggcttt

SEQ ID NO: 31378 - DNA, 201 bp, Homo sapiens
gcaggttcatctgcatgggctcctggttgagtgagagtgggttgttccaggtctggaagaaggtttgctcaccaaagaagggcattgaggaggctggaggrtttggagaagggggatggctggctggcttggccggcagccacaggtctctgaaaaaacacaatgagggtagggtgctactggcaaaggcaggccttggtg

SEQ ID NO: 31379 - DNA, 201 bp, Homo sapiens
ctggtcacccagtgatagtattaggaagtggggtcttgggaagttgttaggtcatggaatgggattaatgctcttatagagaaaagaaaataccttagaaygctccctttcccttgtgccatgtgaagacacagcaagaaggcaccatgtccaagcctgaacagacggagacacacatcttgatctcctggggcttacagt

SEQ ID NO: 31380 - DNA, 201 bp, Homo sapiens
ctaactgcggggtcttcagcgtgtctaaaatcgatctcaaagataagtgggtgggggagcgatgattcaggtatccagctggggagattcaatttcccatmccctcccccagccttagctagcgcctttgaggaatcctccctgctggaatttatctaccaaccctgggaaagagcagagcagtggtaaatatctgattag

SEQ ID NO: 31381 - DNA, 201 bp, Homo sapiens
tccacctacttctctttcatccacagtagacatcttttgttttgtctgcctaggactcctcacttcttttgagcacattccttcttttggagaattgtccscaaactagtcatggggttctagtggaggctacctccttggccccaggaatgggtacattccccagctaaactaatcagaggcctctgatgggctttttct

SEQ ID NO: 31382 - DNA, 201 bp, Homo sapiens
aaaaacctactcctttatagcatgggagagtggccctgattattcagtccacctacttctctttcatccacagtagacatcttttgttttgtctgcctagsactcctcacttcttttgagcacattccttcttttggagaattgtccccaaactagtcatggggttctagtggaggctacctccttggccccaggaatggg

SEQ ID NO: 31383 - DNA, 201 bp, Homo sapiens
tgccctctatcctatctatcatcatttatctcattacccacgtttattttctagtgagtactttaccctatcaaaaactgattcgatatatgtatttgtgktgtttgtttgtttgtttgttaagatggagtctcactctgtcacccaggctggagtgcaatggtgcaatctgggctcgctgcaacctccacctcctgggtt

SEQ ID NO: 31384 - DNA, 201 bp, Homo sapiens
caaggtggctggcctacctaagccatccccttcctccctgtgagccaatgatctctcataaattgagcattctggactggccagggaagcccctccagggracaagctgtagttgtgtggcaggatttgggggcctataagatatcaggtgccatcaaggaagtctgggctagtagggggtctcgcaaaggaacggattac

SEQ ID NO: 31385 - DNA, 201 bp, Homo sapiens
tatctgattagagaaaatgcctagcaagctgcaattccatatattgtaagtgataaaactgtaattgtttgttgacagtgtacattagctattcacagctygcatcaatatagtaccgagaaactagggtctaggaatctttaatggcagtgcaaaaatatactggaactaagttggggaataaaatcaacaatttctgct

SEQ ID NO: 31386 - DNA, 201 bp, Homo sapiens
atgcctgagttctgctacttgatagctgtgtgacctcaagcaagtcgcctaacctctctgtgtctccatcttctcacctgcaagccacaggttataaaggsttgctgtaatagatgagtaaatacatgcgagggacttagaacagtgcctggcgttcagtaaatactcagggcagcatctgtgtcccaagtggtacgtaag

SEQ ID NO: 31387 - DNA, 201 bp, Homo sapiens
ttccagatcccctttccagccttctccaacctctcttcaaccttctctggcctgggaagctggtctgtatgagccacatcagaggatcccataccctctgrtttccatctcactttggtcaatggggccctccacaggagatcagagatggaggaaagttaagtcaaggcatttattctcctggatccccaccccagggtc

SEQ ID NO: 31388 - DNA, 201 bp, Homo sapiens
aagttcatacagttagtagtgggaacagcattcaaagccagttctttcttcatctaaaaccaatgctcatgattatagtggtggtggttagagcaggaatrggggagagacaccaatgcttgctatcagccacccaatattgtaagacaaaatctcctaccctcatcaggactggcatttttgggaaggcaaagtctaagg

SEQ ID NO: 31389 - DNA, 201 bp, Homo sapiens
cagtacaggcattgccccctttctttatctcctcctgcctagggtggtaaaactctacttttatgagcctctgaggtctctgctactttcccacactctgccctcaccaatcattttaatttgagtggccatctgtttcctgcggggaccctgaccaaagtaccatggttttagcctttcaccatgtaggcatcagtttaa

SEQ ID NO: 31390 - DNA, 201 bp, Homo sapiens
cctacagaacagtttttatatacttaataattacttatttagtagctgttattctcattttacttttcttcaacatttgtgggaaccccaaggagggaagrctgactgtctcagaggatcaggaaaggattcacagaggagggttgcaggaaaatgaataggagtttgtccactagacagaaagacaataaatgccctgac

SEQ ID NO: 31391 - DNA, 201 bp, Homo sapiens
caggacagatctagaacaagaccaactctgggttgataactcacacagtgatctatggatactcctcacaggtctttaaaaacctactcctttatagcatrggagagtggccctgattattcagtccacctacttctctttcatccacagtagacatcttttgttttgtctgcctaggactcctcacttcttttgagcaca

SEQ ID NO: 31392 - DNA, 201 bp, Homo sapiens
aactgaaataaagaacattctaccaaatacctgatcagtacccttcaataatgtcaagattttaaaaaaccagggcaaggctaagaaactgatgcagattkgaagaaaccaagaagacaggacaaatgcaatgagagatgctagactgaatcctgtgacagacaaaaagtgggccactggtggaaatctggggaaatctga

SEQ ID NO: 31393 - DNA, 201 bp, Homo sapiens
tggacttagccacccactactaatgaatagaacatggaaagggacaaatagtaactttacagcggggaaatctggcagacaccactttaaccaagtgatcraagtaagcatcatcaataacaggtcatgttgagatcacagaacccctttctgtgttgccataataacagcatctcaccgccatgatattcttcccaaaaa

SEQ ID NO: 31394 - DNA, 201 bp, Homo sapiens
tggagtccaaaaagacaaggtccgatgtcccagagcttagccctgaagccactaggccctgttgaatcatctacttggcagcctctgatggtgacagtgtmgtagtcctgcagctgagggcttaacttgggtgagtccaactttggtaaagccaaagaccccacgtgcatatacaactgggacttgtcattttgtgagaag

SEQ ID NO: 31395 - DNA, 201 bp, Homo sapiens
ggctgaaccttcacatccatcatctcatataatttcatcctcaccatatctcaatgaggtggtatcatttgtcccattttacagatgaagaaacaaaatcagagagattttctaactcatccagacttaagcgaccagcaaatggatttagatccagaaggctaagttcataaattttaaaacctgacctcgctttaacca

SEQ ID NO: 31396 - DNA, 201 bp, Homo sapiens
catcctccagctgttgggcagctcactcattcttctggacatcagagctgctgatctctggcagggaccactagctgcctcctaacaggggaagggacatmcatgatgctcaaactcagagtggcagttaagtggcaggcacacactgatgtgggcagctcctcaagaagccatttacaacagtccctctgggtgagaaat

SEQ ID NO: 31397 - DNA, 201 bp, Homo sapiens
acagctggttgctggcagattcaaaattggaagcccaggtcttttttactccgcagcctaagacatataccaatatatcacctactgagaggaaaatggcmcctgtttttgggtagctaaatgtccattctatggaagaaagtttaaataactgggagaaactgaaccaatgggtagttgcaggagtcaaaccttgactca

SEQ ID NO: 31398 - DNA, 201 bp, Homo sapiens
atggggtatgtggtgggcactcaataactgcactgaattaaatcggattgaattgaaccaaattgaattcacaggcagatattctccagcagtggctgggwcttaagttcattgttgtcttaatcatcttgtggtagattgcattgcctcctccataagccaggctaagcacttaggtttttgagaatagtgtatcttaag

SEQ ID NO: 31399 - DNA, 201 bp, Homo sapiens
tgagcccagaaagttaacctagcctgcccaagatggctcagctaggaagtaatagagccaagactttgtctcccaagcccatgctcttaaccactcaccartcccaatttctttcatatatattaggcctgagaatacctattagactaaactggtggtatctttctccatacacatattttgtaagaaatatgggcacag

SEQ ID NO: 31400 - DNA, 201 bp, Homo sapiens
gcggtgccaccctctatggcaggaagcaggttccttctccaagtcatgtctgccagtgacaggtggaaagtgggcaaggctgggaaagcaggagccagtgsaggccaggctggggttccccagagaaagagggaagttgatggccaggtgtactggctggtctgggtaccacagagtgccctgtccttctacccctgcact

SEQ ID NO: 31401 - DNA, 201 bp, Homo sapiens
cggcatcggactgaattgtttttctggctagatttgtccctgccccttgggcatatcctgcccctaggggagagaaaaaggccgactcaccggcgcttgcmccgctcagcggtgctggaatcctgccctatagagatccatttgctcgcagctccttgctcagtagagaagttgcggggagggggccttgtgttcatggct

SEQ ID NO: 31402 - DNA, 201 bp, Homo sapiens
gtatggattacatttcaagaatgaaggaaactgagagcacttatatctgaggatctctattttctcaatgaagcagaaaatgcgggcgtctcctgagaggsaagagaagcagagccaagttggaatagcagctgtggggaatgcggaacgggaattttgccagcatgcctacaaagttgtcaagtggaataaggctgcttc

SEQ ID NO: 31403 - DNA, 201 bp, Homo sapiens
tccgaggctcacacaaggctgagttgtgagaggggagcagtcgtctgggccatttgatgggagctgagctagttatttaagtctgaacagaacatgacccrcctctgattatctcacctggaagtgggttcaaggtactaatgactggacttcttaagagggtctacatgttggtctttctttgacaggtgacatcgtacg

SEQ ID NO: 31404 - DNA, 201 bp, Homo sapiens
tttcagcaatgctggtgctcacccgctccaggaaggctggagctcctcacctcctgattgctttagtaaatggagtgtcctccaggtcttcctgagaactrtggtcaacttttacacagcagacctagcccagcatgccacttctcccagcctttcccttcacagtttgcatggcagttctggtgactctactttgtttaa

SEQ ID NO: 31405 - DNA, 201 bp, Homo sapiens
cctcagactgtgtctcgtgacttgacttttctgctttgggactttacagacctcaggctgctggagtcagaccccgagtccattggccgccactttgcttycaacagcagctcagtggcagccgcgatcctggtgcctttcatcgccctcattattgcgggcttcgtgctctatctctacaagcacaggtaccgtgcagga

SEQ ID NO: 31406 - DNA, 201 bp, Homo sapiens; identical to SEQ ID NO: 6248

SEQ ID NO: 31407 - DNA, 201 bp, Homo sapiens
catgcaggaccctgcccccaaggactgagtgtgcacgtggaggcaggcgggcagccctgggcacacctgcctcccgtgctgagcaggagtgaggagcaccmtgagtggcagccctgcttcccaagagtgtatagtcggggagggtagccaacggagcctcagactgtgtctcgtgacttgacttttctgctttgggacttt

SEQ ID NO: 31408 - DNA, 201 bp, Homo sapiens
tctgagcagcacaaggtagatgcatgcaggaccctgcccccaaggactgagtgtgcacgtggaggcaggcgggcagccctgggcacacctgcctcccgtgmtgagcaggagtgaggagcaccctgagtggcagccctgcttcccaagagtgtatagtcggggagggtagccaacggagcctcagactgtgtctcgtgactt

SEQ ID NO: 31409 - DNA, 201 bp, Homo sapiens
atgtattttgttttacatattttaagacaccatttgaggtggtgtcacgaggctccaaggagggcatggcacgacaaagatggaggacttcaggtcatggrggtccagggataggcttttttggcctgctaatcccctgaaatgaatgaaaacggcagaaggttagcttcctatgtatgtgattctagaaaaagtatttct

SEQ ID NO: 31410 - DNA, 201 bp, Homo sapiens
gttatgggagcacacaggaaggtcaggagtctagccagcgcctatcagggatgacttcctgaaggaggcaatgttaaactgagacctggaggtctaggggrcagttagtgtagaaaagactgagaagagtcaatcgcaagtttttcacctggtaaagctattattgttaatggcctgggaggctgctgctctgggtggaca

SEQ ID NO: 31411 - DNA, 201 bp, Homo sapiens
ttatgattatttctttaggagcaattcccagaatgaatattttttaagatacttgattcttattgccaaattgttttctaaaagcatttgatcattttacrctgccacagtatgtgaatgtccgaggaaacagaccttttaaaattaaggattataaaatatgtcatagaagaaagagaacggactttggagtcaaagaga

SEQ ID NO: 31412 - DNA, 201 bp, Homo sapiens
tcagtatatatatatatgtcagcctcattttttttaacaatttccctaataattgcatttttcactatttcaaataatgttatagttaacatcatcatgartatacctcagtgcacattggagcattaataggatagctttctttaaaatagaatttctgggtcaaagtatacattatttttaaatttagactctgctaaa

SEQ ID NO: 31413 - DNA, 201 bp, Homo sapiens
aattacagggcctcctctgatggtgctttgggtgtcttccatttcctattaaccgtagctttcaaactttgttttgctcatcccaccccactgtaaaaaamaaaatcacaacccagtataagcatatatctgtagagctaaaaggaaaatatgaccaagtggtatttactgtgtacaatgtagtctgaaaatgtcattttt

SEQ ID NO: 31414 - DNA, 201 bp, Homo sapiens
atacgttttccataatggttacattaacttaaattcccactaacaatgtgcaagagtttccttttctccacctccttaccaacacttgttatctttaatcwtatttataatagtccttctaacaggtaggaggtgatatctcattgtgggtttcacttgcatttccctgatggttagtgatgctgagcatttttcatatac

SEQ ID NO: 31415 - DNA, 201 bp, Homo sapiens
gccccaaatttataggactagaaaactgagtttcattaacataaaaagtaacatgttcaaggttgaacagccactcacaggtgagagtgtggattttgacrgctgattgcttgacctaagcctgtgcttcatcctgcctgcacagagctgttgccagggcactgagggtccagatatgtggtctcagcagctgagccggac

SEQ ID NO: 31416 - DNA, 201 bp, Homo sapiens
tttgtgtgtgtgtgtgtggagaggggggtgtattaatgggtgatgttataaatgaaaacaggaggactgaacttaaaagaaactggtcaattgcaaaacaracacggataaacaaccctttagatgtaatttgtggtttatctggaggtggaggtggcgctgaagaggaacccccgccccccaatattttatccttagctg

SEQ ID NO: 31417 - DNA, 201 bp, Homo sapiens
cttatattttgttgtgcctgtaaggtttcatctgataaaaggctgctacagccaaaagaactttagagacttctaaagggctgcacccttgtaagagtttstgttgagccatggtttcaggctcctctgcggatggtcctctgggtgccatctgagcagcacaaggtagatgcatgcaggaccctgcccccaaggactgag

SEQ ID NO: 31418 - DNA, 201 bp, Homo sapiens
gacactgctaggtacttgcctgtgtggcactgggtttaatatcacttaatggttgatgatagccccaaatttataggactagaaaactgagtttcattaayataaaaagtaacatgttcaaggttgaacagccactcacaggtgagagtgtggattttgacggctgattgcttgacctaagcctgtgcttcatcctgcctg

SEQ ID NO: 31419 - DNA, 201 bp, Homo sapiens
ttgacaaagtttcctgttcagacctggagaggagagcccccaactccagggacattggctcttagatacagcccccagccacaccctccagccagccctgkgtgtcacccctgcctcaacaaacaacgacactgtggagtgtcttagagctctcagggtgccttgactgtgatgtcgtttctgccctagcccagccctaga

SEQ ID NO: 31420 - DNA, 201 bp, Homo sapiens
cttggccacctgcaccaccgaccagttcgggttctccctcttcagctgagcatagtggtcttggcagaagagtaggaaggatgatggaggccgtctgggtkcctggggatcccgctttctccgtttcttcctcttgccaacataattcatcatttcttcctggtatcgggctttgtcgagtttggccagggcttcatattt

SEQ ID NO: 31421 - DNA, 201 bp, Homo sapiens
catcacaggtctcgtcagagtcctccggagccaccttcatctaccaaggctctgtcaagggccaaggctttgggcagttcggctttcaaagactgggtaamtagtgcttgtcccccggaagtgtgggcccgggtgggtgggagagaaaccgtgtgtgccgtggtcaggtagaggactggggaagttgaacagtctgaggcg

SEQ ID NO: 31422 - DNA, 201 bp, Homo sapiens
agaacaaaccctgtgtgtcagagcagcaggtcagtgggtgacctgctgggcagcgtgtatgatgagagaggagttctagatccttccagcagcctcccacstgctctctgtgctccccaccatcacaggtctcgtcagagtcctccggagccaccttcatctaccaaggctctgtcaagggccaaggctttgggcagttcg

SEQ ID NO: 31423 - DNA, 201 bp, Homo sapiens
cccacccttgcctaggtgtgggcagagaacaaaccctgtgtgtcagagcagcaggtcagtgggtgacctgctgggcagcgtgtatgatgagagaggagttmtagatccttccagcagcctcccacctgctctctgtgctccccaccatcacaggtctcgtcagagtcctccggagccaccttcatctaccaaggctctgtc

SEQ ID NO: 31424 - DNA, 201 bp, Homo sapiens
acatttgagtgtcacaacattccagtgtgattgtggcaaggatggtcatccccactgtatccttaggaagactaaggtttacagagttccatgcagcctgycctgagtaaatgcagaagccagaactcggatccagggtcttctgactctgaatcagccaccgtgtccacaacagagtgtaatattacaactttgttcagg

SEQ ID NO: 31425 - DNA, 201 bp, Homo sapiens
attcgcttataaaacacctgctctatgttaaactaggttaggtaatagacacgaagacgtcgcaaattcctgagtattttgaatttttaatatatctcagytatttttgaattcttctctgcccacttgctacaaatatctgacttttcttcaaatatggtttcagtctaatggatccttggttgtctgccattgcaagag

SEQ ID NO: 31426 - DNA, 201 bp, Homo sapiens
gggatctgggcaggggaattaggaaagcaagagttacccaccaggatccagggtgtgctacagtactgacaatgtcgacttttactgcttgtgttcattcrttcattcattcattcattcattcacgtattcattccccacatagttactgagcacctgttaggggccagccactgagggagaccatataatatgttaatt

SEQ ID NO: 31427 - DNA, 201 bp, Homo sapiens
gcatagcaggatgtttagcagcgtgcttggcctctgcccattagatgctagacacagtgcagtaggagggagccacagggaccagcagccattagcagcgcccccccacacacacacagtcatgacaaccaaaaaagtctccagacattgccagatgtccctatgtgcacaagcacctccagttgacaactactactctga

SEQ ID NO: 31428 - DNA, 201 bp, Homo sapiens
cattggatcagtttcacccacagtcagctttgtggcactatagtcttaagtgatttatggcacttcagagctaatgattaccaacttctaatggtattgasagagattttttcccagataaacaaaaagaagtaaacttaaaataaaagataacctacaacatagtacattatattctggtctcagtccaatcagaattta

SEQ ID NO: 31429 - DNA, 201 bp, Homo sapiens
ctcttttttttataggtatggctttgtttttaaagagctgtgttcatagagtattgtgtgagtgtgtgtgtatgtgtttaagtatatacccactttttatwatgagtaatttatactctttgtgaaaaattcaaagcatacctgagagtacagaataaaacgttaaagtcgtctatgtgttaaatccctaccctaattcca

SEQ ID NO: 31430 - DNA, 201 bp, Homo sapiens
cattgtaaacataaagcatggtcattaaagaaaatttagaaaattgagaaaaactgaataaagaaactctatgcatgaacattttgattcatttctttctyttttttttataggtatggctttgtttttaaagagctgtgttcatagagtattgtgtgagtgtgtgtgtatgtgtttaagtatatacccactttttattat

SEQ ID NO: 31431 - DNA, 201 bp, Homo sapiens
ccattcatttagaaatacacatgcaaggtgagcaacacaaactcagccatggctcttggggtgctttcatctagtcagggagaccttaatgaaaactactyaccccaataaacatctaattaggaattatggttagtgctagtaaagaaaagaaaagaaaagggatgtcagtcaggataggtcaggttatactctgtgtac

SEQ ID NO: 31432 - DNA, 201 bp, Homo sapiens
tgctgcatagccactgccagaaggcattggccacgaagtgggaggcaggcttctggaacatgacgacctctcttcctcaaagcttccttccccatttccawccttgccaacctcctgacacgtggtgctggatacttcagtctctgtcatggaagaccaagttggctcaggggttttcaggcttctgtggaagtaaatgaa

SEQ ID NO: 31433 - DNA, 201 bp, Homo sapiens
gtgagccaagatcgcacccctgcactccagcctgggcgacagagtgagactccatctcaaaaaaaaaaatgcctttctttactcctgcagcaaagccctakgcatgagaatgctgggccgagggcagtcatgcctcccttcttgacatatgttgtcaaactgtcttctagaaactgtcccaatttacattccccacagcag

SEQ ID NO: 31434 - DNA, 201 bp, Homo sapiens
ctccgctcatccccaatgggaaggtggtggggtctgacttcatgtggggctcaagtgtgacttatgcctgcctggaggggtaccagctctccctgcccgcrgtgttcacctgtgagggaaatgggtcctggaccggagagctgcctcagtgtttccgtaagttgcttacaagggcctttggtgcatcctcttcaatagctc

SEQ ID NO: 31435 - DNA, 201 bp, Homo sapiens
atttaattatcactgtaatattgtatttgaagatactgaggctcagaaagtaagcagctgggccaaggctgtagagcaggtaggtaaagaaggcgggattwaacctcaagtctacctgaccctagggcccatctttttggaaagcccttgttacagtgctgggcccattgttaccattcaatacatgttagatactattac

SEQ ID NO: 31436 - DNA, 201 bp, Homo sapiens
cttaaaaaaaaagaaatttagaatgggtaatgtccaactgggatcctgtgaggagacagggcatccctgatctgacagtttcccttcttggatgcatgcasggagtgatagggatggtattggaggagaagtggggtcctggccaggagtgaacaatgctatatctctcttatcctagtcataaactgtggtgaccctggg

SEQ ID NO: 31437 - DNA, 201 bp, Homo sapiens; identical to SEQ ID NO: 6251

SEQ ID NO: 31438 - DNA, 201 bp, Homo sapiens
ataccaattaagtgcaattataatccataaacctcaaaaaattatgtgtccatcttcaaggttttcaaatagaaaacagaataagttctattattaagtasgtacatctatttattgattgaaagtaagtgagtgtgacggatgtaactgtaaagggaaaaagcagagactttgaaatttgagatacaagtatattatgag

SEQ ID NO: 31439 - DNA, 201 bp, Homo sapiens; identical to SEQ ID NO: 6253

SEQ ID NO: 31440 - DNA, 201 bp, Homo sapiens
ttactgtctgtctcccccactagacaacaagctgcatgaggatgactacagggactctgtacccccagtgccacacacagcacttgataaatatttatcarttgcatgaatgaaaggcacagggtggagtggaagggagagaatgagtggtaattaatgtttcttgagctccccagggcctggagtctcatgttcataatc

SEQ ID NO: 31441 - DNA, 201 bp, Homo sapiens
ataaccacctcgtgagcaaggccttaggatccccattttacagataaggaagttgaggcctagagaggtgagttaccttgcctgaggtgaaccaggacctraaggtcatgcacaatttaaaaatcagtctggttccaaagcccacactctccaccgtgttcctgctgaaaataagccctgcacagttctccaggcctgccc

SEQ ID NO: 31442 - DNA, 201 bp, Homo sapiens
aaggaagctttgctggcccattgcagatgggaaccccaggaaaacaaaatgcagacaagcctggagaggcaaatgtatcccctttgtgcccaggccctggmagctatgttgaaggaagctgtatgggacttggttatatttcactggctttgtttatgtgactgtgtgtgtttgaaggataatcttttattcattcaacat

SEQ ID NO: 31443 - DNA, 201 bp, Homo sapiens
cacaagcaaaagtctggggccttgagagttccagggcattaaatcaccatcagaataagactagggtcttgaagctcatgatctggagcacttagagtggrcaaggagcaatgaccccacagctactatgacacatggtagagtgtgggtgctgcagccaggatgcctgagttctgctacttgatagctgtgtgacctcaa

SEQ ID NO: 31444 - DNA, 201 bp, Homo sapiens
gctaatcataatagttaataccagatgcctgctaagagccaggcacagtgctaggcacttggcaagtaccatctcctttaatcttcatcattatcctgcaraggaaacacggtcatcacctcactttatggacaaggaagctaaggcccagagaggttaagccaatttcccaaggccatctgaactcctgccttttgagtc

SEQ ID NO: 31445 - DNA, 201 bp, Homo sapiens
gtggagaaggcaggactggggacattagggagacacccccatggggaggaggacaaacagaggctgggggccatgagggaggagtcagcttgggaaggctyccacgggaggccacaaagcctctgacccgatggcctctcctcccagtgccgtgtggaggcaacctcacagagcgcaggggcaccatcctgtcccctggct

SEQ ID NO: 31446 - DNA, 201 bp, Homo sapiens
tacgcgatgggcggacttactcagcgcccttgatcggggtttaccacgggacccaggttccccagttcctcatcagcaccagcaactacctctacctcctyttctctaccgacaagagtcactcggacatcggcttccagctccgctatgagagtgagtctcagtgggctcaggaaaagggatgacaaggtcagcccaggt

SEQ ID NO: 31447 - DNA, 201 bp, Homo sapiens
ggcaggcagatcacaaggtcaggagatcgagaccatcctggctaacatggtgaaaccccgtctctactaaaaatacaaaaaattagccaggcgtggtggcrgacgcctttactcccagctacttgggaggctgaggcaggagaatggtgtgcacccgggaggcggagcttgcagtgagcaacgatcgctccactgcactcc

SEQ ID NO: 31448 - DNA, 201 bp, Homo sapiens
gacctgtttgctcttgagcctgtctgcatttggtcattcacctcctacgaatgcactcaagttggtgctgagggcccagggatgcccagcctcactttctrcttcaaagtcacccaaccagactcagagggaaagagaaattattttactgaatttgcttacagcaaaaagtaagcagaactttaaaagaatagagagtat

SEQ ID NO: 31449 - DNA, 201 bp, Homo sapiens
tgtggttcattaatataccttaggttcttcaaacagaaaactccctttccctgggtcctagcctcatttaggaactgagccctctggatacttcctcttasagggggcactttgaataaggtgaatcttcatagcccaagttgcagcggtgcataaggacagtgtgggcaaggacaggactgatgccagggatttgacaaa

SEQ ID NO: 31450 - DNA, 201 bp, Homo sapiens
gggatatgtttgatctcctgcccttctagcaggctgcagccagtgagcaagaggactgcctcaaagtccagtatcagccaccccagcatcctggaaaaagscatggctgcctgctagcttggcaattaaccattgagatttggaaaatcagggctatgaaacttactttgtatagccacagaatggtaagttctgtggatt

SEQ ID NO: 31451 - DNA, 201 bp, Homo sapiens
gatgacataggcatgaccctttcatgggccataagaccctgcttccaggctgttgtccctaggagtcctgtgtaggtgctgttgggcctacagaggcctcstaggtacaacagcaggtgataagatgtacccctcagcagacaaatcaattgtctcatgtggttcattaatataccttaggttcttcaaacagaaaactcc

SEQ ID NO: 31452 - DNA, 201 bp, Homo sapiens
gggatgcagacactgggagcttgcagtcagctggcccactctgaaagatcgagtattacaggaaggacactggcaccacctgctacaggtgtacgtgtatsaaaaggcagtgttactgacagagctgtaacactgggggcctaggcagctctggagtgagacccagctcactaaaagtgacccttggaaggaccaccttcc

SEQ ID NO: 31453 - DNA, 201 bp, Homo sapiens
gggtgctccctgaggccctctggtctttcactgccctcttcactccttctatagctctctgtggtggcttcattcaaggctccagtgggaccatcttgtcrccagggttccctgacttctaccccaacaacttgaactgcacctggattatcgaaacatctcatggcaagggtgagtgtttcagcccatagcaggcattgg

SEQ ID NO: 31454 - DNA, 201 bp, Homo sapiens
gccaaagaagatacaaaagtgagatgtaggccctgagcatctctctagaagggagaggggtgaaaggccagccctaacatcttatcaggggatgtgcaagstgagaaaactggcccctgaacatctgccaggagtgaatcagaagtaccaaaataaggcctgggccatgaacattgaggggagggtcccgcaaacagagga

SEQ ID NO: 31455 - DNA, 201 bp, Homo sapiens
ctactcagaaggctgaggtgggaggattgcatgagcccaggagttcgaggctgcagtgagccatgactgtgcctctgcactccagcctgggtgacagagtragaccctgacttaaaaaaaaagaaatttagaatgggtaatgtccaactgggatcctgtgaggagacagggcatccctgatctgacagtttcccttcttgg

SEQ ID NO: 31456 - DNA, 201 bp, Homo sapiens
caaacccatacaccctgcaggcattcccaccaggtgctctgtgcctgtatcatgagaagctgtttgcctagagggctctaaggtcagatgtggattcaaasctctgctccgggatttggggaagctatttaacctctctgagcctcggtttctttagctttaaaacaatgctatcaggaataataatttatatttcttagg

SEQ ID NO: 31457 - DNA, 201 bp, Homo sapiens
tgcctgtcctggctcctcattgcttgtgcctcagtgcctcagtttaccccatagaggagccactttagcttctggttcatcttctcacctttccacaataytgttttggcctgaataccctcttttacaggcttgccccctgtaaccctgccccctccaccacggcctctgtgaccttaccttctcctaccctccctctta

SEQ ID NO: 31458 - DNA, 201 bp, Homo sapiens
tggtctgtggcctgagttgtccagataacccttttcatttagtgttgtctttatggatgccacagaggtctccgggcaatgacagcccagcctttgcaccraccaggaagagtcacaggcaggcctgcttcctgacttctgtttgctgtctgtttggctctcacaattattggaatctgtcaagctccatcaagtgacatt

SEQ ID NO: 31459 - DNA, 201 bp, Homo sapiens
ctagacattcatgccctcaagggactcgtgtgttcaaacaagtcacagcacaggctggtaaagtcagcaacagcgatttgtgcaagggagtaccagaaagrgagtaatcaatctgggaagaggtgggaggagttctctaaggaggtgatgtctagctggacatggaaggatgactcttctgaccaggtaaccaaggtgagg

SEQ ID NO: 31460 - DNA, 201 bp, Homo sapiens
tccctccactggagtcagggttgctactactgagatttacagaagagaactagcccagaaaacaccagatctggccacaccaaggactgggtgcttcctcwtcttacacccccgtccccattatcaccatttgggtcttaggtgggatcctcatggatttaagtattggacaaagagaacatcccttatagttcctaatct

SEQ ID NO: 31461 - DNA, 201 bp, Homo sapiens
ttgtgaggattaagtgagacaatgactgcgagccccaacaattgttagctaatcatataatatcactttctattctgcagagatgatagaagccatcagamaatagcttctcctactttcagcttccccacccacacatctgctctgtgtacatccatccttgccccttctctcccacctcagtagaagaatctctctccc

SEQ ID NO: 31462 - DNA, 201 bp, Homo sapiens
gccagtgtgcgcatgccctcttctctgtctttcgttgtccctggccctttccccctggtgttttgcctgtgcgttcccatctttttgctttgtgtctcccygcaatgtctctgagcccggatctcctgctacctttccagagtacgacttggagccctgtgaggagcccgaggtcccagcctacagcatccggaagggctt

SEQ ID NO: 31463 - DNA, 201 bp, Homo sapiens
cggatctcctgctacctttccagagtacgacttggagccctgtgaggagcccgaggtcccagcctacagcatccggaagggcttgcagtttggcgtgggcracaccttgaccttctcctgcttccccgggtaccgtctggagggcaccgcccgcatcacgtgcctggggggcagacggcgcctgtggagctcgcctctgcc

SEQ ID NO: 31464 - DNA, 201 bp, Homo sapiens
gtggtacctggcacggaataggtgcttaataaatatttgtgaataatggatgaatagtgagtatcccaagggccccttggggaaactgacagtatccaagsagacgaaggctgtgattctctccttttaggaggcagaaaccttcttctcacatttcatgtgatagaaagaggatagagacttaagagacctcttgactta

SEQ ID NO: 31465 - DNA, 201 bp, Homo sapiens
cagcatatgctccgtgcagacagctacacacagcttctttcagaggtttaaggtcctgtgggtcttggcctctgcagttgataagtcagggaggcagcttsaggctgaccgaggcagaggccacagcaagaggttgtcatgtctccttgggccaggcagccctgaggtcccagggccatttggcagtaccctgaagggcac

SEQ ID NO: 31466 - DNA, 201 bp, Homo sapiens
gtttcaccatgttggccaggctggtcttgaactcctaacctcaggtgatccacctaccatggcctcccaaagtgttgggattacaggcgtgagccattgckcccagccacaaaactcttgtaaaataataatattatcataaagagattaagaaacctgatgtaatatagctagtaagtgtccgagccagaaattggatcc

SEQ ID NO: 31467 - DNA, 201 bp, Homo sapiens
ttttccagctgtcctcttcatttcctcagtcagttcccttgccctttctccatacagctgtttgacaattctgcctcctttctgaagacttatattccatygcccctacctacgttctcagcaaataactaagttaaacagttaagatggcctggaatcagagaagctgggttcaaaattcagatgagacatttagaaact

SEQ ID NO: 31468 - DNA, 201 bp, Homo sapiens
gctgcaggcctgggttttctattatttattcttctggttaatctgcatttttttgatttaggcaatcactgttatgcttagctgcctggaagtaatttggrtaattcttcactttttaaatttccctaaagtgagcctttatgtaaagtgcaagttttccttcttaatttttgtaaggcagtttttttattttaattcttc

SEQ ID NO: 31469 - DNA, 201 bp, Homo sapiens
ttattagaaattctgtaattttggtattgatttccccttttacatagaaaatttttaatagaaggatttgtttctaggtggaaggcccttttttttcattrtgttattcatttctaattttattgcattgtatgtaatatttctacttcatggaattgactgaagctttctttgtgacctaatagttggtcagttgttatg

SEQ ID NO: 31470 - DNA, 201 bp, Homo sapiens
cagggcactcaggagcataccacagaatcgccatctcttcctaaccacagtgcacatctcagccacctgaggaggattaaaaaaatacacaggccagggcsctatctgcaaagctggtgagtcaggcacctgcagtggagccgggcattttaaataaccttcaggggcttctggagacacctccagttgaggtgccacatc

SEQ ID NO: 31471 - DNA, 201 bp, Homo sapiens
ggaatatgaaacattccgaggctcacacaaggctgagttgtgagaggggagcagtcgtctgggccatttgatgggagctgagctagttatttaagtctgarcagaacatgacccgcctctgattatctcacctggaagtgggttcaaggtactaatgactggacttcttaagagggtctacatgttggtctttctttgaca

SEQ ID NO: 31472 - DNA, 201 bp, Homo sapiens
atgtatgtgaccattctgcttctcccctttgcccagccccagagctcgcccctgctcctgctcttattcccaggcacctgcgctcacagaaaaaaaccgtrgccccatttgaaccctcagcctggctgataggactgcaacagataattcatgtgcattttcattagtaatcaaaagacaaacatattcccactctcacct

SEQ ID NO: 31473 - DNA, 201 bp, Homo sapiens
ggtgttctgtgggcagggctaggttggggacagttggcctacaaggtttttcaaacccagaacttactgatggtagattctctgcagacagttcttttacttttttttttattaatatcgagtggataaaaagcagattataaaatataagcaaaatataaagaacaccaatacaacaaacacctgtgcagccatcgttca

SEQ ID NO: 31474 - DNA, 201 bp, Homo sapiens
gatttttctcctatctcttgcgtgttccttctcagtctctaatactaacacttattcccctccctgaagtatagtgtcctgcagcatttaattctttgtamtttttcccattccttttcaccactctctgggtgagctcatccttgcccaaccctttcactaccacactctgaagcttccagacagatctcttctgccaag

SEQ ID NO: 31475 - DNA, 201 bp, Homo sapiens
gcacagacaggtgtaaagattttctgacaatttgttgaataaatatagcctctgagatcttagagtctcagcaccttctcacagccaaccgcatctcaccrgcatcaaagggaaaagcatatggcacttggctcacctcgcctggtgtcagagccctttggcaacaggaccaatgtcaagataaataaacaggcaaatatt

SEQ ID NO: 31476 - DNA, 201 bp, Homo sapiens
gccactgcctacctgtctgacttccctcctatccctcactcacacccattctctgtgctcttcatcctgtccctagggtgggctaagcaggttccctgctygggcttctgcactagctgttcccagggcttaggatcctcctccttcacagtcttcaaatcttccttccaagttaaaaaaacaaaaaacaaaaaccactgt

SEQ ID NO: 31477 - DNA, 201 bp, Homo sapiens
gtcatttctttttaaggctgaataatattcccttgtatgtctaaaccacattttgtttatccattgatctgttgatggacatttgggttgtttccatccartttggacttctcatcccctccccactcataatctgttctcttagccttctccacgacctcccacatctgttttcctaagaggaagctgcttctgcccatt

SEQ ID NO: 31478 - DNA, 201 bp, Homo sapiens
tttcaccgtgttagccaggatggtctcgatctcctgacctcgtgatctgcccacctcggcctcccaaagttcagggattacaggcatgagccaccgcaccyggccagaaaccacttttatagtttggatctcagacccaaggacaaaagttcactcatgcctgtctttagtgcaagttctctagattaagcctgaagaaac

SEQ ID NO: 31479 - DNA, 201 bp, Homo sapiens
ccatctgtacccggcacccccagggctaccacctgtggagcgaagccatccctctctgtcaaggtgagaagcaggtggaaagggggtcacaaggtagctcrgatccaactcatatcttgggtttgtcccaggactagtcacttccaaatgtgggtttcctctttgataattatttcattctttccacaagcatttacaaga

SEQ ID NO: 31480 - DNA, 201 bp, Homo sapiens
ctattacagatatcacatagttttctatgcatttatacaaatagacagttggatggattgatagaaataatttttaaaaatctgggccgcatcctaggtgrgcgtgctgaccaggggagaggggccaagagaagaccagttctgccatgtctgccttttgccaaaggggccctacccattgctaagtccagcatggagccc

SEQ ID NO: 31481 - DNA, 201 bp, Homo sapiens
tttctcatttacagcactttctttgcctattcttattccagggtctgctactagttggcatgaaaatagcttaaaataagggtttttggaagggtggatcyttagggtgaaataggggagagagaacaggacgtggacagggatcacaatggatgctgtcacctccctcccccagtttcttcagaagctttggtctctgaa

SEQ ID NO: 31482 - DNA, 201 bp, Homo sapiens
acatgtggaactgtaagtccaattaaacctctttttcttcccagtctcgggtatgtctttatcagcagtgtgaaaacggactaatacactcctcttgcccrtaagggtttggccataggtttctatagccagttctgttgctttgcttctccagggactgtcagttgtggcatcagagagcagagtctcaaacaccagcag

SEQ ID NO: 31483 - DNA, 201 bp, Homo sapiens
gagtgtaatttgcacctgcgtctgtcactgtgactaagtatattttacaaccgagattcttgttcctgagggaggtaaccatgtggatacagcacacatargacacagcgggcaaagcaggagtagggaaacaaattcggcttggaaggcagctatttaaaacaaccatttcaccggcagagggatatgatcaccaagaaa

SEQ ID NO: 31484 - DNA, 201 bp, Homo sapiens
acaattttatatgatctgataatgcctaacagtgatcctgtccctttaggaaagttaggaaatgctaataaaagtttcttaaaactaaaaagccctaaggyatagatctctgactggcagatgttaagcatgcagcaaaggatgggctatatttcaaggccaggtgcctttcttctgctctgcaagccatatcttataaac

SEQ ID NO: 31485 - DNA, 201 bp, Homo sapiens
acctcttgacttaacccaattcctaaactcaaatctgggcatagtggccatgaacaggaaggacaggagaatgaagaagggagcatgcctgagagagagtrttacccagagcttacaaatggctcgatgggagacaagggaccactgagaacactggaggtggcaagcagtccaggtgggcatttgagtgagaggggccca

SEQ ID NO: 31486 - DNA, 201 bp, Homo sapiens
ccagtttaagatcccaaaactgaattccaacatctcttaggaggaaaataaactattcaaccaaagaaatgcacgttccctgtgggttgaccacactgaaycagtatagatctctccctttccaaaaataagtaaagaaataagcaaaaagtacataaaataaacttgtatgatgccacttaaaacataccactcattaaa

SEQ ID NO: 31487 - DNA, 201 bp, Homo sapiens
ggtagagctctgctttgcaatcagcatctttgtcttttccgttttttttctagttttgtttttgattaagtgtccccaccttgtggacaattaaatgcagaagctaatggtcttttagaaaatcttttaatatatgctaagagccacttagcttttgagaggctataataggacaagagagacgatggcttctcctaaatt

SEQ ID NO: 31488 - DNA, 201 bp, Homo sapiens
ggtggataacaccactatctatctctagtaccttttttgccttcccaaatggaactccatgcccattaaagaagaatacccagaatagtcagattcatagrcagaaaatggaacagtagcgacaaggagatgggccgtcatttctttttaaggctgaataatattcccttgtatgtctaaaccacattttgtttatccatt

SEQ ID NO: 31489 - DNA, 201 bp, Homo sapiens
tcagtgctaatgtaatatttcaagtcgacagatgaatcttcagcagatttgaggaacgccttctaagactccacggtcacataggcccagggggaagtgtyattctcatactgagagacatggtggggggttagtaagagcttggtctctagaatcaggctgcattgatttggctttggcgctaccatttactggccctgc

SEQ ID NO: 31490 - DNA, 201 bp, Homo sapiens
ttcaaggtctttgcctttgggttttgattcctcattatttgcattatgttcccaactgaactcccacaaagctggagacaagatggctgtgtgggggcatscatgtccagcctagagactcccaattcagtgctaatgtaatatttcaagtcgacagatgaatcttcagcagatttgaggaacgccttctaagactccacg

SEQ ID NO: 31491 - DNA, 201 bp, Homo sapiens
aatatttgaacttgtttctgcaaggaattggtgaaggaagacatgggaaatgatagacttgggctgaagtttctattgtgatggcaaaccatgaatctgtmgtgataccacagttctcctggtagccccccagcccccaggattagagatggaaaaggtgagtggtagaattgatggaaagcaggcatttcaccaagcaga

SEQ ID NO: 31492 - DNA, 201 bp, Homo sapiens
tattccagtgtaccatgccttgacagaaatgaattcgcttcagcgagtcaccccaattaagatcaaaaaatagtctccactcatcaggcatctgacctaagtaaggcaaggtacctgattgtcctgccctcagccttcccttctataaactgaggataatgatagtacttatgccatggcggtattaaatgggttaataac

SEQ ID NO: 31493 - DNA, 201 bp, Homo sapiens
gtcaggagtagagcatgcacgtgggcacatgcacccacaagccttttcacatcaaggattttgacccccgtgaagccttcccaaccagtgaggcatagttcccattcttcctccatgccccactctgaattctcactagtagtgatgtgtctgtcttctccactaaactgggagatctttctcagtgcttagcacaaggcc

SEQ ID NO: 31494 - DNA, 201 bp, Homo sapiens
aattagacaaatcccaagggttagaaagtgttctaaatgggagacagtgcgtgcaaagaccctgaagatggggcatggcaaattgaaggaactgaaaccasaggtgtacgaaggaagggagtgggagaaaagcgggggaagagtatttaatcactgacattatttagaacatggatgcatggtgataagaagtgaactttt

SEQ ID NO: 31495 - DNA, 201 bp, Homo sapiens
tccctgggattcaaggcttcttatgaaggtaactgcttttggcaagccagatgaactgtgtcctgggagtcagagacggggtctggatttgcagtcagaattttttttttttttttttttgagacggagtctcactctgttgcccaggctggagtgccgtggcacgatcttagctcactacagcctccgcctcccaggttc

SEQ ID NO: 31496 - DNA, 201 bp, Homo sapiens
caagtcatgatttaagacttaaaaagaaattagctactggaatttatcccaggaagttagttgtgctttatcctgccctgagcaggcaccagagaattgagcttagatgtgggacctcagcttgggatagataaggagaggatttaaggcaattcctgtaagaaatgttgatggcccccgaatgtttatgcaggagaagaa

SEQ ID NO: 31497 - DNA, 201 bp, Homo sapiens
tgaggacacagcataaagacagctgtccatgaaccagtaagaaggcccataccagacatcaaaattgccagtcccttgaacttggacttcccagcctctaraactgtgataaataaatttctgttgtttagaagtcacccagtctatggtaatttgttacagcagcctgaatggattaagacagccattcagtcccagctc

SEQ ID NO: 31498 - DNA, 201 bp, Homo sapiens
gatgtctgattgggtcagaactgtgttatgcacatgcccatctgggtctgtgaaacaaatgaacttcatccagctgcttcagaaagaattaaacaggtccyaggatgctcatcacctgaaagaactgaagcatgcacctggaaaaaaaaaaaaaaaaaaaaaaaagacccaggacagctagaagcagaccctgcagggtaa

SEQ ID NO: 31499 - DNA, 201 bp, Homo sapiens
gattatgttgtctatgtcctttacattcttacttttcacccactcaatctgttttattctgagagatgtgtttaaagttttctattattagtgtgtttctrtttttccttgcacttcctgtagtttctgttctataaagatggttgctgtcttatttggtgcatagatattcataactagtatctccattgcacattgtgg

SEQ ID NO: 31500 - DNA, 201 bp, Homo sapiens
ggttctatggttctgtctcctctcacacctttcttggacccctggagtctaaaagagggccccagccacataaacctaataggatagattgaatggtctgycctggggtgaacagtgctgtcttgccactgtctcaggcccattaaggacacagtcacaggttatttccacagagagccaaaggaagctggtagaaatgcc

SEQ ID NO: 31501 - DNA, 201 bp, Homo sapiens
ttgttacaattatcttgaagtagcatttatgcttcaaactacaatatgtatcaggcccactgctagatcttattaataatgcattaataaaggagcacttwttagtgtatgatcgattttcagtatattttaaaaactatatttcaatctagctgatttcctttgcaattctatgtattttgttttacatattttaagaca

SEQ ID NO: 31502 - DNA, 201 bp, Homo sapiens
tggcaacctcctcgactatgtcccatccaaagacagaggtttttgttttgttttgttttttggcctacacggtgctttataacaaattttgaattactccrcaatcttttaaaatcaagaaattttacattaaaatccagatttctgtcttctcttgaaaaatgaaaatctaatcaaatgcaactcaaacattcaatagtc

SEQ ID NO: 31503 - DNA, 201 bp, Homo sapiens
aaggaagggctaggtaggcagctggaaagattcctgcaaggagtgagctaaaagcaaagtaatgaggggggaaaaaaaaaaacatggacatggaggttggrggatttcagaagaggaggcaggtgctgaaactgctctcagcattgataaccattgtgccctaagatgtttccacaaaccaccatggaacttaggaatggc

SEQ ID NO: 31504 - DNA, 201 bp, Homo sapiens
cgtgagtcctcgggcaatggaggcgggtgtaaggaagggctaggtaggcagctggaaagattcctgcaaggagtgagctaaaagcaaagtaatgagggggraaaaaaaaaaacatggacatggaggttgggggatttcagaagaggaggcaggtgctgaaactgctctcagcattgataaccattgtgccctaagatgttt

SEQ ID NO: 31505 - DNA, 201 bp, Homo sapiens
tgacattgttttccttttgctagctctttcctgtgggcttcctgaggcccccaagaatggaatggtgtttggcaaggagtacacagtgggaaccaaggccrtgtacagctgcagtgaaggctaccacctccaggcaggcgctgaggccactgcagagtgtctggacacaggcctatggagcaaccgcaatgtcccaccaca

SEQ ID NO: 31506 - DNA, 201 bp, Homo sapiens
cttctttgcacttctatctttattccttcttccaaacttaaaaaaagaagaagaaaaaactcttctgctgatgatcctcccattttcttttttattatgakactttaccctttaattagtttttactaataaaaggaccttgggaggggaggaaggataaaaatagtttctcagaataccatcttaaaacaaatgctcatg

SEQ ID NO: 31507 - DNA, 201 bp, Homo sapiens
actctgttttcaaataagatcacatttataggtaccggagtcagaacttcaacacgtctttttggggggcacagagcaccccataacagaaggccggcccrtctttcctacactaacactgtcataccacaatgtcccctggggtaaagataacggttgtactgttttaataggaggccatgtgtctagagaaggcagaac

SEQ ID NO: 31508 - DNA, 201 bp, Homo sapiens
ggggcaccagagatgacacctggtcgcagcagcttcttctcctgctgatcctggtccagggcctgtggcttgggaatatgtgggaagcagtgggtaagagcctgaaccaggcaggggacacttgcaagtcaccagtggtcctattgatgaatccgatgaacacattttcatctttatcttatttgatctatcagggatatc

SEQ ID NO: 31509 - DNA, 201 bp, Homo sapiens
ccgcggtgcgcgcgcctgggagctctggcctctcgcacacccacacccactgggaggctgtgcataccgacgctgctggtcacccagacttgccacatggrcggtgggggaatcgctgctacctcccgccaggcctcccggacgtacgttgaggcgaggccggtctctggcttagctgattggagaatgtctcggcatcgg

SEQ ID NO: 31510 - DNA, 201 bp, Homo sapiens
acatcagcccctacatggaaaatccaagcagctttgcccctgggaatggcctctgtggtgctctggtccccttcctcattccccttcctctagcaacactrgagccagagacaaggagacgatgaagactctttcttcacctcccacttggccaggtgccctgagccatctccacagacctgaccacaaatgggctgcacc

SEQ ID NO: 31511 - DNA, 201 bp, Homo sapiens
tgaaatattgtgagaattaccaaaatgtgatgcagagacatgaagtgagcacgtattattgggaaaatggtgctgttaggcttgctcaacacagggttacyaaaaacctttcatttgtaaaaaaaacaacatctgtaaagcacactaaagcaagacacaataaaactaggtgtacctgtaacttataaccagcttccttct

SEQ ID NO: 31512 - DNA, 201 bp, Homo sapiens
atatttattttacagacaatccaggctaagccttggaaattcatagattcatccagcatgaccctagccctcaagttactgacagtttaggtgggggacayaggacaggcagcaagcaatcaaggtgcaatatgggaggtgctcagatacaggaaggaacagggaggggccccccaattattaaagatcccattcctctgt

SEQ ID NO: 31513 - DNA, 201 bp, Homo sapiens
cacacacacacgcatacacaaacacatgcacacacatgcacacgcacacaatgcacacacgcacacacacatacacacgcacgcacaaacacatgcacgcrcacacacacacacgtacatgcacacacacacacactctttagcaccagggtaggaaatgctcctgctacggcctctttgagtttagctcctctgctctcc

SEQ ID NO: 31514 - DNA, 201 bp, Homo sapiens
aaatcaagaggttttcccactttcttcacttggagcatcattcattgatgcattcattccctcatattcacaaatatctgtttgtttactacctggttgtscctgtgccagatgctggcattatataaatgaatgagatgtggccatggttcacaaagagcagacgcacatgtctgtccagaacaaggtggtggcacaatg

SEQ ID NO: 31515 - DNA, 201 bp, Homo sapiens
agccagccgggagatgaggaagctacagagggtggggctgaggaggccagggtccagccttcactttctccctggctggaacaggacctcggacccagggyggggagcaggcagggtagaaggaccctagctcagtgaaggggtatttagagagtctgtggtcccagtgaggacccaaggggctcagcagggaaactgagg

SEQ ID NO: 31516 - DNA, 201 bp, Homo sapiens
caacacgaatcggggaggcccttaagatgtggcccctgtggcatctatacttcagaaccactctgtgtacccctctagcatggtattgtctaatgacataytttgatttacttgtttctagtctatgatccaggtccccatggcttatcacagggtctatcctagaggaatgaatgaatgaaggaaggaattaatggcatg

SEQ ID NO: 31517 - DNA, 201 bp, Homo sapiens
acgagatctgatggttttatccgagttttccgcttttgcatcttcctcatttttctcttgttgccaccatgtaagaagtgcctttcgcctcctgccatgaytctgaggcctcccccgccatgtggaactgtaagtccaattaaacctctttttcttcccagtctcgggtatgtctttatcagcagcatgaaaatggactaa

SEQ ID NO: 31518 - DNA, 201 bp, Homo sapiens
ctgagccccactcagaacacagatagcagagaagcagtgagtggtggccctgggtgctagagaggagccaggggcatggtcttccatggtgaggcagcctyggtgccctgtgtcccagccgctccagccgttgcgaaacggggccaatccaaagtctggatcagccaaggatggacagccatcagagcacagtctgccttg

SEQ ID NO: 31519 - DNA, 201 bp, Homo sapiens
ggcagcctttaggccaagagaccataaatcctagaattaaaagagctttcctctgggatgccaactcccaccataacagccctaattcttcctaagagagwtccccctcagtggaaaagaaaattctctcttttgtttggagagtagatacttgaatgtgtctacactgtgtttgtgggaacagatggcggagaactggtt

SEQ ID NO: 31520 - DNA, 201 bp, Homo sapiens
agtaggcaatggggcagcctttaggccaagagaccataaatcctagaattaaaagagctttcctctgggatgccaactcccaccataacagccctaattcwtcctaagagagttccccctcagtggaaaagaaaattctctcttttgtttggagagtagatacttgaatgtgtctacactgtgtttgtgggaacagatggc

SEQ ID NO: 31521 - DNA, 201 bp, Homo sapiens
gctctgagaaattttcatctatgataattccatcccatccactttttgtgttctctctttttggagctctgaacagttggatgctggaccttctgtattgrggattgatccgtgttttctgtcattttctctcattttcggtctcttttttttctatattctgagaaatttacttttcatctctaatcctataatgcttat

SEQ ID NO: 31522 - DNA, 201 bp, Homo sapiens
atggaaggatgaatggaggaactggagcaatggttgagtggacagagagttcctcaaaggcacaagcgaagaaaataaaacaactgtcttaattgagtgcytactgtgtacctggccctggaacaagtcatccctttcttgttagtgcttgggatgtatatgaatgaatcattctttgtctctccagggagtcagaagatc

SEQ ID NO: 31523 - DNA, 201 bp, Homo sapiens
tctttgcattcctttggctccctttccatctgaagacttgtgtctctcttcagctctgagaaattttcatctatgataattccatcccatccactttttgygttctctctttttggagctctgaacagttggatgctggaccttctgtattgaggattgatccgtgttttctgtcattttctctcattttcggtctctttt

SEQ ID NO: 31524 - DNA, 201 bp, Homo sapiens
aaatcaattttgctttgcttttagagcctcaatagtagagagataagaggtttggaaatgaagcacagatcatccaacccacagtttctgctatagattctaagataatgtgatgaatgctatagtggaagtatgcacgaaacacaatagaaaagtgtctgcgaggacagatcataattctgtatggcagttgggggtgga

SEQ ID NO: 31525 - DNA, 201 bp, Homo sapiens
tagtggcaacagatcagaccaggaatggcaggtggagatcgcagctaagcagatttctgctgcaataatgaagaatttcccaacccaagaaccacctatamaaaggagtgggttaacccagaagcaaggagctgtctgtaactggaagagatccaaaaatccagctgatagatgggagcggatgagcacattccttttcga

SEQ ID NO: 31526 - DNA, 201 bp, Homo sapiens
gtgtgtctctggacttcttagatacacaaaattccgtgatggtgaatctaagagggattctctttgcattcctttggctccctttccatctgaagacttgygtctctcttcagctctgagaaattttcatctatgataattccatcccatccactttttgtgttctctctttttggagctctgaacagttggatgctggac

SEQ ID NO: 31527 - DNA, 201 bp, Homo sapiens
tatgtcatttttttttccctctttctagtaatttggaggaatgcctgtgtgtctctggacttcttagatacacaaaattccgtgatggtgaatctaagagkgattctctttgcattcctttggctccctttccatctgaagacttgtgtctctcttcagctctgagaaattttcatctatgataattccatcccatccact

SEQ ID NO: 31528 - DNA, 201 bp, Homo sapiens
ggtatatccttaagtaaattcctcagaaagggttcacaagaggtgcattttctgagactttacatgtctgaaagtgtctatctttttgccctcacacatgyttggtcagttgactgggtaaaattctagtttataaatcattttcttcagaggtttaaagctttgttccattatctttgaacactcactgctgatgggaag

SEQ ID NO: 31529 - DNA, 201 bp, Homo sapiens
gagattccttttctttgtattcttgagttagttctgtcatttttcatatctcatatattgtcctttcctggttttcaccctctttttcatggggtatatcyttaagtaaattcctcagaaagggttcacaagaggtgcattttctgagactttacatgtctgaaagtgtctatctttttgccctcacacatgtttggtcag

SEQ ID NO: 31530 - DNA, 201 bp, Homo sapiens
ttctctttctttttaaattttttttaagacggagttttgctcttctcgcccaggctggagtgcaatggcgcggtctcagctcactgcaacctccgcctccygggttcaagcgattctcctgcctcagtcttccgagtagctgggattacaggcgaccgtcaccacgcccggttaatttttgtatttttaggagagatgggg

SEQ ID NO: 31531 - DNA, 201 bp, Homo sapiens
ctggccatgttgctgcaaacatttctctcctgagttgtccctttgagattccttttctttgtattcttgagttagttctgtcatttttcatatctcatatmttgtcctttcctggttttcaccctctttttcatggggtatatccttaagtaaattcctcagaaagggttcacaagaggtgcattttctgagactttacat

SEQ ID NO: 31532 - DNA, 201 bp, Homo sapiens
gggtctgggtggctgcaatgactgagtgccccaatgtcagtgaccagctctctcacctactagctgtgggattattaggcaaggtacttaaccacttcagscttcagtgtccgcatgatggaaaagaaactttaaggtgcctcttagggctgagttcctggcagctgctcactcaaacaggaaatatagcagtttggtagc

SEQ ID NO: 31533 - DNA, 201 bp, Homo sapiens
acctgtagtcccagctactcgggaggctgggtcacaagaatcacttgaacccaggaggtggaggctgcagtgagccgagatcgcgccactgcattccaccyggggtgacagagcgagagtctgtctccaaaaaaaaattaaaaagaaaggagccagttacaaaagggcaaataaatacctaccatatgctttcactgatgt

SEQ ID NO: 31534 - DNA, 201 bp, Homo sapiens
aggcatcgtctcaactgacttgtgctctagtggcgagatggaggggaaagcaaacgaagtggcatgcaaaagagctgcctggacagtgccagtgggagcamagagaagggagcagacatcttttcaggaacatctgaaaggggatcaggaaagcgctttgtcacaaaagtgagcctaaagtcctcagaatgactaggtggc

SEQ ID NO: 31535 - DNA, 201 bp, Homo sapiens
tgtaaaaatgatacacatccaatctgtaaatactcaaaaaatgggagaggtcaaaggagagatgttaaccactacccaaaatcccccagccagaaatgatycttgccaacaattggtggacactattacagatatcacatagttttctatgcatttatacaaatagacagttggatggattgatagaaataatttttaaaa

SEQ ID NO: 31536 - DNA, 201 bp, Homo sapiens
tcagccaaggatggacagccatcagagcacagtctgccttgtggtcagagtgagatgtggcacacaagggcctggcacagagcctggcacactgtccagcytgcttctcaccatggcaccctcgatattcaggactatggagtttctttgttgtaaggagaggtcctccaccttgtaggatatttagcagcaaccgtggcc

SEQ ID NO: 31537 - DNA, 201 bp, Homo sapiens
gactcatttagctgggctagaggaaggcctattaactgtgccctggcttctttctgtttggacatctggtagaagtgataggcaatacagcatgagaggacaagggtcatgtacattgcctctccagcctccctggagctctctgaaaacagaattagaaggaattcaatgtacgcaaaggctagacaatgagtgaacctt

SEQ ID NO: 31538 - DNA, 201 bp, Homo sapiens
cagccaaggatggacagccatcagagcacagtctgccttgtggtcagagtgagatgtggcacacaagggcctggcacagagcctggcacactgtccagcckgcttctcaccatggcaccctcgatattcaggactatggagtttctttgttgtaaggagaggtcctccaccttgtaggatatttagcagcaaccgtggcct

SEQ ID NO: 31539 - DNA, 201 bp, Homo sapiens
caaaaagctgtgagccaggaaggtggtggccttttgaggcacagaagaagggcccatgggtctcgctccacccctctcagcccttggggtgtagcttttgytggtcactggaagcaccttgacttctgatgatactgatagctccatccttttgcatgtgtagcagtgaccttagggtcataatgtcaccaaatacttgag

SEQ ID NO: 31540 - DNA, 201 bp, Homo sapiens
gccacatgtcttcaggtggctggcctcctgtgttctgcccaaattccctgtggacagctgccctgaagttcatggggagagtggacccaactctctacctwgccatcagttctgaccacccacccacctgtgactccctgcgttgggtagaaggtggtgccttcctgagcacattgcggcttctccctcgccatagtggcc

SEQ ID NO: 31541 - DNA, 201 bp, Homo sapiens
gtttgggaaccatggtgcatttcccaaaattacttatttttttcaggcaaacctactaacatcatattggatagtattctgtgcaacatgatttgggaacygttggggtagagcacatcaagagggctccctgctgcagaaggagacgctgcagtccaatgggaaacacccctgagttttgatggagcgagtgtgcttaga

SEQ ID NO: 31542 - DNA, 201 bp, Homo sapiens
taatataatgggtttgggatctgttacataatctattccagccttgaaggtttacattgacttagcttgttaaaagtcctcctacgcattttattttttawttgttttctgaaaaatccttgctttatttaacccagcatttcccaattctgtttaaccggtgaacattctagaaacatgctttgaaaaataacctagttt

SEQ ID NO: 31543 - DNA, 201 bp, Homo sapiens
ggggtcccaggaggatgacgggggtgctccctgaggccctctggtctttcactgccctcttcactccttctatagctctctgtggtggcttcattcaaggytccagtgggaccatcttgtcgccagggttccctgacttctaccccaacaacttgaactgcacctggattatcgaaacatctcatggcaagggtgagtgtt

SEQ ID NO: 31544 - DNA, 201 bp, Homo sapiens
tctgttacataatctattccagccttgaaggtttacattgacttagcttgttaaaagtcctcctacgcattttattttttatttgttttctgaaaaatccytgctttatttaacccagcatttcccaattctgtttaaccggtgaacattctagaaacatgctttgaaaaataacctagttttggtactttccagaaaaat

SEQ ID NO: 31545 - DNA, 201 bp, Homo sapiens
aggcaaattatggtagatctacctaatagatttatgcagtcatttaaaagtataatagcattatttggcaatacagaaagatgtttatgatattattttcygtgaaaaaaccagaatgcaaaatggattcttcatatttattacaaacatgtaaagtaggtcttatatgaacagggactggatggaaataaaaaaagaaac

SEQ ID NO: 31546 - DNA, 201 bp, Homo sapiens
acatactttccaaactggcatatatactggattttatcaaagttgacattctattgactgtaagatgtaccattattttatgcaccactaagaaagaaaamagtgccagttaaacgatcacgtacccttggttgtaatactcattctaatttctgaattgtttatatgtgaaaaaaaactgtgaaatactatatagccctg

SEQ ID NO: 31547 - DNA, 201 bp, Homo sapiens
cagagtggccactaaatccccatgtgtgggcttaggccttttgttaattatttgtttcacaacaactctgcctgaaaacaatcagcaatggctccccaaaraacatgggaaaatttaaaatttatgtggttaataggaggcagcatacaaatcacttctaattagcatgcaacgagactttgtggccaccctgaatattaa

SEQ ID NO: 31548 - DNA, 201 bp, Homo sapiens
ataaacataatgtcgaccctactccttataaaataataatcctggccatgttgctgcaaacatttctctcctgagttgtccctttgagattccttttcttygtattcttgagttagttctgtcatttttcatatctcatatattgtcctttcctggttttcaccctctttttcatggggtatatccttaagtaaattcctc

SEQ ID NO: 31549 - DNA, 201 bp, Homo sapiens
ttaaaaatgtagattctggccaggtgcagtggctcacgtctgtaatcccagcactctgagagactaaggtgggagacttgcttgaggccagtagttcaagrccaacctgggcagcatagtaataccctgtctctacaaaaaataaaaatattagctgggtgtggtggcggcacacgcctgtagtcccagcaagtcaggagg

SEQ ID NO: 31550 - DNA, 201 bp, Homo sapiens
agctctagactagtagccagaggggatagtggatggaggcagtagtgggtactttgacggattaatctttccatctgtaataccccctgagctgtcaaagrgcaaggatgatttataagtattactttctttcaaagaccaaacagtctactcttgcctaagtaattcctattcctcctataaacataatgtcgaccctac

SEQ ID NO: 31551 - DNA, 201 bp, Homo sapiens
caccagacttcagttgacccatccccatactactgtgcatgtcttctccccactgcaccccttgcctcccactgatgcccttcctctaagcctcccactgygttctctggaatcctagttccgtggccagcaagcgtacaccctcagtccctacccagctggctgtcttcacttcctccctccatggagaccatggctgtc

SEQ ID NO: 31552 - DNA, 201 bp, Homo sapiens
aggattgcttgagcccaggaggtcaaggctgcagtgagccatgattgcaccactgcactctagcctgggtcacagagcaagaccctgtctcaaaaaaaaamaaaaaaaaaagaaagaagaaaaatgtagatttccaggtcttcctctgattttctgaatcagaggatctgagagcagggtgcagggatctgcgtctttaat

SEQ ID NO: 31553 - DNA, 201 bp, Homo sapiens
cgcctggactctattgttaatattatacttcgtcaccattattttcaatagttgcacagcattatgagaaaattgtcattcatttaagtatcattctcttsttggtcatttggatttctatattctttgtgacgataaacttataattccatctttatgaatattacatatttccttaaggcaaattctcagaaatgagat

SEQ ID NO: 31554 - DNA, 201 bp, Homo sapiens
agcccaggaggtcaaggctgcagtgagccatgattgcaccactgcactctagcctgggtcacagagcaagaccctgtctcaaaaaaaaacaaaaaaaaaaraaagaagaaaaatgtagatttccaggtcttcctctgattttctgaatcagaggatctgagagcagggtgcagggatctgcgtctttaatgagttcttcct

SEQ ID NO: 31555 - DNA, 201 bp, Homo sapiens
actgctgacctcaggtgatccgcccacctcggtctcccagagtgctgtgattacaggtgtgagccaccgcgcctggactctattgttaatattatacttcstcaccattattttcaatagttgcacagcattatgagaaaattgtcattcatttaagtatcattctcttgttggtcatttggatttctatattctttgtga

SEQ ID NO: 31556 - DNA, 201 bp, Homo sapiens
ccatattggtccggctggtctcaaactgctgacctcaggtgatccgcccacctcggtctcccagagtgctgtgattacaggtgtgagccaccgcgcctggmctctattgttaatattatacttcgtcaccattattttcaatagttgcacagcattatgagaaaattgtcattcatttaagtatcattctcttgttggtca

SEQ ID NO: 31557 - DNA, 201 bp, Homo sapiens
caggctggagtgcagtggcacgatctcggctcactgcaagctctgcctcccgggttcatgccattctcctgcctcagcctcccgagtagctgggactacasgcgcctgccaccatgcccagctaatttttttgtatttttagtagagatggggtttcaccatgttagccaggatggtcttgatctcttgatctcatgatcc

SEQ ID NO: 31558 - DNA, 201 bp, Homo sapiens
atatcttgggtttgtcccaggactagtcacttccaaatgtgggtttcctctttgataattatttcattctttccacaagcatttacaagatctgtagtgcrtagcaatctcagtgttttgagatccatgggggagatgggtatgtgagcacatcaatgcaaagtggcagaggaaggaagtgtcgtgtcaggagcataatca

SEQ ID NO: 31559 - DNA, 201 bp, Homo sapiens
atttttttgtatttttagtagagatggggtttcaccatgttagccaggatggtcttgatctcttgatctcatgatccgcccgcctcggcctcccaaagtgstgggattacaggcatgagccaccgcgccaggccttatcctttatttcattcgctcctatggctttcatgccactgtccaaatgctgagactctccatact

SEQ ID NO: 31560 - DNA, 201 bp, Homo sapiens
tccctctctgtcaaggtgagaagcaggtggaaagggggtcacaaggtagctcggatccaactcatatcttgggtttgtcccaggactagtcacttccaaaygtgggtttcctctttgataattatttcattctttccacaagcatttacaagatctgtagtgcgtagcaatctcagtgttttgagatccatgggggagatg

SEQ ID NO: 31561 - DNA, 201 bp, Homo sapiens
ctttgctcggagagccagaatttcagcctgctgtccccttcaagctcacagagggccatgctttcttctgccgctgggtttttttttgtttgtttgtttgttttttttttttgcatatgccgattcctctgtctggagtattatcttcccctttcactgcattaaccatggctcaagtttcacttcctcagagaaggcccc

SEQ ID NO: 31562 - DNA, 201 bp, Homo sapiens
gctcggagagccagaatttcagcctgctgtccccttcaagctcacagagggccatgctttcttctgccgctgggtttttttttgtttgtttgtttgttttktttttttgcatatgccgattcctctgtctggagtattatcttcccctttcactgcattaaccatggctcaagtttcacttcctcagagaaggccccctgc

SEQ ID NO: 31563 - DNA, 201 bp, Homo sapiens
aggttggtcttgaactcctggcctcaagtgatccactggcctcagcctcacaaagtgctgggattactggcgtgagcccaggccagggttttggtctgttktcttcactgttgtattgcaagcacttagaacaatatctggaagataatagatacttgatgtctatttgttgaataaatgaatgaaataagttgaagccat

SEQ ID NO: 31564 - DNA, 201 bp, Homo sapiens
gaattacttcagaaattttcaaaacatgtaagaaaatgtaaatggaacacaaattatatttcacaaaaatgggatcattgtagatctatcatatacattaytctgtaacatgcttttttctcttagaaatgtctcttatacctctttctgggtaggtgtacatagatttatctcattcctcttagtggctacatgatattt

SEQ ID NO: 31565 - DNA, 201 bp, Homo sapiens
catagatttatctcattcctcttagtggctacatgatatttcataagttactgtaaattagtcaatcagttcttttttttttttttttttttttttgagayggagtcttactttgttgccaggctggagtgcagtggcgtgatctctgctcacggcaacctccgcctcccgggtttaagcgattctcctgccttagcctcc

SEQ ID NO: 31566 - DNA, 201 bp, Homo sapiens
tgtcctcatcagttatactgtgctgcttttgaggcctgaatcccacacttctaatcctcaagcagctattgtccattcctttccaccacaagctcctgggkgggggggggggcaggctgtaaagtcattcttggtttctagccccaaacacccatctagatggaactctactgtgggttcttacaactcctcacatttcct

SEQ ID NO: 31567 - DNA, 201 bp, Homo sapiens
ttttgtaggtttgacacccttgtcaaagaccatttgacaatatatttatttctgaggtttctattctgtttcactggtctatttgtctttctttagtccartgctatactgttttgattactgtagctttgcaatgtgttttgaaattaggaagtgtggggccttcagctttgtttttctttctcagatttgttttggcta

SEQ ID NO: 31568 - DNA, 201 bp, Homo sapiens
aaggcccagggctgagatagatattagagtaaagggtctttttattttggcaattttaaggtttttattttaaaatctttcgttttcaattaatcgcaatyactattctgtgatttttaggacagtttaggtgaaccccaccttaagaatgaaaacgaacaaaactctttccattccaagaagttccactaacaagcaggt

SEQ ID NO: 31569 - DNA, 201 bp, Homo sapiens
cagcttggcctccccttccgcatcccacccaacctccctgacaggatgattagttctgggagctgggatttcctcaggaaggcatctgaattctcaggtgkgtaccgaggccctgcacttacgtttgtgttccctccctggcagtcccttgtggcgggaacatcacttcttccaacggcactgtgtactccccggggttcc

SEQ ID NO: 31570 - DNA, 201 bp, Homo sapiens
tccacggtgggaaacagaatggagaacatgtggttaggtagtgtctcacagtctgagtcgagactaggaaagggaataatcccaaggttgagaagtggaaragacataaatggcaagtggtggggtacacatgacttaaacatttattggctccagccaactagatgtggtcactcagatgttaccatttgatgcccacac

SEQ ID NO: 31571 - DNA, 201 bp, Homo sapiens
aaggagaaagagagactgctaagtctcctgggtttgaacttggatgatatgtcctgggcttccctgaaggcccagggctgagatagatattagagtaaagsgtctttttattttggcaattttaaggtttttattttaaaatctttcgttttcaattaatcgcaattactattctgtgatttttaggacagtttaggtgaa

SEQ ID NO: 31572 - DNA, 201 bp, Homo sapiens
agctaggcggttaagaaatgaagctatgctaagcagtttggactttatcctatggcatcggggagccagtaaagatgtttctgcaggaaaaaattttttgaaaaaaaaaaaggtcagatggttagtgattgttaagattagaggacaaagtagaagatggattagagggagagtttacaaggaggggacattagtcgggag

SEQ ID NO: 31573 - DNA, 201 bp, Homo sapiens
caacaaagcagggcctcattctgtctctgcctccacctcccaccctgagacattgccccagctggtgcctccctgtgactgtccatctctgtgtgtgctgkttttttttttttttttttttttgccttgtagtaactcaggttggtgtgtcccaaggacataatatgtgtccagaccctggcatacccgaaaggggcaaaa

SEQ ID NO: 31574 - DNA, 201 bp, Homo sapiens
tgtccatgccctttaacccacttctcttcatcctccccctcccctgactcacccttcccaggctctattatctgtttttccactctctacctccacgtgawccccatgtattttcaatttaagaagttattttcacagctctaactctaaaagtctagaatcaatgaccagatcagtggcaatgagtactcttactgcctg

SEQ ID NO: 31575 - DNA, 201 bp, Homo sapiens
ctgaaagaggtaagacagggagccacaaagaccagaggccagtgtcgttggagcaaagctagcatagagacgacaggagctgaggtcacagaggggactaytggggccacatgtgcagggccttgaaggcctgtaaggattttggttttaccccaagtgacacgggaggctattggattgttttcagcagacatgatctaa

SEQ ID NO: 31576 - DNA, 201 bp, Homo sapiens
gagatgctgaaaatgctttatattttgctaatttgaaccaaattgaagaagttgtccccttggtaggtcttaagaggatattctgcaaaatttgtactttmtttgagtataagaattgtaccaatatgagctttgcttcccctttaaacagcatgccacaagaatgatgcctttgaaataaatcctgtttgagtaatgttt

SEQ ID NO: 31577 - DNA, 201 bp, Homo sapiens
tacagggggcactttgaataaggtgaatcttcatagcccaagttgcagcggtgcataaggacagtgtgggcaaggacaggactgatgccagggatttgacmaaacaaaatttaaaatgggcaagctgggtgtggtggctcatgcctgtagtcccagctactcagaaggctgaggtgggaggattgcatgagcccaggagtt

SEQ ID NO: 31578 - DNA, 201 bp, Homo sapiens
ccttctaaaaggaaatgaatgctctccggaccagagccaagcaagcagcttagacccattcacaagcaaaagtctggggccttgagagttccagggcattmaatcaccatcagaataagactagggtcttgaagctcatgatctggagcacttagagtgggcaaggagcaatgaccccacagctactatgacacatggtag

SEQ ID NO: 31579 - DNA, 201 bp, Homo sapiens
atagcaatgtgcagccagggtaaagacaccctgctcttgatccatcatctccaggaatcacagggccagattttaccctcaattacagcagcatatgctcytagcatatctctgtcaaagtatctctcagattttgcagcatgatggaatcacctaagctttccaaaaccctcagtgctcaggccacagcaacaacagcaa

SEQ ID NO: 31580 - DNA, 201 bp, Homo sapiens
agcattaggtctcaagcatgtgcactgcattgtccatctttgggataattctgagtgaggtgaggaaccagtgtgccaaaccctggcttcatctggcaaargactgtgggtaatgaaagcatttctgcagggtaggtggctaaatggcaaggcagccctcagctacaagggaggggcagaatgcaggatgtatacccaaca

SEQ ID NO: 31581 - DNA, 201 bp, Homo sapiens
ttctgagtgaggtgaggaaccagtgtgccaaaccctggcttcatctggcaaaagactgtgggtaatgaaagcatttctgcagggtaggtggctaaatggcraggcagccctcagctacaagggaggggcagaatgcaggatgtatacccaacaatttttcaagtaggaaaaaggcaaggtcagatttcagtttttgaaaga

SEQ ID NO: 31582 - DNA, 201 bp, Homo sapiens
aaaaggcaaggtcagatttcagtttttgaaagatcaccccctgcaactttttaaaagatgggctggaggggatgaatctgcaaagaaaactctagcaaaaraggatgagtataggtaggagtgtcttagaacattgaaagaaggatacacattggagaaattgtgtaaggctgagcaaattggatttggagaaggagtagt

SEQ ID NO: 31583 - DNA, 201 bp, Homo sapiens
ggaggggatgaatctgcaaagaaaactctagcaaaagaggatgagtataggtaggagtgtcttagaacattgaaagaaggatacacattggagaaattgtrtaaggctgagcaaattggatttggagaaggagtagtggcaggaaaggaaaagatggttcagccagcaagactggcaagtggcagggcaaggggaatgatc

SEQ ID NO: 31584 - DNA, 201 bp, Homo sapiens
acatttgtattgccagattcttctagctaaatgtgtaccatgtgtcccgctaacctttacaacagcgggaaaatgtcttgtaattaaccagaatataaagratgaatggagcagcctggcagtctcctgtagtcattatcattcggaggagatgaatgtacctagtaagatttccatcaaccagttacagccagcactttt

SEQ ID NO: 31585 - DNA, 201 bp, Homo sapiens
gggcccctggacctggctgagcaaagagaggactggggaagtgtgggggtgggtcctgcctcgggtcaatggggaggcactgggggctctcttcttgggcrtggggaggatgacatctttcagaacatgttcctgctaccagtgtttgtaaggttaataggggtctagttctggggaatggtctggaatgtgggtcccaga

SEQ ID NO: 31586 - DNA, 201 bp, Homo sapiens
gtgcagtggaaagtgcctggcttcagagtgttgtgaggtgaactgggtggaggcattaagcatctggcatcatggctgactcagggtggctgttccgtccrtagagtaccctcttcatttgccttattagggacactcaaagatgaaaagtgtgcagtcatctgagtttgctcttgtagaaggggccaggaagctccagtc

SEQ ID NO: 31587 - DNA, 201 bp, Homo sapiens
tgtggatacagcacacataggacacagcgggcaaagcaggagtagggaaacaaattcggcttggaaggcagctatttaaaacaaccatttcaccggcagasggatatgatcaccaagaaagaggccggggacctcaccaggggtggctgtaagggccccacacgcgcatcctgccttatccatctctgcctggaagacccc

SEQ ID NO: 31588 - DNA, 201 bp, Homo sapiens
gtcagttgtaattacaatacatatgccacgtagaaagtgagttaattacatggcgcaacaattagtacttaataattcagatcgagtagatgagtgtaatytgcacctgcgtctgtcactgtgactaagtatattttacaaccgagattcttgttcctgagggaggtaaccatgtggatacagcacacataggacacagcg

SEQ ID NO: 31589 - DNA, 201 bp, Homo sapiens
atctcattcctcttagtggctacatgatatttcataagttactgtaaattagtcaatcagttcttttttttttttttttttttttttgagacggagtcttrctttgttgccaggctggagtgcagtggcgtgatctctgctcacggcaacctccgcctcccgggtttaagcgattctcctgccttagcctcccgagtagct

SEQ ID NO: 31590 - DNA, 201 bp, Homo sapiens
ccaaggcgggcagatcacctgaggtcaggagtttgagaccagcctgaccaacatagtgaaaccccatctctactaaaaatacaaaaattagccaggcatgrtggcatgcacctgtaatttcagctacttgggaggctgaggcaggagaatcacttgaacctgggaggtggaggttgcagtgagccgagatcacgctactgc

SEQ ID NO: 31591 - DNA, 201 bp, Homo sapiens
caggcactcagggtactttgctgtcccccaactttcctgtgaactacaataacaatcatgaatgcatctactccatccagacccagccagggaagggaatycagctgaaagccagggcattcgaactctccgaaggagatgtcctcaaggtaaaattgatcgatttcagagtatgtgtgttatagtatgcaatagtctagt

SEQ ID NO: 31592 - DNA, 201 bp, Homo sapiens
tctctgctcacggcaacctccgcctcccgggtttaagcgattctcctgccttagcctcccgagtagctgggactacaggcacgtgccaccacaccagctastttttgtatttttagtagagatggggtttcaccatgttggtcaagatggtctcgatctgttgacctcatgatccacccgcctcggcctcccaaagtgctg

SEQ ID NO: 31593 - DNA, 201 bp, Homo sapiens
tgggaaatgaaacctggctcaagtctgcaaactgggcaaaggattgcacctttctgctgggggcagcttttctcatcctgcagttagctactaatgatctrttttgttcatatagttatacttgttttggctgctcttcttggcttcctatttaccttgcccttaggaacatcatgctctatgagccatcttcgtagatcc

SEQ ID NO: 31594 - DNA, 201 bp, Homo sapiens
acaactttttaaaaacttgcgaatctgatggaaatcagaaaagtagctcattattgcgttcctttaattataactgaaactaagcatcttttcatgtttcycagttgtctgtatctcttctcctgaaaactatctgtttatgcaccttgcttgttttctatggcattgtttctatttttcttactgatttataagaactct

SEQ ID NO: 31595 - DNA, 201 bp, Homo sapiens
gcatgtctcagcatgcttcagaccactggaccctaaaaattcatagcagaactttgtaggatttacctcttaccctctggagcacatgcatcttgaaaagkcatcttgccaaagcactaattgtcccttctcactcatcaggtctaattaatatgatgtcctcaatagagtgaaccaatatgttatattctgcaagatgtc

SEQ ID NO: 31596 - DNA, 201 bp, Homo sapiens
ttaacaatgaatgtgtcttgatgctttcttttataataatttctaatctaaaatagggcagcaaatgttactatggtaatgtagtgactacttatttggawatgaaaatatgaagttttcacatttctgaattaacctaaagggatatttgcggcctctttatcccctaggcctgtcagagagaaaagaaactcccatttc

SEQ ID NO: 31597 - DNA, 201 bp, Homo sapiens
aattaacctaaagggatatttgcggcctctttatcccctaggcctgtcagagagaaaagaaactcccatttcatggctttcccctctccagactattactrtaatgggttgagatttaaagaagagtttgaagatctagggcaaagagtgttggctgttgtcaggcaaacagatgtttctaatgtgatggaggcaccaaga

SEQ ID NO: 31598 - DNA, 201 bp, Homo sapiens
ctccttttctaagttccaagctcaatgtcttccttagaatgacatttttttctttagctatataaatagtactaattaagccacagccaagttctgagacytttctgttcaagatgcagttttcatcattccctctacaatttattgaagcactatgttgcatgctttacatatattatttcataatatatatatatacat

SEQ ID NO: 31599 - DNA, 201 bp, Homo sapiens
aagcatgaggcctgacactgaggtgcccaaccaatgtttggtgattgaatgaattaatttgaaagctgtattagtcaaggttcaccagagaaatagaaccaaaaaaaaaaaaaaggtgtgtgtgtgtgtttgtgtgtgtgtataaaatttattatgagaattggctcatgcaattatgaaggctgaaaagccccacaatct

SEQ ID NO: 31600 - DNA, 201 bp, Homo sapiens
cagaggtgagatgggtgaacagcccatggcaaagtcttgtacccaaaatagcattacctgaaattgtaatcctgggattaatttttggtcttgcagttccmgttccagaacctcccttttaccagtgtcccagaatccagcagacccaggaagcctgtctaaaggcacatctactgcaaaacactgatttctccgtgtgca

SEQ ID NO: 31601 - DNA, 201 bp, Homo sapiens
tgactgccagtctacccacgcttcccctcccaccactcctgcatgcttctccataccccaggtgtacttgcctttttgcttttactggaaaacaacaaacttttttttttttttttttttttgcctccagacatttcttcctgctgtttttttctgcctggaatgctctctctcccatcttcaaacagttcgctcttaccc

SEQ ID NO: 31602 - DNA, 201 bp, Homo sapiens
tcccccacttctgggaaagcaagagtaggaagaacctgcaatatggactgtcagtaaggaatagcagacctggtagaggcaggagaggaccacgaggcctragagaacttaagtatcaccacatctcagtgccctgtgctggtcatcggattagtgaaatcaggaacatgtcaaagctaagcgagtttcctcttagaagac

SEQ ID NO: 31603 - DNA, 201 bp, Homo sapiens
atggggtttcaccgtgttagccaggatggtcacgatctcctgacctcgtgatctgcctgcctcagcctcccaaagtgctgggattacaggcgtgagccacygcgcccagcctatcatgggctcttttaaattcctccctatttacacatatccttccatgtattgtaactgatacatgtaagcacatgtgcacacacacac

SEQ ID NO: 31604 - DNA, 201 bp, Homo sapiens
agtaattgctccatgtttgtgttaatattatcattagtgcgactactgtttctagaactactgctacctgcaaatattcagtagcctatggggaaacaggycagcctttcccccacttctgggaaagcaagagtaggaagaacctgcaatatggactgtcagtaaggaatagcagacctggtagaggcaggagaggaccac

SEQ ID NO: 31605 - DNA, 201 bp, Homo sapiens
ctgacctaaattgcttgatgctattttggtgagcaaccacggtgctgcagggcttctgcagaacggcctgccaaattgctgccaacacacacacacacacrcacacacacacacacacacacacacacagccaaggttgatgggaagtgtgcttgcaccatctgtgcacggcctacctgtgtgtgccctggagcacatgtg

SEQ ID NO: 31606 - DNA, 201 bp, Homo sapiens
cccaggttccccagttcctcatcagcaccagcaactacctctacctcctcttctctaccgacaagagtcactcggacatcggcttccagctccgctatgasagtgagtctcagtgggctcaggaaaagggatgacaaggtcagcccaggtgggtcaaaggcctcaggactgtgctccaccacaggcccctgcttggcccca

SEQ ID NO: 31607 - DNA, 201 bp, Homo sapiens
agttcccgagactcccccccgcttcagacaccagtcacatgtccaaacctccagaacttctgaccaattggcttcaagttggggttcccacaacccccccycctttaagtttgattaattggctggagtagctcacagaagtcagggaaacacatacgtttaccagtttgttataaaggatatacaaaggatacagatgaa

SEQ ID NO: 31608 - DNA, 201 bp, Homo sapiens
ggtcagcagagactttgggatgggtatgactcgtgggtcacagggttgactagacagaatctaaagaaggtgggtgcttagctgggaagtctgcagtaggracggatcactgtgaagctctagggggacctggcttaccacagataaggcagcaaatacagctcaggcttcctcctccttcccaccttctgggtgccttag

SEQ ID NO: 31609 - DNA, 201 bp, Homo sapiens
cactcaaagatgaaaagtgtgcagtcatctgagtttgctcttgtagaaggggccaggaagctccagtcctaagaaggtcattccttggagatactccttcygttctgtgggacttggaggctttaatgtgcaatgtaggaattggatcctgagatgggccttatctgactttcaagctcatgctcaaacacttgccagtat

SEQ ID NO: 31610 - DNA, 201 bp, Homo sapiens
tttctcaaggtgcactgatttcatattgttcaaacacacgttttacaatcagtttgtacagttaacacaatagtggtcctgaggtgatgtatactctcagmttacaaagataacaggattaagagattaaagtaaagacaggcataagaaattataaaagtattaattttgggaactgataaatgtccatattaaaatgaa

SEQ ID NO: 31611 - DNA, 201 bp, Homo sapiens
agaaggggaaagggaaccgccatatgttcttcacgtgctgcaagggggctgtgtggttcccatgaaatggtcagcagagactttgggatgggtatgactcrtgggtcacagggttgactagacagaatctaaagaaggtgggtgcttagctgggaagtctgcagtaggaacggatcactgtgaagctctagggggacctgg

SEQ ID NO: 31612 - DNA, 201 bp, Homo sapiens
caaagactatgattgtcttgaagaatctcctagaccagggatcagcaaactatagcctacaggccaaatacagctctttgcttgttttgtaaataaagttytgttggaacacagccacacccattcatgtacacattgtgtatggctatgttcatgctacatcaatagagctgaatatctgtgatacagatcacatgacac

SEQ ID NO: 31613 - DNA, 201 bp, Homo sapiens
ctaagtggagcaggcaggggtcagctgcctgggttttgcttggagagaagccctcaaaaaggtccagattgagctcagagtccagagggaatgtgggaggraggacacccctggtcttgggtgtggagcagaactgaggtcagggcgtcggtgaggccgattgctgagaaggtggaggaagaggccacttcccacaaggaa

SEQ ID NO: 31614 - DNA, 201 bp, Homo sapiens
cttatcctcctgggagcagctatgttgtctcacaatgatggcagagatgcaagaggccaagcctaatctggcaagtgcttttatgcctttgaacacatcawggcctccaaatttcccatggccaaagcaagtcacaaggccaaacccaaagtcaaggagtgggggaatgtactccacctctgtaatggagggagctaaaaa

SEQ ID NO: 31615 - DNA, 201 bp, Homo sapiens
gagaactgagacaagtcaggctcacagatgagaagaaatattctagggcagtgacagggagcaggaagagcctgcgtaagtcagggtcatgaataggctgycctggtgtgaatgcccaggacttcaagtggccacacaggctgtgcagtggagggcagtcagcagggagcaggtgcagagatgcccttcttatgtttcatg

SEQ ID NO: 31616 - DNA, 201 bp, Homo sapiens
gagggtgaagtcaggtagaatttgggttccttggaggcaccccctctcacccacctcccaaaacaggcacccgcccaacctgccgaaggcacttgaaccartcccacatgaccctcccaagcttgcagagaaggcaaagaagtaatcagctgcttgccactgggctccacggggaaaacccagctctgtcctttcacgagg

SEQ ID NO: 31617 - DNA, 201 bp, Homo sapiens
cactcataatattttcagatcctttttatcttgatcttgatttcagggtagtatattttattttgtctctttcatgcttttggacataaagtattataacwgtcatatctttattttgtaatgggctcattatccatgttttaaatatgatatttggattttgtattaggtctctataaaggactactgaaaactctcttt

SEQ ID NO: 31618 - DNA, 201 bp, Homo sapiens
cgtttatattaactcttcttcccatccaggaatacaatatgtctctccatttgtttatcttctgtagcccttgggagggtgctataatttttatttaggcrgtattcattgtttgttaactttattcccagatatttcatggagatttttgttgctgttgtaaatgggtcttttttcccccattatgttttctagctggtc

SEQ ID NO: 31619 - DNA, 201 bp, Homo sapiens
actagtatattcaaagactgttgtttttggcatatttgctttgtaaagtcatcagactcttcataatactgcttacactgccaactaattctcctggctcytctaggcaagaagtaatatcatctgcaaataaatttgtctcattattttatctcctccttttcagtggcttttcttttattttcttccatggttattggt

SEQ ID NO: 31620 - DNA, 201 bp, Homo sapiens
gctcctggaaaatagcactgcccgtgggctttggtaagtctctgcagcccccagaggagacaggcttcaagcccagacccttgagcttaaaactactgtcygccaaaatctcttagcacaaacttgggccaagtctgtttagtactctgcctctctgttttctcatctgttgacctcttgtacaattgtgaagaccaatta

SEQ ID NO: 31621 - DNA, 201 bp, Homo sapiens
ggtgatctaattttgaaaaatcttatcagtaaacaaacataaatgttcccaccttcgttcttgaaagagtatattactatgtacattaagaacttaattasatttatttaacctgtcaggttgctagaatgtcttgattaactcactaagatcccaaagtagaaactttatttggcttctttatggaacagaggggacaat

SEQ ID NO: 31622 - DNA, 201 bp, Homo sapiens
aaactgaggataatgatagtacttatgccatggcggtattaaatgggttaataacataaaccagtttagaatgatgcctggcatgcagtaattgctccatrtttgtgttaatattatcattagtgcgactactgtttctagaactactgctacctgcaaatattcagtagcctatggggaaacaggtcagcctttccccca

SEQ ID NO: 31623 - DNA, 201 bp, Homo sapiens
aggcaggagaatcgcttgaacctgggaggcggagagtgcagtgagccgagattgcgccattgtactccagcctgggcaacaagagcaaaactcaatctcaraaaaagaaattacagttaccaattaattgttgtcctactatacacctcatattgctctgtataaatcttacacaaactcccatgcccctcgtttcttcac

SEQ ID NO: 31624 - DNA, 201 bp, Homo sapiens
tctttattatttaggctttttctagttttgggctaccccaaacaatatcacaacaaaataattgtgtgtgtgtgtgtgtgtgtgtgtgtgtgtgtgtgtgwgatttcaacatgagggcagatgtctatagaatggatttgttgcctcaaaggatatatgcatttgataaacttgccaatttgcattaatttaaatactgcc

SEQ ID NO: 31625 - DNA, 201 bp, Homo sapiens
aagtgtgcaaggatcaacacaagctatataacatataatgcaagttgtataaaacaaaaatatttatatttgcagagaataaacactccaggaacgtactrtaattggttaacagtcgttatctctgagagggcaatggataagtttgatttcttcctactgttccatagaatacctcaaattttctttaatgataatgta

SEQ ID NO: 31626 - DNA, 201 bp, Homo sapiens
tgattactgtagctttgcaatgtgttttgaaattaggaagtgtggggccttcagctttgtttttctttctcagatttgttttggctatttggggtcctttragattccatataaatattagaatggctttttctatttctgcaaaatgtgccattggggttttgatagggattgcatcgaatctgaagatcactttgggaa

SEQ ID NO: 31627 - DNA, 201 bp, Homo sapiens
atggcatgatcttggctcactgcaaccttcgcctcctgggttcaagtgattctcttgcctcagcctcccaagtagctgggattacaggtgcctgccaccatgcccagctaatttatttttatttttagtagagatggggtttcaccaagttgattaggctggtcttgaactcctgacctcaggtgatccacctgcctcagc

SEQ ID NO: 31628 - DNA, 201 bp, Homo sapiens
gattactgacattcagcaggagatatctgtactttcaaaagggtcatgtacttgaatcttcctagttaaaaaagaaaaagaaaaaaaacgtaaaagatgcrtatataaaaaaagatttcattgcagctttattttaaattgcaaaactttggaaacctaaatggttaacagagtatctgttaaatacattctagtaaatct

SEQ ID NO: 31629 - DNA, 201 bp, Homo sapiens
ctctactactccctgacacaatttttagattatctgtccacccactcagatatatttttccctcagttcattcaaactgcgagagagaaagagagagaaagagagagagagagagagagagagagagagagagagaatttgaaagaatttattgaaataaggttcctttcagccaagactgccacctctgtccttcctctg

SEQ ID NO: 31630 - DNA, 201 bp, Homo sapiens
ctggatgtggatggtacagtatgcaatgcacagaggcgctgttttgtcacaccatgttgttgggtgatcgtgatgttttaagtatttaacttctctaacayaatggtttgttgcatatatttaggtattttattttgtcttaattactttttggattttgggttgaagtacaacacagtataattttttcccacttaaaat

SEQ ID NO: 31631 - DNA, 201 bp, Homo sapiens
agtgactaagggacttgaccataccccttgctagcaagtggcaaggcagagttaagaacccaggctttctgattccatggcactatgttagggttttgggtttttttttctctctctctcattagggttttgttttctttttctctctctcatttttaaaattaattttcaaatatgtctcacataagggcacagggcttg

SEQ ID NO: 31632 - DNA, 201 bp, Homo sapiens
atgatggcacccagtgctggaggaacagtcactctgttgacagtatcaatgggaaccattttcctggagggcaaagtggaagcatgcagcaagtgtggacrtggccttcccaggcttatgttaaatcaaaggtaaacccacttggttacctcaagagtgcctcttagttttaacacccacatttcatagagcttacgtatc

SEQ ID NO: 31633 - DNA, 201 bp, Homo sapiens
gggacttgaccataccccttgctagcaagtggcaaggcagagttaagaacccaggctttctgattccatggcactatgttagggttttgggtttttttttctctctctctcattagggttttgttttctttttctctctctcatttttaaaattaattttcaaatatgtctcacataagggcacagggcttgaagttgcct

SEQ ID NO: 31634 - DNA, 201 bp, Homo sapiens
acctgacacagtgcctgacccagggtgagccctccatagacaatcattacatgaactgggtgaaagaagaatgatggcacccagtgctggaggaacagtcrctctgttgacagtatcaatgggaaccattttcctggagggcaaagtggaagcatgcagcaagtgtggacgtggccttcccaggcttatgttaaatcaaag

SEQ ID NO: 31635 - DNA, 201 bp, Homo sapiens
tattgagtgcctctgtgcgcctgagctctcagcagcactggggacatgggcaagtttcagtgctgagtgtacataagagaggcagctacacacaggctcasagcagcattattcacaacagccaaatggcggaagcaacccatgtgtccatgtgcagatgagtggataaacaaaatgtggtatatccatatgataatcttt

SEQ ID NO: 31636 - DNA, 201 bp, Homo sapiens
acaagaaacaaaggcaaaggaaggcatttcaatattagctgggcatggaccccagattcaaaagcagagcctgagtcctttggtaagctcaaatgaaccaygtgagctcacatttttttctaagctaatttggttttaaaggctgcaaatgaggccgagcatggtggctcacgcctataatcccagcactttgggaggcca

SEQ ID NO: 31637 - DNA, 201 bp, Homo sapiens
agaaataatctaaatgtaaaaatagtaagagattaggtattataaatttaaagtgtatactcagagagagagagatagggaaagatacagtcattacaaakcattcatgtatgaacctgggcaacatagtgagactctgcctctaccaaaaaaaaaaaaaaattagctgggtgtggtggtgcatgcctgtagtcccagata

SEQ ID NO: 31638 - DNA, 201 bp, Homo sapiens
ttcattaggaactccaatatggctaagaattagaccagtcgttctcaactagaggtgattttccccctaggggacatttggcaatatctggagagattttggttgtcacattgggaggtgctactggcattcagtgggtagaggtcagggacgctgctaaacatcctatatgtacaggacagcctcccacagtgaagaatt

SEQ ID NO: 31639 - DNA, 201 bp, Homo sapiens
gagaaataaggattttgaacatatactttagtcactaatatatttaaaataaagtatagtacttctaaatcactaaaagaaaaaacatgtaaaacataatycaaatataaaaggcagagaacaaaggaaactatgtagggacaaagatacagcaagcacaaaataagatacagcagtagaataaaatcattcaattgtaat

SEQ ID NO: 31640 - DNA, 201 bp, Homo sapiens
tgaggcaggagaatggcattaacctgggaagcggagcttgcagtgagctgagatggggccactgcactccagtctgggtgacagagcaagactctgtctcaaaaaaaaaaaagtgaacattttaatctacatgggaaatctaaacaaaacaaaaagcacacaaccaggtagaaaacaatatttgcaacaaatatgacaaaa

SEQ ID NO: 31641 - DNA, 201 bp, Homo sapiens
caattctgcctgctggagttatttaagcttgtcctgctcttaaggcagagtccccacatgtgtggtcgagtctttgttttctgacacttggttttctttctttctttttttttttttttccaggaaacttaagatttcatttgcataagccacagtaattaagaaattcaatttggttttgaaatggagattgacatacag

SEQ ID NO: 31642 - DNA, 201 bp, Homo sapiens
ttctcccagggatagtgaatcagagggctatccccctgccgcactgtattagctaggcttgaataatgtatgtttccctactaatgccctctgtttgatcrtgtgtccatgttagtgttcattggaaattttcctgctggatacacatggagagtaatgcacatttataaaaacggtttgaatgcatgttgggaggctatg

SEQ ID NO: 31643 - DNA, 201 bp, Homo sapiens
catcggtctctttgtagtccttacactttggggcctcacagaagacttccacacaaaagcctttctgatattggaaggcaatccctatgccttagcaaagaaaaaactatccagtggcagcagcaaaaactaacaactgcaaggccaggcctcaggatggagatatcaagcttttgacccagttactcctttacccctcag

SEQ ID NO: 31644 - DNA, 201 bp, Homo sapiens
gagcccatatcctctgcaaagtccatccaacctctcctttccctggtgcacacggagaggggtctgggtggctgcaatgactgagtgccccaatgtcagtsaccagctctctcacctactagctgtgggattattaggcaaggtacttaaccacttcaggcttcagtgtccgcatgatggaaaagaaactttaaggtgcct

SEQ ID NO: 31645 - DNA, 201 bp, Homo sapiens
gagtatcagggtaaggacaaggagcaccgcctttgcttctctgtctatctccatctcttgccccagccacccaccttcccagccttccatgtgggggaaarcagaacaccataaggggtgggttgcggtggcaggcccagtcagggaagcttccttttggtggcagatctctccggaccccatttgtcagcttaagttctc

SEQ ID NO: 31646 - DNA, 201 bp, Homo sapiens
ttgtggtgctggaactgctcctgttctcccagggatagtgaatcagagggctatccccctgccgcactgtattagctaggcttgaataatgtatgtttccytactaatgccctctgtttgatcatgtgtccatgttagtgttcattggaaattttcctgctggatacacatggagagtaatgcacatttataaaaacggtt

SEQ ID NO: 31647 - DNA, 201 bp, Homo sapiens
accaggtgtgtccctttagaacaaacccacttgctttcctgaggagtccttctttggggaagttcatccttcctcctcttagggtttatttctgccttatrtggccaacctctccctttgaagcttcttgcaggggaacaggctctgaggtttctctcagtgttgaggtactctcactgaagtttctgtctttttgaagag

SEQ ID NO: 31648 - DNA, 201 bp, Homo sapiens
cccttgagagaggcaaggagcaggagacttttcctcagtgcaaccgtgagaagagaggaaggggaggctccctcttagcatcgcctcccctcatggccacrcatatctcacagtgcccacatcagcccctacatggaaaatccaagcagctttgcccctgggaatggcctctgtggtgctctggtccccttcctcattccc

SEQ ID NO: 31649 - DNA, 201 bp, Homo sapiens
aggcagaaaaatagttttctttttttggttcaagtcagcatctttttgagaaataaatccatgcaagacagtataaaatgtcctggaatatgaaacattcygaggctcacacaaggctgagttgtgagaggggagcagtcgtctgggccatttgatgggagctgagctagttatttaagtctgaacagaacatgacccgcc

SEQ ID NO: 31650 - DNA, 201 bp, Homo sapiens
tgttttgagatccatgggggagatgggtatgtgagcacatcaatgcaaagtggcagaggaaggaagtgtcgtgtcaggagcataatcagtgttgtgggagyccagaggtgagaaaggatctgcttcctcctggccagctggggagggctcccagcagaggggatgcttgggttccggctcatagagcaagtgggttgatca

SEQ ID NO: 31651 - DNA, 201 bp, Homo sapiens
caccccttgcctcccactgatgcccttcctctaagcctcccactgtgttctctggaatcctagttccgtggccagcaagcgtacaccctcagtccctaccyagctggctgtcttcacttcctccctccatggagaccatggctgtcctctgagagcacgtatgctgtggccctttcaagtggattgttaatccccctccac

SEQ ID NO: 31652 - DNA, 201 bp, Homo sapiens
ctaggaacaggggaatggtcgaaagggcccctgaagcccctaatctcctccagtccaacagggtctttcctctcatccagcccaccactgcaggcagccakagacgccaacgcatgccaacgtcggggccctggatttgccctccatgggctacacgctcatctactcctgccaggagggcttctccctcaagggtggctc

SEQ ID NO: 31653 - DNA, 201 bp, Homo sapiens
tcttttacaggcttgccccctgtaaccctgccccctccaccacggcctctgtgaccttaccttctcctaccctccctcttattcccttccccagccacaakggcttccttgctggtccttagatgccacgcgtgctcttcccacctcagggcctttgcacgtgctttcccctctgcttggaatcctctccccctgagatat

SEQ ID NO: 31654 - DNA, 201 bp, Homo sapiens
ggtgtcagggggagccacactgatgggctgcctggcatgggcagctggagcttaggtatctgtacagggatggagctggcacagggtgtcagagctctgcrcaggatgagcagacacccatgtagggtattggagcccaagcagaggaaggcggacagccacacagagaaggttcagcccaggaaaggaagtcagagccca

SEQ ID NO: 31655 - DNA, 201 bp, Homo sapiens
cctccatcctgttctcatgatagtgagttagttctcacgagatctggtggttttataaggggcttccctcttcactgggctctcattcttctccttcttgytgccatgtgaagaaagacgtgtttgcttccccttctcccatgattgtaaatttcctaaggcctccccagccatgctgaactgtgagtcaactaaacctct

SEQ ID NO: 31656 - DNA, 201 bp, Homo sapiens
tggctaatttttgcactctttctgtagagacagggtttcaccatgttgcccaggccggtctcaaactcctgagcttaagtgatccactttgcctccatctyccaaagtgctaggattacagatatgagcctccatgcccggtctactagtgtgtcatttaagtcttaaaacagtttatggttaagtgttactattaagcct

SEQ ID NO: 31657 - DNA, 201 bp, Homo sapiens
catgttatttctgttatgtaaagacaatcattctataaatgttcttctgtgacctgctcttctcactcaaaattaagtttttgaaattcatgttgatgcaygtgactgcacttaactcatttttcaatgctgtatgatttcattgcatgaaaatatagcaatttatttagtctactgttaacacttaagttgtttcatttc

SEQ ID NO: 31658 - DNA, 201 bp, Homo sapiens
acaacaatgaacaaaataagggaaaaaatcatcacttaaaacacagatatatagggttgaacagagagtgacaaagagcgagagctagaagattctttggrggcccctctttcctacatctcagcctctctggttctatcagatgagtcctagcagcattttccatgctgcacttttttgtgtgtgtgatctaaccacaca

SEQ ID NO: 31659 - DNA, 201 bp, Homo sapiens
caaaaccgccatcgtcatcatggcccgttctcaatgagctgttgggtacacctcccagacggggtggtggacgggcagaggggcccccccaccccccagaygtggcggccaggcagaggtgccccccacctcccagacagggtggctgccgggcgtgggcgcccctcacctctcagatggggcggctgccaggcgggggcg

SEQ ID NO: 31660 - DNA, 201 bp, Homo sapiens
gctacagtatctgctctggtgtgactatacagtgttattacatcatgcgtgcacttgcagaaacacactaagactgtgaaagaggtagtgaaagaaacagraagcaacagagagaaacaaggatgtaaagaacctaagcagctgtgactgccattcccaggagctatcgtccagggtgagtgcaatgtgggaatgagactc

SEQ ID NO: 31661 - DNA, 201 bp, Homo sapiens
tcctcacttcctagacgggatgacggccgggaagaggcgctcctcacttcccagactgggcggctgggcagaggggctcctcacatcccagacgatgggcrgccagttagagacgctcctcacttcctagacggggtggcggccgggaagagacgctcctcacttcccagactgggcggctgggcagaggggctcctcaca

SEQ ID NO: 31662 - DNA, 201 bp, Homo sapiens
tttctgcagtgatggaactgttctatgtctatgctgcccaatatggtagccactggctacagagtacttggatatgactgagggtctgatttttaaatgtyatttaatcttgataatttaaatgtaaatagccatgtgtggctggcagtggctgaattggacagctcagctctgagttatgtagttatatacaacaagagt

SEQ ID NO: 31663 - DNA, 201 bp, Homo sapiens
cgggaggctgaggcaagaggattgtttgaacctgggaattcaagactagcacgggcaacacagtaaaacctagtctctgaaaaataaaaataaaaaaaaayttcatgagtacaagttttgcaattactgctttcactacattttaaaaaattattttattttagattcggaggttacatgtgctggttctttacatggata

SEQ ID NO: 31664 - DNA, 201 bp, Homo sapiens
tgggaagggagaggggacagcttcagggcatcctttcttcttggcagttctcttcataagaaagagaaagagggaggctgaggcagacccacagaggggcmtgcagtgatgattgagagccagccagggtgttctgtgtggggactggtgggtagaaccaggtgcagccatcctcagcttggcctccccttccgcatccca

SEQ ID NO: 31665 - DNA, 201 bp, Homo sapiens
ctgtgttagccaggatggtctcgatctcttgacctcatgattcgcccgcctcggcctcccaaagtgtcctcactgcttttttttttttttttttttttgaracggagttccgctctttagcccaggccggattgcagtggcacaatcttggctcagtgcaagctccgcctcccaggttcacgccattctcctgcctcagcc

SEQ ID NO: 31666 - DNA, 201 bp, Homo sapiens
acatagcaaatgcgtcctcttccagggcctgggctgaacattttgcctgcatcgtttcacctcatcaccaccacaatcctatgggggaggtattcttagtyccattttacaggtgaggaaatggagactcagggaggctaaactacttatctaagactatctgctcaatacatcgttcagctatgatttgaacccaacctt

SEQ ID NO: 31667 - DNA, 201 bp, Homo sapiens
aattatgatgagatagaaacaaaaggaatactcctacatttataggaaaaattagaaagcactatttagcaaaaagacaaaataatttgtgaatcatgagrtagagcagtggttctcaactgaaggcagttttgtcccccaggggacatttggccacatctggagaaatttgtggttgtcccaactgcaagtggagaggtg

SEQ ID NO: 31668 - DNA, 201 bp, Homo sapiens
tataagaactctcttgctcccctcttcatcttccccctccctgctccattatactctcctacacagggctggagagacctgagttgatctatcagggagcyggaggtggcactttcttgggtcttcttccttacccagaaccaggaaggaaggtgaccaagagcttgtgctgcctccaccctcatctgcacacttcagttc

SEQ ID NO: 31669 - DNA, 201 bp, Homo sapiens
gaaaaacccattttttgaggagaaattcaaactggctgcaaaaatttgcataagtaacaaggaaccaaatgttaatcccaaagacaatggaaaaatgtctytaggccatgtcagagaccttcacagcggcacctcccattacagccccagaggcccgggaggaatacgtggttttgtgggctgggcccaggatccccatgc

SEQ ID NO: 31670 - DNA, 201 bp, Homo sapiens
tcccccatactgttcttgtggtagtgaataagtctcatgagatctgatggttttatcggggtttccgcttttgcatcttcctcacttttatcttgttgccrccatgtaagaagtgcctttcacctcccaccatgattctgaggcctccctagacatgtggaactgtaagtccaattaaacctctttttcttcccagtctcg

SEQ ID NO: 31671 - DNA, 201 bp, Homo sapiens
tctcggtgggggccatcgtccgcttcgaatgcaactccggctatgccctgcaggggtcgccagagatcgagtgcctccctgtgcctggggccttggcccartggaatgtctcagcgcccacgtgtgtgggtgagtaaccaggacccgggcgttgagggtgcggggggcggcacgtagtcctttctctgtaggggaggcagt

SEQ ID NO: 31672 - DNA, 201 bp, Homo sapiens
tcttacaagaactctgtgaaataggtgttgccattctgcagatgaggagctgaggctcagggagattgagtaactcataagtggtggtgctgggatttgagcccatgagtcaggtagttgagcccctgagccccactcagaacacagatagcagagaagcagtgagtggtggccctgggtgctagagaggagccaggggca

SEQ ID NO: 31673 - DNA, 201 bp, Homo sapiens
aaaaaagtatcaaaaatgagatttcacaactgtgtcactacaaaaatgaatataatccagcctggattctttattacagagccattattatcctagtcatttttttttttcatctgattttgaaagaaactaaaattagaatgttttcctgggttcctaaaagtatggtggcccccaagcactgggcctccaggtctaatg

SEQ ID NO: 31674 - DNA, 201 bp, Homo sapiens
acattttgtagagtttgtgttgttggtatgcggaacccttgcccaaagagctgtgacccctgtatttccctgcgctaacatgatgaggacaaagactctayctgtggattctagcatgcatccgatgaccatgtggtggctacaggcaacactggtgatataacctctcagacctagctcaaagcggtaatcaccaagttc

SEQ ID NO: 31675 - DNA, 201 bp, Homo sapiens
tctgcaacccccaccaggactcacagagttcaccgttgatgggtagaagttcttccttcatgcgaggcatctggaagaaaagcaaagtcgagggcaggactttttttttttttttttttgagacagagtctcactccgtcacccaggctggagtgcagtggcgtgatcttggctcactgcaagctccgcctcgcaggttca

SEQ ID NO: 31676 - DNA, 201 bp, Homo sapiens
ccgtcaatcagctcccatatggtgtgtgccaactgtaggttctaccatcaatcagctgggcctgaatatacattttgtagagtttgtgttgttggtatgcrgaacccttgcccaaagagctgtgacccctgtatttccctgcgctaacatgatgaggacaaagactctatctgtggattctagcatgcatccgatgaccat

SEQ ID NO: 31677 - DNA, 201 bp, Homo sapiens
ttaagtttggtaattacagtatcagcacataacatcacacctttcctggtttccactggattaacacctttgctaatctctaccaagccttccatggtgayggagcatgccagtacagtagcaatggtggtgccaccccaccctcttcatttgtgtgttggcaacatcctgatcaaatctggtgccaacatttatcttgta

SEQ ID NO: 31678 - DNA, 201 bp, Homo sapiens
cagtcagatcccagcctgcctttcctatacctgtcactgcctctcttgccaagtcaaccctgctgactgagagatggaagatattccacagtgaaaaccaytggctcctttgccttctagaagtcctgcactgagtttcaattgtctgcagaataaacttattcatttgaaaacatttgcatttactgagatggttgaggc

SEQ ID NO: 31679 - DNA, 201 bp, Homo sapiens
tcaggaggctgacacaggagtgcatgaacccaggaggcagaggttacggtgagccaagattgcgccactgcactccagcctggcaacaaagtgagactccrtctcaataataataattttaaaaagtatctttcttcacactctcatctccttgcaggttctctaagtctctttcatacccaaacttctgtagcaggatgt

SEQ ID NO: 31680 - DNA, 201 bp, Homo sapiens
gcagcggctgttaccagttgttcctttccatgtttagtgcttccttcaggagctcttttagggcaggcctggtggtgacaaaatctctcagcatttgcttktctgtaaaggatttcatttctccttcacttatgaagctagtttggctggatatgaaattctgggttgaaaattcttttctttaagaatgttgaatattgg

SEQ ID NO: 31681 - DNA, 201 bp, Homo sapiens
atccaggcacctgcccaaagggagaagagcatgaagcctctttataagaactctcttgctcccctcttcatcttccccctccctgctccattatactctcytacacagggctggagagacctgagttgatctatcagggagccggaggtggcactttcttgggtcttcttccttacccagaaccaggaaggaaggtgacca

SEQ ID NO: 31682 - DNA, 201 bp, Homo sapiens
agttggaaagaaccaactcaactcctcccgtcgccgcttcctatgtctgggatcttgatcctggttgtgaaggttcaatgagataagcaacatgaaaggarttaggctggtgcctggcccccagtggcactcagtgaatagaggttcaattgagcaatgtcttccttgagcctccttttcctacggaattactaataatag

SEQ ID NO: 31683 - DNA, 201 bp, Homo sapiens
agctactccctctgaaaagcttctctccttgccacagatttgacttactcccaccagatttcttccttcctgagaggttttgatctctcggagttggaaaraaccaactcaactcctcccgtcgccgcttcctatgtctgggatcttgatcctggttgtgaaggttcaatgagataagcaacatgaaaggagttaggctgg

SEQ ID NO: 31684 - DNA, 201 bp, Homo sapiens
gaggctcagggagattgagtaactcataagtggtggtgctgggatttgagcccatgagtcaggtagttgagcccctgagccccactcagaacacagatagcagagaagcagtgagtggtggccctgggtgctagagaggagccaggggcatggtcttccatggtgaggcagccttggtgccctgtgtcccagccgctccag

SEQ ID NO: 31685 - DNA, 201 bp, Homo sapiens
ttattacgtatgagaaacacatgtacttctaagaagcatctatccagtcccaactacttccactgaggattcccactgtaggaacgttctgtctcctcccrctgccaatttcctgagtggagtgggcgcaattactgccacgaaggctgttctgtgtcctgtggacccaattcatcaaaggccttgctcaggaatccctca

SEQ ID NO: 31686 - DNA, 201 bp, Homo sapiens
tagttactgagcacctgttaggggccagccactgagggagaccatataatatgttaattatactgggccatgtggtcactctgcagggttgaacaggcatygcaaaaacagtgggggaacaaaatacacagattcccatctctcccaaacttagcctctagtaagggagattagtaaataaactaggaaacagacagaatg

SEQ ID NO: 31687 - DNA, 201 bp, Homo sapiens
atgttatcttcaagatccgcgttattgatgttgttattacgtatgagaaacacatgtacttctaagaagcatctatccagtcccaactacttccactgagkattcccactgtaggaacgttctgtctcctcccgctgccaatttcctgagtggagtgggcgcaattactgccacgaaggctgttctgtgtcctgtggaccc

SEQ ID NO: 31688 - DNA, 201 bp, Homo sapiens
tcactgtgctcttagggtcaactcccaaataagctcacttgtagccaaatccttaacacaggtcttgttttagtggaaatccaacccaggtgatatagctaaacaggtgctgaacattttgatagaaataattgtaatagctatgagcacttattctgtgctaagtaccattcaaaacattttgcctgtattaagttattg

SEQ ID NO: 31689 - DNA, 201 bp, Homo sapiens
gtattcccacagaggcctcatcatttgtgataggcccaaataactctccctgaccataagcccacactctctgtttacaccttcctccgccgtacggagcrgcacctcgtaagcaagctctgaccactctccccaggtttttcctctggggaaaaacccagcttcaatgaacgagccatttgtccccactgaggctgtttc

SEQ ID NO: 31690 - DNA, 201 bp, Homo sapiens
cctaaagtctcaagcttttttcacaccagctcacacgataagagacaatcaccagctccaataatgtttgacagtggcctggttggaaaccactttttttwaaagagacagagtctcgctctgtcgcccagcctagagtgcagtggcgcgatctcggctcactgcaagctccgcctcccgggttcacgccattctccttcc

SEQ ID NO: 31691 - DNA, 201 bp, Homo sapiens
tgatgggaccagccactcgctgtgctccccgtgtgatgagcccacttgtccttgtaaaggttgtgcctgtgtgaccgcctcagattctccattgactcccycgacagaagaggcctaactacccccacagagccctggccttgggctcactcgcccctgattccccagcccccatctttggaaatgctcccactatggcca

SEQ ID NO: 31692 - DNA, 201 bp, Homo sapiens
atcctataggatactctctctcctctttctctttcttacacacacacacacacacacacacacacacacacagttgtcccataggggattgatttctcgaccccccccccatggatataaaaatctgcagatgcttaagtcccttatttaaaatggtgtagtaattgcatataacctcccatatcctcccatatcccttaa

SEQ ID NO: 31693 - DNA, 201 bp, Homo sapiens
tgccttcaccctagacaatgggcacggtcctgccactgaatccctgtgatgggaccagccactcgctgtgctccccgtgtgatgagcccacttgtccttgyaaaggttgtgcctgtgtgaccgcctcagattctccattgactccctcgacagaagaggcctaactacccccacagagccctggccttgggctcactcgcc

SEQ ID NO: 31694 - DNA, 201 bp, Homo sapiens
caggagaatcacttgaacccgggaggtggaggtagcagtaagccaagatcgcgccattgcactccagcctgggcgacagagagagactccgtctcaaaagaaaaaaaaaaaacctgtagatatcaatatcagtatattcagagagtcccttattcctcatttggagaaacactgataacaagccattggtactgatgggag

SEQ ID NO: 31695 - DNA, 201 bp, Homo sapiens
cttccttctcggataaatataaggaatggcagtgccaccattgtgccagggacagctgccctgggcccaccccgtgcactgtgccttcaccctagacaatrggcacggtcctgccactgaatccctgtgatgggaccagccactcgctgtgctccccgtgtgatgagcccacttgtccttgtaaaggttgtgcctgtgtga

SEQ ID NO: 31696 - DNA, 201 bp, Homo sapiens
aaggcacaaaaagcctagattttccacatttcccagttttagaagctcttgatgaaatgcaaaggggaattaccagtgaaaacctgtgtttgtaggggtgtgtgtgtgtgtgtgtgtgtgtgtgtgtgtgtgtatggtgtgtgattatgactaatgtccatcaattacctgcaaattactagatgatgcctgtaatgatag

SEQ ID NO: 31697 - DNA, 201 bp, Homo sapiens
agagaggcagcaaactgggagtccagcagacagatctgggcaggagtgggttacgggctcattgctgcaggacgtctgatgaaatcaaggcaggaaagtgrggaaacccaaggaacattccagagatgaggagacagtcagtgagactgtctttccacttcctggaacttcttttccccattctctgccttgcaaaatatc

SEQ ID NO: 31698 - DNA, 201 bp, Homo sapiens
ggcacaaaaagcctagattttccacatttcccagttttagaagctcttgatgaaatgcaaaggggaattaccagtgaaaacctgtgtttgtaggggtgtgtgtgtgtgtgtgtgtgtgtgtgtgtgtgtgtatggtgtgtgattatgactaatgtccatcaattacctgcaaattactagatgatgcctgtaatgatagtt

SEQ ID NO: 31699 - DNA, 201 bp, Homo sapiens
gttttccaaagtggcaacaccattttgccattctagtaatggacttctgactgagtgtggtgtataggtgtgcccagtggccagggcaattatctgaatcttttaggcccagaactctaggtggccaagagataaagaggagtcacatgcttcagataaactgtccacactgcaggactgcccagagaataatacaggtca

SEQ ID NO: 31700 - DNA, 201 bp, Homo sapiens
aatcccagcactttgggaggccaaggcgggcagatcacgagttcagaagatcgagaccatcctgactaacatggtcaaactccatctctactgaaaatacaaaaaaaaattagccaggcatggtggtggcctgtaatcctagctactcgggaggctgaggaaggagaatggtgtgaaaccccggaggcagagcttggagag

SEQ ID NO: 31701 - DNA, 201 bp, Homo sapiens
tgggacctctgagcatgcagaataggctggtctgggatgtcaggaatgcacctttctagaagtaacgttgagacactcgtgataagatttgaatgatgagaaagagttaattagacaaatcccaagggttagaaagtgttctaaatgggagacagtgcgtgcaaagaccctgaagatggggcatggcaaattgaaggaact

SEQ ID NO: 31702 - DNA, 201 bp, Homo sapiens
gaagtggaaccctcaatcctcatattcatcaatcactttgactcacttgttaaatggtgaaacccttgcacagtgagaaagagctggtgcctctggctctyccttagacacctgctctttgctttccactctgacctaatgatcgtcatttggcccctcccttcagtcagatcccagcctgcctttcctatacctgtcact

SEQ ID NO: 31703 - DNA, 201 bp, Homo sapiens
cccactggactcatggctagttagatttggtgggagtgggaggggatggggttgaaggagatgaaggagtcagggatgaatctagcttaagtggttttagmaaaatgatattaacaaagatggtctggggcagaaacagatgggggatgaagtttgcttgggacacattgattctgggtaatgttgggatgtcagggattg

SEQ ID NO: 31704 - DNA, 201 bp, Homo sapiens
tccactgctgaggttgggtctttgtgtgagtggaacagctgtctgtatctttctgctgtgtttctcaaaagacaaaagcagagatgaatgctataattgtwtctgattaagtaagtgctgggtgtttctaatatttcaagttactgagggcccatttgtcagtttttaaggttaaggtttgatgccagcaatgggcgacaa

SEQ ID NO: 31705 - DNA, 201 bp, Homo sapiens
aaaaaaagtatcaaaaatgagatttcacaactgtgtcactacaaaaatgaatataatccagcctggattctttattacagagccattattatcctagtcatttttttttttcatctgattttgaaagaaactaaaattagaatgttttcctgggttcctaaaagtatggtggcccccaagcactgggcctccaggtctaat

SEQ ID NO: 31706 - DNA, 201 bp, Homo sapiens
atttcatcactgatgctgaaaacaccagcaagggctttgaactgcacttttccagtaagtctttcttgcatctgtgtggacaaggaagtcagggtttcccrttttattcatttatttgagcttctgcttgctcacgagatacaaagaatgtgctcttaagactgttttaaaatccaatatgtatccatcagtggatgcatg

SEQ ID NO: 31707 - DNA, 201 bp, Homo sapiens
acaggtgcttgtgaccacagccttgggggagagggcaagggggagatttttacagagccacgtgggagggaatgcagggtggataggggaccagtaccaaygctgaaatgtcagcaaggttggagaacactggaccaaattgccctgggtggggcagacctcactggctctgcccttgggcttggtttgtgctgtttaggg

SEQ ID NO: 31708 - DNA, 201 bp, Homo sapiens
ttattccagtgtaccatgccttgacagaaatgaattcgcttcagcgagtcaccccaattaagatcaaaaaatagtctccactcatcaggcatctgacctaagtaaggcaaggtacctgattgtcctgccctcagccttcccttctataaactgaggataatgatagtacttatgccatggcggtattaaatgggttaataa

SEQ ID NO: 31709 - DNA, 201 bp, Homo sapiens
gttttcatcattccctctacaatttattgaagcactatgttgcatgctttacatatattatttcataatatatatatatacatatatgtatatagatatatttttttttgagatggagtctcactctgtcgccaggctggagggcagtggtgcaatctcagctcactgcaacctccgcctcctgggaagcaattctcctgc

SEQ ID NO: 31710 - DNA, 201 bp, Homo sapiens
  misc_feature (1)...(201): n = A,T,C or G, or insertion/deletion polymorphism (see Tables 1-2)
gtcaccaggggctgtggatggtccacttctggctgctggtgtgggacgagggaagcaggtggtggttggcatggagggcctgtctctgagcccacacactngtgatgactttgctcacaaaggaatttgtcaaaagcagcctcctatcttgcacatccaagaaaccccaggccagtagactccggccaccccacacagccc

SEQ ID NO: 31711 - DNA, 201 bp, Homo sapiens
ggtgcgatcttggctcaccacctcctgggttcaagcgattctcgtgccttagcctccccagtagctgggactacaggcatgcaccaccatgaccagataawttttgtatttttttttttttttttttttttttttagtaaagatggggtcttgcttgccaagctggtctcaaactcctgggctcaagtgatccacctgcct

SEQ ID NO: 31712 - DNA, 201 bp, Homo sapiens
ctccatctgctcagttcccatgcccctctcattgggcacacctgtcgctccactaatgaaatccaggctttaaggctctgtcattttgacttgtgactttcccatagagtgataagagtatggacttcagagtcacagacgggttcaaaccttggctctgacacatgcaagctatgtaactttgtctgtcatttcaccctt

SEQ ID NO: 31713 - DNA, 201 bp, Homo sapiens
tgtgagtcctttcaggctgggattttttgttttgttttttttgtttgcttgttttttgagacagagtctcactctgtcacccacgctggagtgcaatggcrtgagctcatctccctgcagcctccacctcctgggttcaagtgattctcctgccttagcctcccgagtagctgggactacgggcacgcaccaccacgcctg

SEQ ID NO: 31714 - DNA, 201 bp, Homo sapiens
  misc_feature (1)...(201): n = A,T,C or G, or insertion/deletion polymorphism (see Tables 1-2)
gagggaagcaggtggtggttggcatggagggcctgtctctgagcccacacactcgtgatgactttgctcacaaaggaatttgtcaaaagcagcctcctatnttgcacatccaagaaaccccaggccagtagactccggccaccccacacagccccaacaaagcagggcctcattctgtctctgcctccacctcccaccctg

SEQ ID NO: 31715 - DNA, 201 bp, Homo sapiens
ggtttaaagctttgttccattatctttgaacactcactgctgatgggaagtcttatgccagtttgattctcgttccttcacagttatgtcatttttttttycctctttctagtaatttggaggaatgcctgtgtgtctctggacttcttagatacacaaaattccgtgatggtgaatctaagagggattctctttgcattc

SEQ ID NO: 31716 - DNA, 201 bp, Homo sapiens
gcagatctagacctgttaggaacccagggtgagtggccaaggagcaggagggaggagaggaatgggatggagctgggcttgaaagtgcaggtgagggagaycaggagccacatcattctggtgtcccatctgagaaccaaagcctggtccagaagctataggtaggacaagcaagaaaaaagtgaaaagcagaccagtgcc

SEQ ID NO: 31717 - DNA, 201 bp, Homo sapiens
tctgagaaatttacttttcatctctaatcctataatgcttatttcggcaatcatatttttcatttcaaagagtttgtccttgttttttttttgtttgtttktttttccttcagagcacactgattttattttatgagtaccgtatgtcaccttgactttctcaagatactactgatcagaagtttaaagattgtgtatctt

SEQ ID NO: 31718 - DNA, 201 bp, Homo sapiens
ttgccgtggatgtgtatagaagtggcttataattcactaggtgtgcagttcctttcaaggtatcatctcagaacccatggtgtccctacccccattcacayagatgctcatgccctcaacagaggcccccagacatgccacatcagggagctcacaccagggagaagtcatttaaaggtggctcctggactagttcctagg

SEQ ID NO: 31719 - DNA, 201 bp, Homo sapiens
ccctcttcttcaataagaatgtggccctcagataatgactacactctaagccttgttccttatcctggaatggaaggagatgtctcattgaaagaatggcytgggttccaactggagaaatgggtttctgtgaggggaaacccacataaagacagcaaggaggtgggggtggcggtggtcttttctgcaatacaggtcaca

SEQ ID NO: 31720 - DNA, 201 bp, Homo sapiens
gacctctgagcatgcagaataggctggtctgggatgtcaggaatgcacctttctagaagtaacgttgagacactcgtgataagatttgaatgatgagaaagagttaattagacaaatcccaagggttagaaagtgttctaaatgggagacagtgcgtgcaaagaccctgaagatggggcatggcaaattgaaggaactgaa

SEQ ID NO: 31721 - DNA, 201 bp, Homo sapiens
gaattaaaagagctttcctctgggatgccaactcccaccataacagccctaattcttcctaagagagttccccctcagtggaaaagaaaattctctctttygtttggagagtagatacttgaatgtgtctacactgtgtttgtgggaacagatggcggagaactggtttcaccctgaggctccctcccatatattttgagc

SEQ ID NO: 31722 - DNA, 201 bp, Homo sapiens
gtgtcactgaaggagaaattgagctaagtcctgaaagaggtaagacagggagccacaaagaccagaggccagtgtcgttggagcaaagctagcatagagaygacaggagctgaggtcacagaggggactattggggccacatgtgcagggccttgaaggcctgtaaggattttggttttaccccaagtgacacgggaggct

SEQ ID NO: 31723 - DNA, 201 bp, Homo sapiens
catctcttgcttagaataggcattaagggaactgcaaaccctggggcccaggagataccctcaacatcacccttctgaccacttccaaaccccctttggcsaataacagctaacgccagtccctacaaaggtggaaggagaagccatccacaagttactgttaagcccctcttaggtactagacgctagaccagcacaagg

SEQ ID NO: 31724 - DNA, 201 bp, Homo sapiens
tggcggagaactggtttcaccctgaggctccctcccatatattttgagctacagcttctttgcacttctatctttattccttcttccaaacttaaaaaaaraagaagaaaaaactcttctgctgatgatcctcccattttcttttttattatgagactttaccctttaattagtttttactaataaaaggaccttgggagg

SEQ ID NO: 31725 - DNA, 201 bp, Homo sapiens
gggttaggacatttgtgggtgctaggcgtggggcaatagcagaccctgaggagagctggagcactggcttgggatgaaggcacaaagctagggtccttcayggtaacaggtcccttcctccctgagaatggcaccatagttggctcattctctcttagaaaatgaggttcagaagagcacagtataaggacattagtgtca

SEQ ID NO: 31726 - DNA, 201 bp, Homo sapiens
aggatggtccctaggctgagtgtctgggaagggcacccaagggcataattctggtagacatgggtgagagacaagttgcagctgctgtgaattgggcccayctggagatggagacaaccagcgcttgctaggatggggtctggggaaccagatataggtctggccttgctggggacaatttactattttaatccatagggt

SEQ ID NO: 31727 - DNA, 201 bp, Homo sapiens
atggagttgcctttcttcccggacagcttcacctcctctctgcctccaggtcttatctcatgttattaaatccaaagaaagcactctcctttcacgccacytaaacttcaggtctcatttccttttgccttccctgatgagtgtggcccacaccgatgtcttttctgagagcacgtacagccacaccacacggctggcact

SEQ ID NO: 31728 - DNA, 201 bp, Homo sapiens
ccaatccagggagactgagtgtaagtctgatctaatggaggactggcgtactgtccaatagcaatataatatgagccatagatataattttttaaaacttwttaaatttaattttttattggtagagggtgttttactggggaaattcacagacagaagcatggtcttgggtagccacaaggcaggtagatctctgcaatg

SEQ ID NO: 31729 - DNA, 201 bp, Homo sapiens
ctactgggagcattaaataaattaatacacataagatagttagaccggtgtctgatccagatgttaagcagcagttgctgctgctgctgctgctgttgtgtgatgatgatgatgatgaagatgatggtagtggtggtagtaatgctgccaccatcacattacagaatccaggatctcttacactaaggcccattctctctt

SEQ ID NO: 31730 - DNA, 201 bp, Homo sapiens
tctctcatctctcttttctcttataaagatatcaagactcagctcagtagttacctctcccaggaggcctggtctcatacccttggcctaagttagggggmttctccgtacatacctttactgtagactgtaccacatgcaggggtggaagcatgccatattcttatctgaatcaccagtgcctagtatgctatctgaacc

SEQ ID NO: 31731 - DNA, 201 bp, Homo sapiens
tttgcggattttctaactgagttgttgaatccttgcctttttctcaatcttaagggaaaagcattcagtctttcaccatgaagtgtgatgtcagctactgtttttttttttttgtagatgttctttatcaacttcagaaacttaccctctatttgtaggtttctgaatttttttttttcgtttaactacaaacgggtgttg

SEQ ID NO: 31732 - DNA, 201 bp, Homo sapiens
ggagagcatccagagcctcccagggtttcatccagacggtctttgttccagacccgttgtatgtccgtccctgggccagtttctgaggggtgaggcctccmctcagtgcccttgtcccccacagcggttcctcgaaccagcgccacgcagtgcagctctgtgccggaaccccgctatggcaagaggctgggcagtgacttc

SEQ ID NO: 31733 - DNA, 201 bp, Homo sapiens
ggtgccgtctgtcacccctttctttgactaggaaagggaatttcctgaccccttgtgcttcccaggtgaggcgatgcctcgccctgcttcggctcacacayggtgcactgcacccactgtccggcactccccagtgagatgaacccggtacctcagttggaaatgcagaaatcacccgtcttctgcatcactcatgctggg

SEQ ID NO: 31734 - DNA, 201 bp, Homo sapiens
ctgtaggatttggggttgggcaaacccagcttataatcaggatcttcctttgactccctgtgtgccagtctctccccatcaatgagcctgaatttcctaayctgtgaagaggggctgatgaatggttatctttccagggtctcatgaggactcagtatagtcaagcacccagcatagggcctgacatttagtaaatgctca

SEQ ID NO: 31735 - DNA, 201 bp, Homo sapiens
gtcctagtaagaagtcaaataggccctaggcttttgaggtcatggatttgaaaactgtgacacacacacatacatgcatgtacacgtactcacacaaatasaactcttccataagattcacagggagtttacagatgccctgtggccaccccgatcccctagttcacctaaaaaaacagcccagagaggttgacctcacac

SEQ ID NO: 31736 - DNA, 201 bp, Homo sapiens
agtttgatctcagactgctgtgctagcaaggctccgtgggcgtaggaccctccgagccaggtgcggaatataatctcctggtgtgccgtttgttaagcccrttggaaaagcgcagtattagggtgggagtgacccgattttccaggtgccgtctgtcacccctttctttgactaggaaagggaatttcctgaccccttgtg

SEQ ID NO: 31737 - DNA, 201 bp, Homo sapiens
ccagcatagggcctgacatttagtaaatgctcagttggaagcttactcccttctctgctctccaaggcctacagctcttcttccaacctacatcattaccygaagcttcagaattacctctgcctccattttagcccctgttattccagctcctggggagttccacacaggatagacatctcgactcaggaacgagcaggg

SEQ ID NO: 31738 - DNA, 201 bp, Homo sapiens
tatatagccctgagggttgcatgatgggagcaccaaagcctacaagctaaatgtggcacgttttctaatcttatcgtaaagcaaatatacatacaatcattctatctgtctatctatctatctatatcaaatagtaaactaaatacatatatttcaaccaaatatatattttaaaaatatgtttctttatgcagtctatca

SEQ ID NO: 31739 - DNA, 201 bp, Homo sapiens
acaaaggtaacatattatcctcagatatgcacaaaagccacataaaattggctctcatcggcttcctgaggaacttacaaaaacattgtagtaggttgaayggtggcccccaaaaatgtgaggttccaatgcgtggaacctgtaaatattgccttatttggataaagggtctctgcaggtgtgattaaattaaggattttg

SEQ ID NO: 31740 - DNA, 201 bp, Homo sapiens
atatagccctgagggttgcatgatgggagcaccaaagcctacaagctaaatgtggcacgttttctaatcttatcgtaaagcaaatatacatacaatcattctatctgtctatctatctatctatatcaaatagtaaactaaatacatatatttcaaccaaatatatattttaaaaatatgtttctttatgcagtctatcac

SEQ ID NO: 31741 - DNA, 201 bp, Homo sapiens
tatagccctgagggttgcatgatgggagcaccaaagcctacaagctaaatgtggcacgttttctaatcttatcgtaaagcaaatatacatacaatcattctatctgtctatctatctatctatatcaaatagtaaactaaatacatatatttcaaccaaatatatattttaaaaatatgtttctttatgcagtctatcact

SEQ ID NO: 31742 - DNA, 201 bp, Homo sapiens
atagccctgagggttgcatgatgggagcaccaaagcctacaagctaaatgtggcacgttttctaatcttatcgtaaagcaaatatacatacaatcattctatctgtctatctatctatctatatcaaatagtaaactaaatacatatatttcaaccaaatatatattttaaaaatatgtttctttatgcagtctatcactg

SEQ ID NO: 31743 - DNA, 201 bp, Homo sapiens
ccagaggtcagggccaacctgaagggtcgtatcccctttgggccctgggccaagctttttctcctgcttgaagctatcttcttgtgtgctgctcttgcctyttgaacccatcctttagagaccaaggcaggcaaccccattcctagggcactgcttatgcatcagatgccacttaacgatgatgtcccaggcatttcattt

SEQ ID NO: 31744 - DNA, 201 bp, Homo sapiens
ttatgtagctggagctgcccctcacatgccaggctaatcataatagttaataccagatgcctgctaagagccaggcacagtgctaggcacttggcaagtascatctcctttaatcttcatcattatcctgcaaaggaaacacggtcatcacctcactttatggacaaggaagctaaggcccagagaggttaagccaatttc

SEQ ID NO: 31745 - DNA, 201 bp, Homo sapiens
ttcctcagtgggcagcagagatgacacctggagggctcatcacctctccctactgggtccggtgtggcttcaggcatccttgccttctttgtacgtttctwtttgcagaccagaggtctgcagatttgcatctctgcatctgcccttgtcttttgccccagagagggatgtttcccaaattatgtagctggagctgcccct

SEQ ID NO: 31746 - DNA, 201 bp, Homo sapiens
gtcctatatggtgtcttcttacatgcagccccctgtttggagataactattttctctctgctccaggattgggagtggtaacaagtccctcagttgccagycccaggatactgcccctcccgggtggttcccccatagtcggccctcacctttatagttccaagagtttgatgaatgactgtttcacataggatataagga

SEQ ID NO: 31747 - DNA, 201 bp, Homo sapiens
atattatttcaggttcaacaattcctttagcttcacacctgtttccttttattcagttaaattccagaaagaaaatttaaacattttaattttaatagcaygcacagtttgatcccatttgtatgaaattatttcattgaatatgattccatctattgatcccaccatctctttgtatgtcaactgtcaggaataattatt

SEQ ID NO: 31748 - DNA, 201 bp, Homo sapiens
gcccgatactcatgcccttcagtggatatcctgggcatcaagatattgtatagcagtgggaggtatacagcggcacccaggagaaccacggatatttcaarttacctaaaaatggggacaaagttaaaccttgaaattcctcctagattcctacctgggtgtggtaaggcaggctgaggcttagagggggttaaggacaaa

SEQ ID NO: 31749 - DNA, 201 bp, Homo sapiens
gatgattaaacaaagtttgtttccttataatatgtatgatttcattattttatgtatacatttttgatgagagagagtatatgaatatggggtgaggtagrgatcttttgctggatgtgtttatatttgaagagaagatgcccttgaaacttatttggttgcctgctgcataatttgataattttttctttgctttttctt

SEQ ID NO: 31750 - DNA, 201 bp, Homo sapiens
cccatagaaggactcggaatgactctgcttgggtggtatggtctcttccctcttccccataccctgaatccgtccataaaaatgagggctagtatgtcgcrattgatcatttacctagctctgtggctagtgggtaggtggagtaccatcagaactccatgccatggacagctcccatggaagactgacagggcaaatagg

SEQ ID NO: 31751 - DNA, 201 bp, Homo sapiens
tactgggagcattaaataaattaatacacataagatagttagaccggtgtctgatccagatgttaagcagcagttgctgctgctgctgctgctgttgtgtgatgatgatgatgatgaagatgatggtagtggtggtagtaatgctgccaccatcacattacagaatccaggatctcttacactaaggcccattctctcttg

SEQ ID NO: 31752 - DNA, 201 bp, Homo sapiens
cgcattaaacagaaatttgtaattttatggccaggcacagtgactcacacctgtaatcccagcactttgggaggtcaaggtgggaggatcacttgagcccmggagtttgagaccagcctgagcaatatcttgaaacccgatctctacaaaaaaaaaaaaaaaaaaaaaattttaattagccaggtgtggtggcatgagtct

SEQ ID NO: 31753 - DNA, 201 bp, Homo sapiens
tttctctgctaagtctggatttcactattgaaggatacctcactcctttcaatatggtatttaatcttgtcagataaaagatgggaaagtctgaaagtttwatttgctcattctgtcatgcaacaccatagctcctcctaactgcggggtcttcagcgtgtctaaaatcgatctcaaagataagtgggtgggggagcgatg

SEQ ID NO: 31754 - DNA, 201 bp, Homo sapiens
tttcttctagtaaaatgcagcttttatcataataaagtgaccctatccatattaactttttgtcccaatgcttgttttctctaaagttaattcagtcacatattcaggctcctcttctaattctggttctcttgctgctctaattctggttctcttgatgctgcttcagtggaggagtgagatcctccaatgaagtcttga

SEQ ID NO: 31755 - DNA, 201 bp, Homo sapiens
aggagacagagcagagaatctgtcagggccaagccatgcaggatttgtgaacctcgttagggattctggctttaatcctaagaacagtgggaggctgtggrtagattctgagctgagaaatgaggagtatatggtgtcctggccgtcccattttcaagactctgggttacttttggcaggaaggcaaaaacaaagaaaaga

SEQ ID NO: 31756 - DNA, 201 bp, Homo sapiens
gttaatgttgctgttgatattactaataggtatatatattaatatagaggcatacattggagatattgcaagtccagtcccagactactgcaataaagcamaaatcgcaataaaataagtcacacaaattttttagttttccagtataatctaagtgtgcagtagtatcatgtcaaaaaatatgcacaccttaattaaaaa

SEQ ID NO: 31757 - DNA, 201 bp, Homo sapiens
taggtatatatattaatatagaggcatacattggagatattgcaagtccagtcccagactactgcaataaagcaaaaatcgcaataaaataagtcacacamattttttagttttccagtataatctaagtgtgcagtagtatcatgtcaaaaaatatgcacaccttaattaaaaatactttattgctaaaaaatactaaca

SEQ ID NO: 31758 - DNA, 201 bp, Homo sapiens
gcttgtggccctgcatggcatagtatgccccttcctctaggaaactgtgttatcttttcagcggcagtgtcttctgatctgttggcctcaccatacctgartggtagtaacaaaacctacaagtgaaaacatggtggtagcaaacaaccctcaaattgaaatggcttaactcaccaaaagtttatttcttgctcatgctgc

SEQ ID NO: 31759 - DNA, 201 bp, Homo sapiens
cagtagtatcatgtcaaaaaatatgcacaccttaattaaaaatactttattgctaaaaaatactaacaatcatctgagcccttagcaagtcatactcttcrctggtggagactttgcctcaatgttgatgactgcaaactgatcggggtggtgaaggctggtgtggctgtggcaatttcttgaaataagacaacagtgaag

SEQ ID NO: 31760 - DNA, 201 bp, Homo sapiens
ccctggttccattcagctctgtgctcatgtgtcttcttattgagaagccttttctgaccacactgtatataacacagcacctgttacccatcactccctakcacctcctgacatatgctatgactgtttatttatttgcttattgtccttctctgcaagaatgtgagcttcctggggtcaggagctttgtgttgttttgca

SEQ ID NO: 31761 - DNA, 201 bp, Homo sapiens
tactgtcctacatctcattagtcagaacttgccatgcctggcagggaaaaagtgggaaatcaattttgctttgcttttagagcctcaatagtagagagatragaggtttggaaatgaagcacagatcatccaacccacagtttctgctatagattctaagataatgtgatgaatgctatagtggaagtatgcacgaaacac

SEQ ID NO: 31762 - DNA, 201 bp, Homo sapiens
caaagaagtagaagggcatggtgagcctggtgaacatggtggcgcacgcctatagtcccagctacccaggaggctgaggtgggaggtcgaggcttcagtgrgccgtactgtcatgagtaccatcatcaatgcacttttatgagcttatatacgaatgtctgtcagatggaaagtgaggagtggaatttttgcatcaaagac

SEQ ID NO: 31763 - DNA, 201 bp, Homo sapiens
ccgcttagatggacaataggatatttaattgtctttgctgtttctggttctttgtgtgttttctgtttggacaatttgtctttttcatatagagtgttcarctgggctcatttctagtctataactcatttaggtttctcttaaatccaataatatttaagaattttttcagttactaagtggtttatagatcttgtatgc

SEQ ID NO: 31764 - DNA, 201 bp, Homo sapiens
acgtatatgtttctctataaataaaatgataaactataaatcttaactaaatatatgtatataaataaaatattcatgcacataaactaaatacacacatmcacacacacacacacacacacacacacacagagcaaggagtccagtgtaaatgggcatctttcaaaagatagaggaggagatttcagagatatccttctg

SEQ ID NO: 31765 - DNA, 201 bp, Homo sapiens
cttcatagaattgaagagggtcagggccttgctctggattaggctttggcttaagggaatattgtggctggtttgatcttctgtccagatctacctacctyccatggtaggtggatgccaaggacgatgctaaacgtcctacaatgcacaggacagccccctacaataaagacttactcaaactttctccatgttggcaat

SEQ ID NO: 31766 - DNA, 201 bp, Homo sapiens
cgtatatgtttctctataaataaaatgataaactataaatcttaactaaatatatgtatataaataaaatattcatgcacataaactaaatacacacatacacacacacacacacacacacacacacacagagcaaggagtccagtgtaaatgggcatctttcaaaagatagaggaggagatttcagagatatccttctgg

SEQ ID NO: 31767 - DNA, 201 bp, Homo sapiens
cactcaaggagagggagatagacaaggaatggccagttggtgtagcagtcagaacacacacaacatttatcaattaagttctccattttatgtgtgcatgrttcatggcgccccaaaacaattacaatagtgacatcaaagatcactgatcacagatcaccataacagatgtaacaataatgaaaacgtttgaaatattgt

SEQ ID NO: 31768 - DNA, 201 bp, Homo sapiens
ctgggatcccggctcatggcatccgtttgggggacagctttgatccaggcactgtgatgcgcttcagctgtgaagctggccacgtgctccggggatcgtcmgagcgcacctgtcaagccaatggctcgtggagcggctcgcagcctgagtgtggaggtaatgtatgtgaccattctgcttctcccctttgcccagccccag

SEQ ID NO: 31769 - DNA, 201 bp, Homo sapiens
ccagggagcagatggcagcgcagacaaaggctcgcccatggcacagagcacagaagctcatctctgcctggcaggcacctattgcccagggaacgatggattgaaaactccataatggcacgatgatgactgataatacttgaaaggaaactgcaacgtctgctttcaaagcagccctccccggaaggctgaactgccctc

SEQ ID NO: 31770 - DNA, 201 bp, Homo sapiens
atgttttaataggatccctctggttcttgtgctaaggacagactatatagggacaagggtggagaatgggaggccacagtcatgaggggaaaggtatctcrgacttgaatcaggatgatagacaatggaagttgtgagaagtggttgcctttgggatatatttggaaggattttctgatggattgtgtgtgggtttgagaa

SEQ ID NO: 31771 - DNA, 201 bp, Homo sapiens
tagttacgactccacactggacatggctggtggcttataggggatgagaaggcagagagcatgaacttcctgagcctagtacccaagaatgaactgtggckcatttgcttattcatcccaccttgcattgtgctagttattagatggaaaaaaaatgaagataaacaggaccaagtcttttggtgacttgtaggagctcac

SEQ ID NO: 31772 - DNA, 201 bp, Homo sapiens
taaaaatacaaaaaaaaaaaaaaaaaattagccggtcgtggtagcaggcgcctgtagtcccaggtactcgggaggttgaggcaggacaatggcatgaaccygggaggcggagcttgcagtgagccaagatagcgccactgcagttcagcctgggcgaaagagcgagactccgtctcaaaaaaaaaaaaaaaaaaaaagaca

SEQ ID NO: 31773 - DNA, 201 bp, Homo sapiens
ttattagatggaaaaaaaatgaagataaacaggaccaagtcttttggtgacttgtaggagctcacaagtaagacagacaaacctgtcaaccagcaattgcaaaacaatgaagtgtttgataagccctagaataatttctttctgaggctctggaaacccaggctactcacctatctttatctgttatttatactctagaga

SEQ ID NO: 31774 - DNA, 201 bp, Homo sapiens
tattagatggaaaaaaaatgaagataaacaggaccaagtcttttggtgacttgtaggagctcacaagtaagacagacaaacctgtcaaccagcaattgcaaaacaatgaagtgtttgataagccctagaataatttctttctgaggctctggaaacccaggctactcacctatctttatctgttatttatactctagagaa

SEQ ID NO: 31775 - DNA, 201 bp, Homo sapiens
attagatggaaaaaaaatgaagataaacaggaccaagtcttttggtgacttgtaggagctcacaagtaagacagacaaacctgtcaaccagcaattgcaaaacaatgaagtgtttgataagccctagaataatttctttctgaggctctggaaacccaggctactcacctatctttatctgttatttatactctagagaag

SEQ ID NO: 31776 - DNA, 201 bp, Homo sapiens
tggctaatttggactccaccttctaatgatgtccttgccctagtcaggaccacattcaaggcctgggcgtggtagagcctgcagtagccatatgggttacacctaatcataaataaatcacagattggttctacaaaggggaagtggaggattcctggcaagtgagatattaggagcatttaaaagttctcttttctctcc

SEQ ID NO: 31777 - DNA, 201 bp, Homo sapiens; identical to SEQ ID NO: 6237

SEQ ID NO: 31778 - DNA, 201 bp, Homo sapiens
ggctaatttggactccaccttctaatgatgtccttgccctagtcaggaccacattcaaggcctgggcgtggtagagcctgcagtagccatatgggttacacctaatcataaataaatcacagattggttctacaaaggggaagtggaggattcctggcaagtgagatattaggagcatttaaaagttctcttttctctccc

SEQ ID NO: 31779 - DNA, 201 bp, Homo sapiens
ggaagacaggccttcccagctcaatgaaatttgcctgcctgtcactcattctcccttcttcctctcgctcacctaccccactcccataacccaaagcatacccgctggatccaatggattattatgtcctatttattctacctctgaaaaatccctcaaatttaaccacccttttcagatctccctactggctctgcctca

SEQ ID NO: 31780 - DNA, 201 bp, Homo sapiens
ccaactgttgcacaacaaaacctcttaagtccttgagtcatacaccactgggccaccaaggctatggagagatttctggagtttgagacctacttcaagargttcaccacccacatctccactgtcattctctttgcctcttcggtaaatagttgccatctatctactctgcccccatggtgcaatatcctgtccagactc

SEQ ID NO: 31781 - DNA, 201 bp, Homo sapiens
gttggttgcccaggaaatcccagacacatcactctatatgaccacccaggactttggcctctcacccctattaatctcattaaacacctaattaaggaacygggcaggactatataggagccatgatgactcatttagctgggctagaggaaggcctattaactgtgccctggcttctttctgtttggacatctggtagaa

SEQ ID NO: 31782 - DNA, 201 bp, Homo sapiens
atggaaaagggctataattggctttcattctggaatccttggccaatgaagacaatctgagggtgacagagctcccatttttgtcttgtgtatactctgcrtaccaccttcctgcccagagacatcatgagtatgaggaaatagggagaggtaagcataagaggcaagagagaaaacaatctaatgttattgtatatctgc

SEQ ID NO: 31783 - DNA, 201 bp, Homo sapiens
tcagtggaggagtgagatcctccaatgaagtcttgaacccatcaaagtcatgcatgagggttagaatcagcttactccaaactcctgttaatgttgctgtkgatattactaataggtatatatattaatatagaggcatacattggagatattgcaagtccagtcccagactactgcaataaagcaaaaatcgcaataaaa

SEQ ID NO: 31784 - DNA, 201 bp, Homo sapiens
gctgcttcagtggaggagtgagatcctccaatgaagtcttgaacccatcaaagtcatgcatgagggttagaatcagcttactccaaactcctgttaatgtkgctgttgatattactaataggtatatatattaatatagaggcatacattggagatattgcaagtccagtcccagactactgcaataaagcaaaaatcgca

SEQ ID NO: 31785 - DNA, 201 bp, Homo sapiens
cttgatgctgcttcagtggaggagtgagatcctccaatgaagtcttgaacccatcaaagtcatgcatgagggttagaatcagcttactccaaactcctgtkaatgttgctgttgatattactaataggtatatatattaatatagaggcatacattggagatattgcaagtccagtcccagactactgcaataaagcaaaa

SEQ ID NO: 31786 - DNA, 201 bp, Homo sapiens
tctctaaagttaattcagtcacatattcaggctcctcttctaattctggttctcttgctgctctaattctggttctcttgatgctgcttcagtggaggagwgagatcctccaatgaagtcttgaacccatcaaagtcatgcatgagggttagaatcagcttactccaaactcctgttaatgttgctgttgatattactaat

SEQ ID NO: 31787 - DNA, 201 bp, Homo sapiens
ccctttctctcccaatccagtccccaccatctctgctatatgtggttctgtagctcagaaaaagaagccagtgaattcattctggcatcattctgatccasatagggaagatggagcagagaagggtcataaatgaggactttctcaacccttagataaagagccacataaaatttcatcatcatgggttatataaggaaa

SEQ ID NO: 31788 - DNA, 201 bp, Homo sapiens
gcacatagtaggtgctcaagaaatatttgttggctggacgatctgtagcaacatttgaaatggtgaatgatgcattgtggttgtagtttatataagacagwcaatgtggagaacaaacccatgatcaaagggaaggccttggtcctgcattaaactgattggcaaataaatgtatgcttaagtgttttacattataatgaa

SEQ ID NO: 31789 - DNA, 201 bp, Homo sapiens
ctgctttggggataggtcagcatgagaagaatccccaggaaggtaccagcagctgctaagtgaagcaggtagtggggcacagccagagctgaggaactagractggggaagcatgtcttgacaggagtgggcagtgccatgggaaacccgggtgaagcccgcgtggcactggaggccctccctcctattccctggctcacc

SEQ ID NO: 31790 - DNA, 201 bp, Homo sapiens
actcttatttcaaaataacatttttttaaagaaaaatctttccagttgatagcaatgtgcagccagggtaaagacaccctgctcttgatccatcatctccrggaatcacagggccagattttaccctcaattacagcagcatatgctcttagcatatctctgtcaaagtatctctcagattttgcagcatgatggaatcac

SEQ ID NO: 31791 - DNA, 201 bp, Homo sapiens
aaattattcaaactaggcaatcctaaacctgctcagctgcttacctgatcttgcccattccttcttgggaaaaccacaataaaggctcttgcccacatttwcccaggctccttctgccttgtcactgacgctggagcttctgacatgcttgtggccctgcatggcatagtatgccccttcctctaggaaactgtgttatct

SEQ ID NO: 31792 - DNA, 201 bp, Homo sapiens
attacaggtgtgagccactatgcctggcctctacctcttttattgagatctcattgtttatctactatccccctgccctaattacccagggccatacatcrgacagctaagggtggtccacataccctggtgccctctgaaattattcaaactaggcaatcctaaacctgctcagctgcttacctgatcttgcccattcct

SEQ ID NO: 31793 - DNA, 201 bp, Homo sapiens
ggatttcaccatgttgctcaggctggtcttgaactcctgagctcaagtgatcctcccaccttggcctcccaaagtgctgggattacaggtgtgagccactrtgcctggcctctacctcttttattgagatctcattgtttatctactatccccctgccctaattacccagggccatacatcagacagctaagggtggtcca

SEQ ID NO: 31794 - DNA, 201 bp, Homo sapiens
caagtttagctgagtaaccaccacactcagacaaatttttgaaaacatttttatagagatgggatttcaccatgttgctcaggctggtcttgaactcctgwgctcaagtgatcctcccaccttggcctcccaaagtgctgggattacaggtgtgagccactatgcctggcctctacctcttttattgagatctcattgttt

SEQ ID NO: 31795 - DNA, 201 bp, Homo sapiens
aggcggagcttgcagtgagccaagatagcgccactgcagttcagcctgggcgaaagagcgagactccgtctcaaaaaaaaaaaaaaaaaaaaagacaaatwtggaacatcttgtcactccagcgaggattccaccaaagataactgaggtcatgttaactggactcaggagccaactagaagaggctcctattggctaaag

SEQ ID NO: 31796 - DNA, 201 bp, Homo sapiens
cttcctcttacagggggcactttgaataaggtgaatcttcatagcccaagttgcagcggtgcataaggacagtgtgggcaaggacaggactgatgccaggkatttgacaaaacaaaatttaaaatgggcaagctgggtgtggtggctcatgcctgtagtcccagctactcagaaggctgaggtgggaggattgcatgagcc

SEQ ID NO: 31797 - DNA, 201 bp, Homo sapiens
ttgacaaaacaaaatttaaaatgggcaagctgggtgtggtggctcatgcctgtagtcccagctactcagaaggctgaggtgggaggattgcatgagcccasgagttcgaggctgcagtgagccatgactgtgcctctgcactccagcctgggtgacagagtaagaccctgacttaaaaaaaaagaaatttagaatgggtaa

SEQ ID NO: 31798 - DNA, 201 bp, Homo sapiens
catgttctaaacttcctgtaatgttactccattacttggatcattattaataggcactttgaatgtagaagggagaggaagcccccatcagcagcagcacygcagcaggtggaagcacctacctggggctgccccggttcccagagttcaagctcaaccaggaagggagcagtgcaaagaacaaagatgggggtgtgggac

SEQ ID NO: 31799 - DNA, 201 bp, Homo sapiens
tggccgggcggggtggctcatgcctataatcccagcactttgggaggctaaggcaggtggatcacttgaggtcaggaattggagaccagcctagctaacayggtaaaaaccccatctctactaaaaatacaaaaaaaaaaaaaaagttagctggacatggtgggtggtgcgcgcctgtaatcccagttactcaggaggctg

SEQ ID NO: 31800 - DNA, 201 bp, Homo sapiens
tgaggagagaagggcatagagtggcaccggtggttttcgagctctgtgccgatgtgtgtggccgggagaacatcaggagaagaggcactttggtctcaggmtccgactgaaccgagcctgggttggggattgtctgtggtctttgaagttgtctgagtggagacagttgccacaggctgttggatacagccaggaactggc

SEQ ID NO: 31801 - DNA, 201 bp, Homo sapiens
gggctagccctgtgcagagcagggtgacattcctggctgaacgaagggctggtgcaaaggagtgctgagggaagtgcttagcagcctgggggcctggaaartaggccagctagcaagtctgcagccccgtgagggaggataaggaaatgtagtcaagagtgaggctaggttggaaaacagcttggtcctggtgtgtaaagt

SEQ ID NO: 31802 - DNA, 201 bp, Homo sapiens
gtggctggcctcctgtgttctgcccaaattccctgtggacagctgccctgaagttcatggggagagtggacccaactctctaccttgccatcagttctgamcacccacccacctgtgactccctgcgttgggtagaaggtggtgccttcctgagcacattgcggcttctccctcgccatagtggccctcccagagtagagt

SEQ ID NO: 31803 - DNA, 201 bp, Homo sapiens
aatatcagggagttgagaatagatgcacttaggcaaggaggacactgttgtcatgactccagggaaaaagaaggtgagaagtgatcctgaacgcttgttcrggatacattttgtaggcagaaccaagaggactcattgatgggttggattgtggggtcgaagggatcaaagatgacttgaggttttttatttgcacaactg

SEQ ID NO: 31804 - DNA, 201 bp, Homo sapiens
aggagactcgcttgaacctgggaggtgaaggttgcagtgagccaagattatgccactgcactccaccctgggcgacagagtaagactccgtctcaaaaaaraaaaaaaaagttgtcagatgaaaagaaagaaggtatctctttgtcctctttgtcctttcttaacatgctacattcctctggaagtgacaagtttacttct

SEQ ID NO: 31805 - DNA, 201 bp, Homo sapiens
tgagatttaagtttgcttgtttcctggggaagcttgaagatcctcgtgggaccaccatcccctgctcagtcctccctggaagggggcactggctgggtatragccgcgtcaccgttgggtttgtgactttctggatggtgcctgggtttcacctggggctggctgaggaaaggggaggcggtagggtctgctctgtctgtc

SEQ ID NO: 31806 - DNA, 201 bp, Homo sapiens
ctcgcttgaacctgggaggtgaaggttgcagtgagccaagattatgccactgcactccaccctgggcgacagagtaagactccgtctcaaaaaaaaaaaaraaagttgtcagatgaaaagaaagaaggtatctctttgtcctctttgtcctttcttaacatgctacattcctctggaagtgacaagtttacttcttttgta

SEQ ID NO: 31807 - DNA, 201 bp, Homo sapiens
tatctccgttccattacttgcaaaaaactgaggcttccaggaagcaggagcttcctctgcttcgggaatggcacttccatcttactttcccagcctgaggygtctggactggtgggaacggctcaggatgtgaaagctttggaggtaaaggcttggcaaggaaggggatgggcgtaagagacaagtaggggtaggggtaac

SEQ ID NO: 31808 - DNA, 201 bp, Homo sapiens
catccccactgtatccttaggaagactaaggtttacagagttccatgcagcctgtcctgagtaaatgcagaagccagaactcggatccagggtcttctgaytctgaatcagccaccgtgtccacaacagagtgtaatattacaactttgttcagggtattagatgaggccttgtggaggaggcatcctatcaactgcctca

SEQ ID NO: 31809 - DNA, 201 bp, Homo sapiens
agtcccttcctcctctccagggctggtgggaaggctgagccctctctttcgggggctgagtctggacaatgggaagggagaagccccctcctcactgcccmgggaacataaagcaggcctttcactgaggagttctggctgcttcggttggttcttggcacccagcaaggcggcgtcgggaggggcgggcatacaagcgtg

SEQ ID NO: 31810 - DNA, 201 bp, Homo sapiens
tttccttttgttttctgttgctgcaccaaattacggcagatttttcagagtgaaggattgctgagagactgggcaaggggccggtggaggtttttgatgcrgagcaatgagatagttgctctgtgtctgcctgtgtttcaggaaaattctgttattactgaaatctttggtttgaaagccactgttagaactaaatatttt

SEQ ID NO: 31811 - DNA, 201 bp, Homo sapiens
ccttttgcccgggaaagttctgggggtaaatctcatctgcccgttgcagccacagagcaaagttctggagctgagaagagggtaagagaaagcccattggmctgcagccccagaattacagagcagcccagactctcttctgcccagctgtgggctgcacaggaggcctgggcatctctgccagttcctttctctggagga

SEQ ID NO: 31812 - DNA, 201 bp, Homo sapiens
taaatgctcggggagggcaaagctttcatgaccagatgagtgtgggaaacactagacccttggcttctgaggtgtggttcaaggccttgccaggaagcttkttagaaatggagcctcttggaccccatccgccacctactgcacctaaattttaacaagatccccaggtcaattcctgtgcctgtgagagtctgagaagca

SEQ ID NO: 31813 - DNA, 201 bp, Homo sapiens
tgcactacgatagggatatgctcatcatatttatgtgaccaatgcagatgtcacagaggaggcaagtgattgtaaagaggtagaaggaagtggtcagtgaraagtgggagtttgaaactgggaaggaggagaaatggtgtcttccaatgcctgtgatccaggttgggcatagatcccagcatttgagaggctgaagtgggt

SEQ ID NO: 31814 - DNA, 201 bp, Homo sapiens
atcctcaacttcttccgtgtactaattcccattattctggatttaatactctctgaagggcagacacacagcattgaaatgccgttttcttcgggcctgtwggtggggggcagctggcatttcaggatgaggcattgcaggcaggctgaggtgaggccagccagccgggagatgaggaagctacagagggtggggctgagg

SEQ ID NO: 31815 - DNA, 201 bp, Homo sapiens
ttggtcttttatgtattgattataaaaataggatcatccgtgtacaaagctcttatagattttgtttcccataatgctgtgcaaccactgaaaatcatggkgaggaagtatatttaactatatactattttttgagacagagtctccctctgtcgcccaggctggagtccagtggcatgatctcagctcactgcaacctct

SEQ ID NO: 31816 - DNA, 201 bp, Homo sapiens
caggagcataatcagtgttgtgggagcccagaggtgagaaaggatctgcttcctcctggccagctggggagggctcccagcagaggggatgcttgggttcyggctcatagagcaagtgggttgatcaaacacttgaaatgtgtcagtcaatttgcatgcattaccttttatgatttatgattttatgatttatgacagttt

SEQ ID NO: 31817 - DNA, 201 bp, Homo sapiens
agaccccaccagggactcctagggcaaacaaagagaattatctgcctgctcctttggtcatccctctttcctggcctcacagaactccccctgaggatccstggcaggctttataatgtgagtcctttcaggctgggattttttgttttgttttttttgtttgcttgttttttgagacagagtctcactctgtcacccacg

SEQ ID NO: 31818 - DNA, 201 bp, Homo sapiens
cgcatcctgccttatccatctctgcctggaagaccccaccagggactcctagggcaaacaaagagaattatctgcctgctcctttggtcatccctctttcstggcctcacagaactccccctgaggatccctggcaggctttataatgtgagtcctttcaggctgggattttttgttttgttttttttgtttgcttgtttt

SEQ ID NO: 31819 - DNA, 201 bp, Homo sapiens
ggggtggctgtaagggccccacacgcgcatcctgccttatccatctctgcctggaagaccccaccagggactcctagggcaaacaaagagaattatctgcstgctcctttggtcatccctctttcctggcctcacagaactccccctgaggatccctggcaggctttataatgtgagtcctttcaggctgggattttttgt

SEQ ID NO: 31820 - DNA, 201 bp, Homo sapiens
tactgccagcctttgtcttcaggataagtttaacaattttatatgatctgataatgcctaacagtgatcctgtccctttaggaaagttaggaaatgctaayaaaagtttcttaaaactaaaaagccctaaggcatagatctctgactggcagatgttaagcatgcagcaaaggatgggctatatttcaaggccaggtgcct

SEQ ID NO: 31821 - DNA, 201 bp, Homo sapiens
tgccacccacagactgacctcatgacccactgatgggtcacactccaagaatggatttgaaaaacactgtccagacaagctgagagggagcttccgcctcrgagactgtgagatcctctttacttggtggcagtaacatgaagtggaaagaacatggccttttaagccagacacatataagttcaaattctagctttgcca

SEQ ID NO: 31822 - DNA, 201 bp, Homo sapiens
aatcaatttcatcttacctgccagcccctagaggtaggcagggacttcctagagcactgctttagagctgggcttaggagaaaagagcaccttgagcaatkcctgtggatgcagagagaggagtgcaagtacaaatgattttgctgactctgaacaagtcaccccaccctctgagccctgaggtcttccctggaggctccc

SEQ ID NO: 31823 - DNA, 201 bp, Homo sapiens
ctttgtcgagtttggccagggcttcatatttggccttttcatgctttgagatggatctccatttttccgaacactttctagagaactctttaaagccaacrtaggtatttggctgctgctccttgaatttgtttctgtaattcagcaaaaagtgaacgtaagaagagacatttgccttaggctttagctggatttcttttc

SEQ ID NO: 31824 - DNA, 201 bp, Homo sapiens
ggaccaccatatcatggcatcaagtgaacttgtatgagtgtacaggctggagggccagcacccttatagtaaggagcaagggccccagggaggcagggagrgggcaggaagagcaggagggggatagctctccgtgaggggtgagaccaggaggaaaggattggtatggattacatttcaagaatgaaggaaactgagagc

SEQ ID NO: 31825 - DNA, 201 bp, Homo sapiens
tatctgggtgctcttctgttaggtacatatatgtttataattgttatatcttccttgttgaattgacccttttttcattatacaatgtcttctttgtctcytgtgacagtttttgatttaatgtatattttttctaatataattatataatcaccttgctgtctttggttaccatttgcatgaaaaatctttttctattct

SEQ ID NO: 31826 - DNA, 201 bp, Homo sapiens
gtgacttttgtttcacaatttatgtggctgattttgtctgcttttgacagttctgttgtgttcctgacagttacaatttggtttctctctgggaccttggratgataagttgggatgccaacctcgcattgatccactgggggagcacagaccccttcttgtttctccccatgctgtgcttatgaatgggaagttctgagc

SEQ ID NO: 31827 - DNA, 201 bp, Homo sapiens
ctgccttttcttttctttttttttttttttgagatggagttttactcttgttgcccaggctggagtgcaatggcgtgatctcggcttactgcaacctccgmctcccaggttcaagcaattgtcctgcctcagcctcccaagtagctgggattacaggcatgcaccaccacgcccggttgaatctttttttagtagaggtgg

SEQ ID NO: 31828 - DNA, 201 bp, Homo sapiens
acttccatcttactttcccagcctgaggtgtctggactggtgggaacggctcaggatgtgaaagctttggaggtaaaggcttggcaaggaaggggatgggsgtaagagacaagtaggggtaggggtaactggcttgaacgtgcactgcacacaaccaagaggatacctgtgtctggcttgagcacacagtctgtccaaatc

SEQ ID NO: 31829 - DNA, 201 bp, Homo sapiens
ggtttctggctcaaggccctgtgtttcccgaaggccccagttaaagtacaatttaatggatggatgctatacctagagaatgggcaggattactccttcarcaggcagttattgagtgcctctgtgcgcctgagctctcagcagcactggggacatgggcaagtttcagtgctgagtgtacataagagaggcagctacaca

SEQ ID NO: 31830 - DNA, 201 bp, Homo sapiens
ttgagggaaaggattaaggttaaacgattagttcagtgctggaatagcattaaactctctgataggcactcacctcaccagataccaggcattgtgctaartgctttgtatgtttcaactcatttaatcttcacaagatcctatgaggctatttaatatatgaggaaactagggcatagagaagttaattaatgtgtccaa

SEQ ID NO: 31831 - DNA, 201 bp, Homo sapiens
acctcaccatccactcttccttgtcactcttcaccttccctcctactctggtcacactgcataacacgcattctctttccaggtttccacctcactcctcrtgcctgtctatctttgtcatctctgttgccgtgtgtctaaatcctattagctcagaaggtccatgttcgatgccacctcttccaggcagcctcacatgcg

SEQ ID NO: 31832 - DNA, 201 bp, Homo sapiens
gaggtttctggctcaaggccctgtgtttcccgaaggccccagttaaagtacaatttaatggatggatgctatacctagagaatgggcaggattactccttsagcaggcagttattgagtgcctctgtgcgcctgagctctcagcagcactggggacatgggcaagtttcagtgctgagtgtacataagagaggcagctaca

SEQ ID NO: 31833 - DNA, 201 bp, Homo sapiens
gacctgaaccttggccgtctggcccaggcccaaagcttttgcctttgctttgcctgtgagggcttcttggtcttaatctcatcattccaagggaggaaggygctcctctgcaacccccaccaggactcacagagttcaccgttgatgggtagaagttcttccttcatgcgaggcatctggaagaaaagcaaagtcgagggc

SEQ ID NO: 31834 - DNA, 201 bp, Homo sapiens
ggcaaaagactaggctcggatttcaggtaagatctatttgggaattttctgattgcaagaagggtggggtggcctggctgggaggaagacaggggctggcyttcctgcaggtggaaatggagaggatggcatggatataggaacagacacttcctggagaagagctatggctttgacattctctcctggttcagtccttgg

SEQ ID NO: 31835 - DNA, 201 bp, Homo sapiens
cgaggcatctggaagaaaagcaaagtcgagggcaggactttttttttttttttttttgagacagagtctcactccgtcacccaggctggagtgcagtggcrtgatcttggctcactgcaagctccgcctcgcaggttcacaccattctcctgcctcagcctccgcaaagttttcaatgaggacattcagggagtctgtgca

SEQ ID NO: 31836 - DNA, 201 bp, Homo sapiens
aaagggctgccatctcagtaatgacacgccagaaggcaactcgcgcctgcaataatctaggagaccattttccttaaagtttatgggtatcatccacccaygcttagctgccctaactggtgcttatctcagaggatcgctgttttgctcacaaagtcaccttttaactcaatcctaaaaccattaaacagtccgaaaaaa

SEQ ID NO: 31837 - DNA, 201 bp, Homo sapiens
ggcaggactttttttttttttttttttgagacagagtctcactccgtcacccaggctggagtgcagtggcgtgatcttggctcactgcaagctccgcctcscaggttcacaccattctcctgcctcagcctccgcaaagttttcaatgaggacattcagggagtctgtgcacttggatgggaaaatatacaccttttattc

SEQ ID NO: 31838 - DNA, 201 bp, Homo sapiens
gcaggcccagggatggagctcacagacacactttgtctcccaggttaggatccagcgtccagttcacctgcaacgagggctatgacctgcaagggtccaarcggatcacctgtatgaaagtgagcgacatgtttgcggcctggagcgaccacaggccagtctgccgaggtgagggtgccctggggaagggaggctggccag

SEQ ID NO: 31839 - DNA, 201 bp, Homo sapiens
acatacccatcatctcacctaattatcatttttttgtgatgagaacatttaaaatctactcttttggccgggtgtggtggctcacacctgtaatcccagcrctttgggaggccaaggtgggcggatcacctgaggtcaggagttcgagaccagcctgaccaacatggtgaaacctcatctctactaaaaatacaaaattag

SEQ ID NO: 31840 - DNA, 201 bp, Homo sapiens
ccaggttaggatccagcgtccagttcacctgcaacgagggctatgacctgcaagggtccaagcggatcacctgtatgaaagtgagcgacatgtttgcggcytggagcgaccacaggccagtctgccgaggtgagggtgccctggggaagggaggctggccagagagttgggctgagcctggaggctgaagcccagctccca

SEQ ID NO: 31841 - DNA, 201 bp, Homo sapiens
ttgggaggccaaggtgggcggatcacctgaggtcaggagttcgagaccagcctgaccaacatggtgaaacctcatctctactaaaaatacaaaattagccrggcatggtggtgcatgcctgtaatcccagctacttgggaggctaaggcaggagaattgcttgaacctgggaggcagaggttgcagtgagccgagatcaca

SEQ ID NO: 31842 - DNA, 201 bp, Homo sapiens
gctactatgtttttaaaaaatcaaacaacaaaaaagaattcttgtcataactctcagcaattgggcaaatcacccattttccctaagcctttcttacctcyaaatgttgctaatagtatgtatcctacccttcttctgtttaatgtggagattgaatggagttgtgaatgtgtaagcagtttatgaattgaaaagtgctag

SEQ ID NO: 31843 - DNA, 201 bp, Homo sapiens
gagtcctccggagccaccttcatctaccaaggctctgtcaagggccaaggctttgggcagttcggctttcaaagactgggtaactagtgcttgtcccccgraagtgtgggcccgggtgggtgggagagaaaccgtgtgtgccgtggtcaggtagaggactggggaagttgaacagtctgaggcgggggtgctttggcctct

SEQ ID NO: 31844 - DNA, 201 bp, Homo sapiens
agtagaacatgagctctatagggcaaggacttctgttttgttcactgcctaaaatggggcgtggcatgtagcaggtactcagtaacaggtgttgaatggaygacggaatgaatgactcattgaatagcataccactccaatgccagggagcccagacaccagctgtgcagagaggcatagaattatcaagtctgaggacca

SEQ ID NO: 31845 - DNA, 201 bp, Homo sapiens
ttggcctctttgggatcagggatgcctcttgagattctgacaaaagccatggaatatctctccaaaagcaaacacatgtgcataacccactcaacctttgwcaaagtttcctgttcagacctggagaggagagcccccaactccagggacattggctcttagatacagcccccagccacaccctccagccagccctgggtg

SEQ ID NO: 31846 - DNA, 201 bp, Homo sapiens
ccaaccatcatcatttttagctggggcccttgggccagtttcttcacctctctgaatctcttttttcctgccaaaaagtggtgataatagaacattacttygtggggttactttgaggactagatgaggcagtccttgtttagaagtgatgccagtacgtctgtgagacttatatgcacacgtattcagcttaacctgctg

SEQ ID NO: 31847 - DNA, 201 bp, Homo sapiens
aaagtttcctgttcagacctggagaggagagcccccaactccagggacattggctcttagatacagcccccagccacaccctccagccagccctgggtgtsacccctgcctcaacaaacaacgacactgtggagtgtcttagagctctcagggtgccttgactgtgatgtcgtttctgccctagcccagccctagaagact

SEQ ID NO: 31848 - DNA, 201 bp, Homo sapiens
gccccccacccctcccctgcgtctccttgtaaagttccatgagatgctcgaggagcacctgctggtggggcacccagcactctgctgggcatcaccctccrcacccctgacatttctctccacctccagaggcttggaagggaacagggcagatgaggcccttcacccaccatctacgccatatacccatcaccatcccat

SEQ ID NO: 31849 - DNA, 201 bp, Homo sapiens
aaaaagtggtgataatagaacattactttgtggggttactttgaggactagatgaggcagtccttgtttagaagtgatgccagtacgtctgtgagacttayatgcacacgtattcagcttaacctgctgggcactgtccgcataagcttcctcaagccctggagcaaacctcagcctctagttgctgcaggttcttttaga

SEQ ID NO: 31850 - DNA, 201 bp, Homo sapiens
ggtaactggcccacctttgagccagcgggtctcaccacgccttctccccaccagaactctccagcggctccccatcattttcaggatcagactcaaacccygtaaaagtctgatctctgaaacctcaccatccactcttccttgtcactcttcaccttccctcctactctggtcacactgcataacacgcattctctttcc

SEQ ID NO: 31851 - DNA, 201 bp, Homo sapiens
cttgcctgccaaggcagtccactccatgtcctctggctccaagctcctgaaagcttctctggactgagccacggtctgctcccaccctttcccacccacastgctcctcccccggagttgtcccagctctgccctcatgagctgcatggactgagaccactgtcttccacacagcacccttcacctactgcaagatggcca

SEQ ID NO: 31852 - DNA, 201 bp, Homo sapiens
ccttcccaaatcaatgctctccgttgtaaaatgcagataattatacccacctgtaagactcctgtgaataacaaatgagagagaacacatgtatagcgccrtagagtgggagctctgcataaatctgtttccttttccagcccatttcaacagcgtatgtttaagcaggtcataactcagcttttaaacatacatttaaag

SEQ ID NO: 31853 - DNA, 201 bp, Homo sapiens
cggacctgggaccggcctctgcccacctgtgtcggtaggagggctcttcctctgcagggaacccttgggtctcccataataccaagctctagtcctggtcycattccagttagaccccatgctccagggcctgggggccatcaacttggactgaatcctcttgttaacaggcatcatggttcacctgcaccccttctccac

SEQ ID NO: 31854 - DNA, 201 bp, Homo sapiens
gtgaccctgatcccttcttctcctatttctagcatcttgcctaatcaactattccttttcctaaatagctctgcaatgaacatcctcctcttcatttgtaytcattctcccttgattcagacgcttatagtaatttgcatggaaagcaataatctgcttccattcatttgattgtccagccatccattaattcaataaacg

SEQ ID NO: 31855 - DNA, 201 bp, Homo sapiens
cacaatctcaactgcatctggaccatcgaagcagaggccggctgcaccattgggtaagtgtcagggctgacaaagtaactatcgccagttgttcaggggarccatcatcagcatcatcaccaggccatccagctagtgcctggcctgcctgcctcacctggagaaccttgtgatcaatagtggttgctatactggatgcct

SEQ ID NO: 31856 - DNA, 201 bp, Homo sapiens
agaaatcaggacactcaggggagtcttatcctcaacttcttccgtgtactaattcccattattctggatttaatactctctgaagggcagacacacagcaytgaaatgccgttttcttcgggcctgtaggtggggggcagctggcatttcaggatgaggcattgcaggcaggctgaggtgaggccagccagccgggagatg

SEQ ID NO: 31857 - DNA, 201 bp, Homo sapiens
tggcagtggagatggagaagaagagaaaattcaggggacattcaagtgatcacaccaacttttctcaactactgtttgtgacaacaatacaccaagtaccygcgtacctaccgcctacacccaaatggcgttactattttgccatatatgcttatgtgctttctttgttcttctctttccatccttttgttttcctttttg

SEQ ID NO: 31858 - DNA, 201 bp, Homo sapiens
tttctcaaagagctttcaaaagcagtattagggagctctgttacttatgaccccgagacatgacattttcctctagctttattgctatgtattcattccawaaatatttttttctatatggcaggcactgagctttttttcttttctttttttttttttttttttttttttgagactgagtctttctctgtcacccaggct

SEQ ID NO: 31859 - DNA, 201 bp, Homo sapiens
tgaaggagagcaatttgcaggtagaatatcttcgagggagcagctagacaaagacttaaagcagcaggctgtgcttgggagatgtcaagtttgcatccccygccccccctttatcagcatcatagtcttccttgtggaagctgtcccttagtttttatttttatcttttttataggcagagtcttgatctgtcacccaggc

SEQ ID NO: 31860 - DNA, 201 bp, Homo sapiens
ccagtttcagctttctgcatatggctagccagttttcccagtaccatttattaaatagggaatcctttccccattgcttgtttttctcaggtttgtcaaaratcagatagttgtagatatgcagcgttatttctgagggctctgttctgttccattgatctatatctctgttttggtaccagtaccatgctgttttggtta

SEQ ID NO: 31861 - DNA, 201 bp, Homo sapiens
ttatgggttatccagctttatattctgcgccccttcaaccagccccctcgggatgcaatctcagacatttaaggtaggacaaaagaagagggaggtctttytcaaagagctttcaaaagcagtattagggagctctgttacttatgaccccgagacatgacattttcctctagctttattgctatgtattcattccataaa

SEQ ID NO: 31862 - DNA, 201 bp, Homo sapiens
tgtgttatgggttatccagctttatattctgcgccccttcaaccagccccctcgggatgcaatctcagacatttaaggtaggacaaaagaagagggaggtytttctcaaagagctttcaaaagcagtattagggagctctgttacttatgaccccgagacatgacattttcctctagctttattgctatgtattcattcca

SEQ ID NO: 31863 - DNA, 201 bp, Homo sapiens
agccatcattcagggccttttccagagtgataaatcctgtgttatgggttatccagctttatattctgcgccccttcaaccagccccctcgggatgcaatytcagacatttaaggtaggacaaaagaagagggaggtctttctcaaagagctttcaaaagcagtattagggagctctgttacttatgaccccgagacatga

SEQ ID NO: 31864 - DNA, 201 bp, Homo sapiens
acggacctgggccaggactccatttattcccaaaaccacccttcatacaccactcctctggcagagtagctatgatagtgctttggacccccagtcatcarcatcaattaacatcctgtatccagaagtctttgatatatctgaacattccattttctataatattctgttttctgagtaaacagtagtaggtcttttggg

SEQ ID NO: 31865 - DNA, 201 bp, Homo sapiens
tgtgtactgtgagacggacctgggccaggactccatttattcccaaaaccacccttcatacaccactcctctggcagagtagctatgatagtgctttggayccccagtcatcagcatcaattaacatcctgtatccagaagtctttgatatatctgaacattccattttctataatattctgttttctgagtaaacagtag

SEQ ID NO: 31866 - DNA, 201 bp, Homo sapiens
tggttacctcaagagtgcctcttagttttaacacccacatttcatagagcttacgtatctctcagtacgatacatttcagcgagtgcgtctatagaaaacrtttacagttagatcccccaaaacatagtacaccattttcaataaatctatatgcagggaaagtctcaagctgcattccaactacagttggtaaaatgtca

SEQ ID NO: 31867 - DNA, 201 bp, Homo sapiens
atggagcctccatccaggatgggagggtgggcatgcagccacgtactaaagagctgtatgcatgagaaccgtgtgtgcaaaatgtatatgtgtgtgtgtgkgggggggggtacacatgtatgtagtggacgtggacgtctgtttctgtagctgttgatgtgtgtgtgcacaggtgtgaattctgcatgccaggacttgggc

SEQ ID NO: 31868 - DNA, 201 bp, Homo sapiens
gagtcagaccccgagtccattggccgccactttgcttccaacagcagctcagtggcagccgcgatcctggtgcctttcatcgccctcattattgcgggctycgtgctctatctctacaagcacaggtaccgtgcaggaaggaggcagggcgggcatcaggcaggcctccctctctccctccagggccccccgcaccagacc

SEQ ID NO: 31869 - DNA, 201 bp, Homo sapiens
ggtttacttacaaaattccccacattgagcacaacagaggggaggagctcccggaaatatagacagggggcagacacacccacacgtgtacacggtcatgmacacacacacacacatacgcatacatgcacacaggcatgcatctgacaggcccactgggaaggaactgatgaatctaaaaggcactgcctcttcctcact

SEQ ID NO: 31870 - DNA, 201 bp, Homo sapiens
tccctgtgacagagaccatatagcctgcaaggccaaaaaatatttactatctggccctgtatggaaaatgtttgccaattcttacactatttattgcttcktgtgtgtgtgtgtgtgtgtgtgtgtgtgtgtaattctgattaatatataatatatattttattatgtatacatatatatttaattcactcaacacattcc

SEQ ID NO: 31871 - DNA, 201 bp, Homo sapiens
taataagcaatcattacccatttgtgcaatacttttatattaacatcacctcttttatacactggggttctggggttctgtgtgagatttccttccttccttcctgcctgcctgcctgcctgcctgccttccttccttccttccttccttcctccttccctccttccctccctcccttctccctttccctttcctttcctt

SEQ ID NO: 31872 - DNA, 201 bp, Homo sapiens
tatcagtcaattggttgtggttgacaaaaaccatgtgttcagaccacatctagattcactgagaagagggcagagatcaattagtgatgtctgcatggggrtggatgagcaaaatagtggcacatgtgctatttgtgtcatttctgacctcaggcatcacagagcatattgctggatggcagagaggatagcatcataaca

SEQ ID NO: 31873 - DNA, 201 bp, Homo sapiens
agcaatcattacccatttgtgcaatacttttatattaacatcacctcttttatacactggggttctggggttctgtgtgagatttccttccttccttcctkcctgcctgcctgcctgcctgccttccttccttccttccttccttcctccttccctccttccctccctcccttctccctttccctttcctttcctttttct

SEQ ID NO: 31874 - DNA, 201 bp, Homo sapiens
ggagcagtcgtctgggccatttgatgggagctgagctagttatttaagtctgaacagaacatgacccgcctctgattatctcacctggaagtgggttcaargtactaatgactggacttcttaagagggtctacatgttggtctttctttgacaggtgacatcgtacgctacagatgcctccctggctttaccttagtggg

SEQ ID NO: 31875 - DNA, 201 bp, Homo sapiens
gcaatacttttatattaacatcacctcttttatacactggggttctggggttctgtgtgagatttccttccttccttcctgcctgcctgcctgcctgcctgccttccttccttccttccttccttcctccttccctccttccctccctcccttctccctttccctttcctttcctttttcttttgacagggtctcactctg

SEQ ID NO: 31876 - DNA, 201 bp, Homo sapiens
gttctggtgactctactttgtttaatatgatccattaatttttccaagcttctaagagctgtctcagtggcatagtagagccatcattcagggccttttcmagagtgataaatcctgtgttatgggttatccagctttatattctgcgccccttcaaccagccccctcgggatgcaatctcagacatttaaggtaggacaa

SEQ ID NO: 31877 - DNA, 201 bp, Homo sapiens
tcttttatacactggggttctggggttctgtgtgagatttccttccttccttcctgcctgcctgcctgcctgcctgccttccttccttccttccttccttsctccttccctccttccctccctcccttctccctttccctttcctttcctttttcttttgacagggtctcactctgtcacccaagcttgaatgcagtggaa

SEQ ID NO: 31878 - DNA, 201 bp, Homo sapiens
tgtcttccagtcccaaggccttttcgactcacttgtttatccatgggccaaatggtctcctacagcttctgccctccaggtgtgagtctacacgttgtccraacttttggagtgaaacaaatctgaaagagttccttttcctattaagtcactcagtggggaaggaattaagcagaggaaattattaggggagtcactcag

SEQ ID NO: 31879 - DNA, 201 bp, Homo sapiens
tggcggctctaggttgaagctcctggaataatagaagcaggtgtaggtggggtcttggggacacagaattctccaggtgcaacgtacagcatccccatccyctaggcaagatattaatctctgagttaaggactaagggaccctgatgaggtctgggaggactgtctcaaaggttctctagactgaggcaccttggctttg

SEQ ID NO: 31880 - DNA, 201 bp, Homo sapiens
gctgggcttggactgactgagggttacaacccacagagaagaattggtattacaccctgactacacatacatgtgtgcagccctcacccaacatacacacaaacacacacacacacacacacacacactgccaaatcgtctctgacacatacctttccaagtcactgccaaattcacatcaccaagtcatccctcaccccc

SEQ ID NO: 31881 - DNA, 201 bp, Homo sapiens
aatgagatctggggtgggatggggtggaataggagcagttgatctattggcggctctaggttgaagctcctggaataatagaagcaggtgtaggtggggtmttggggacacagaattctccaggtgcaacgtacagcatccccatcctctaggcaagatattaatctctgagttaaggactaagggaccctgatgaggtct

SEQ ID NO: 31882 - DNA, 201 bp, Homo sapiens
ctgggcttggactgactgagggttacaacccacagagaagaattggtattacaccctgactacacatacatgtgtgcagccctcacccaacatacacacaaacacacacacacacacacacacacactgccaaatcgtctctgacacatacctttccaagtcactgccaaattcacatcaccaagtcatccctcaccccca

SEQ ID NO: 31883 - DNA, 201 bp, Homo sapiens
ttcatcatgcctccatgagaacatcacaaaacttccatctagaaaggaaataggccaagtgtggtggcttgtgcctctcatcccagcagtttggaaggccraggtgggaggattgcttgaggccaggagtttgagaccagcctaagtgacaaaaagtgaggcctcttctgtataaaaataaataaataaataattagctgg

SEQ ID NO: 31884 - DNA, 201 bp, Homo sapiens
agagtgggttgttccaggtctggaagaaggtttgctcaccaaagaagggcattgaggaggctggaggatttggagaagggggatggctggctggcttggcyggcagccacaggtctctgaaaaaacacaatgagggtagggtgctactggcaaaggcaggccttggtgagggtgcctggagccccacatcagcaaattggg

SEQ ID NO: 31885 - DNA, 201 bp, Homo sapiens
aatgctggaggctcccttttcctgccataagggatcattcttcagggagaccctgggagtcccatgtggccaccaccaggaaaccatccgaaaaatatgcytggcacaaaccaggaaccccagggcagctcctatcaagtccaccatcagagaaagacattgtgcctaccctagagctagcacagtggctccactcacaga

SEQ ID NO: 31886 - DNA, 201 bp, Homo sapiens
tacactaagatattctggggttacagggcaacatgttggcgacttacttgcaaacggttcatggaaaaagatttttgtactatacttccaacttctcctakacctttgtggctgctccaaattaaaacttttatttccaagggaagctagatactaaaaaatagcaagactgaaaagaaacaaaatagcgtaattttcatc

SEQ ID NO: 31887 - DNA, 201 bp, Homo sapiens
cctcatcaataatgggacaaattgaaatcatactccaggtgagaggatgcagtgagaagaagccagcatcacttccatgattatccagttgcagaagacargctgaacataatcaggaggaaacaccaggcaaacctaacttgagggacggactgtcaactccctggcaggcagtcttcaaaaatataaaagttctgaagg

SEQ ID NO: 31888 - DNA, 201 bp, Homo sapiens
tggctatttggggtcctttaagattccatataaatattagaatggctttttctatttctgcaaaatgtgccattggggttttgatagggattgcatcgaayctgaagatcactttgggaaaatatgagcattttaacaacattaagtcttccaactcatggacatggaatgtctttccatttatttgtgttttctttaata

SEQ ID NO: 31889 - DNA, 201 bp, Homo sapiens
actcatgaaagcttaaaaactgctgcttgaagggagcttccaaacattggcagggccctgtacaccccttgatgttgtcctgaccctctgtctcatctcaktgtcacagcacagtgtgggggaacagtggaggagatggagggggtgatcctgagccccggcttcccaggcaactaccccagtaacatggactgctcctgg

SEQ ID NO: 31890 - DNA, 201 bp, Homo sapiens
gatataaatgacaacttgattgtaaatcaaattacgggtcaaactttatctttcaaaactgcagtaattattccactctattccaacatttactgttacasacaaattggggtccaacgtgattctttgtccttgtaagtaacctgtgcttttctgtctatgtgattttctttttttgttgttgttaattaaaaagcccac

SEQ ID NO: 31891 - DNA, 201 bp, Homo sapiens
gttttgtttttttttttttcagtagggcttataactgcagtactttctgtaccatgcatatatgagaatgctttccttttgacatgggatataaatgacamcttgattgtaaatcaaattacgggtcaaactttatctttcaaaactgcagtaattattccactctattccaacatttactgttacagacaaattggggtc

SEQ ID NO: 31892 - DNA, 201 bp, Homo sapiens
attaggtggaattaagatgctatttgaccaggccataggaatacttggaccctacctcaggccatctcgttctaaaaagccccctagggagatttcatatrttctcaattgcaagatgtactccctcccctcctacaccctaaccaatagtttaaccttttggaaatcaaaacaaatcttactatcaacaaatgcagttta

SEQ ID NO: 31893 - DNA, 201 bp, Homo sapiens
tataatgtactatggtgatgtttaccctgctttgtattagtggtgatattcctgcctttgttatcctgcatcgtgcattcatcatcccctttttactcggytgtaccaggtgttttgtgtttttgtgggttttttttaatttttattgctgcaatttatcaattattctgcagtttgttgttgcttttttttattaatctc

SEQ ID NO: 31894 - DNA, 201 bp, Homo sapiens
tatttaggcagtattcattgtttgttaactttattcccagatatttcatggagatttttgttgctgttgtaaatgggtcttttttcccccattatgttttmtagctggtctttactagtatattcaaagactgttgtttttggcatatttgctttgtaaagtcatcagactcttcataatactgcttacactgccaactaa

SEQ ID NO: 31895 - DNA, 201 bp, Homo sapiens
aagagctgtagtcagggctcagccttttcagtgctgatggcattgttgagtcagaggagggaaactgtgacatcatccacaagccagccaatcccagccarcacctgtgggcatttgtgtacaggtgctcgtattggttggttacttgagggtcaatgtttgcctctcatgaaagatgatggttcattcatagtaggctat

SEQ ID NO: 31896 - DNA, 201 bp, Homo sapiens
tggcctgtgcattttttatttgtgaatttattgtgaatttgtgtcgatttttctacaagcacttattttcttatttattgagtagagctccatattttatragctacataaatatatataatatgctataaaaagccctcctctccagcttgtcttttgctatataattttcttcagggtgctttaatgtcagaatatgta

SEQ ID NO: 31897 - DNA, 201 bp, Homo sapiens
gtgcagcacaccgacatgacacatgtatatatatgtaacaaaactgcacgttgtgcacatgtaccctgaactttaagtataataataaaaaaaggaaagtyatttgaagagactgtaaataaaagtaaatttaatctaaaaaaaaatgctaatgttcctggtgatgtggatcttgcctagagcttacccctcagtgaagga

SEQ ID NO: 31898 - DNA, 201 bp, Homo sapiens
aaagtaataaggtttcagtcactttttttttcttatactcactgggccttgcttgccgcagtctctttgcctccagagagataagtaagtctaggctatgrggtgggatgaagaggtgcaattgctgaatggatgggtggacggatggatgggatggatagagatagtgggtgatggaagaatggataggtggatgggatg

SEQ ID NO: 31899 - DNA, 201 bp, Homo sapiens
ttgaaaaagtaataaggtttcagtcactttttttttcttatactcactgggccttgcttgccgcagtctctttgcctccagagagataagtaagtctaggytatgaggtgggatgaagaggtgcaattgctgaatggatgggtggacggatggatgggatggatagagatagtgggtgatggaagaatggataggtggatg

SEQ ID NO: 31900 - DNA, 201 bp, Homo sapiens
ctcaaagatgttctggtgaaaagagcttagtgggccttgttgaaaaagtaataaggtttcagtcactttttttttcttatactcactgggccttgcttgcygcagtctctttgcctccagagagataagtaagtctaggctatgaggtgggatgaagaggtgcaattgctgaatggatgggtggacggatggatgggatgg

SEQ ID NO: 31901 - DNA, 201 bp, Homo sapiens
tgggcttggactgactgagggttacaacccacagagaagaattggtattacaccctgactacacatacatgtgtgcagccctcacccaacatacacacaamcacacacacacacacacacacacactgccaaatcgtctctgacacatacctttccaagtcactgccaaattcacatcaccaagtcatccctcacccccag

SEQ ID NO: 31902 - DNA, 201 bp, Homo sapiens
gagtctcgctctgtcacccaggctggagtgcagtggcgcgatctcggctccctgcaagctccgcctccagggttcacgccattctcctgcctcagcctccygagtagctgggactacaggcatgcgccaccacgcctagctaattttttgtatttttagtagagacagggtttcaccatgttggtcaggctggtctttaac

SEQ ID NO: 31903 - DNA, 201 bp, Homo sapiens
ggcacaggtaaagaatgggcaaggaagagctcttcagtctttaagattcactctcacaaaaatataagcctctgagggctggccccactgtgccaagcacrgtaagcccacaatgaatttttgttgcatgaaggaattaatacatgaatgagtaactctccaaataactaattaatgaacatgcacatatgtccctacaag

SEQ ID NO: 31904 - DNA, 201 bp, Homo sapiens
tcccgagtagctgggactacaggcatgcgccaccacgcctagctaattttttgtatttttagtagagacagggtttcaccatgttggtcaggctggtcttkaactcctgaccttaggtgatccacctgccttggcctcccttggtgctgggattccaggcatgagccactgcacccggcctatgtccatttttcataacac

SEQ ID NO: 31905 - DNA, 201 bp, Homo sapiens
tacatgaataggttagtgggagttgttctcaatctcagcttttcagtctcctggagcagccgaggctctgtttctcacgttatgattcagcaggtttaggracagggtctaagcatcagtatctttataaaactttccacataaccatgatgctgaaggttgcagaatcacaaacatgagtcgagagaataggcttatggc

SEQ ID NO: 31906 - DNA, 201 bp, Homo sapiens
acccaggaggtggagcttgcagtgagatcgtgccactgcactccagcctgggcggcagagcaagactccatctcaaaaaacaaaacaaaacaaaacaaacaaaaaaacctatcattccatttttaggtgtacaacttagtagcattaagcacattggctatttagtggtggataacaccactatctatctctagtaccttt

SEQ ID NO: 31907 - DNA, 201 bp, Homo sapiens
cccaggaggtggagcttgcagtgagatcgtgccactgcactccagcctgggcggcagagcaagactccatctcaaaaaacaaaacaaaacaaaacaaacaaaaaaacctatcattccatttttaggtgtacaacttagtagcattaagcacattggctatttagtggtggataacaccactatctatctctagtacctttt

SEQ ID NO: 31908 - DNA, 201 bp, Homo sapiens
ccaggaggtggagcttgcagtgagatcgtgccactgcactccagcctgggcggcagagcaagactccatctcaaaaaacaaaacaaaacaaaacaaacaaaaaaacctatcattccatttttaggtgtacaacttagtagcattaagcacattggctatttagtggtggataacaccactatctatctctagtaccttttt

SEQ ID NO: 31909 - DNA, 201 bp, Homo sapiens
caggaggtggagcttgcagtgagatcgtgccactgcactccagcctgggcggcagagcaagactccatctcaaaaaacaaaacaaaacaaaacaaacaaaaaaacctatcattccatttttaggtgtacaacttagtagcattaagcacattggctatttagtggtggataacaccactatctatctctagtacctttttt

SEQ ID NO: 31910 - DNA, 201 bp, Homo sapiens
aggaaaaaaaaaaaagtaaaacaaagacaaaaaaaatcttttgtacagagatatatttttattatacaaagtttgtacagtaccaaaaaagaaaaaaaaaaggtgtaaatttttttttcattattgtaggtaaacggtagtggaagccttttttgtaaatgtaataaaatgtataaatatggttttcagaaaacatcaagt

SEQ ID NO: 31911 - DNA, 201 bp, Homo sapiens
gtcctcatcagttatactgtgctgcttttgaggcctgaatcccacacttctaatcctcaagcagctattgtccattcctttccaccacaagctcctggggkggggggggggcaggctgtaaagtcattcttggtttctagccccaaacacccatctagatggaactctactgtgggttcttacaactcctcacatttcctt

SEQ ID NO: 31912 - DNA, 201 bp, Homo sapiens
tctgttactttagaatatctagaagtggaattgtcaagttaaaggatatgtgagatctttaaggctttttatgcagattatcaaatatccctctagaaagrtcttgtcagtttgatcaccaacaagaaagagggcatgttttattctcacaaaaaccaggtaattaaaaaaacaaaagcgtcatcagtttgaaaagtgaaa

SEQ ID NO: 31913 - DNA, 201 bp, Homo sapiens
tcccttactaactaatttttaaaaagcaatattaaactataagtagatagtttaagtagatggaattctgacaaagttctgatttttcccgtgccaattayatcatggctttaaaaaaatcaaatgccaaattaaaaaaatttcccctgctttgtatgttgtctgagtgcttgcttttagtcagcctcttgtagactagag

SEQ ID NO: 31914 - DNA, 201 bp, Homo sapiens
accaatatacatattttattgaaatattcgctacgagcttttctctgtcattttttttcttctaggctaggatttttaagtgctacatagtagtctctcayacagttagttaaaatttatgtaacgaattccctattattgaacatttagattgtaatgttttgtgcttatgaatagtaatgcaatgtattgtacatacat

SEQ ID NO: 31915 - DNA, 201 bp, Homo sapiens
tggcttcctggtccatgggaattctgggtctaggtaacccatatatccagctgatccttggacatcttcacttagatatttcccttccagagcaatcttaytagcttctttcttaagcctcccgtatttcctttgtgagctggtggttcctgtagcctcccagttatggagcccagaaacctttggattatcctcaactcc

SEQ ID NO: 31916 - DNA, 201 bp, Homo sapiens
agctgccctcacccagactgtgtctacaccgcccccttgtggtgtagccttctcctgttggttcgtattcagatgcaactttttttcttactataaatgtrttgcattttcattatagaaaacttagtgacaaaacaaaataattgcatacagaatcaaaataaagactaccccgaaagagccactgacaagatgtagtgg

SEQ ID NO: 31917 - DNA, 201 bp, Homo sapiens
actactgggtaatacaaatcaggatctaattagcactggacggtgggaggtggccctccaccttcaagatgttggtaacaagagattggtaacaaaggaamggaaattaaatggggaaggtagaggctggagatagaaacaagattaaagacagtctcttctagaattataaggaagagggcatttattgagtaatgtatt

SEQ ID NO: 31918 - DNA, 201 bp, Homo sapiens
gagctccaactagcggggccttcagcagctgccctcacccagactgtgtctacaccgcccccttgtggtgtagccttctcctgttggttcgtattcagatrcaactttttttcttactataaatgtattgcattttcattatagaaaacttagtgacaaaacaaaataattgcatacagaatcaaaataaagactaccccg

SEQ ID NO: 31919 - DNA, 201 bp, Homo sapiens
acaacacacaccctgtcctcatggaacttacagcctagtaggggaagagatgttaaacaagcaaccacacagataaatacaaagctattaatgaataaatkaatatcgtaagacttcacttatattcctacaaagctccaactttattagaagctgcccatctgtgtgtttaggtgagaaagagtttttgaacgtgaacct

SEQ ID NO: 31920 - DNA, 201 bp, Homo sapiens
atgaaacacccacctcggcctcccaaagtgctgggattacaggtatgagccaccgcgcctggcctatttgttgtttttttaattgtctgtctctcctcacyggaacgtgagagatgaggaaccttgttgtattcccagcaccagaatagttgctgttatattgcaggcataagatttatgtaaatatctgttgaatgaatg

SEQ ID NO: 31921 - DNA, 201 bp, Homo sapiens
agagctccaactagcggggccttcagcagctgccctcacccagactgtgtctacaccgcccccttgtggtgtagccttctcctgttggttcgtattcagaygcaactttttttcttactataaatgtattgcattttcattatagaaaacttagtgacaaaacaaaataattgcatacagaatcaaaataaagactacccc

SEQ ID NO: 31922 - DNA, 201 bp, Homo sapiens
ggtggtcattggccgggggctgacactgcctctagaattatacgtgatgatatctggagaacacttagaaatagggcttagtccatagtaaacgcccaaarcatgtcagtcatgagcatgacatttattataagaaatacccttcctctttggacagagctaaggagcatacatttgctctcactaaccagcccccttctt

SEQ ID NO: 31923 - DNA, 201 bp, Homo sapiens
ctcgcggctcctcagctccctctcgggctcccatacaggtatccggggctcggccagtgtggggatggttgtgggccgggggcatcacgtccggctaaagsaaggaggctctagaagcaccccatggccgcaggtggaaccctacggctctgcgtgcctgtcgtgttctggtgcttgtctacaacgcagcagccagctcgt

SEQ ID NO: 31924 - DNA, 201 bp, Homo sapiens
caggttaggaagaggcaatgctgagtcagccctgggctgtgcgccatagccatcctgaacagctttctgccattacaggatagaataagaccagccaggtstggcccatttcctctcagcagccatttgccttctgcccacacatcgatcttgccaaaagagggcttgtgctgcagcattgagtcattctcctaccctctt

SEQ ID NO: 31925 - DNA, 201 bp, Homo sapiens
gccctactggggccagaagctcaggctggggcagaacagaggatggtcactggtaagaggcccacaaggtcacctgactctctatctggtttctctttcakccccctgtgggggacagtatgtgggttcggacggagtggtcttgtcccccaactacccccagaactacaccagtggacagatctgcttgtattttgttac

SEQ ID NO: 31926 - DNA, 201 bp, Homo sapiens
tgatgggctgtacctaagcactgacctttaccacagtgaccctgccggcagctgagatgtggtccagggactgtcagcccccaccagccagagaaacacaygtttcccttggggaggagcaagcaggggatgagagagggcctcagcgattttgctgggcctccttcctctgtgggtcaaggcaagaacatggggggagga

SEQ ID NO: 31927 - DNA, 201 bp, Homo sapiens
gaaatcatctgaggctcggagatatttagcaacttgcccaactacacacagctggttgctggcagattcaaaattggaagcccaggtcttttttactccgyagcctaagacatataccaatatatcacctactgagaggaaaatggcacctgtttttgggtagctaaatgtccattctatggaagaaagtttaaataactg

SEQ ID NO: 31928 - DNA, 201 bp, Homo sapiens
ttcatttaactcatctcgtcactcagaacgtgcttatgggttaccagaggctgggaagggttgtgagtggggagggaggaggggaggatgattaatgggtwgaaaaaatcattatcatgaataagacctactatttgataccccaacagggtaactatagtcaataatcatttaatttatgctttaaaataactgaaacag

SEQ ID NO: 31929 - DNA, 201 bp, Homo sapiens
aagggattccagacagaaagaggaaagactgagcaaagactggaggccaaggcccacatagagtggtggaaagctgcatgtgattcagtctctgggaatartatcagaaggcaaggaaggctctacagcagacagacctgtatgaatattaaggatctgaacattgtcctgtagacaatggagagccactgaagggctctt

SEQ ID NO: 31930 - DNA, 201 bp, Homo sapiens
catcatttattctagaggaaatcatctgaggctcggagatatttagcaacttgcccaactacacacagctggttgctggcagattcaaaattggaagcccrggtcttttttactccgcagcctaagacatataccaatatatcacctactgagaggaaaatggcacctgtttttgggtagctaaatgtccattctatggaa

SEQ ID NO: 31931 - DNA, 201 bp, Homo sapiens
caccatgtgacagacactggaatatggccgtgaacaaaactgaacagctgcccttctgaaatctatattctagtggaggaagacagaaaaaaataaggtcwatatagagtcgatgagagagtattaactgcagtggagagaaatatagcagaggagggtgttgggggcattggggagaggagtattgcaattttaagtagc

SEQ ID NO: 31932 - DNA, 201 bp, Homo sapiens
caataaaatacaccattttggagtgtacagtttggtgcgttttcacaagttcatgcatccatctagctaccaccacaatcaagacataaacatctccatcrcccccaaaagtttctttgtgccggttcttagtcattctcctcccatccctgaccgcaggtaactgatctgctttctgtcacgtcagattagatttgtctt

SEQ ID NO: 31933 - DNA, 201 bp, Homo sapiens
aattaagaaacagaggaggataagacggatctggggtggagggatgaccattttagatgggcagtttgggaagaccttgagaaggtggtatttgtgtgaakaggtgaaagaggtgaaggactgaagcctgggagaagagtgtcccggcagcgggaagagcaagggcaaggctctgaggtgggcctgatctgctggaggagc

SEQ ID NO: 31934 - DNA, 201 bp, Homo sapiens
aactgtgaaccattcagcccaaattcccagtttttcagatgaggaaacggcttctagccactcaaagcgatgtttatagtctcactgtcagtagcagaccyggttctatcactcaggtgccttgatgtccaaattactccttttcatttaactcatctcgtcactcagaacgtgcttatgggttaccagaggctgggaagg

SEQ ID NO: 31935 - DNA, 201 bp, Homo sapiens
ttaataaagcctagcattaaacaataattttgtgttcttcctgaaaagccaaggatcttaggacactatgactttaatcattccttccaattcatactctrtggtgtgtgtatattatgttaccttaattttttctcaagttattattgttattgtttgataaagccactgtccacttaggtttactcatatattgaccac

SEQ ID NO: 31936 - DNA, 201 bp, Homo sapiens
ctaggaggccacaggaaggagttcgggccttactcacaagaaggggaccatcgctgaagggtcttaggcagggaagtggctccgtgagatttatgctttakagacattggggagagcaggggcagactgcggggaaggaaaccagtcacaggaggcaaagcagggaccactgtcgagcatagaatgtttctgaaccttcac

SEQ ID NO: 31937 - DNA, 201 bp, Homo sapiens
agccaagatcacgccattgtactccagcctgggtgacaaagcaagactctcaaaaaagaaaaaaaaaatagacaagttaaaagagaaaattgtgtagtatrtacatgttgatgtgcaaagcaaattaagaaacagaggaggataagacggatctggggtggagggatgaccattttagatgggcagtttgggaagaccttg

SEQ ID NO: 31938 - DNA, 201 bp, Homo sapiens
ctaaatttagctgtgactacttcccagggaggggtggggtggatggggaaggaaggctaagtcctgagttttgagtctccatagtgaaagggagacagccmagggctccatccctccaggacagcttcccctccatcgacctgctggtgaagccttgaagctgtggcattgcgttactgcacacacttggcttgaatatga

SEQ ID NO: 31939 - DNA, 201 bp, Homo sapiens
tgtctaggtgtgaatattttttgtattcatcctgtttaattaagtttcttgaatctatggattgtatctttcatcagcttgggaaaatgtttacccattaycttttcaaatgcttcttttttcttcttctagaagactgacaagatatgttcatctttctcactccatcatcagtatttcttaacctctctcatactttct

SEQ ID NO: 31940 - DNA, 201 bp, Homo sapiens
gtggtgcatgcctgtagtcacagctactcaggaggttgaggcaggagaatcacttgaacctgggaggcagaggtcgcagcgagccaagatcacgccattgyactccagcctgggtgacaaagcaagactctcaaaaaagaaaaaaaaaatagacaagttaaaagagaaaattgtgtagtatgtacatgttgatgtgcaaag

SEQ ID NO: 31941 - DNA, 201 bp, Homo sapiens
cttcccagctccctacttatctccctgaagcaggtgcccagctcccagcaggagctcagcacatgttggctgagtggagggatttggggtctcaggagagytggtgggttctaccccgcggtcctgagagaagcaagaaggactgtgttgtcaagaggatgcccctctgagggagagaggcaggtcgtgtgtgtgcatggg

SEQ ID NO: 31942 - DNA, 201 bp, Homo sapiens
tcatgtcttttgatttcagccaaggacaatgtcccatgccacactccttcccaacaaggctagctccaggatatctccttctggttctaatgctgaatgaraaatggccatttagtaacagctggcttgtcctgaggctgttcttttctgggtgtttttcacaacttccctacacctacctggagatgatgctatacaggc

SEQ ID NO: 31943 - DNA, 201 bp, Homo sapiens
gcccctgccccgaagggcttcccagctccctacttatctccctgaagcaggtgcccagctcccagcaggagctcagcacatgttggctgagtggagggatktggggtctcaggagagctggtgggttctaccccgcggtcctgagagaagcaagaaggactgtgttgtcaagaggatgcccctctgagggagagaggcagg

SEQ ID NO: 31944 - DNA, 201 bp, Homo sapiens
ccactgcccattctgcacttccatattctcattgtactatgggctgacaacccctaccttcctggcaacagggccattaaatgagataatgggtaggaaaytgataagtgcagtatcttacatgggtaggtgcttggggttgggattgtgaattgaatccccccctccccgcccccacacccatgcttaaaccctcttctt

SEQ ID NO: 31945 - DNA, 201 bp, Homo sapiens
cagctccttccagaggtctaagaaggggcagatcaggctgtagagagctgggaaccaagaacagtaccgcccctggcaaaggagacctagcccctgccccraagggcttcccagctccctacttatctccctgaagcaggtgcccagctcccagcaggagctcagcacatgttggctgagtggagggatttggggtctcag

SEQ ID NO: 31946 - DNA, 201 bp, Homo sapiens
ccaggtgtggacctggaaaacagttatgtctgtttctggttcttgcagcagttgtagtgtcagctccttccagaggtctaagaaggggcagatcaggctgyagagagctgggaaccaagaacagtaccgcccctggcaaaggagacctagcccctgccccgaagggcttcccagctccctacttatctccctgaagcaggt

SEQ ID NO: 31947 - DNA, 201 bp, Homo sapiens
ccagtaccaatcagctgtggaaggcagtcaagtttaggggtttgagtccaggcttgttacttacaaggtttacgacctagggcaagttagttcatttctgyggtcttcgtttcctcatttgtagaaacaagatcatgatagtactatacctacttcgactctcaggggagggggttgaaggagataatactagccctaggt

SEQ ID NO: 31948 - DNA, 201 bp, Homo sapiens
gttaggtgtgagaagcctgccaggaatatgggaggaactggtgggtaggcagctggatggagagaacctatctgcccatgtaagttggagcatccttagcrtgtagattgtattgaaagccatgaggtcagatgagatgacctcgcaagggagcagagacagaaaagagggattctctttactccccaaggctgcctttgc

SEQ ID NO: 31949 - DNA, 201 bp, Homo sapiens
ctgtaagtgggatgtttgaatggagagatgaacaatagaaagtagactgaacgccggcactttattttgtctaatagtgtcagcatatacaaagcaacccratagaaatgatgatgatgatggtgatggtggtgatgatcagggtgacacaaagtcagcttccacacactggcatatcagtgccaagcccttcacacatga

SEQ ID NO: 31950 - DNA, 201 bp, Homo sapiens
tctctgccaggtactgggtctatactaatgaatgagtcagagaggctccctgcttgcatggagcgtaccttctagtagggaagatagacagtaaacaaagsggggaaagacagccagttgtgataagtgtcatgcaaagacttgaaataagacagccttggagagaggacctgtgggcttctgcctctttgatttgtgtgg

SEQ ID NO: 31951 - DNA, 201 bp, Homo sapiens
tctgtgggtcaggattctgggtatggccttgtgggtcctcagtgcagggtttcaaaaggctgctgtcaagtgatggtggggctgcattttcatctggaggmggagttcaattccaagctcattcaggtgtctgacaggtggatgtcaggtggaggccactctgaggttctagaggcagccctttcatcccagaggccaact

SEQ ID NO: 31952 - DNA, 201 bp, Homo sapiens
caacaactctgttttcaaataagatcacatttataggtaccggagtcagaacttcaacacgtctttttggggggcacagagcaccccataacagaaggccrgcccatctttcctacactaacactgtcataccacaatgtcccctggggtaaagataacggttgtactgttttaataggaggccatgtgtctagagaaggc

SEQ ID NO: 31953 - DNA, 201 bp, Homo sapiens
gaagcagggaatagaggtggggagagatgggtctggatgcaattttaaagaggatctcaccgagcagcagacatttgcggacacacctgaaggatatgagkgagtcaatcttgctgatttgggggaggaagattattccaggcagagggagctgcaagtacaaaggtccagaggctggagcaagggagggagtagagagga

SEQ ID NO: 31954 - DNA, 201 bp, Homo sapiens
gttagatgctatgaataaaaaggaagcagggaatagaggtggggagagatgggtctggatgcaattttaaagaggatctcaccgagcagcagacatttgcrgacacacctgaaggatatgagggagtcaatcttgctgatttgggggaggaagattattccaggcagagggagctgcaagtacaaaggtccagaggctgga

SEQ ID NO: 31955 - DNA, 201 bp, Homo sapiens
cagagccagacagtgaaattataaagctaggaatgacaagaatgatgaggccctgcaaatcagggaagacacatcaccataagctctttatcaggccttcmcccaagaggccctctgtggaaagtgggaagcaggagggccttcttcactccacggtcgaggggaagaggatgagtggagagaagaattctaaccccatcc

SEQ ID NO: 31956 - DNA, 201 bp, Homo sapiens
ataccaaaggggatgggaatacaagaagccatgaacaccagatgctagaggattgttgggagtcaccttgggggccatctgccacctggaatttgtaaaamactctaaagatggacagcaagaggttagcgggcttaagactcaccccagctcccatgtgagttctaagttaaggaagcatgagatgcaaagataactcac

SEQ ID NO: 31957 - DNA, 201 bp, Homo sapiens
tataaatcacttagcatagtgcatggcatctgtaactacgcaataaataatttcaaaatctctatatctatctatctgtctatctatccatccatccatcrcactgtctagtagaaatgtgatctaaacctcaaatgtgagccatgtgtataattttaaatttctagtagccatgttaaaagactgaaaaagaaacaggtg

SEQ ID NO: 31958 - DNA, 201 bp, Homo sapiens
tcactttacgggagcagagacaatgggcaagatctggaatgagggtgggattagcgattgcggacacagggattcctgagggagggagaaaaagagggagrggattgagtcttgggcaccatcaccacatggggcctgctattgcctagaggtctggtgtgtaagagctgaaactgttccacctttcttcaccatctgaag

SEQ ID NO: 31959 - DNA, 201 bp, Homo sapiens
gctaccacctgtggagcgaagccatccctctctgtcaaggtgagaagcaggtggaaagggggtcacaaggtagctcggatccaactcatatcttgggtttktcccaggactagtcacttccaaatgtgggtttcctctttgataattatttcattctttccacaagcatttacaagatctgtagtgcgtagcaatctcagt

SEQ ID NO: 31960 - DNA, 201 bp, Homo sapiens
aataggcccagcacatcctaaggcagatagtgtgggcaggggaggatcctagcagggctggattctggcacggccaggcctgggatctggttgaggagagkgttaaagaaagacagggcctgggtctggaggggtggctgggagctgagtcttggggtcagaggctgaggcctacttgcaactgggcaaccttggatggat

SEQ ID NO: 31961 - DNA, 201 bp, Homo sapiens
tatatctctattgagaagatattagcctccattctaagagttcctcagaaagaatgggtgtgtgactccagctgcctcagacccaggtagccacatgtctkcaggtggctggcctcctgtgttctgcccaaattccctgtggacagctgccctgaagttcatggggagagtggacccaactctctaccttgccatcagttc

SEQ ID NO: 31962 - DNA, 201 bp, Homo sapiens
ctctgaagcttccagacagatctcttctgccaagacatctctcctgaaattcatctattggcttcctggtccatgggaattctgggtctaggtaacccatrtatccagctgatccttggacatcttcacttagatatttcccttccagagcaatcttattagcttctttcttaagcctcccgtatttcctttgtgagctgg

SEQ ID NO: 31963 - DNA, 201 bp, Homo sapiens
gggcacgttggtgcgcacctgtagtcccagctactcgggaggctgggtcacaagaatcacttgaacccaggaggtggaggctgcagtgagccgagatcgcrccactgcattccacccggggtgacagagcgagagtctgtctccaaaaaaaaattaaaaagaaaggagccagttacaaaagggcaaataaatacctaccat

SEQ ID NO: 31964 - DNA, 201 bp, Homo sapiens
atttcatttagtccttactaaatgaggtgaggtaaatgtgtcatcatttattctagaggaaatcatctgaggctcggagatatttagcaacttgcccaacyacacacagctggttgctggcagattcaaaattggaagcccaggtcttttttactccgcagcctaagacatataccaatatatcacctactgagaggaaaa

SEQ ID NO: 31965 - DNA, 201 bp, Homo sapiens
tttttaggagtgtaaagtgccatctcgttgtattaatttacacttctctgattactagcaagtctgttaagtctagtaagcttgttagctgtttgaacttyttttcttctgaattacctatttatattctttgcccatttaaaaattggatctcttgccttagaaatcttccggttgatttgtagaagttttgtttatagt

SEQ ID NO: 31966 - DNA, 201 bp, Homo sapiens
ttgaattgaggccatcacatgtgtggaatgccatcttgccccattgggtcttcacccccaagtttgagttaggtattggcatacccatcttgcagataaaraaactgagcctcagagacttagcttcctcctcacctacacgtggttctccccagctgggttttcccattttgttccctctgcagatcctaggccagccac

SEQ ID NO: 31967 - DNA, 201 bp, Homo sapiens
ctaccaaccttcattgcttcctccattgccatttcaggaatggagagagttcagtgattgggtgggacttggtgatggtgtgtggacttggcagtaagaargagatgacagtttaatggtttattttcaattaatgctaaaatgttcctagcacgaaaacagacatctcaatgttggcatcccctcctgccagggacctat

SEQ ID NO: 31968 - DNA, 201 bp, Homo sapiens
atcaatacctgatattttcttgcttacttacgtatttctttttcttctgtgcccttcccctcccctgccattgccagcagaaccgtgacaagcccctaatrtgcatcttggcacttagtaggtatccaaggttggtttgtttggaggagagatctgcttctgccttgccagttacaatgtcctgtggctaattgcaaaggt

SEQ ID NO: 31969 - DNA, 201 bp, Homo sapiens
ccaaccctttccctaccccagcctcaatctgtctacctaccaaccttcattgcttcctccattgccatttcaggaatggagagagttcagtgattgggtgrgacttggtgatggtgtgtggacttggcagtaagaaagagatgacagtttaatggtttattttcaattaatgctaaaatgttcctagcacgaaaacagaca

SEQ ID NO: 31970 - DNA, 201 bp, Homo sapiens
ctatctaagccactgccccatctctttttgtcttttagtcacttctcttcaaaggggtcttcatgtcagttttctctactacccgtcactccttacttcarcctctgtctccaggatgacactggaacactctagaagagagcaccaatgaccacctcaattgccaaatacattgtactttatctttattttcttttatct

SEQ ID NO: 31971 - DNA, 201 bp, Homo sapiens
aatggtggagaagacaaggcctctgcctttgtggaacttacggtctatttgggggagactgaagttagtaaaatattcaaacataaatgtagaaagtatgmcacatgtcataaaggaaatgaacaggatggggaataacagcagtggggaccctattctaaatctgacctctctgaggagggtaggatttaagctgagacc

SEQ ID NO: 31972 - DNA, 201 bp, Homo sapiens
accagcatcgtctttcatagggaaaatctccttcattatggtcactgtcatcttaccatttcatcttcattaccagcatctctccatcatcattcaatcaktcaaacaaactactcaggcccttctcctgcttgacattgaacttggcactgggaatgcaatggtggagaagacaaggcctctgcctttgtggaacttacg

SEQ ID NO: 31973 - DNA, 201 bp, Homo sapiens
acagtttgaaggtggagctaatagaactggctggcagattagaagtgggtgctggagaggagccaaggttagctcccagggtttggggggatcaacgggcmgtatggagctgcccttaactgaggtggcaaagcccataggaagagcaggtttggggtgcggagatcaggagctcagttcagactgttaggtgtgagaagc

SEQ ID NO: 31974 - DNA, 201 bp, Homo sapiens
aagataaggctggatgtgctgggacacagctgcccttggttacgaattcacagtcattgggataagactggtgaaggtggtcagataaaatcaacagctayacctgaaagcttggtgttcaataccctggcaggaccatgagcggtcatcttcacaatgagcaccagcatcgtctttcatagggaaaatctccttcattat

SEQ ID NO: 31975 - DNA, 201 bp, Homo sapiens
gagactgttgagtcagaagagaggtctatttccaccccacacccttccttggtaccctgtgagtgctgcagatttacacactgtgtcctccctccctgagstggcccactctgtgctttcttcctagaaagtgctggttctcacctgccctttcccataggctgagctaggagcccttcttatttccatcacatgctatat

SEQ ID NO: 31976 - DNA, 201 bp, Homo sapiens
gagacgagtggtaggaagagataaagttggagacaagggaccaggtcacacacagcctttacattatgggaagaacttggcttctactgagtttatcaggrcccatgggcaggttctgagcagaagctgacctggtctgacctagctttaaccagctgctgtgctgagaatatgctgaaggagtgcagagtgggaacaggg

SEQ ID NO: 31977 - DNA, 201 bp, Homo sapiens
gaggattgttgggagtcaccttgggggccatctgccacctggaatttgtaaaaaactctaaagatggacagcaagaggttagcgggcttaagactcacccsagctcccatgtgagttctaagttaaggaagcatgagatgcaaagataactcacctaacatgactcaaagaaccagcttgattcatttctagacaggctcc

SEQ ID NO: 31978 - DNA, 201 bp, Homo sapiens
acagataaaaaatcagacaactgtgacaactgctggagagctgagcgcttagggcacagtggtcgcttgcctaggctccaggaaaagatcacactagagcractgtggattccacaccatggcctactggggaattcccaggctctgagccagcagcacttctgacctctcaaggtgagagttcccctggcatatctggag

SEQ ID NO: 31979 - DNA, 201 bp, Homo sapiens
ccagctcccatgtgagttctaagttaaggaagcatgagatgcaaagataactcacctaacatgactcaaagaaccagcttgattcatttctagacaggctycccgaagtgtgggactatgacagggccaggctggaaaatgggtcgggcttctcatcttcctcctaaagaggagaccactaggctcatggggcaaggctga

SEQ ID NO: 31980 - DNA, 201 bp, Homo sapiens
ggtagcaccagcccttgcccttgggcaatcatggtctagtggaggagacagataaaaaatcagacaactgtgacaactgctggagagctgagcgcttaggrcacagtggtcgcttgcctaggctccaggaaaagatcacactagagcgactgtggattccacaccatggcctactggggaattcccaggctctgagccagc

SEQ ID NO: 31981 - DNA, 201 bp, Homo sapiens
aaatgggtcgggcttctcatcttcctcctaaagaggagaccactaggctcatggggcaaggctgaccagtgatagttagccaggggttgaaaatagtcgcrgagatgggcagcttccatgctttagcatctaagaatactcctgcagtgatgggatctcatctgtggtttctgaccgccttgcagaaaaccatgtaaggaa

SEQ ID NO: 31982 - DNA, 201 bp, Homo sapiens
ctgcagagtgcctgggaagggatgggtgctttacccaggcattagctttccccaggcccaagtaagcctagacccagtgccatggtggctcctcatgcctytcacctagctagtctcccacccacttctggaggcagggaagagaaaggacactgctgggacaataggataagcctacactttggaatcatagagttcttg

SEQ ID NO: 31983 - DNA, 201 bp, Homo sapiens
ctctgagtaagaggggaagctgttggggcattggagtagagaagcagtaataaattttttccctcaaggttccttgtaaatcagatgtttgtcaagtgaaycctgcttcaaatcccctatgagaacctgggctgaccttgcttgaaagtggctggattccacagagcatgtgtgtttgcacagatgctgcacatgctttac

SEQ ID NO: 31984 - DNA, 201 bp, Homo sapiens
cattggagtagagaagcagtaataaattttttccctcaaggttccttgtaaatcagatgtttgtcaagtgaatcctgcttcaaatcccctatgagaacctgggctgaccttgcttgaaagtggctggattccacagagcatgtgtgtttgcacagatgctgcacatgctttactcaaatgaagtctttctgtggcccccta

SEQ ID NO: 31985 - DNA, 201 bp, Homo sapiens
ctgatttctccatgtcatatgaaggattcaacatcaccttctcaggtaaagagtatgagggtccctgaggggaagagaccatggtgctatttgctctctcyttctgctaccagtctctggttttcctagcagatagatattaatccactctccagtccctgggaagttgaccttagtgcttcagcaaaagatgcttgggtt

SEQ ID NO: 31986 - DNA, 201 bp, Homo sapiens
gaatttgtctttcaagggatgtcagtcccacccttgaaaaatcattattataaggaacttttatgatgctaaaaataatgtatgtatagttaaattactgmgagcaccaaattactctgagaaatttacttgagaatctcctgtgccatctagaacagaaaataagggcttatattgcaacacaaatagccttcctacctg

SEQ ID NO: 31987 - DNA, 201 bp, Homo sapiens
gaatagctcatgtaggacctaggaggccacaggaaggagttcgggccttactcacaagaaggggaccatcgctgaagggtcttaggcagggaagtggctcmgtgagatttatgctttagagacattggggagagcaggggcagactgcggggaaggaaaccagtcacaggaggcaaagcagggaccactgtcgagcataga

SEQ ID NO: 31988 - DNA, 201 bp, Homo sapiens
attaatatcgtaagacttcacttatattcctacaaagctccaactttattagaagctgcccatctgtgtgtttaggtgagaaagagtttttgaacgtgaayctattgttctccttagttctgttgaacagaacagcatcatgatagagccctgaggcagaaaactagagaccaccttcagatgggcgcaagtctactgact

SEQ ID NO: 31989 - DNA, 201 bp, Homo sapiens
cagtaatgggattgctgggtcaaatggtgtttctggttctagatccttgaggaatcgccacactgtcttccacatatacaccatggaatactatgcagccrtgaaaaagaatgagttcatgtccttagcagggacatggatgaagctggaatccatcatcctcagcaaactaacagaggaacagaaaaccaacaccgcatg

SEQ ID NO: 31990 - DNA, 201 bp, Homo sapiens
gacacgatgatagaatatgaaatatgatagtaaataaaatcaagtgtctaagttatgaaatataaactgcagttctttttctttttgcagcactataaatrccatgctattttgttcaagataaaaaccagaaacaaatgtaatccaattactggatgcagcgggggtatcactctgcttggggaagtaaaatactcagca

SEQ ID NO: 31991 - DNA, 201 bp, Homo sapiens
atatgacatatataaaatgtataattatatatctcatgtataataaaatataaatatatatcagttgaatggagaggaaatggagacagcaagtatagaaractctttggggatggaaatatatgaaaagcacttgacattaaggatagcacagagtaagtatgctatgaattatgtttaaaaggccaaaccgctaaaaat

SEQ ID NO: 31992 - DNA, 201 bp, Homo sapiens
gcctcactacaatgcagccactcacatttcagtgcagccttggcgattaggcctcacctcatacatcagccagaggctctcagcagtgctctgttgacaamgagtgtgaggctgctgggctcagaaaagaagggcaaggaaattgattagcagtgtctgcccagggcactcaggagcataccacagaatcgccatctcttc

SEQ ID NO: 31993 - DNA, 201 bp, Homo sapiens
ttaggcctcacctcatacatcagccagaggctctcagcagtgctctgttgacaaagagtgtgaggctgctgggctcagaaaagaagggcaaggaaattgawtagcagtgtctgcccagggcactcaggagcataccacagaatcgccatctcttcctaaccacagtgcacatctcagccacctgaggaggattaaaaaaat

SEQ ID NO: 31994 - DNA, 201 bp, Homo sapiens
tgtgccttggtggtaaggaacttacttttataatgtgggctcctggcagggtcaatagggcatggccatggtgaatttgtcattctagaatgctggctccrgcattgctgaggacaatgcactggagagggcaaggccagcagtgagaagatcagagttgggcacagaagtccagggaagagaccatgagggtcttcaaat

SEQ ID NO: 31995 - DNA, 201 bp, Homo sapiens
gaccatggttctggaagctcctgtttctcctagttccctggagtatgggaaacagtgggcatagtgtcctggtgcctgaccctcccttccaagtgggccarcaagcatttctgtccagttcacaaagacagggcctgatattctcccacttcatggccaacaccttctggtggtggctatgcagcagctgataataatatg

SEQ ID NO: 31996 - DNA, 201 bp, Homo sapiens
atgaatggtgctcctgaaagatgtgcaacatagtggccctgaaaaatcctagaagctgcagcagagttagaggttcacaacagacactgggaagtaaggcytgagaaagtccctgaaccacctgcaaaaactctccagtgaccaaactctcttactgcctctgtggctcctccctctcttgtctacagatgaggcccacag

SEQ ID NO: 31997 - DNA, 201 bp, Homo sapiens
tacacataacaccactcattatcttaaccatttttaagtgtggagttagttcattggcattaagtacattcacattgttgtataaccatccccgccatccrtctccagaaccttttcattttcccaagctgaaactctgaccctttagtctgtactaactcctcttttccctctcccccagcccctggtaacctctattct

SEQ ID NO: 31998 - DNA, 201 bp, Homo sapiens
ttaagtcccttatttaaaatggtgtagtaattgcatataacctcccatatcctcccatatcccttaaatcatctctagattactgacaatacctaacacartgcaaacactatgtagtaattgtactgcgttgttttaaaatttttattatttttattaatattatttattatttaatattttcaatgcatggttggttga

SEQ ID NO: 31999 - DNA, 201 bp, Homo sapiens
tcgaccccccccccatggatataaaaatctgcagatgcttaagtcccttatttaaaatggtgtagtaattgcatataacctcccatatcctcccatatccyttaaatcatctctagattactgacaatacctaacacagtgcaaacactatgtagtaattgtactgcgttgttttaaaatttttattatttttattaatat

SEQ ID NO: 32000 - DNA, 201 bp, Homo sapiens
tcttcattataataagggaaccaaagtctcaaattaaaaataaaagaaggcatgatgtagcttttgctgcacttcagccacagaggagattcattgtcatrcaatcactgagaatattacgttgattggcaagagtcgggctttgtagaagagacaaaaattccccacagctaatctacaatggaattgttcaatgtcagg

SEQ ID NO: 32001 - DNA, 201 bp, Homo sapiens
ccaacttgttcatatttgcccaagaccttcccaattttagtcctgaaagttccgcatcctggaaacccactcagtttcaggcaacagagacatttgtcacyctactcccagcctattccttacacaatcttcttttttttttcctttcttcctttcttttttctttcattctttttcttttttcttttttttttttttttt

SEQ ID NO: 32002 - DNA, 201 bp, Homo sapiens
gttatactgtgggagcagtggtgcggtacagctgcatcggcaagcgtactctggtgggaaacagcacccgcatgtgtgggctggatggacactggactggstccctccctcactgctcaggtatggtgcatggcattgaggaaagagctccagtggaatgcttgactgatgggaggtagacgagcccccaaggtgtgagtg

SEQ ID NO: 32003 - DNA, 201 bp, Homo sapiens
agggtaaccagtttaacctcaacgatgtggtcaagtttgtttgcaaccctgggtatatggctgagggggctgctaggtcccaatgcctggccagcgggcartggagtgacatgctgcccacctgcagaagtgagtcaccctttctctcccaatccagtccccaccatctctgctatatgtggttctgtagctcagaaaaag

SEQ ID NO: 32004 - DNA, 201 bp, Homo sapiens
taagacaatgaaatggcactttatccctattaagttaggctgaagaacttcggtgggtatgatgcagtgctggagtggtggcaaagacacagacacactcrcacatggctggtgctgatgtaaattagtcctttggaaatccagcttgacagtatgtatcaagagtcataaaatgctcatgtcatttgacccagtaattcc

SEQ ID NO: 32005 - DNA, 201 bp, Homo sapiens
atgatcgtcaggatgataatgaaagctagcattgctggggctcttaccaggtgccaggcactcttctaagtgccttacattttaacatttaattctcaagyagtcctttgaggtaggccctattattatctccattttacagatgaggcactgaaagttaagtaacttgcttgaggtcacacagctagtaagaggtaaagt

SEQ ID NO: 32006 - DNA, 201 bp, Homo sapiens
caatgggatttagctcaattgactcccagtggcaccttatatgaccaggtcccctttctcagctgccttctcttttctgtttcatatcccctcccctcacwgtgctcttagggtcaactcccaaataagctcacttgtagccaaatccttaacacaggtcttgttttagtggaaatccaacccaggtgatatagctaaaca

SEQ ID NO: 32007 - DNA, 201 bp, Homo sapiens
tgcctgggagctgagcaatcctggctctagatgagaaggaattccaggatgcctgggggcgaggtacgctggggagggcaaggcagcctcagagctccccscaggctgccgcagttgcctgtcctcccccaggggccctgcatcctccgcctcccggtctttctccttcccatcctttgatatatatgttttcagtatata

SEQ ID NO: 32008 - DNA, 201 bp, Homo sapiens
gatatttagcagcaaccgtggcctgccagtagcccccctctccccattgcagagaagaaaaatgttctcagacattggccaatgtcccaggcagggttggrgtggagcaagcttgctgcaggggttgggaagtgcgagcttccctttgtgccaaagactcttccacggctacggattatggtctcttatgcaatagctgtc

SEQ ID NO: 32009 - DNA, 201 bp, Homo sapiens
agagctggacatgggagagaagaagaagtctgtttcaagctgtctgtaagacactctcagagttaagagaccatcatgaggtggggttgggggaggggagmaaaggaaggcctaggggaaagaagagctttcaggaagcctccttgatatggtttggctctgtgtctccacccaaatttcatcttgaattatactcccata

SEQ ID NO: 32010 - DNA, 201 bp, Homo sapiens
cctttggagatttggaccccagcccatgcctgatggagtctgcagtttggcataatgaattctgtgcatacccaacaattcggccctatctttgagagcaraaaggcagagtggggcgaagaaggaaagtgttggtgcacccaaaggcagagctggacatgggagagaagaagaagtctgtttcaagctgtctgtaagaca

SEQ ID NO: 32011 - DNA, 201 bp, Homo sapiens
cgccagacccctgcctccctaggctagggcaagactccacctgcctctcttgagcccacttgtctctgcagctggactcagaccctgacttctaactccaygtcagagccagcccccagggccttagcagctcccaagacttgcagctcgagcttcatggcatcccccctctactaggctggtttctgagccccaaacttt

SEQ ID NO: 32012 - DNA, 201 bp, Homo sapiens
atatccaagttcacacaggtcagcaccacctgaccagcaccgaagggggttatggaaggggaggagtggggtctgccagggatgaggctctggaaaccaaytgcagtgaccccatggggcagccatgtgctccatccctaatgccaaagggagggtctgggcagacgtggtgggggaggggttggcagcaggtgatacaca

SEQ ID NO: 32013 - DNA, 201 bp, Homo sapiens
aattctgaggggtgtggaatagtaggagggcttacctatcttctgttttggttacagcaattacctgtggacacccaggcaaccctgtcaacggcctcacycagggtaaccagtttaacctcaacgatgtggtcaagtttgtttgcaaccctgggtatatggctgagggggctgctaggtcccaatgcctggccagcgggc

SEQ ID NO: 32014 - DNA, 201 bp, Homo sapiens
atgtaataggtattttctgctttaagaaggtcagcagtgtatagagtgagaaaaatgcagctgcctcctttcccaggcccttgtcccagcctcactccctrgaggtaaccgctgttaacagtttggtgtgtgtccaatttctttttaaataaggattcattaaactgcccatgaggcttattgggacatccatcagacctt

SEQ ID NO: 32015 - DNA, 201 bp, Homo sapiens
tccccgcccccagtgtctctgtaagtagatgtcacctgctcaaaatgactgatggggtggcccgtgtcaaagaacagtcctcccctctgtgcatgtgtgtrtgtgtgtgtgtgtgtgtgtgtgtgtgtgtctgcacatgtatgagttgccttatggtgacagtcactctggctactcctgggatttcagattccttcttga

SEQ ID NO: 32016 - DNA, 201 bp, Homo sapiens
tttttggaaagagaatttccctgggaagcaggctcaacctactctctaggtccagcaagtaacccttttgagtttcaacattaaatttccttaatttcatmcctccttttcatgtccttagagctttgacggatttgcttcacttcattcccttcattcatttgcttttgtttttgtaggtggcgatacaaaaactgtcta

SEQ ID NO: 32017 - DNA, 201 bp, Homo sapiens
cacgagcaaacataatctatgaagacgctgctaataaactgcatcccgtatattggagggtttatagggtgctggtgatgactgcaccagttaagcacagmtaagcatctcttaatttagacatttgggctcaagttatgggaaacactacaactcgttccctcaattattggaaatacacattctgtcatcagcctaagg

SEQ ID NO: 32018 - DNA, 201 bp, Homo sapiens
tcttctgaccaggtaaccaaggtgaggggagaagtccagcaaccttgggaccagctcaccctcccgacagggtctgcttcattgcctagttttgctcggargattttactatactgggaatccatgcctgtttggacttctgttcaattgcagtcatcaactgtacagatcctggacaccaagaaaatagtgttcgtcagg

SEQ ID NO: 32019 - DNA, 201 bp, Homo sapiens
accaaagctggacactgtgggactcctgagcccattgtcaacggacacatcaatggggagaactacagctaccggggcagtgtggtgtaccaatgcaatgstggcttccgcctgatcggcatgtctgtgcgcatctgccagcaggatcatcactggtcgggcaagacccctttctgtgtgcgtaagtatgtcatccactct

SEQ ID NO: 32020 - DNA, 201 bp, Homo sapiens
agtggccatttggggtacaaccttgggatttggggtgccaagtcctcaacactatttttgtcatgctgagggttcctgaagtcactcctagattgctactstcagggagaggtgggaaaagtaatgagttgtgggatagttggtccttttccccaccatccctgtctctagccactcagaccaagctccactccattttct

SEQ ID NO: 32021 - DNA, 201 bp, Homo sapiens
gctaagcagaagcagccatgtccctcctcttggggctggcttactgagcatcttgtgatcattttagtcatctcctgtggagagctcccgattccccccartggccaccgcatcggaacactgtctgtctacggggcaacagccatcttctcctgcaattccggatacacactggtgggctccagggtgcgtgagtgcatg

SEQ ID NO: 32022 - DNA, 201 bp, Homo sapiens
ttttgtcacagttcttgctaagcagaagcagccatgtccctcctcttggggctggcttactgagcatcttgtgatcattttagtcatctcctgtggagagstcccgattccccccaatggccaccgcatcggaacactgtctgtctacggggcaacagccatcttctcctgcaattccggatacacactggtgggctccag

SEQ ID NO: 32023 - DNA, 201 bp, Homo sapiens
ggttggaaatgagccccattcattacacccaggtcccaatggaagcatcaggtcagagtggtctgattgtgaacagctcattaagtaaagagcagtgagcktttgagagtgactttttaagaagaatcgacttttatttatagtgatgttccagtcattaatttcgaaggaagaaagcccaaagcagaagcaggttcatta

SEQ ID NO: 32024 - DNA, 201 bp, Homo sapiens
actgaagattcctggattcttcattattgcattaaggtctccaagtccctagatctgggctcttacaaggtcttccagaattaatcaagtaattaatcctyctttcttttcctcatttccccagctgtgacttgtcctgatgtcagtagcatcagcgtggagcatggccgatggaggcttatctttgagacacagtatcag

SEQ ID NO: 32025 - DNA, 201 bp, Homo sapiens
gatgatgatcgtcaggatgataatgaaagctagcattgctggggctcttaccaggtgccaggcactcttctaagtgccttacattttaacatttaattctyaagcagtcctttgaggtaggccctattattatctccattttacagatgaggcactgaaagttaagtaacttgcttgaggtcacacagctagtaagaggta

SEQ ID NO: 32026 - DNA, 201 bp, Homo sapiens
atcaaggctcacaacccagtgtctttgtgtccaggcacagcgggcagcaagggctggcccttccgagggaaggagcagggtggagagataccactcttctrgcattcacaccacacagtaattcatgggcctgggcgggggtggcatgtcttttggtggcacgactctctgaagtcttccaattcttttttcgtcgtctga

SEQ ID NO: 32027 - DNA, 201 bp, Homo sapiens
tttcttttttattatgagactttaccctttaattagtttttactaataaaaggaccttgggaggggaggaaggataaaaatagtttctcagaataccatcytaaaacaaatgctcatgacattgttttccttttgctagctctttcctgtgggcttcctgaggcccccaagaatggaatggtgtttggcaaggagtacaca

SEQ ID NO: 32028 - DNA, 201 bp, Homo sapiens
tggtgctgcacattccatgatcactcatcaccccacccacctgagcagactgttaaaaaaacaagatggctatatataactcagggtgtgactgcttccckgggattgctcaaaaactgagaccccagcatctggaagtgatgtcttaatgctaatattctggaggtggagccaagatggccgaataggaacagctccagt

SEQ ID NO: 32029 - DNA, 201 bp, Homo sapiens
gaaagggactggaagggaaaggaagaggatattctatctaggaacaggggaatggtcgaaagggcccctgaagcccctaatctcctccagtccaacagggyctttcctctcatccagcccaccactgcaggcagccagagacgccaacgcatgccaacgtcggggccctggatttgccctccatgggctacacgctcatct

SEQ ID NO: 32030 - DNA, 201 bp, Homo sapiens
cgctgcccttgtagaggttgacttctggtgtggagacagccagggggcaagccaatcaaaaaataatttcagattgggataaatggcatgcagaacaaaarcagggtcagggaaagagagtggtgagctgcattacatgggacagggcagtctgggagggcttcctggaggagctgacccttgaaaagagacctgaaagat

SEQ ID NO: 32031 - DNA, 201 bp, Homo sapiens
cttttgaggggttctcattctggttagaaagacaatcccttcctattggcctttgtataatgagtgaagccccagtctccatttttggcaaatttgcagaygcattcctgtaacacacctaaaataccttttatattatctattagcaaattttacacacaacatatagatctatacatatatactaagcaaattacagaa

SEQ ID NO: 32032 - DNA, 201 bp, Homo sapiens
gagagccccgcctccagcagccggtgagcaggggtgtgggaggaagacaggccatgacaagcacagacagggacctatgcgtgccaggggctccacccaayggagtcgcacacaccacatagacacacccagtaagaggagagctgtgcattgagcatcattgtgtaacaggcactgaaccaggccctttgtggatctaat

SEQ ID NO: 32033 - DNA, 201 bp, Homo sapiens
tgctatgtactggcagcttcacctggcatcattgatgagaaggtgccaatagacacactgcgcacagcttgttctatatgcagatgctattcatctcccartgactccctttctctaccaggagttcatagccatctccttgaaagcatctcacatttcatctggagctattcacaagcaaccacatcccagggtgccaga

SEQ ID NO: 32034 - DNA, 201 bp, Homo sapiens
tgacctcatacaaggtttggtttctctgagcctcatctataaaatggaggtgacatttacccgccttacagggttgttgtatgtgagccaccagctatagrtgcttacgtggtccggaaacattgtttacgtcctttcctgcccttctgttcttaggactcagtaactcagacctttccagagagttctagtgcctgtgat

SEQ ID NO: 32035 - DNA, 201 bp, Homo sapiens
ggcatggatgtgtatgatgctatgggaaagagttatccccagagttagtagtggatgtatagggacagtggactgggagtaagaaaaagaaaggaatggargatgactccgcagtgtctgccttggaaacagaaaacaaaccaaatcagtctgcagtgaatttcagtctccagtgaaatgtgttcttggggcctaccagga

SEQ ID NO: 32036 - DNA, 201 bp, Homo sapiens
tgtctagaacctccagtataatattgaatagaaatggtcagagtggctagccttgacttattcctgatgttaggggaaaaacatttcgtcttttagcattragtatgatgttatctgtaggttttttgtggatacccttctaataaaaatttttaagcagaggattttggcatgatttggtggcagtgtggaaaatgcact

SEQ ID NO: 32037 - DNA, 201 bp, Homo sapiens
gtgcctctagtttcagctacttaggagactgaggtgggaggactgcttgagctcaggagttcaagaccagcttgagcaacatagggagaccctgtctcttaaaaaaaaaaacggaaaaatatatataacataaaacctatcggctggacacggtggctcatgcctgtaatcccagcactttgggaggccgaggcgggcaga

SEQ ID NO: 32038 - DNA, 201 bp, Homo sapiens
aatatttagatatgtgatgtgtcaggcagtgttgaggcatacagagaaaaattaagtcagcttagaaagtgctggagctagggttgctcttttatcatggycagaaaaggcctctctgatgagttgacatttggccagagatagatatctgggagaagagggaacagaggaccaagacccaaaccatgagcatgctcagca

SEQ ID NO: 32039 - DNA, 201 bp, Homo sapiens
tgctcctgtgcatttctttctttctttctttctttctttctttccactcagttagtcttgccagaagtttgcctattttattggtctttttaaagttccartgctagggtgatccattttattctcttttatctaaattattgatttctgcttttatctttatctattcttttctctcactttccttaggctaatattgtt

SEQ ID NO: 32040 - DNA, 201 bp, Homo sapiens
gggaggggattacacagagtgtgaatttcaggagttggagatcactgggagccatttcagaaactgcctaccacggtgaatatcagggacagcacaactakcaatgccccagtggcctgattatgccatgtcagactcccataggtgatggacaaccactgaaatatttcaccgttgaaggggagacatagaaatgtcacc

SEQ ID NO: 32041 - DNA, 201 bp, Homo sapiens
cataagaggacccagagaccttcctcaggacagcactcagggaggacaagagcttggaaagcgcagaaagaaagccctctgcctctttgaacagtgctccrtgggagcaccctgcagagacagcaggaccctaacatccgtcagagaaactgatgaggaaggacagatggcgtgcagttccatgaacacttcccggcaacc

SEQ ID NO: 32042 - DNA, 201 bp, Homo sapiens
aatataccttcaacagtataatcactttgagagctaccatgtttcaggcactgtactaaggtttttatatgcatggtctcatttaatgtttacaaaactcttttttttttttttgagatggagttttgcccttgttgcccaggctggagtgcaatggcatgatctcagctcactgcaacctctgcctcccgggttcaagca

SEQ ID NO: 32043 - DNA, 201 bp, Homo sapiens
attgtaaacataaagcatggtcattaaagaaaatttagaaaattgagaaaaactgaataaagaaactctatgcatgaacattttgattcatttctttctcttttttttataggtatggctttgtttttaaagagctgtgttcatagagtattgtgtgagtgtgtgtgtatgtgtttaagtatatacccactttttattatg

SEQ ID NO: 32044 - DNA, 201 bp, Homo sapiens
tattcttgcctgaaaaatctagttaccagacagacacttacagcacaatcccatttgtgtcaaattatagtcaagtaggaaaaaacctaagtcaaaccatstcagggaaaaaatgaaatgtgttgttcatcttcaatgaaaagtttaggagactgttctgatgccacagggattctagcatctcggcctccttcttgggcc

SEQ ID NO: 32045 - DNA, 201 bp, Homo sapiens
gctgtgtgcattgcttcaggccttggtcagccagggccaagttctcatctgctggcttgactggggaaggattcacctacccacttgtgtggctgctgcartattaagttccttgtggttggtggactgagaacttctgtttctcactggctaatggtctgaggccaccctcagcttctagacatttcccacagttccttg

SEQ ID NO: 32046 - DNA, 201 bp, Homo sapiens
acagtttctgtggggtcaggagtccagtaacagcttagctgtgtgcattgcttcaggccttggtcagccagggccaagttctcatctgctggcttgactgsggaaggattcacctacccacttgtgtggctgctgcagtattaagttccttgtggttggtggactgagaacttctgtttctcactggctaatggtctgagg

SEQ ID NO: 32047 - DNA, 201 bp, Homo sapiens
tcctctgccttcttgcttcccctccctgtgtggttcccagggacttacccatggcctcagatctttgtgttcttccaccattgcatatggaggcaggagcrtgtgcaggtaacttgtgctaggcctcattcgtgggacccactgcatccccttagtcccatcccagtatctttctcccctgcttctccactcccttttctt

SEQ ID NO: 32048 - DNA, 201 bp, Homo sapiens
aatgatcgtcttgccccatgtgaaaggcccaggcaagaaaagagatttaggctcaaggtacctgataccatatttctttgactctaagatgcccccagtcrtaagatccagctttagttgatgtaccattaagaaagaaaaaaatgctgccaattaaagtgtgacatgccattgactataagacacatcctaatttcagag

SEQ ID NO: 32049 - DNA, 201 bp, Homo sapiens
tgcctaaactaaatccaagaggctgcccctgtgtacaacagccctattctattacctcttggctccctgcacttctccttctatcatgtgcatcactcgtrtattttctgttccttgtttaccttctctactcttgtgtgtgcttctggacaggaagaacgctcaatagagcactgaagtcagagctcagggtctaaagga

SEQ ID NO: 32050 - DNA, 201 bp, Homo sapiens
ggagcgaggaatacactggttccacctgctgggtttctccctatcaagagggaagcagagctcagattcagttcgacatccccaaagcaggcccacagccrtgcacacagagagcatccgcacaggccactggagcgtcagtggagtccaaccaggctgcaccagcttccagatgcccttcacctgctacagaggggaggc

SEQ ID NO: 32051 - DNA, 201 bp, Homo sapiens
agctgctcggaagctgctggctctgctctcacccacgcacagcacagaaaagacattggaatgtgcctggctttgcacaaaagctgaagcaaccaggatcwggggaaagacctgagcgaggcacgatgtttcccgaggccctgcagatctcccagcctgtgagcagtgtcagggctggacccagtggctgccccaccataa

SEQ ID NO: 32052 - DNA, 201 bp, Homo sapiens
gatcatttgaggacaggagtttgagaccagcctgggtaacatagcaaaactccatctctacaaaatattaaaaagaaaattagctaggcatggtggtatgyacccgtagccctacctgttcaggaggctcaggcaggaggatcactagagcccagggggttgaggctggagtgagctgtgattgcgccactgcactccagc

SEQ ID NO: 32053 - DNA, 201 bp, Homo sapiens
tactgggcacatattgtgtgcagtccttgactttcatccaagcttcattttcattgtcacgatttgtgctctctccctagtctatctcccctcccaaaggrgagcagggagaaagaagacatgctccacttagtgtcacttctggaaaaaaaaagacaaaaccctggtatgcttttgctaccaatggaagatcggtaatat

SEQ ID NO: 32054 - DNA, 201 bp, Homo sapiens
acaatcccagccccaccccagtaccctggctccagagtttgcataaaatccttaatccagctgttcgtggtgtgtctagctttacagccagacggtggctkttggagggaagaagcagagtgttcttcatattcatgagcctctggcactgcttgagcctgtgtccattggatagggatgaagtctcaggttttgtcactt

SEQ ID NO: 32055 - DNA, 201 bp, Homo sapiens
aaaaccacaaagatggggaaaaaacagagcagaaaaactgaaaattctaaaaatcagagctcctctcctcctccaaaggaacacagctcctcaccagcaayggaacgaagctggacagagaatgactttgacgagttaagagaagaaggcttcagatgattaaactatgatgagctaaaggatgaagttcgaacccatggc

SEQ ID NO: 32056 - DNA, 201 bp, Homo sapiens
aaagtgctggctgaacttgagctgaaagagggcaaaagagaaggaaggaattgcgtttcaaggagctggatcccgcttctgattttctaaggttttgagtmtagaagagcaaagcagagcggtctaaaaaggtgcatactcaacccaccccaagggttgccccttttgcctgggctgaaacactcacaggatcacatttca

SEQ ID NO: 32057 - DNA, 201 bp, Homo sapiens
aggtagaaggatgtaaggatctaaagttttggggaggagtaaaggttgaaaatagatgtctgggagccatcagcttaggtgtgaggagagagcttacaackgggacacaacagggaaaaagggaggatgagaggacaagaggacaagcagaataaattagagtattaggacttcctgggagcctagactcatccactagag

SEQ ID NO: 32058 - DNA, 201 bp, Homo sapiens
gtgtgaggagagagcttacaactgggacacaacagggaaaaagggaggatgagaggacaagaggacaagcagaataaattagagtattaggacttcctggragcctagactcatccactagagagggtgggcatggagttgattgcgctgacatccagcatgtcagggaaagccctgggaattccactgtgtgtccactgt

SEQ ID NO: 32059 - DNA, 201 bp, Homo sapiens
gaggagagagcttacaactgggacacaacagggaaaaagggaggatgagaggacaagaggacaagcagaataaattagagtattaggacttcctgggagcstagactcatccactagagagggtgggcatggagttgattgcgctgacatccagcatgtcagggaaagccctgggaattccactgtgtgtccactgtgtgt

SEQ ID NO: 32060 - DNA, 201 bp, Homo sapiens
ggaattccactgtgtgtccactgtgtgtctgctatggtcatgggaggccctctagcttcctgcctggcctagagagtccactgaattccagtctgttgcastggcccatgaaccccagccccgccctgcccagctcatcctccttctagggctgaccctctccttctaactccttctaagttatattgaagagccctggtc

SEQ ID NO: 32061 - DNA, 201 bp, Homo sapiens
acaggaaatacggttgaatggcattttgttttttcaaactggatccatcagctctgcctgactcttttccctctgcaccggtttctagctgacattcggtrcttcttcctggcattacattgtttacggtagagttcaagttcctcgaagtacttagctctcaggagagccactctttgctcataagggtgcttctccagg

SEQ ID NO: 32062 - DNA, 201 bp, Homo sapiens
ggatgccttgagctgtgcctgggtgattgaggcccagccaggctaccccatcaaaatcaccttcgacaggtgcttgtgaccacagccttgggggagagggmaagggggagatttttacagagccacgtgggagggaatgcagggtggataggggaccagtaccaacgctgaaatgtcagcaaggttggagaacactggacc

SEQ ID NO: 32063 - DNA, 201 bp, Homo sapiens
ggcctcataatgaaatgttcattgtgtcactggtaatccaacccagaggtcagggccaacctgaagggtcgtatcccctttgggccctgggccaagctttwtctcctgcttgaagctatcttcttgtgtgctgctcttgccttttgaacccatcctttagagaccaaggcaggcaaccccattcctagggcactgcttatg

SEQ ID NO: 32064 - DNA, 201 bp, Homo sapiens
gccatgtcagactcccataggtgatggacaaccactgaaatatttcaccgttgaaggggagacatagaaatgtcacccagcagcctgaacagagaaagcaytggaaatgcagcactgggtagggagagctgttgcaatgcaactacctcaagggatggcctcataatgaaatgttcattgtgtcactggtaatccaaccca

SEQ ID NO: 32065 - DNA, 201 bp, Homo sapiens
gcgcttgataaatgtcagctaattaattaagtcactctcatcctaaccttacttgactgggattatttcaggggatggaaggaatatgtcaacttcatagytcacaatcccagccccaccccagtaccctggctccagagtttgcataaaatccttaatccagctgttcgtggtgtgtctagctttacagccagacggtgg

SEQ ID NO: 32066 - DNA, 201 bp, Homo sapiens
acttccagcctaggctgcccccagtcaggatggtttccttatattcgctattcatgatgttgttgtgtccgtttcaaaatggcatcagggccctgctcttsgtagctcctcttggctgacatccccaaatgtctgctatcaaagcgagtttgatcctcctccaccctcatccagaatgtgaaaagtatagataaggaactg

SEQ ID NO: 32067 - DNA, 201 bp, Homo sapiens
cacccacagtggatggacaaggatggaaggtgggaggcatgagtagggtcagccacagctgtgagcatacctacctgatatatgccctgggatgtctatcrttgagcttattcaacaggcaactgaatcgggttgaacctgtacctgactcactgggtgaccttgggcagatttttaagctctctgagcctcattgtgggg

SEQ ID NO: 32068 - DNA, 201 bp, Homo sapiens
ctgaaaattctaaaaatcagagctcctctcctcctccaaaggaacacagctcctcaccagcaatggaacgaagctggacagagaatgactttgacgagttragagaagaaggcttcagatgattaaactatgatgagctaaaggatgaagttcgaacccatggcaaagaagttaaaaaccttgaaaaaagattagacaaat

SEQ ID NO: 32069 - DNA, 201 bp, Homo sapiens
aattaatcaaatctgggggagggggtcctgggaatcttgctttacagccagttggtcagaagtaaaggtaaaacaaccagggtcttgtgattggcatctgyggtgggaggcagtcttgtgagactgagccctcaacctacgggacctgatgctaacttcaggtagataatcagagttgaattgcactggaggacatccagc

SEQ ID NO: 32070 - DNA, 201 bp, Homo sapiens
cccctttgaggcagggagtgagataactgtgattccctgtggagggcgtgaaggcagagccggctggctgctccacacagaccctccctggagcagccgtrgggtcccaggtcccagtgccaggttctgtgtcgctttgactcgggtgctgcgtgggtgtgcacacagtggcgtcacgggccacatgccgaggcgtgggca

SEQ ID NO: 32071 - DNA, 201 bp, Homo sapiens
gaattccagagaggcagcctggagattggcctgcgacccgccggtgaggagcacagggggcctgagggcggggtcggggctgtggggccagaggacggtgkcgtctccactcagcaccagcagccttggcaggcagccagagaggcaggaggagcggcctgtcccccaggggctgcatgggatggtaattgtgttaatccc

SEQ ID NO: 32072 - DNA, 201 bp, Homo sapiens
agctccccaggggccagccccgcctctgcgtctgggtctccatctgcggggagagatggaggctacataaattttgctttatcaggaagaagccagccttrgaggttactcatcactaattaatcacggcactaattaatttatccctgttgctggctgccagagaacagagcatttggcctggccttcccagggagggaa

SEQ ID NO: 32073 - DNA, 201 bp, Homo sapiens
ctggctgccagagaacagagcatttggcctggccttcccagggagggaaaagcctggcccagagccccacgccccccgcccacgtggctctgccctcccgmcagatgggctcacagggccacaccctctcaccccaagaccattcaccctccgagttgctgctgtcctcctcgccctcctcctcgtcctcttcatcgtctt

SEQ ID NO: 32074 - DNA, 201 bp, Homo sapiens
gtggccatgggagggtctgtctgtgctgtgtgtgtgtcctgcgcgcgtcgggagctgctgcgccacacacaggcacgcagggtgtgggcacacctgtgctkctgagcccacgtgcccttgccggtggccaggcacacacacagctgtgcatccttggcccaagatcagctgtgccacacctgcaggctgcaggatcttttc

SEQ ID NO: 32075 - DNA, 201 bp, Homo sapiens; identical to SEQ ID NO: 6262

SEQ ID NO: 32076 - DNA, 201 bp, Homo sapiens
ggagggtctgtctgtgctgtgtgtgtgtcctgcgcgcgtcgggagctgctgcgccacacacaggcacgcagggtgtgggcacacctgtgcttctgagcccrcgtgcccttgccggtggccaggcacacacacagctgtgcatccttggcccaagatcagctgtgccacacctgcaggctgcaggatcttttctgtatatct

SEQ ID NO: 32077 - DNA, 201 bp, Homo sapiens
ggggaagcggctttacctcgtgctctcccagcccttctacctggacgggggaggagtcctcgggcacccgagcgccctccccggtggagacaggggggccrcgcttgtcttagagcctccccttgggtgccttttagctgcttatcctcgagtcctgggtcagggtcttctccctgggaggagtaattcaacgtgggcctg

SEQ ID NO: 32078 - DNA, 201 bp, Homo sapiens; identical to SEQ ID NO: 6263

SEQ ID NO: 32079 - DNA, 201 bp, Homo sapiens
tccgacagtgcttccgtgagcatctcctccccaccccgtggccacagccaggagatgcccccccacctggggctcccaggtccctgccctgcgtgagggayggctcagatccaggcctgcctctgccagtccctcccaggcctgtcccacacccttcccctaggaagcaactccaggggccccttctttccagcccccatg

SEQ ID NO: 32080 - DNA, 201 bp, Homo sapiens
ctggcggcggctgcagatgtatgccgagttctcctgaaccttcccaagcagctgctgcacctgccggcagtagttggccaccttgcactcccggaggaacracttcagctgcggaagggaggggtcagccactgaagcccaggaccgctccatgtgcacagctggcccaggtcctgtgcaaaaccacgcgtggtggccacg

SEQ ID NO: 32081 - DNA, 201 bp, Homo sapiens
gttgaagggacccccgagctccagctgacacgcggaggcccgggcacagacaggcatcataccttcggccttggccgcactctgtggtcattggtgttggsggcagcccagggtcagggcagggtctcagcctcggaccccaggccccaccccttgcccagcagtgctgcgttttcccagtgagctgtcgtggagagagca

SEQ ID NO: 32082 - DNA, 201 bp, Homo sapiens
tgtttcagcctgtccctgggtccttctgcctctgcaggctcccacagaacacactgccaggccacctccatctgtgtgttcatttgctcccgtccagtggyctccacccatctgtccgtctgtccttccatccccttcgccctgtctggctggctctgcagtgaccacctgccttttggagccagcggagccccaggccgt

SEQ ID NO: 32083 - DNA, 201 bp, Homo sapiens
agaaaaaggaattaggcctggagctgacggcagggcttgtggggggacgggcttgggagccccactgcctaggcctcatggaggtcttgggtcacaggggrgtggcccctcactccacccagctagagccctcatgaggatgaggaagggccagagtcggaggcactggctggcctgggagacccccagggcgtggagtca

SEQ ID NO: 32084 - DNA, 201 bp, Homo sapiens
gggtccttctgcctctgcaggctcccacagaacacactgccaggccacctccatctgtgtgttcatttgctcccgtccagtggtctccacccatctgtccrtctgtccttccatccccttcgccctgtctggctggctctgcagtgaccacctgccttttggagccagcggagccccaggccgtcctcctctgcctcagga

SEQ ID NO: 32085 - DNA, 201 bp, Homo sapiens
actggctggcctgggagacccccagggcgtggagtcaggggcttcggaggagctcggggtgggtcggagatgggtacatggatggtgtggtctggaatggktgcggtcggcaggacccaagggaggacctcaggagagtgagctgggcctggcctgggcctcccctctgccacctgctgggctgtgtttggggctgaagct

SEQ ID NO: 32086 - DNA, 201 bp, Homo sapiens
tgattgagatattctgagccagcaggccctcccctgtgccttcacacagggagacctcctcaggtacacgcgtgtgcgtgtgccggcatgtctgtgtctgsggtcctgtggggtgcacgtgatgggggttgcccggcagctctcacccatggagtcaggacgtgttcgtgcacttccgggctcacaggctctacggggcct

SEQ ID NO: 32087 - DNA, 201 bp, Homo sapiens
gtctgcgagggttcagctcagacagttgccagtggccttgcaccaggctgcagctgcccctgagccgggctgtgcgtggcgctgatgaaatagaaaagggsattcgcttgtcaacgttggcatcagtggcagggtgtggtgggcagaagggtcacaaagtacgggtgggattggcaggcagatacacggagggaacgtgcg

SEQ ID NO: 32088 - DNA, 201 bp, Homo sapiens
gactgcccctgagcagatcggcctcttcccgggcgcccggtgggcccctcgaccccctttgaggcagggagtgagataactgtgattccctgtggagggcrtgaaggcagagccggctggctgctccacacagaccctccctggagcagccgtggggtcccaggtcccagtgccaggttctgtgtcgctttgactcgggtg

SEQ ID NO: 32089 - DNA, 201 bp, Homo sapiens
gttgccagtggccttgcaccaggctgcagctgcccctgagccgggctgtgcgtggcgctgatgaaatagaaaagggcattcgcttgtcaacgttggcatcrgtggcagggtgtggtgggcagaagggtcacaaagtacgggtgggattggcaggcagatacacggagggaacgtgcgcatttgagtgcacgtccaccagca

SEQ ID NO: 32090 - DNA, 201 bp, Homo sapiens; identical to SEQ ID NO: 6266

SEQ ID NO: 32091 - DNA, 201 bp, Homo sapiens
aagggccgtgtcaggctctctcggccccatgcctggtcaccctggcttcaccctggctgcaccctggtccccctggtccctttggccctgcacctggctgsaccctggtcaccctggtcctcaggcttcagcacgaggagacccaacccgaaacaagagataagcagctaggcacggtcccagccccatggccccacacag

SEQ ID NO: 32092 - DNA, 201 bp, Homo sapiens
tcaggctctctcggccccatgcctggtcaccctggcttcaccctggctgcaccctggtccccctggtccctttggccctgcacctggctgcaccctggtcmccctggtcctcaggcttcagcacgaggagacccaacccgaaacaagagataagcagctaggcacggtcccagccccatggccccacacagcctggcgtgt

SEQ ID NO: 32093 - DNA, 201 bp, Homo sapiens; identical to SEQ ID NO: 6259

SEQ ID NO: 32094 - DNA, 201 bp, Homo sapiens
gcccacggggtcagcttttcccggtctcgttctgcagccaggacggcaaccttcccaccctcatatccagcgtccaccgcagccgccacctcgttatgccsgagcatcagagccgctgtgaattccagagaggcagcctggagattggcctgcgacccgccggtgaggagcacagggggcctgagggcggggtcggggctg

SEQ ID NO: 32095 - DNA, 201 bp, Homo sapiens
ctcaataaatggttgattgattgatgaggggatggatgagaagggctctaagagaaatgctggggagcctgggcaggcactcccggatggcggaggcggcrtgcgggctggggcagcggcccctggcgcccccacactcccccaggacgtctggggtcaccgtctgctccatggcagccccagggttatttatgacctcct

SEQ ID NO: 32096 - DNA, 201 bp, Homo sapiens
aacgcacgcactcccgcagcgcacgcatgactggtcccgcctcctagggctcctggacggaaggggtccccggtcccgcctcctagggctcctggacggarggggtccccggtcccgcctcctagggctcctggacggaaggggtccccgtcccgcctcctagggctcctggacggaaggggtccccggtcccgcctccta

SEQ ID NO: 32097 - DNA, 201 bp, Homo sapiens
aaaaatgaggctgtcacctcccccttcccaccctcctagagacccacaaggaggtgagaatgctgatgtgtgagtggggccctgaagggtgtgtaggagcyctaaggcgaggggatgtctgcagagtggaggaacagggaagggcgtgtaggagggacgaggagtgaacctggcagctctggttcagttggatgctgaaga

SEQ ID NO: 32098 - DNA, 201 bp, Homo sapiens
gaaatcgggggtcaggggatggttcacatgtggcacattctctcctggggcctgtcctgcaggactgcccctgagcagatcggcctcttcccgggcgcccrgtgggcccctcgaccccctttgaggcagggagtgagataactgtgattccctgtggagggcgtgaaggcagagccggctggctgctccacacagaccctc

SEQ ID NO: 32099 - DNA, 201 bp, Homo sapiens
tgtcctcatccttcctgtcagccatcttccttcgtttgatctcagggaagttcaggtcttccagctggaaggccaaagaaccaggggctcaggtgagagarggcaggggctggcggccacagcagggccaggcatcgccagacccaccaccagggccccatgtggccaatttctagtcccctctgttcccaaatcacaaag

SEQ ID NO: 32100 - DNA, 201 bp, Homo sapiens; identical to SEQ ID NO: 6260

SEQ ID NO: 32101 - DNA, 201 bp, Homo sapiens; identical to SEQ ID NO: 6265

SEQ ID NO: 32102 - DNA, 201 bp, Homo sapiens; identical to SEQ ID NO: 6267

SEQ ID NO: 32103 - DNA, 201 bp, Homo sapiens
ccaccctcctagagacccacaaggaggtgagaatgctgatgtgtgagtggggccctgaagggtgtgtaggagctctaaggcgaggggatgtctgcagagtrgaggaacagggaagggcgtgtaggagggacgaggagtgaacctggcagctctggttcagttggatgctgaagagtcatggatgctgggcctgtgggcacc

SEQ ID NO: 32104 - DNA, 201 bp, Homo sapiens
cctcatggtcacagatgctccggggcagaatatgagtgtgtatgtgccttggggaccctgcacaggggccctgcaggccaagcaccttccaagaggaggtmctgtcaggggccgagttttcagatctgtgtgctgtggccgaggtctctagtgtggaggaggtgtgttctgtccttgggcagggtgggtggcagggaagct

SEQ ID NO: 32105 - DNA, 201 bp, Homo sapiens
catctttaaacttatttctacctcattttggggttgccagctcacctgatcatttttatgaactgtcatgaacactgatgacattttatgagccttttacwtgggacactacagaatacatttgtcagcgaggcctgtagggaaacccagccgcggtccccccgaccccgctccagtaacggctcctcctgcctgcagccc

SEQ ID NO: 32106 - DNA, 201 bp, Homo sapiens
tgctcctcgagccattgtttgcaggcgggggcttggcccctctctcctgggcccctgagctggtgggaaaatgggcaagggctaggccgtgtggtcatcamtgaggggcggtggcgggaggcccatgcgtgggcagctggggtcacacctgccaggctctggcctccccctccccttctccttcctgcgcctcctgcccca

SEQ ID NO: 32107 - DNA, 201 bp, Homo sapiens
tcgtgtgcagaaatcgggggtcaggggatggttcacatgtggcacattctctcctggggcctgtcctgcaggactgcccctgagcagatcggcctcttccygggcgcccggtgggcccctcgaccccctttgaggcagggagtgagataactgtgattccctgtggagggcgtgaaggcagagccggctggctgctccaca

SEQ ID NO: 32108 - DNA, 201 bp, Homo sapiens
gcagggaccacagcgggcgtgtctgtgctcccacccgaggcacccacagctccacacgctcgttccgtgggtgcaaaggagatgggagaaagaagccctgwgagaaatgcggggcagggtttgcggaacggaggacctgggctggtgagggctcctcgtctggtgacctgtgagccccggggcctgcagtctgcgagggtt

SEQ ID NO: 32109 - DNA, 201 bp, Homo sapiens
cccacccgaggcacccacagctccacacgctcgttccgtgggtgcaaaggagatgggagaaagaagccctgagagaaatgcggggcagggtttgcggaacrgaggacctgggctggtgagggctcctcgtctggtgacctgtgagccccggggcctgcagtctgcgagggttcagctcagacagttgccagtggccttgca

SEQ ID NO: 32110 - DNA, 201 bp, Homo sapiens
cacccgaggcacccacagctccacacgctcgttccgtgggtgcaaaggagatgggagaaagaagccctgagagaaatgcggggcagggtttgcggaacggrggacctgggctggtgagggctcctcgtctggtgacctgtgagccccggggcctgcagtctgcgagggttcagctcagacagttgccagtggccttgcacc

SEQ ID NO: 32111 - DNA, 201 bp, Homo sapiens; identical to SEQ ID NO: 6261

SEQ ID NO: 32112 - DNA, 201 bp, Homo sapiens
ccccaggtcccctcgccgagccgcacccgctctttgccactgatctccagctggatctcccggtcacgcagcttgcgccagtggctgtagtacaaggtcargggtgtcccctcttcccgggtcagcttctcccaggcttcctggggggttgggggagttcagggtcatgcctcaccctgggcaaacccccacatgtagctg

SEQ ID NO: 32113 - DNA, 201 bp, Homo sapiens
gggcgcccggtgggcccctcgaccccctttgaggcagggagtgagataactgtgattccctgtggagggcgtgaaggcagagccggctggctgctccacayagaccctccctggagcagccgtggggtcccaggtcccagtgccaggttctgtgtcgctttgactcgggtgctgcgtgggtgtgcacacagtggcgtcacg

SEQ ID NO: 32114 - DNA, 201 bp, Homo sapiens
ggaccgtagtcacagccccctgttttcgggtgtgaaaaggggctggattctctttgcatgtctgctgacaagtggtcacagaggcccttctgatgctctgygggggatcaggtgcccctggctggttcacagcctaagccccttgctggctggctgccctcagtcccctacccaactgtctgagccactcatcttcttctc

SEQ ID NO: 32115 - DNA, 201 bp, Homo sapiens
cagaaggggtaactgaggctccagaggcatgaaaatgtcctaagtaatgggctgagggcagtaagcagtggggctgggattcagtcccatgttggtctgayctccaaacctacactcttaactttgtgccatgctatcccccccagtcccttgggtgtggccccccagataccatcttctgggagtggacgtggcctcagg

SEQ ID NO: 32116 - DNA, 201 bp, Homo sapiens
tctctgggtagtaatgataataggactagtaataagagcagtagtaagagcagtggtaataatggctcctgttacccaagtactaactgtgggccaggcayggggccttgcacttagcaagcattattccatgtgatgcttataagatcctagcagttatcactcccattttacagaaggggtaactgaggctccagaggc

SEQ ID NO: 32117 - DNA, 201 bp, Homo sapiens
ggatataagccagtccagagcatcgaagagtgttttgagattagcatgaatctcatagcgttgctttgtacaacagaggtgtctagggttcttgttttttyatagttattgatttccaaagtacctggcaggtactccgctgctagtgtaatccatctgtgaaagagagtatatgacacgcgtaacactgccttcctgcct

SEQ ID NO: 32118 - DNA, 201 bp, Homo sapiens
cacctgagaagactcaacccagagacctcagggccaggaaggggaggcctgtgttctagtccagagctgctgctcccattgtgggaccctcagcaaacccsttttgctgggggcccgtggggactctgtcctcctaccggaaacccaggtgatgtctagggagacacagggcctgtggagtacctgctgggtactcaatgt

SEQ ID NO: 32119 - DNA, 201 bp, Homo sapiens
caggacaccgggaggttaagaagggagggcaggtggggagacccaacctagtggaaaggaagaggttgtcagccagccctgttggttctgggtcttccaaygtggccctatgtagggggacagggcaaacccagctgtggccatatgtgacaagccatatatcagagctggcaagaggccacctgagaagactcaacccag

SEQ ID NO: 32120 - DNA, 201 bp, Homo sapiens
agccagctcctggggaagggagggaactcggactagggctcagggatacggtgatgactttgtgtcctgaaagtctacccagttgttgtcaaccatgcgtwggcattaaccgtcctctgggttttggggagtgttgagccaggggtatgggtgggacccccaacctccttcccctcagcactcatcatattctgcaatttt

SEQ ID NO: 32121 - DNA, 201 bp, Homo sapiens
taatggctgagacccctgtttgtcatgctctgcgctgagcactatgcagcctttaaccctgggagcctggggaaatcagtgtcaccatcccgggtacagasagccagaactgaggctcaaagtgtacctagttgtccaccattgccaagaggcagaacccaaatttgaacctggacctcggtagccagctcctggggaagg

SEQ ID NO: 32122 - DNA, 201 bp, Homo sapiens
agtggcctgctttgtggtatctcagtggccatccccgcccgcagctatgtagggctggagtcagactctggctgtgaactcagaggggctcctggctccargattcctccgcttcttgtccagcgtgctcctctcccctgggacctgtagcatcgctggtcaccagaccagccagacaccaagccagtgaccctcactctg

SEQ ID NO: 32123 - DNA, 201 bp, Homo sapiens
cagatgaggcagggacagtcacatgtcccaggtccactccagaggagggggcagcgtctttgctcttgggggtgactctcgtgcctgagcccaggcctctrtcccgtgtccctgcaggaggccgggtcctgcagatccccctggtgcgggcagagaacgccgggaggtactcgtgcaaggcctccaacgaggtgggcgagg

SEQ ID NO: 32124 - DNA, 201 bp, Homo sapiens
ggcaactgaggggctttgaggcttctgcaagcttctcccttctctgcctggcagggcacactgcttatagttctagaaggaattaaggggaaaacatctcycattgtgcgcctgagttctggtttcagacataaattcccatcccctctgccttctctctggccctgtggaacacaagtctagcatccctcattcattctg

SEQ ID NO: 32125 - DNA, 201 bp, Homo sapiens
ctggttctatttacatttgtgaataaaacatagaatgggaactcctaactaccaggaagggcttcttaggcctccctgatctgcctgaggggaaggaaatyggggaagagtctcagaattctgacagtctggctttcttcctgcagtgcccccaacatttgagaaccccaagacagagacagtgagccaggtggctgggag

SEQ ID NO: 32126 - DNA, 201 bp, Homo sapiens
tttgtggtatctcagtggccatccccgcccgcagctatgtagggctggagtcagactctggctgtgaactcagaggggctcctggctccaggattcctccrcttcttgtccagcgtgctcctctcccctgggacctgtagcatcgctggtcaccagaccagccagacaccaagccagtgaccctcactctgcccagcatag

SEQ ID NO: 32127 - DNA, 201 bp, Homo sapiens
gtcaaccatgcgttggcattaaccgtcctctgggttttggggagtgttgagccaggggtatgggtgggacccccaacctccttcccctcagcactcatcakattctgcaattttatgatgagaccctctccagatgggttcagtggacacacctagaggggtcagaggcattggacccggccacccagggagcctgggggt

SEQ ID NO: 32128 - DNA, 201 bp, Homo sapiens
aaccctgggagcctggggaaatcagtgtcaccatcccgggtacagacagccagaactgaggctcaaagtgtacctagttgtccaccattgccaagaggcaraacccaaatttgaacctggacctcggtagccagctcctggggaagggagggaactcggactagggctcagggatacggtgatgactttgtgtcctgaaag

SEQ ID NO: 32129 - DNA, 201 bp, Homo sapiens
ctctctgggctggatgctccatgagaaccttcaagggtcaggggcatcctgacctatgccgaggtggggcagttctccggccaacccctttctttgctcamagggccaggacgcaggcacctatacctgtaccgctgagaacgccgtgggccgggcccgccgccgcgtgcacctcaccatcctggtactgcctgtgttcac

SEQ ID NO: 32130 - DNA, 201 bp, Homo sapiens
gctcttgtcacatctggtttgctacagagaaccacccaacaccaacctcacacgcccgctcctgagcgccacacaaggccctggatggaggaggttccagrtctccatgagctgcctggtgcctgcttccctggcatgggatgggagggattcctcgcagtcattcctgggggtggtggtgtccaaggggtctcaggtatc

SEQ ID NO: 32131 - DNA, 201 bp, Homo sapiens
aggacagtgccggctcccagcctccagcatgcccacctctgcttactgccccctgccccaataatcactgtcctggattctgcctctttaaaaaaaaaaamaacaaactttattgagttataatttgcataccataaaattcacccgttcatgcaatgcaatattatttaaccttaaaaaggaaggaaattctagggctgg

SEQ ID NO: 32132 - DNA, 201 bp, Homo sapiens
tcaggttcccatacagtcacatcccccagactgtttgtaaatgggcaaaggaggcaggttgagtgaccagagacagagtggggttgtgtaggagccctgcyacctccatccctggggacctctgtcctgatcccctcaccctgattcccaccaacaggcgccctggagatcgggcaggccctccccatccacgcaggccgc

SEQ ID NO: 32133 - DNA, 201 bp, Homo sapiens
tcccctatgacctactcatccaccaggagtagcacaggagccctcggtgacaacgtgtcttagtttgcacaacctcaggatgggtggggctggatgggggkaatgagcagccccaggcaccaaaagagaactgcagcttttggtagatccaacctcaggaaaccaggaaggatataagccagtccagagcatcgaagagtg

SEQ ID NO: 32134 - DNA, 201 bp, Homo sapiens
atgacctactcatccaccaggagtagcacaggagccctcggtgacaacgtgtcttagtttgcacaacctcaggatgggtggggctggatggggggaatgarcagccccaggcaccaaaagagaactgcagcttttggtagatccaacctcaggaaaccaggaaggatataagccagtccagagcatcgaagagtgttttga

SEQ ID NO: 32135 - DNA, 201 bp, Homo sapiens
aactgcagcttttggtagatccaacctcaggaaaccaggaaggatataagccagtccagagcatcgaagagtgttttgagattagcatgaatctcatagcrttgctttgtacaacagaggtgtctagggttcttgtttttttatagttattgatttccaaagtacctggcaggtactccgctgctagtgtaatccatctgt

SEQ ID NO: 32136 - DNA, 201 bp, Homo sapiens
ctcgatgtcaccccatgcagaggctcctgtcctacaaggggaggctttctcctacctggtggaacctgtaggaggcagcattcagctagactgtgtggtgygtggagacccagtgccggacatccactggatcaaagatggccttccactgcggggcagccacctccggcaccagctgcagaatggctcgctgaccatcca

SEQ ID NO: 32137 - DNA, 201 bp, Homo sapiens
gcaccagctgcagaatggctcgctgaccatccacaggactgaggcaaggcggggcctggcaccttgggtggggccactgaggacaactctacgctttttcwgattgttcaagagggttcttcctattgccccctctgcttctgcagtgtacaaagcacctccctgcccattcctcagatatcctcccactaccaccaatat

SEQ ID NO: 32138 - DNA, 201 bp, Homo sapiens
tccacaggactgaggcaaggcggggcctggcaccttgggtggggccactgaggacaactctacgctttttctgattgttcaagagggttcttcctattgcmccctctgcttctgcagtgtacaaagcacctccctgcccattcctcagatatcctcccactaccaccaatattgacctccagccaactgggcttttccatt

SEQ ID NO: 32139 - DNA, 201 bp, Homo sapiens
gccatgctatcccccccagtcccttgggtgtggccccccagataccatcttctgggagtggacgtggcctcaggctgccccaggcccatctgatggtggcrctgccactcagaagtgatgtgagccagcgcgccacctgagttccatcacatatccatgggtcacctgttagggaaacgctgcaaacgatctcccttctgg

SEQ ID NO: 32140 - DNA, 201 bp, Homo sapiens
ggaagtgtgctcggggacagcggtggcgtgtgcagcctagagggcagacggcagggctgggacttggaattctttcattaatacttacttggaacacacaytgaatcctaccaaatgtttcccaaatgtggggtgactgagactcaggactgagctaaagaaaacctggcaacctgggcctgggggagctgggcatttaaa

SEQ ID NO: 32141 - DNA, 201 bp, Homo sapiens
gagactcaggactgagctaaagaaaacctggcaacctgggcctgggggagctgggcatttaaaactcagaccagccgtcaagatcaccgcgacagctctckcatgtgccaagcagctcgtagtttaccaggcgctgtttgagcctcagaataacactgtgaagttgtctcaatagggattctgtagaaaatgttttattga

SEQ ID NO: 32142 - DNA, 201 bp, Homo sapiens
cgcagtcattcctgggggtggtggtgtccaaggggtctcaggtatctcccaggcatggctccctgcacccacaggtttccacggcagaggtggccgacgcygccagctacatgtgtgtggccgagaaccaggcgggctccgctgagaagctcttcaccctcagggttcaaggtgagctgggctgagcaggcagcccctgtg

SEQ ID NO: 32143 - DNA, 201 bp, Homo sapiens
cctccccaacccttctcctgtcaccatggcctgagatgccatccgagcactcggtggctgaggtgggaggtcgggagggggcagctgagctgggctcaggstcaggcttcttggctccttctgtcccttggtcattctgtgaccccagcaagtcatttgctgcctgtgagacagaatagcccaatctgcccacctcggggg

SEQ ID NO: 32144 - DNA, 201 bp, Homo sapiens
aaagaaaaaaaactatagccccgtgcccagaaggatgtgctgagtgggcaaatgtgacttctccctctgttgccacctccctccttggccctttgtcactratgtcaccttgtgtactagctttaccccctggccctgtggccgtgagtgccctgtgcccgccggcagggcctcaagccttgtcttgggttttagtgcctc

SEQ ID NO: 32145 - DNA, 201 bp, Homo sapiens
tccagcctgggcaacatactgagaccccatctctgaaaaaatacacttttttttttaaagaaaaaaaactatagccccgtgcccagaaggatgtgctgagygggcaaatgtgacttctccctctgttgccacctccctccttggccctttgtcactgatgtcaccttgtgtactagctttaccccctggccctgtggccgt

SEQ ID NO: 32146 - DNA, 201 bp, Homo sapiens
gcagggatttaggactgggggctgggctggaatgctggtgtgaggggctggcttcccccggcaggcacccacacgctgcagctggggagagcacggctgtsggactccgggatgtacacatgcgaagccctcaatgctgccggccgagaccagaagctggtgcagctcagtgttctgggtatgtccatgtctgtccccaac

SEQ ID NO: 32147 - DNA, 201 bp, Homo sapiens
catggggcagggacggggcggggtgtgctcaggtctcaccggagtcaggaccagaacttgtgtctcaactttggggatcagagagtcttcacactgagatmggggtgagggcactggggatatacagctaaacagagacatctgggctttatttatatccaccagagtcactcttgtctaaaaacaaaacatgaactgggt

SEQ ID NO: 32148 - DNA, 201 bp, Homo sapiens
gctgagatgggaggatcccctgagcctgggaggttgaggctgcagtgagctgtgattgtgccactgcactccagcctgggcaacagaacgagactgtctcaaaaaaaaaaaaaaaaaaaagaatgtccatttttaaaaattggaaaaccaatgtacagagaaacagggatgaaaacgaaaatcactcaaaaatccaccagc

SEQ ID NO: 32149 - DNA, 201 bp, Homo sapiens
tcctgcctcagcctcctgagtagctgggattataggcgcacgccaccacacccggctaatttttgtatttttagtagaaacggggtttcaccatgttggcyaggctgctcttgaacttctgacctcaggtgatccacctgccttggccccccaaagtgctgggattacaggagtgagccactgcacccagggcttgtgctc

SEQ ID NO: 32150 - DNA, 201 bp, Homo sapiens
cacaaggacaggcccaccactcatgaaggtctcttgcttgtttaacttgatcagaagccttgatagatggggcggggtagaggggcatgaatggatctcaygagatctgatggttttaaagcttctctcagcttctctctgtgtaggcttcatctctttctctctcttaccttcttccttggtgaacatgggagaaacaca

SEQ ID NO: 32151 - DNA, 201 bp, Homo sapiens
caggctggtctcgaactcctggcctcaagcaatccacctgcctcggcctcctaaagtgcggattacaggcaggagccactgggccctacattttcttataygatttttgtagttttagttctcacatttaggtcagtgatccattttgagttaatctttgtgtggggtaagggtctaacttccttttttgcatacggatag

SEQ ID NO: 32152 - DNA, 201 bp, Homo sapiens
ccgctccatccccaggttagggatgctgggctgtacacttgtctggctgaaagccctgcaggtgcaattgagaagagcttccgggtcagggttcaaggtargtggtgggggtggggtgggggcagggccgggaggcaggacgggctcgcggcaggggtgagtccccctctcatatcctcttgtgccacccccttcccagcc

SEQ ID NO: 32153 - DNA, 201 bp, Homo sapiens
cacctgcctcggcctcctaaagtgcggattacaggcaggagccactgggccctacattttcttatacgatttttgtagttttagttctcacatttaggtcwgtgatccattttgagttaatctttgtgtggggtaagggtctaacttccttttttgcatacggatagccaattgttccagtaccatttatgttgatcttga

SEQ ID NO: 32154 - DNA, 201 bp, Homo sapiens
agccctcccccacccttcctgtcccccaagttccccggctccatcaggggctcacagggcttgtcagcactgggtccccttgtttcatggcccccaccccygatacattgtgaactccttgaggacagggactgagctgccctcatcttgattcccaggctctgcgctggacatggggcagttgctcgtgtctttgtgttg

SEQ ID NO: 32155 - DNA, 201 bp, Homo sapiens
acattttcttatacgatttttgtagttttagttctcacatttaggtcagtgatccattttgagttaatctttgtgtggggtaagggtctaacttccttttytgcatacggatagccaattgttccagtaccatttatgttgatcttgaatttctttcagtgatgttttgtagttttgaatgtactggtcttatatttttgt

SEQ ID NO: 32156 - DNA, 201 bp, Homo sapiens
tttgtcccttatatcctgggccgcatacttgagaagccaacaacctggaaccaccagtgggctcagacacacgcatgtgcacatgcgcacacacacgcacrcacacacacgggggcatgtgcacctcaacaagagcctgtcctctcttgcaaaggactaggaaagggacagcatagtaagaaagaaaacttgtaaataaca

SEQ ID NO: 32157 - DNA, 201 bp, Homo sapiens
ggaaagcccactggctgacactgggctcagcattggcccccagagctgctccttggtggtgactcagctcggtcctagctgggccgttggtcaaccccatsccccatccaggcctccccattctggccgctgctgtgcccaccgttcctccgcatgacggcagaagccccacatggtctcctgggcccactgtgcctctca

SEQ ID NO: 32158 - DNA, 201 bp, Homo sapiens
gcctcccaaagtgctagggttacaggcatgaaccaccatacccagctgcaagtattgttataaaagagagccggggccggacatggtcgctcatgactatmatcctagcactttgggaggccgaggagagtggatcaccagaggtcgggagtttgagaccagcatgatcaatatggcaaaaccccgtctctaccaaaaata

SEQ ID NO: 32159 - DNA, 201 bp, Homo sapiens
cgggaggcagaggttgcagtgagctgagatcgtaccactgcactccagcctaggtaacagagtgagactccgtctcaaaaaaaaaaaaaaaaaaaaaaaaygagagagacagagagctggggtggtgtggcaggggagagagagagagaagagaaggtaaagtggagacagaggcagaggatggattgttgcagcctcagg

SEQ ID NO: 32160 - DNA, 201 bp, Homo sapiens
aagttcagcggttctctgaccccccagccagagatgcagtctcagagttagccttgggtctaagcagacccccatgtatttcagggcttcgtcccacttcttttttttttttttttttttttttgagacggagtctctcactcttgttgcccaggctggagtgcagtggtgcaatctcggttcactgcaagctctgctccc

SEQ ID NO: 32161 - DNA, 201 bp, Homo sapiens
tcatcctggcggagcaggagagagtgttgggatcgattagtgatgtctgccctggcacaggttaaggactgtgggtgagtgagcctcccatttaccatccktgggctaaggagaccccgctggagctttgctttgtatgctttaaaatagccaggcactggttctatttacatttgtgaataaaacatagaatgggaactc

SEQ ID NO: 32162 - DNA, 201 bp, Homo sapiens
gtttgattagcgctaaagagcatctgctcacagatggcctggcgggcagcggctaggaaaccagcccacccggccaggccagctgcagggcagccagggcyagcagcactgatggaatggggctgttcaggtgatggcacccggctctggctcggtgccctggctccttcagtgtgccagccacgccatcgtgggctcccg

SEQ ID NO: 32163 - DNA, 201 bp, Homo sapiens
ctgggcctcccacaggtgctccggtgttccaggtggagccccaggacatgacagtgagatctggggatgacgtggccctgcggtgccaggccactggagarcccacacccaccattgaatggctacaggcgggtcaacccttgcgggccagccggcggctccggaccctgcccgatgggagcctgtggctggagaacgtgg

SEQ ID NO: 32164 - DNA, 201 bp, Homo sapiens
ttgcccatttcattggcatcaactagaggcagttctgacagatggccccccacttcattggaagcagtctaactgtcctataggagaggcttcatttagcyaatcccaatacagtcaggcaatagaagactacctagccactaacaacagatatgtaactgcatggaaaggtagttacgatctattgcagaggaaaaataa

SEQ ID NO: 32165 - DNA, 201 bp, Homo sapiens
ccagccctaaagcaacagtgagatggagggagagggcgtgggttggctgggaggtggatggcagacctcgcagggctgagtttgaatcctgggtccctcgwtgcatgagaaagaaaccagattgggaggcgggcagagaggggccaggggcagctgctcaacccgctccatccccaggttagggatgctgggctgtacact

SEQ ID NO: 32166 - DNA, 201 bp, Homo sapiens
acaggaagcatcatccccatatttcagatgggaacactgagggtcagggagtgacttggtgagagccacccacagtaggtgacagagcacgagtttgcccwtttcattggcatcaactagaggcagttctgacagatggccccccacttcattggaagcagtctaactgtcctataggagaggcttcatttagccaatccc

SEQ ID NO: 32167 - DNA, 201 bp, Homo sapiens
agcctcaccagcactgggcctttcccatcctttccatactagccttccaggagggtctataatagtaagtggacaggaagcatcatccccatatttcagaygggaacactgagggtcagggagtgacttggtgagagccacccacagtaggtgacagagcacgagtttgcccatttcattggcatcaactagaggcagttc

SEQ ID NO: 32168 - DNA, 201 bp, Homo sapiens
gggacagctgcagcacctcactctgctatctcctgcccccagttcccccggccttcaggcaggctcccagaggtccccaggatgcggtcctggtgagggtyggggacaaagctgtcctgagctgcgagacagatgcgctccctgagccaactgtgacctggtacaaggatgggcagcccctggtcctggcacagcggaccc

SEQ ID NO: 32169 - DNA, 201 bp, Homo sapiens
caagcaaacctcctgcctcagcctcccaaagtgctgacattacaggcgtgagccactgcacccagctaatttctagaatttaaaaaactaaggttagcagrctccaaatagaactctgccagtgacctgcttcatggagcttagtagagtgactttgtccctcagagcctaaggtttaccttcagtgaatgagtctaaaag

SEQ ID NO: 32170 - DNA, 201 bp, Homo sapiens
gaggagccccagggcatctggagggtgatgcgtgggcctgggcacgggagataaggcgacatgtgagcaaagcccacactgtgtcctgggccacgggtctyacttccctgggcctccatggcccatcctcaaactagaggacaatagtgccagcccagggtatagcggagattcgggaggtgagaagagagtcagggagtg

SEQ ID NO: 32171 - DNA, 201 bp, Homo sapiens
ctggctgcaacacccactccccaccccacagcgagtgtggactgcgccccagatgctaatgctaggatgggtctcagggacccagggaaggggaggtggtsggggtaggaggagatgcaggagaagtcaggtttcagggaaggagagaccaactgggccacaggagacgaggcctgaggacggactgttggctttggtgct

SEQ ID NO: 32172 - DNA, 201 bp, Homo sapiens
cccaccaccttgtccagctaatttttgtaattttagttgagacagggtttcaccatgttggcccggctggtctcaaactcctgacttaaggtgatccaccygcctcggcctcccaaagtgttgggcttacaggcgtgagtcactgcgcctggcctcgaccttcatttaagtggaatcaccccacacgtgctcttgcgtaga

SEQ ID NO: 32173 - DNA, 201 bp, Homo sapiens
tccacgtcctcagtcagctcccatgagacagcagacgtgggctctccattgcgcagggcaggtgctgagggccatggaaagcccactggctgacactgggytcagcattggcccccagagctgctccttggtggtgactcagctcggtcctagctgggccgttggtcaaccccatcccccatccaggcctccccattctgg

SEQ ID NO: 32174 - DNA, 201 bp, Homo sapiens
ctgtgatggtcacggtggggtagggatgggcacagccccaggcaggaaggccaaaggcttccactgttcttatccaaagttctagaggctttatttatttwtttttttttttggagacagagtctcactctgtcacccaggctggagtgcagtggcgcgatctcggctcactgcaacctccacctcccaggttcaagagat

SEQ ID NO: 32175 - DNA, 201 bp, Homo sapiens
tgaggggctggcttcccccggcaggcacccacacgctgcagctggggagagcacggctgtcggactccgggatgtacacatgcgaagccctcaatgctgcyggccgagaccagaagctggtgcagctcagtgttctgggtatgtccatgtctgtccccaacttgtactgtccccactccttcagtcacccctcagcccata

SEQ ID NO: 32176 - DNA, 201 bp, Homo sapiens
gaggcagcacgctgcagcgggccgctgtctccagagaagacagcgggacctatgtctgctgggcggagaacagagtgggccgcacgcaggcggtcagcttygtccacgtgaagggtagggcacattccccaggtggcttctctctcaagacctccagtctattgggacccaatctattggtttcctaagaacccagcctcc

SEQ ID NO: 32177 - DNA, 201 bp, Homo sapiens
atccaaacataaagagcgtctcctgtgagggtttggaagctcctttgcatccacgtcctcagtcagctcccatgagacagcagacgtgggctctccattgygcagggcaggtgctgagggccatggaaagcccactggctgacactgggctcagcattggcccccagagctgctccttggtggtgactcagctcggtccta

SEQ ID NO: 32178 - DNA, 201 bp, Homo sapiens
accactgtgatggtcacggtggggtagggatgggcacagccccaggcaggaaggccaaaggcttccactgttcttatccaaagttctagaggctttatttwtttatttttttttttggagacagagtctcactctgtcacccaggctggagtgcagtggcgcgatctcggctcactgcaacctccacctcccaggttcaag

SEQ ID NO: 32179 - DNA, 201 bp, Homo sapiens
caccatttgtgtttgagtgaagcgttgtttattggcccttggaatccaaacataaagagcgtctcctgtgagggtttggaagctcctttgcatccacgtcmtcagtcagctcccatgagacagcagacgtgggctctccattgcgcagggcaggtgctgagggccatggaaagcccactggctgacactgggctcagcatt

SEQ ID NO: 32180 - DNA, 201 bp, Homo sapiens
caaggctctcatgttgatcagcagtaggatcacacttgtgattagccactgcattccagcctgggcaacatactgagaccccatctctgaaaaaatacacttttttttttaaagaaaaaaaactatagccccgtgcccagaaggatgtgctgagtgggcaaatgtgacttctccctctgttgccacctccctccttggccc

SEQ ID NO: 32181 - DNA, 201 bp, Homo sapiens
cggacgaaggaagttattggttgttgatgatcttggcaaaaccagagactggcagtgccgtgttgccccccccccaccatttgtgtttgagtgaagcgttrtttattggcccttggaatccaaacataaagagcgtctcctgtgagggtttggaagctcctttgcatccacgtcctcagtcagctcccatgagacagcaga

SEQ ID NO: 32182 - DNA, 201 bp, Homo sapiens
aaaataaaaaataaagtaacaagaaagggactgacaccaggcttgctgctcaaagctcccagccctttctgatggctacattgatgaacagtggaaagggsgaatatctggtccctgagggcaaaggcatttcatcttgagcctggttgactctgttccgctggtggtgtctgcctggggtgtgtgacttcatcctggcgg

SEQ ID NO: 32183 - DNA, 201 bp, Homo sapiens
aggcagctggctgcaggggacactgggaaatgtagtttctgctagagtgatcgtgggctcagctaaaactctgctatgcacagtgggaagaacgggctgakgggacaccagccatctgccacagatgccaaagccagtagcctcccaaccaggtgagcggtgggcacatgcaaccctgagccatacacaacacaatcgttg

SEQ ID NO: 32184 - DNA, 201 bp, Homo sapiens
catgcggtagttaagggacccgggttccttccctcctgttgatcttccatttcttagggtgttgttcttgtgcatatggttgaaactgggacacggcatcrtgtcctggcccacaggaagcagaaaagagcagaagtggtgggcaagcatttatttcatacagaagttgcacctgtcccttctgcgtgtattccattagtg

SEQ ID NO: 32185 - DNA, 201 bp, Homo sapiens
tagtagagacgaggtttcgtcgtgttgcccaggctggtctcgaactcctggcctcaagcaatccacctgcctcggcctcctaaagtgcggattacaggcakgagccactgggccctacattttcttatacgatttttgtagttttagttctcacatttaggtcagtgatccattttgagttaatctttgtgtggggtaagg

SEQ ID NO: 32186 - DNA, 201 bp, Homo sapiens
cagaggtgggtgtctaggctggtgggtagctcggctccatgcggtagttaagggacccgggttccttccctcctgttgatcttccatttcttagggtgttrttcttgtgcatatggttgaaactgggacacggcatcgtgtcctggcccacaggaagcagaaaagagcagaagtggtgggcaagcatttatttcatacaga

SEQ ID NO: 32187 - DNA, 201 bp, Homo sapiens
tcaagcaatccttgtgcctcagcctcccaagtagctgggattacaggcacgcaccaccacacccgactaatttttgtaattttagtagagacgaggtttcrtcgtgttgcccaggctggtctcgaactcctggcctcaagcaatccacctgcctcggcctcctaaagtgcggattacaggcaggagccactgggccctaca

SEQ ID NO: 32188 - DNA, 201 bp, Homo sapiens
ctttcaggtatcggataaaggtttatacagctgtaaagtcagcaacgtggctggggaggccgtgcggaccttcaccctcaccgtccagggtaagccagggrccagcctagccaacgtgactgtggagcccctagcaacacccagggctgccaaggaggacaaagacaatagctgggcagaggcagtgctgccaagtgctga

SEQ ID NO: 32189 - DNA, 201 bp, Homo sapiens
tccattcctggccaggctccatccccacagcaagggggacctcttcctgccagcttggcccagggagggaggtccccagagcctgtgtattcactgttgargggcccttctgcttcttgaggctcttggaaaaggccagagcgtcctgattccctttggctccccagtcaggaccagcatatttgggaggcccctgctctg

SEQ ID NO: 32190 - DNA, 201 bp, Homo sapiens
ggcctgctttgtggtatctcagtggccatccccgcccgcagctatgtagggctggagtcagactctggctgtgaactcagaggggctcctggctccaggawtcctccgcttcttgtccagcgtgctcctctcccctgggacctgtagcatcgctggtcaccagaccagccagacaccaagccagtgaccctcactctgccc

SEQ ID NO: 32191 - DNA, 201 bp, Homo sapiens
atggccagggagggctgaagggctgggccaaaggccaagggccccaggatggtgtcagccgcctccctgagccccggttccgagtgggcctccctctgccygcagtcccaccagtgatcgagaatggcctcccagacctgtccaccaccgaaggctcccacgccttcttgccttgcaaggcgaggggcagtcctgagccca

SEQ ID NO: 32192 - DNA, 201 bp, Homo sapiens
caggatgctgtcaggtgacacctaatgaggagacagaattgtcaccactgtcatctactgagtgggaagctcctcccccgtgtggccaggtgggcagcgarggtagtgccagcagaggcccggtgtgggcgtgcctccacccatccacccatgctcagcagtaatgaggcacccctccctgttccgggctgaccatggaag

SEQ ID NO: 32193 - DNA, 201 bp, Homo sapiens
ttgccgggaacactcttcccctcactcagcaaacacctgctttcccttcagatcgcaggttaaatgccacttcccctggaggtctcctctggcctcccctrctccaagtgggaaacccacgagtaaccccctgtgaagttactaggccagggtctctatagaaagctgtatcccactgggtgcagtggcatgtgcctatgg

SEQ ID NO: 32194 - DNA, 201 bp, Homo sapiens
gagaagccaacaacctggaaccaccagtgggctcagacacacgcatgtgcacatgcgcacacacacgcacacacacacacgggggcatgtgcacctcaacragagcctgtcctctcttgcaaaggactaggaaagggacagcatagtaagaaagaaaacttgtaaataacaacccctaactgggtgtggtggctcgtgtct

SEQ ID NO: 32195 - DNA, 201 bp, Homo sapiens
tcctcacatgtcacagcacgggtataccagctccgaccgtgtcctggagcaaggcaggcgcccagctaggagctcgggggagtggctatcgtgtctcaccrtcgggtaagtaagggtaagccacagagagaggcagctgaggggagactgggagagcaggcagagggggtgaaaggtcacatggcggaataggatggaact

SEQ ID NO: 32196 - DNA, 201 bp, Homo sapiens
tgttttgtagttttgaatgtactggtcttatatttttgttaaattgattttaagtctttttattattgttgatgctattttgggtggaattgttttctttsatttttggatttgtaattgctaatatgtagagatacagttgaattgatatcatatcatctatgaatagggacagtttgactatctttctttcaaatctgc

SEQ ID NO: 32197 - DNA, 201 bp, Homo sapiens
aatgccctggtgtttctttttgtcccttatatcctgggccgcatacttgagaagccaacaacctggaaccaccagtgggctcagacacacgcatgtgcacrtgcgcacacacacgcacacacacacacgggggcatgtgcacctcaacaagagcctgtcctctcttgcaaaggactaggaaagggacagcatagtaagaaa

SEQ ID NO: 32198 - DNA, 201 bp, Homo sapiens
ttgcagtgagccaagatcgtgccatcgcactccagcctggttgacaggcaagactcaatctcaaaaaaaaaaaaaaaaaaaaagaacaaaaggaatgcaaygcaattctgacacaggctacaacatagatgaaccttgaggtcattatgcgaagtggaaaaagccggtcacaaaaaaacaaacactgtatgattctgttta

SEQ ID NO: 32199 - DNA, 201 bp, Homo sapiens
tcggcctggccccagggcagctggtcctggagtgttcggtggaggcagagccagcgcccaagatcacgtggcaccgagacggcattgtgctgcaggtgggygccaggcagggccccagggtgctgccttctgtcccgctcaggcctcagacctgacctggccggatccaagatccagagcgggtgccaagggcccgctctg

SEQ ID NO: 32200 - DNA, 201 bp, Homo sapiens
cgacctgggacagggccgtcagtcgtgcagggatttaggactgggggctgggctggaatgctggtgtgaggggctggcttcccccggcaggcacccacacrctgcagctggggagagcacggctgtcggactccgggatgtacacatgcgaagccctcaatgctgccggccgagaccagaagctggtgcagctcagtgttc

SEQ ID NO: 32201 - DNA, 201 bp, Homo sapiens
ggcctcagacctgacctggccggatccaagatccagagcgggtgccaagggcccgctctgagctgcactttgcaccctgttccccgggtgtcatacccccygccattgtcattgtcactcccattttatggatggggacactgaggcaaggctcaggtcactcagggcttccgaggcccacccagtattctccccctggct

SEQ ID NO: 32202 - DNA, 201 bp, Homo sapiens; identical to SEQ ID NO: 6269

SEQ ID NO: 32203 - DNA, 201 bp, Homo sapiens
ggggtgggggcagcgccttcccgctcttgggtgctctccctgccagcagggaattgtgtggctttttcctgtgctgcactggacacctcctccaggaaggyctctcagatcctgctgggccacactggcataaccccagctccagcacagttcctggcacacgggagctcacaggagaggcccctcgcaaatccagaatgt

SEQ ID NO: 32204 - DNA, 201 bp, Homo sapiens
cagcagggaattgtgtggctttttcctgtgctgcactggacacctcctccaggaaggtctctcagatcctgctgggccacactggcataaccccagctccrgcacagttcctggcacacgggagctcacaggagaggcccctcgcaaatccagaatgttctaaactcaaatctgaccttgtcatcacccccgttaaaaatc

SEQ ID NO: 32205 - DNA, 201 bp, Homo sapiens
acaccttttaaaaatctttgcctaatctaaggtcgtctttttcttttcttttcttttctttctttctctttttttttttttttgttttaatatttttgggrcagagtctcactctggtgccaaggctggagtgcagtggcaagatctcagctcactgcaacttccacctccaaggttcaagcaatccttgtgcctcagcct

SEQ ID NO: 32206 - DNA, 201 bp, Homo sapiens
gattagcagcttccagggtggaagacatgggcggagctcagggctctggagtcacgttccagacccagccctgcagtcatggcatgagcccttcctgcctyggtttcctcagcatctagatgcttttatctggtccgctccggctgaccatctgagactcctgggagtctgccctgccctccctccctccttccgtggagt

SEQ ID NO: 32207 - DNA, 201 bp, Homo sapiens
gtaatgggctgagggcagtaagcagtggggctgggattcagtcccatgttggtctgacctccaaacctacactcttaactttgtgccatgctatccccccmagtcccttgggtgtggccccccagataccatcttctgggagtggacgtggcctcaggctgccccaggcccatctgatggtggcgctgccactcagaagtg

SEQ ID NO: 32208 - DNA, 201 bp, Homo sapiens
ctgcggggaggaaggtgggcaggatgtgagttgctgcctccttggcctgtcagaccccaaaccgagtggattagcagcttccagggtggaagacatgggcrgagctcagggctctggagtcacgttccagacccagccctgcagtcatggcatgagcccttcctgcctcggtttcctcagcatctagatgcttttatctgg

SEQ ID NO: 32209 - DNA, 201 bp, Homo sapiens
agtaataagagcagtagtaagagcagtggtaataatggctcctgttacccaagtactaactgtgggccaggcacggggccttgcacttagcaagcattatyccatgtgatgcttataagatcctagcagttatcactcccattttacagaaggggtaactgaggctccagaggcatgaaaatgtcctaagtaatgggctga

SEQ ID NO: 32210 - DNA, 201 bp, Homo sapiens
gcggggtgggcagaggctggagatccaggaagcccaggtgagcaaccctgggggcacgggcagccatgagcgctgcaggaaagtcgcctcccagccctggsgagctgcggggaggaaggtgggcaggatgtgagttgctgcctccttggcctgtcagaccccaaaccgagtggattagcagcttccagggtggaagacatg

SEQ ID NO: 32211 - DNA, 201 bp, Homo sapiens
aggtgaggcactgccccaaggggcacagcagggaataatggctgagacccctgtttgtcatgctctgcgctgagcactatgcagcctttaaccctgggagsctggggaaatcagtgtcaccatcccgggtacagacagccagaactgaggctcaaagtgtacctagttgtccaccattgccaagaggcagaacccaaattt

SEQ ID NO: 32212 - DNA, 201 bp, Homo sapiens
aatggctgagacccctgtttgtcatgctctgcgctgagcactatgcagcctttaaccctgggagcctggggaaatcagtgtcaccatcccgggtacagacrgccagaactgaggctcaaagtgtacctagttgtccaccattgccaagaggcagaacccaaatttgaacctggacctcggtagccagctcctggggaaggg

SEQ ID NO: 32213 - DNA, 201 bp, Homo sapiens
tacggtgatgactttgtgtcctgaaagtctacccagttgttgtcaaccatgcgttggcattaaccgtcctctgggttttggggagtgttgagccaggggtrtgggtgggacccccaacctccttcccctcagcactcatcatattctgcaattttatgatgagaccctctccagatgggttcagtggacacacctagaggg

SEQ ID NO: 32214 - DNA, 201 bp, Homo sapiens
accacagttctggttccatctggggctgggacaggggctgtgggtgggccagagtgccgtgggccttgcttccttcccccacccagcaggcccccaggggyccacggagcacaatttagaaccctcgtcacttgactgccaaggtgcagcctgcagtctgggaaggttaaaatggtgttcactgagtaaccaaggctaagg

SEQ ID NO: 32215 - DNA, 201 bp, Homo sapiens
ctggtactgcctgtgttcaccaccctgcctggggaccgcagcctgcgccttggggacaggctgtggcttcgctgtgcagcccggggcagccccacccctcrcattggctggactgtcaacgaccggccagtcacaggtctgggtctgctgggcatgggtgggacagagagccaggacaccgggaggttaagaagggagggc

SEQ ID NO: 32216 - DNA, 201 bp, Homo sapiens
cagagacagtgagccaggtggctgggagccccctggtcctgacctgtgatgtgtccggggtccctgcacccacggtcacttggctgaaggacaggatgccygtgggtgagcacatctgtccttgtctgtttcgcgtaaagcattcctttctttaataagatgacagcagaagcggacgaaggaagttattggttgttgatg

SEQ ID NO: 32217 - DNA, 201 bp, Homo sapiens
ccctcaggtctcccctgcacaggtgcatatttcccacgatggccagggattgtggggagccaatccagcctgtccgtggctccttcatttccaggttctcsccgttcagttgctggctgggtccctgctcttctcagccagggccatgccgcaggccagcacagcagccatttcccttttggctcctaccagttttgcccc

SEQ ID NO: 32218 - DNA, 201 bp, Homo sapiens
tgtttctggaaagtgagcaaggaaatgtacaatgcactgccagcagcctcatggaataaaacacggagcagtgatgagagtccaaaggcttccccctacacacacacacacacacacacacacacacacacacatatacacacaagccacacacaaattgtgtatgtttgatgaaaattcatttggtggcaaaatgatgtg

SEQ ID NO: 32219 - DNA, 201 bp, Homo sapiens
ttctcataaaagaggtgatttcggggcactcaccatcccagtgattgccagaaaatggattcaaattttcggctaaagagaaactctgtggttctttgttaaaaaacaaataaaaccatcctggctaacatggtgaaaccccgtctctactgaaaatacaaaaaattagccaggcgtggtggcgggcgcctgtagttgcag

SEQ ID NO: 32220 - DNA, 201 bp, Homo sapiens
aaaattagccaggcgtggtggcgggcgcctgtagttgcagctactgggaggctgaggcaggagaatggcgtgaacccgggaagcggagcttgcagtgagcygagatcgcgtcactgcactccagcctgggctacagagcgagactccgtaaaaaaataaataaataaataaaatttaaaaaaattaaaaaaccttcatcca

SEQ ID NO: 32221 - DNA, 201 bp, Homo sapiens
gggagttcaagaccagcctggccaacatggtgagaccgtctctctactaaaaattaggtgggcgtggtggggggcatctataatcccagctactcgggagsctgaggcaggaaaatcgtttgaacccgggaggcagaggttgaggtgagctgagatcgtgccattgcactccagcctgggcaacaagagtgaaactccacc

SEQ ID NO: 32222 - DNA, 201 bp, Homo sapiens
gtcgggagttcaagaccagcctggccaacatggtgagaccgtctctctactaaaaattaggtgggcgtggtggggggcatctataatcccagctactcggraggctgaggcaggaaaatcgtttgaacccgggaggcagaggttgaggtgagctgagatcgtgccattgcactccagcctgggcaacaagagtgaaactcc

SEQ ID NO: 32223 - DNA, 201 bp, Homo sapiens
aacccgggaggtggaggccaagaccatgccactgcactccatcctgggcgacagagcaagactctaaaaaaaaaaaagaaaaaaaataggtagccaggggyggtggctcacgcctgtaatcccagcacccagcactttgggagaccgaggcgggtggatcacctgaggtcgggagttcaagaccagcctggccaacatggt

SEQ ID NO: 32224 - DNA, 201 bp, Homo sapiens
tgtatgtggtgtgcacacatgcaatgcacacatgtgtctgtgcatatatgtgagctgtgctgagatgacccacatcattaatgaggccaggtaagtctcayggttaacaggtaactctcagtgaaagatgaaaggaagactttccgttctggatatttttaaccaaaaatagagaatatttagtacctgtaataggataac

SEQ ID NO: 32225 - DNA, 201 bp, Homo sapiens
tttttattgtaaatgatgtatgtatgtggtgtgcacacatgcaatgcacacatgtgtctgtgcatatatgtgagctgtgctgagatgacccacatcattamtgaggccaggtaagtctcacggttaacaggtaactctcagtgaaagatgaaaggaagactttccgttctggatatttttaaccaaaaatagagaatattt

SEQ ID NO: 32226 - DNA, 201 bp, Homo sapiens
tttttagtggagatgggatttcaccatgttagccaagatggtctcgatctcctgacctcgtgatccacccatcttggcctccctaaatgttttcatatatrttgcctatgctggaaaacaatccctggagtacacaattgctgtcttgccaaaaagcaatttcagacatcttgccaactgaacatcagataatgactaaga

SEQ ID NO: 32227 - DNA, 201 bp, Homo sapiens
agtgtgcagttttatctaactcttattacctgatttttgtcctaagataagactttttaaaatttaacaaccgtgctcagacttgcagtgctttttataamcattgtgaaacttcatttgaggtagaggtatgtaaagaaacaggtgtgtgtaggtataaaatccatattttatgtgattactttagattcttcctgttga

SEQ ID NO: 32228 - DNA, 201 bp, Homo sapiens
taaaccaaagaaatttacaaagaaaactccctcctactagaattcttcttagataaaaagcactttgagccattctctaaaccaatggttttccaactcascaatctaggagctggttaaaactgtagatacctagatctcatcctgcaaaatctgatttgtagatctagtatggggcaggaatcttcattttatcaaaca

SEQ ID NO: 32229 - DNA, 201 bp, Homo sapiens
gctaaagaatctaagaaagtttaattaaatttcttctgattccagttttaaattctttccagaggtacactatttttctgggtctttaagaccacattccrttttccttcaattcttgtagtactcctcgaggccaagagtctcttattttctgtttattcttcttggaacagaagaaatatattcagatctttctcattg

SEQ ID NO: 32230 - DNA, 201 bp, Homo sapiens
ggggacaagcaaataaagcaaagaaggttattagactaccttaattgatttgacttaggtaagtttactaacatctaactcaaactggtgatcacaggtcyttctctcttccaggtggttcagcatgcccttgataaagccaggacgggaaggacatgcctagtggtcactcacaggctctctgcaattcagaacgcagat

SEQ ID NO: 32231 - DNA, 201 bp, Homo sapiens
ctcagcaatctaggagctggttaaaactgtagatacctagatctcatcctgcaaaatctgatttgtagatctagtatggggcaggaatcttcattttatcmaacattccagattactccaaggcataatttatagctacaaggatggattatctgtgtctctttcaaaaatgacattgtgtctcagaaagggagatacaca

SEQ ID NO: 32232 - DNA, 201 bp, Homo sapiens
ttattttctgtttattcttcttggaacagaagaaatatattcagatctttctcattgtaccaccaacaccgaaaagcagggtttgtggcttgttctcggtygcactgactgaacatttcaataagtttgtggtaatttaaactaaaatgaactatagaaaggatataattctattttccagcagcagattaacacaagaat

SEQ ID NO: 32233 - DNA, 201 bp, Homo sapiens
aagctgggtgcaatggctcacgcctgtaatcccagcactttgggaggcggaggcagccggatcacttgaggtcaagagcttgagaccagcctgcccagtakagtgaaaccccatctctattaaaaacataaaaattagccgggtgtggtggtgcgcgcctgtaatcccagctactcgggaggctgaggcatgagaatcact

SEQ ID NO: 32234 - DNA, 201 bp, Homo sapiens
gcttctccagctgtttgattttgctatgtccttatcccttaggagtttcttgcacatgtaggcacttatttagtaaatgaacattggttaaatgaatggtwatcattaatatttgtagagtatgcattacatgctattatctcagtcttcacaacaacatgacgaatgagcttcttgtattagcatgcccattttacagat

SEQ ID NO: 32235 - DNA, 201 bp, Homo sapiens
ttttttttttgagacggagtttcactcttgtcacttaggctggagtgcaatggcacgatctcagctcacggcaacctccacctcccagggtcaagcgattrtcctgcctcagcctcccaaatagctcggattacagatgcctgccaccacacccagctaattttgtatttttagtagagatgggatttctccatgttgatc

SEQ ID NO: 32236 - DNA, 201 bp, Homo sapiens
gccatgtgaatattaggactgtaacatttttagatacagtagcttctgctaataaggatgcttgaaactataagccataaactctgggttttaaaatatcwtgtacatactcacaaagacttgcacagaaagtctatgccacttagcacatgttattaaatatccccataagttaagttgtttgttttccttcttcatcct

SEQ ID NO: 32237 - DNA, 201 bp, Homo sapiens
cacatttgttgactatttctgctcatttttgtttttctttaaatttatctttttccctgttcaaataaatttattttaaatttctagaaacttttgaaaakgtttcctgaatgcctagatgtttgtttttatacagaagaatataaattttaatttttccaagcatactttgaacttcctttctgttcatggaatgctttt

SEQ ID NO: 32238 - DNA, 201 bp, Homo sapiens
ctcttagggagctacaagatacaaaacggaaagaagcaagtcggaggtttcccacggcaacaccgtggtctaaagcaatgggtgaccttacaccttctgtkcaaaaaggtcccatttctgcttcttgttccacatttggagacactccttaatccagaaaaacaaaagtctacttgtaggatcataaatcaatttgatgcc

SEQ ID NO: 32239 - DNA, 201 bp, Homo sapiens
gtcaaaacccatttttaagtcttatgacttttaggagcagtgctctgaaggctgccgtgcaacagctgtactcttagggagctacaagatacaaaacggaragaagcaagtcggaggtttcccacggcaacaccgtggtctaaagcaatgggtgaccttacaccttctgtgcaaaaaggtcccatttctgcttcttgttcc

SEQ ID NO: 32240 - DNA, 201 bp, Homo sapiens
aagctcaccaggcaggagcaaatagcttcctgccaaggtgatttcttttcagaaatagagttactgtcactccaactgagtcgtcaaaacccatttttaartcttatgacttttaggagcagtgctctgaaggctgccgtgcaacagctgtactcttagggagctacaagatacaaaacggaaagaagcaagtcggaggtt

SEQ ID NO: 32241 - DNA, 201 bp, Homo sapiens
ataataggaaataactggttgaattaagcctattttaagattttttaaaaactattaatactagtatagtcagatctttctttggagtagtacatctttattttttattgtaattaaactaaaaatccattataggtcttaagttaaatgctttcacaatgtataaaaagcaaaaatggtgtgtttgtgggatgagtgtgt

SEQ ID NO: 32242 - DNA, 201 bp, Homo sapiens
cgtgcaactttttaaatttttgtacattcttttgaacagtgacctagctgaaatgttgtgccctttttgatgatgagctttagaaaacttcagcaggaaaratgatggatacaatcaaattattaagtaatccaatataaatgtgggttagccaccctgaaaatggactttaaaggcatcagaatttcaaagttctgttgt

SEQ ID NO: 32243 - DNA, 201 bp, Homo sapiens
aatcttttattgtgtattttcccagaggcaaaagaacatctttaaattacctatgtaatgtagatcgttctataggaggaagatagccctcctaatttccyggctctgtaatttactggtgtcctggcacatgttaaaccttaatctccttaccaaataaggtaattttgtaatgcacttagtttcatgctcagtgcctga

SEQ ID NO: 32244 - DNA, 201 bp, Homo sapiens
gtattaccagtatttgtgacatcacgaacggataccacagaaattttaatataacattgcccttatagataatttacaatatatttacactcatcattatyatatcttatgttctaataatgaaccacattcataactgtatcacaactttaggttacttgttaaatattttgaatacgatgtttcaatggaattggcttt

SEQ ID NO: 32245 - DNA, 201 bp, Homo sapiens
taggggcatggatgaagctggaaaccatctttctcagcaaactaacaaggacagaaaaccaaacacggcatgttctcactcataggtgggaattgaacaaygagaacacttggacacaggaaggggaacatcacacaccagggtctgtggtggggtggggagaggggggagggatagcattaggagatatacctaaggtaa

SEQ ID NO: 32246 - DNA, 201 bp, Homo sapiens
aatactaggcagccataaaaaaggatgagttcatgtcctttgtaggggcatggatgaagctggaaaccatctttctcagcaaactaacaaggacagaaaascaaacacggcatgttctcactcataggtgggaattgaacaacgagaacacttggacacaggaaggggaacatcacacaccagggtctgtggtggggtggg

SEQ ID NO: 32247 - DNA, 201 bp, Homo sapiens
gtgggtgagggctgaaccctacagcctgttagcaatacagctttcccttaggaattctaaagcgtgccgaaccccagcgcagccttagggaatctcctttygccatctactcgattccccagcgatctcctccagtcccaaggcttagatggccaaacacctaccgacaaagcccaggcttgcaagcacttacccgacctg

SEQ ID NO: 32248 - DNA, 201 bp, Homo sapiens
gcctgagcatgattactttttgttgccattctttctatttgagttaaaaatatatcaactaaatgttacaaaggaaaagaacgtagatttttgtttgtttrcttttcagggattattttacggcagagcaggggaaattttaacgatgagattaagacacttggccttcaaagccatgttatatcaggtcagtgataagtt

SEQ ID NO: 32249 - DNA, 201 bp, Homo sapiens
ttcaaagccatgttatatcaggtcagtgataagttgatttttttttattttatttaaaatttattgtaaaacattctagctttaattctgtctcaagtcamtttttgacataatctttctttgaaagcacactctttttgttctaagcagcaaaaatctgatgtcagaagtcttatatttttctaaaagaagcaagtccaa

SEQ ID NO: 32250 - DNA, 201 bp, Homo sapiens
atacggtaacattcttgtaacattcttttttttttttttttttttttttttttttttttttgatacagagcctcgctctgtcgcccaggctggagtgcagkggcgcaatctcggctcattgcaagctccacctcccgagttaacgccattctcctgcctcagcctcctgagtagctgggactacaggcgcccgccaccacg

SEQ ID NO: 32251 - DNA, 201 bp, Homo sapiens
atatcttgggaatgtatctgaaaagaagttgttaatttctctggttctaattcatgtgcatagcttaagttttttgactctacacttcttaaagcagccartctctctgcctttatcagaagagtcctgaactcagataacatcggtctagctgccaggtctgcctgcctcacgcagatgatcagtccccgctgtgaaata

SEQ ID NO: 32252 - DNA, 201 bp, Homo sapiens
ttgcaagctccacctcccgagttaacgccattctcctgcctcagcctcctgagtagctgggactacaggcgcccgccaccacgcctggctaatttttttgkggtttttttttttagtagagacggggtttcaccgtgttagccaggatggtcttgatctccggacctcgtgaccagcccgcctcggcctcccaaagtcctg

SEQ ID NO: 32253 - DNA, 201 bp, Homo sapiens
caagaagggaaaaagccagtaagcacaagtgtgatcttaaatgtccaaataaagatggcaacagtaggaactgggggccactgaagatgggagggagagaggggcaagggctgaaaaactaaccattgggtgctatactcagtacctgtgtgacaagatcattcataccccaaacatcagcattacgcaatatacccagac

SEQ ID NO: 32254 - DNA, 201 bp, Homo sapiens
ctgagattctcagctttgtctgctcaactcagagtctattgggctctttgcactgccacctggaaactcttaaggtagtaagccacagcaaccacaggggkcaccttgtttgtttgccacctctgcccgtggttgccttatgttcagtgtcttgaaaaccactggttcatgtattttgtctattttttgtttggttttaga

SEQ ID NO: 32255 - DNA, 201 bp, Homo sapiens
gactctttctttagttttttgttaatagtaactatgattctgtcattttcaaacatcagctttattaccaagaacttatctgtaagttagggttgaagagrtggcagggtgttagtatctatgtttatgcacaaatgagttgttgtattattgctgggtgtttgggtgtaaagaaacaagaagaatgtgggtatgtaccta

SEQ ID NO: 32256 - DNA, 201 bp, Homo sapiens
actccaaaacaagccaaggtattaggaaaatgtttttgtaaatacatcttgaaactttccaactttcaagtttgagatcgtaatgaaacttttaccttccrcattttcttttcttagcttctgcctagatttttttcttatcctgtagtacaatattccatccagtttaacaagagtaaagaaaaatacacctgccatttc

SEQ ID NO: 32257 - DNA, 201 bp, Homo sapiens
aaagtgtcctacaaccaagaaccgaaataagctaaggagtgactcaatggccatatttttaagggactctttcagactgtggtaatccagtgaaaaataarcaaggaagtgaagagactgtaataatcaataatgagctggggacagtgacaggtctataataatagctacaagagaggttaaggtaggaggattgcttga

SEQ ID NO: 32258 - DNA, 201 bp, Homo sapiens
aaaataaacaacaactaacttttgggatcagacatatctgggctgtaatccttacttcatcagttactagcagtatgaccttggtctaacctcagttcagytatcagaaaaataaaaatactgtcattttatgaggttattgaaagaatttaaatgagatatccatcttgggaacattttatgtattcaacaaatatgggt

SEQ ID NO: 32259 - DNA, 201 bp, Homo sapiens
tttgaaactaatatgagttggaataataggaaataactggttgaattaagcctattttaagattttttaaaaactattaatactagtatagtcagatcttyctttggagtagtacatctttattttttattgtaattaaactaaaaatccattataggtcttaagttaaatgctttcacaatgtataaaaagcaaaaatgg

SEQ ID NO: 32260 - DNA, 201 bp, Homo sapiens
ttatttgataatcgaatttttattccacagtagacctaataatttacgaggtttaatattttgaaactaatatgagttggaataataggaaataactggtygaattaagcctattttaagattttttaaaaactattaatactagtatagtcagatctttctttggagtagtacatctttattttttattgtaattaaact

SEQ ID NO: 32261 - DNA, 201 bp, Homo sapiens
tagttcaaccattgtggaagtcagtgtggcgattcctcaaggatcaagaactagaaataccatttgacccagccatcccattactgggtatataccccaargattataaatcatgctgctataaagacacatgcacacgtatgtttattgcagcactattcacaatagcaaagacttggaaccaacccaaatgcccatcaa

SEQ ID NO: 32262 - DNA, 201 bp, Homo sapiens
ttcatcagttactagcagtatgaccttggtctaacctcagttcagttatcagaaaaataaaaatactgtcattttatgaggttattgaaagaatttaaatgagatatccatcttgggaacattttatgtattcaacaaatatgggttttcaccttccactcccactttctctatatagcgtcataacctcactgttggctg

SEQ ID NO: 32263 - DNA, 201 bp, Homo sapiens
tgaacctgggaggcagagattgcagtgagccgagatcacaccactgtactccagcctgggtgacagagcgagactccttctcaaaaaaaaaaaaaaaaaaytaaaatctggtcaaacaaaattggcaaatattgaaattccagctgggtgataggtatgtgggccatttattaaatttttctctctatttttatacttttg

SEQ ID NO: 32264 - DNA, 201 bp, Homo sapiens
ataatattcataggttgtagggggcaaatggaaaatactcactacactaaaataaacgactactacactacttttaaattttggcaaatatccttccagattttttttttctatttctagatctcttaaccacatcttaacatcaaattcttttaacaagaaaataatatcataaaattttttttgtttactcctcacccc

SEQ ID NO: 32265 - DNA, 201 bp, Homo sapiens
gtattatttatcctctgaccactgtgaccactacctccccttgtcaccttccacgtctcctaggaagggctggcagacccagaatgactacttgcattgtsctttctctgtataaaacctgaaattttgtgtaatataatccttcctctgtaataacatcagaaacagcaatgactgctagcatttattgggtgtttattg

SEQ ID NO: 32266 - DNA, 201 bp, Homo sapiens
ctaaaatagtttacattttaaatacgaatatatacataataaatgcacttacacttttaattttaaactagtcctccttatcacattgacttagtgatgctttttatattactttaacagaaagatagctttttactcttttggactcatacttgtagttggcaccaccctttaatttcctctattctgttaatgaaagat

SEQ ID NO: 32267 - DNA, 201 bp, Homo sapiens
ataaataaattagacaattctacttaggtatactacttagaaatactacttcctgactttgagtttagaactactcaaagaaatgatagtagaaatttgartagtattagaactactcaaagaaattgtagtagaaatactactataattctacttagaaatactacttcctgactgtgagtttagaaccactaacatata

SEQ ID NO: 32268 - DNA, 201 bp, Homo sapiens
ctcatgttccagaaaggttttctcactcaaatttgtctcattatcaaaagtggaccaattttcaaaatgttttttcattcaaggaaagagcccaagaaaawtaacttttcaattttattattattccagtgatgccaaacaaactaataaggtaattagtatgggtaaaagagtaatctacactgcagggtcagagcctga

SEQ ID NO: 32269 - DNA, 201 bp, Homo sapiens
cagaggaccatgatggcttcaagatttgtgtgaaattttctttacccttccatgaagggaaacactggagaaattgggttattagtaagtaggggaactawgaaaacactgtgaagtgctaaatgtcaccattactacttagtggcctgaaaaggtgaatagactgtttcaagacgccaacctggccaggcgcggtagctc

SEQ ID NO: 32270 - DNA, 201 bp, Homo sapiens
agagaaaggcaattccctcaagcttctctagattaccaacacaaaatgaacagctaggaatcacaagctacatgtgaaatgctgctacaggattaatcttyctggctatacccttggaccagctttctcaatggaactgatccatctacacattcttgtctaggtaccaagggcttatgtttcttacaaaagtgccaaggg

SEQ ID NO: 32271 - DNA, 201 bp, Homo sapiens
agggccactagaaagcaatgtgaagccttgaaaggaagcaaagtcaatgggacaatctaaaaagcaggcaagaacctgcttaccccaactgtactgaccarttgtgattcagaggaccatgatggcttcaagatttgtgtgaaattttctttacccttccatgaagggaaacactggagaaattgggttattagtaagtag

SEQ ID NO: 32272 - DNA, 201 bp, Homo sapiens
taaaaaaataaataaataaataaaatttaaaaaaattaaaaaaccttcatccaatatgttctttaaacttacactctcctacaatccagggaaggccaaaractgcaaagtgattcctagttttgtatgttcttcagctgccctagaagaattcatgtacaatttaagctaggctggcagaaagggctacgagctcattat

SEQ ID NO: 32273 - DNA, 201 bp, Homo sapiens
cttttagagattatttccacaggatatggcaaccgttctaagttgttttttttttttaacttttgcaagacctctttgtttaatatacatcggcaagatcrgatttatattatcagaaaatagaataagtgggttacagttgtgaatattcacaagcattcattttggtttacaaagctaattttatgatggagaaagagc

SEQ ID NO: 32274 - DNA, 201 bp, Homo sapiens
tcaaatttatatcaacaggtggatggataataatttgtgagatagctatacagtgaaatgctatgcagcaataaaaggaaatgatatgctgatttatgccrcagcatggataaatggcaaaataagtatgttgagcaaaacaagctatctgaaaaggagtagataatgtatgatttcatttatataatgttctaaaaatgc

SEQ ID NO: 32275 - DNA, 201 bp, Homo sapiens
gatgtagtgttctgggatcagaacggaaggccaaattaaaaaggagaagtaagagctaccatatcttgggaatgtatctgaaaagaagttgttaatttctstggttctaattcatgtgcatagcttaagttttttgactctacacttcttaaagcagccaatctctctgcctttatcagaagagtcctgaactcagataac

SEQ ID NO: 32276 - DNA, 201 bp, Homo sapiens
cagaaacaatgcaaacaagaagataatggagcaatattttcaaagcactgaaagaaaaagaaaacacctcaaatcagaatgctatttacagaaaaatgccyaataaaaaggaaggcaaagttcagacattttcagaaattaaaggttaaaataattaactaccagcacacctacactacaagaaatattaaaggaagtcct

SEQ ID NO: 32277 - DNA, 201 bp, Homo sapiens
cttaaagtataataataaaataataataataataataaaagaaagttaagacacctctaaagaatacagaagtagcagataaaagtagcaccccactaccsctggagtgaaatacagcacccatcgatgatccctttcttctctcccagcaaggcggagaggcaggcctcaatggaaagggcacagctgtggttcactgga

SEQ ID NO: 32278 - DNA, 201 bp, Homo sapiens
aaaacacgtagaaaaataaggaaacctgataccaaaataaaatagtttaaaaaaaatcaaatcagataattcctagaaaagctgcatattactaaatgccytcggttagtaccctggggagaataaggctgccctcttatgctcagttggctgggaaaaacgaagagaggaaaccagccacgcattccccagcccttctgg

SEQ ID NO: 32279 - DNA, 201 bp, Homo sapiens
ctgggaggcagagattgcagtgagccgagatcacaccactgtactccagcctgggtgacagagcgagactccttctcaaaaaaaaaaaaaaaaaactaaartctggtcaaacaaaattggcaaatattgaaattccagctgggtgataggtatgtgggccatttattaaatttttctctctatttttatacttttggagtt

SEQ ID NO: 32280 - DNA, 201 bp, Homo sapiens
gcctgcagggattctccagaatgcagttgctttaggattagactctggtgttccctctgggacacaactgacttttagctccggttcatattaaggagccrttaccccttgagtttctcataaaagaggtgatttcggggcactcaccatcccagtgattgccagaaaatggattcaaattttcggctaaagagaaactct

SEQ ID NO: 32281 - DNA, 201 bp, Homo sapiens
gaagtggaagcaacaccgccttgacctcaaggatcctctgagacacacaccaggtgtggttctctactaatcttcacagtatcacccagtggcagctctcrgtcgagccacatccttaagtaggactttgaccactgtaaccaccctgaaaatccaacccagtgcctgcagggattctccagaatgcagttgctttaggat

SEQ ID NO: 32282 - DNA, 201 bp, Homo sapiens
tctattaaatatagataacatatcgtatatgtataatacgtagacttttttcttctaaggttgaaaaaaaatcagaattcttaaatacagataactccaasggtttcggtaagggagtgtggatctgtgtaacggctcaaaccagaagggtgcagagcaaggagtcaattagaacatgctgagtgtaatgtaatgcatcta

SEQ ID NO: 32283 - DNA, 201 bp, Homo sapiens
tgtcctcacgacagtccagaaatctagttccctcctacaacccaagttattcttcagagaaggccaagtgtctacctggtcttctctgtcccacagtccaytctgccaatctggaaacagaatgtgaaaacaggaagtttctctttcaagccaacacatgttctcatgtccgaaaagctattctaaaccaaaactctcttc

SEQ ID NO: 32284 - DNA, 201 bp, Homo sapiens
tgtcttttctcaaagaattctcagtagtaaaaaaaaaaaaatcactttctctttcatcattcgaaaaatgcctttccaccaaattataacatttcaaagtyctctctatttattactctacatgtattcaattgaccttgctataattcatgcctcattatttggtaaattttgtacattccagaaatacctcgaagaaag

SEQ ID NO: 32285 - DNA, 201 bp, Homo sapiens
tttcagtgttttaaattttaactttaatttaccttcatgtcattgttcccccaaaaacacgtagaaaaataaggaaacctgataccaaaataaaatagttwaaaaaaaatcaaatcagataattcctagaaaagctgcatattactaaatgccttcggttagtaccctggggagaataaggctgccctcttatgctcagtt

SEQ ID NO: 32286 - DNA, 201 bp, Homo sapiens
catctggcctaacttttattcttaaattgtttattatcttctattctttttattgtaccagttctcacatttactcaaaactatatgctgcaaaaatccaytgtgctaactttttacaacagactttgaaaactaagatgttatttcctttaacattttttctaaaagactagcttatttttcagtgttttaaattttaac

SEQ ID NO: 32287 - DNA, 201 bp, Homo sapiens
cctttctcaaataaaataaaataaaataagaaagataaatcagaattcaaaacatactgtaccttcactataaaacatggcccaatttagagaaataaccytcatacatatagtttatgagaaccccagctcttctgaattaagcaataaaggtttgtaaagcacaaaccacattaaaaagaaaaacgtattacccagata

SEQ ID NO: 32288 - DNA, 201 bp, Homo sapiens
ggaaggggaacatcacacaccagggtctgtggtggggtggggagaggggggagggatagcattaggagatatacctaaggtaaatgacgagttaatgggtrcagcacaccaacatggcacatgtatacatatgtaacaaacctgcacgttgtgcacatgtaccctagaacttaaagtataataataaaataataataataa

SEQ ID NO: 32289 - DNA, 201 bp, Homo sapiens
ctccccttgtcaccttccacgtctcctaggaagggctggcagacccagaatgactacttgcattgtgctttctctgtataaaacctgaaattttgtgtaayataatccttcctctgtaataacatcagaaacagcaatgactgctagcatttattgggtgtttattgtttgcaaatacagtgagttgcaaatgtactgaat

SEQ ID NO: 32290 - DNA, 201 bp, Homo sapiens
ttcatgccctggcccctgcctcccactccaagctcctctcatatcactccccacgtcatcatgcactgtgctttttctgttttttggggggcttttgtacrttttttgttttgttttgtttttttgagacagagtcttgctctgtggcccaggctggagtacagtggcgtgatctctgctcactgcaacccccgcctctag

SEQ ID NO: 32291 - DNA, 201 bp, Homo sapiens
aaactgcttaaaaccaatgttaaggagaaaactactaaagcatccagagaaattgacacaatatagatgaggaaaaagacaagaaagctacaaacttctcrtcagaaacaatgcaaacaagaagataatggagcaatattttcaaagcactgaaagaaaaagaaaacacctcaaatcagaatgctatttacagaaaaatgc

SEQ ID NO: 32292 - DNA, 201 bp, Homo sapiens
tggaagcaacaccgccttgacctcaaggatcctctgagacacacaccaggtgtggttctctactaatcttcacagtatcacccagtggcagctctcagtcragccacatccttaagtaggactttgaccactgtaaccaccctgaaaatccaacccagtgcctgcagggattctccagaatgcagttgctttaggattaga

SEQ ID NO: 32293 - DNA, 201 bp, Homo sapiens
ctaaactctgcactaaacctaactaacaaatcctaatagcaagactcaaaaggattaaactgtttccaagtaatttaaatgtgttccagaacaaggctcartaacatttacgagaattcagaaatacctagtccccaaaagtttaaaatttacaatgtctggcatccattcaaaaatcaccaggcaagcaaaaaaggagaa

SEQ ID NO: 32294 - DNA, 201 bp, Homo sapiens
gcacagctttctggcggccagaaacaaagactagctattgcaagggctcttctccaaaaacccaaaattttattgttggatgaggccacttcagccctcgrtaatgacagtgagaaggtaacatcattttcttttatctcagaatataataccaaatataagcatccaataacatggaggaaaccaaggtaagtttggaaa

SEQ ID NO: 32295 - DNA, 201 bp, Homo sapiens
aaaaaatgtggacaattcacaagagagaatatccaaattgtcactaatcatttgaaaagttgttcaactttattagtcatcgagaaaatgcaaataaaaayatgatagttctcacccatcagacagaaagaaccaagtcttagtcagcatatagagcaaccatggctctcttgcactattggggggtttataaaatagggc

SEQ ID NO: 32296 - DNA, 201 bp, Homo sapiens
ttcccaaatagcaatcgttcctcaagagcctgtgctcttcaactgcagcattgctgagaacatcgcctatggtgacaacagccgtgtggtgccattagatragatcaaagaagccgcaaatgcagcaaatatccattcttttattgaaggtctccctgaggtaagaaaatttctgaaatcttgaattataaagctgccaag

SEQ ID NO: 32297 - DNA, 201 bp, Homo sapiens
agagtatatgactatagggaaaagaattataacattatctgtcttttctcaaagaattctcagtagtaaaaaaaaaaaaatcactttctctttcatcattygaaaaatgcctttccaccaaattataacatttcaaagtcctctctatttattactctacatgtattcaattgaccttgctataattcatgcctcattatt

SEQ ID NO: 32298 - DNA, 201 bp, Homo sapiens
agttgtgtgatcttaacacaccattctccaatctgcttttggcagctgtttgatggtgtggatgcaaaagaattgaatgtacagtggctccgttcccaaayagcaatcgttcctcaagagcctgtgctcttcaactgcagcattgctgagaacatcgcctatggtgacaacagccgtgtggtgccattagatgagatcaaa

SEQ ID NO: 32299 - DNA, 201 bp, Homo sapiens
ttctcttattgaccactatttccctggtactggaagagtccccctcacgtagtgagcatgctcatcaaatatgagatggtgttgttaagagtgttgttatytatttatgtgaataaacatggctgtgtgcaagatgacacagctttacatgtggagtactgtatcatctccacctactttttactgggctttcagaaagtc

SEQ ID NO: 32300 - DNA, 201 bp, Homo sapiens
tcttccccaagactttcccatcttaactaataacaccaaccaccatccacacagttgtcagcccaaaaatgttggagtcatccctgttgcttctcttgccrttgtccaccacataaatcactgattcctcatgactctaattccaaaattcttctcatcctcttcacactcatccaagcccctccctgtcttgactggacc

SEQ ID NO: 32301 - DNA, 201 bp, Homo sapiens
atgagaatcacttgacccgaggaggcagaggttgcaatgagccaagatcacaccactgcactctagcctggatgacagagtgagactctgcctcaaaaaawttaaaataaaatttcaacagaaattgcaagttccctgtcctatgttctcctagcctctaaaatagtgtgcactattgcccatgtgaatttataaaccaca

SEQ ID NO: 32302 - DNA, 201 bp, Homo sapiens
ctaaaatttatatttcatattttaaaatatatgcttttaatttatatgcctgatgctatgagaatgttcttgaaaaaaaagattgattcttatactgaatkctactgagaaactaaagttttgatcttggatgaagattcgtattaaggtttatttgtttttttttctctgataatatatgcaaagtaaataatattctgc

SEQ ID NO: 32303 - DNA, 201 bp, Homo sapiens
ggtaacacattctatttgttatttcactataaatgtgtagatttagatgtacaaaataagtttattttatcctatctctttgtgttagtccctttcggctrgtttccagctgacttgccttttgcaataccgaccaagaaccattcctaatcaggagaggtttctgtagccttcctttccccactgcaaagctttctctat

SEQ ID NO: 32304 - DNA, 201 bp, Homo sapiens
tttgacctttctcctattttggcccacttttagtgtgtcttcccttctgccctactgtttcctgtccatgttggtttcctttccatagcaactcttgcctytccaacacaaagcttcatgctccaaaaagcactgagtcagacagcatgggttattccttgcatgattataatatcttcaccaatagaaagagataatttg

SEQ ID NO: 32305 - DNA, 201 bp, Homo sapiens
tctcacagaagaattttcatctgttttcatcaatttctctgtcactactctttctttgctttgtaatcacacctataaaaaaaaataagaaggccaggcayggtggctcatgcctgtagtcccaacactttgggaggcagaggtgggtggatcacaaggtcaggagctcaagactagcctggccaacatggtgaaaccccg

SEQ ID NO: 32306 - DNA, 201 bp, Homo sapiens
ggtagattaacaagaaacaaaatctgaaatcacataaataattcagctcaccagcccccgtgagccagtttttcctttgttctaatataatccaggcactyccaagcttgaaagttggttgtaatccaaaagtttgtttgcaagccaatagtttgaaactcaaaacatgttttcctcatgttgctctaaactttccacaga

SEQ ID NO: 32307 - DNA, 201 bp, Homo sapiens
cctgttacaaggatgctgctatttggcagaacacactgggcacttctctttgggttttgtttcccaagtctcaggacattactttgaatatccttattgtyggcatatttgtattttcaggataggttcaatttgaggaaatggccaaaagacatttaaacctaagtaatttcagaataacttggaataatttttagtttc

SEQ ID NO: 32308 - DNA, 201 bp, Homo sapiens
cataactggtaaaatactgatactgatataaggcataaaatctgaattaaattcccagatgaattgctctctgcttcagtttactggaacatgggaatgtrggggcaaaatatgccttcttgtcattcatcccttaggaaatttgtgagacattatgaaactctcagtgtggagatggcttcctaaagtaagactgtacat

SEQ ID NO: 32309 - DNA, 201 bp, Homo sapiens
tattatatatttatggggtacaatgggatgttctgatatatgttaacactgtgaaatgattaaatcgagctaagtgtttttgttatttagtctctataagyacagcataactggtaaaatactgatactgatataaggcataaaatctgaattaaattcccagatgaattgctctctgcttcagtttactggaacatggga

SEQ ID NO: 32310 - DNA, 201 bp, Homo sapiens
atactgaaagacccaacattactgtccttacatttattaattgttactaataaatagtattgtccctgagggaaattacggggaatagttgtcaacctgaytataagcacctgactaatatcatttcatcacttgaaacttcattgttgcagttattaagtgctggtctcacaataacttctagacaagtcaaatcttttt

SEQ ID NO: 32311 - DNA, 201 bp, Homo sapiens
aggcacacggcaaattccccttctttaggatccatacttgcgtgtgtcatggatccaccctactggatttcacataactttctcattagggcacattaatwtgagtcatgggaattaggctctagctctcttctttgttctcgcccagctttcttctcttgacctggaaggcatccttttttcgaagggctcttctacaga

SEQ ID NO: 32312 - DNA, 201 bp, Homo sapiens
ttaaaaaattgaatctgtggttaaattcttttttccctaaaaaaaaaaacaaaaaaacaaaaaaactttaagccatatggctttactgatgacttctattaaaaaaaaaagtgataaggaagaagttcttattctatgagaccaacatcattactctgatatcaaaattagacaatgagattacaaaaaaaataaaattat

SEQ ID NO: 32313 - DNA, 201 bp, Homo sapiens
catgtgtagatttggaaaaattatcaaacgtttagtttttaagactttgaatgggccaggtgcgctggcttacgcctgtaatcccaacactttgggaggcygaggcaggtggatcacaaggtcaggagttcgagaccagcctgaccaacatggtgaaaccctgtctctactaaaaatacaaaaattaaccaggtatggtgg

SEQ ID NO: 32314 - DNA, 201 bp, Homo sapiens
cgggcatgatggtgcatgcctgtaatcccagttacttgggaagctgaggcaggagaatcatttgaacccgggaggcggaggttgcagtgagccaagattgygccaccgcactccagcctgggcatcgcaggaacactctacctcaaaaaaaaaaaaaaaagaaagaaagaaaaggaaaggaaaaaaaagaaaaaacacctg

SEQ ID NO: 32315 - DNA, 201 bp, Homo sapiens
tgttttataagatagcaactgaagctttggagaatatacgtactatagtgtcattaacaagggaaaaagccttcgagcaaatgtatgaagagatgcttcakactcaacacaggtgattatagattcatactgacttcaaaaacttaattttgttctgtaaaggcagtactctcaaatgactccagtggtttgcctgctaat

SEQ ID NO: 32316 - DNA, 201 bp, Homo sapiens
cctctctatttattactctacatgtattcaattgaccttgctataattcatgcctcattatttggtaaattttgtacattccagaaatacctcgaagaaarcacagattattggaagctgttatgcattcagccatgcctttatatattttgcctatgcggcagggtttcgatttggagcctatttaattcaagctggacg

SEQ ID NO: 32317 - DNA, 201 bp, Homo sapiens
cagctttacatgtggagtactgtatcatctccacctactttttactgggctttcagaaagtcaggtcctgttacagtggagggggcagtagtgagttacaygctgtttgcttctatacaacgtatgatttatgagccttccttgggtaactttatactttgaaatagcttgaattcctatccttcttgttatgatttgtgt

SEQ ID NO: 32318 - DNA, 201 bp, Homo sapiens
gctacttggaaggctgaggcaggaggactgcttgagctgaggagtttaacactagcttgggcaacacagtgagacctactctctaaataagtaaataaataaataaaaacaaaaaataaaaaatttcaaagccatataaaatatttctttcatggcagagacatttacaggaaaaaagagaaaatgatagcaaaaaggaat

SEQ ID NO: 32319 - DNA, 201 bp, Homo sapiens
gcttcaaccccggaggtggaggttgcagtgagccgagatcacaccactgcactccagcctgggcaacagagcaagactccaactcaggaaaaaaaaaaaawatatatatatatatatatacatataaaatttactggatcctgtttttcagccaggactctgtgtgttggagggctttagagctcccagacctttcatcta

SEQ ID NO: 32320 - DNA, 201 bp, Homo sapiens
gtttgggtggggcaaacaatgcagaagttaaaaagaaaaaaaatctctgtgtcaacccttaactaagaggacaagcaaaccatcacaaaaatgatggttasgactctgaagtgaagcacaaaggtccaaagattcttcaaccattctggcagcagaaatgttgatcttagccatggaattactttagaacatgggtgctgg

SEQ ID NO: 32321 - DNA, 201 bp, Homo sapiens
aggctgaggcaggaggactgcttgagctgaggagtttaacactagcttgggcaacacagtgagacctactctctaaataagtaaataaataaataaaaacaaaaaataaaaaatttcaaagccatataaaatatttctttcatggcagagacatttacaggaaaaaagagaaaatgatagcaaaaaggaatgcctgattaa

SEQ ID NO: 32322 - DNA, 201 bp, Homo sapiens
gttctactgttttacaaaggatcgatggacctaagattcaaatgctttatcttttgatagagtttttactgcaattgcatatggagctatggccatcggaraaacgctcgttttggctcctgaatattccaaagccaaatcgggggctgcgcatctgtttgccttgttggaaaagaaaccaaatatagacagccgcagtca

SEQ ID NO: 32323 - DNA, 201 bp, Homo sapiens
tgcataaaacacaatgttattatacgcaaaacacttagaacagtgtctggaagacagtaagcacgtactaatgtcagccattattactggggaagttttcmaacatcatcattccccattttctggtcattgaataatcaaattttcttgagcaattcttctgaatattttatttttcaaaacaaacaggcaatgcagcag

SEQ ID NO: 32324 - DNA, 201 bp, Homo sapiens
aaagatgtctagtttatagtgagttatcatttaaatcacatatgtggaaaaggtatgcttgaattttttttaagttggaatttttttaaatatacacatayttttaaattttgtattgatatataatagttacacatattttaggggtacacatgatattttgatatattcatatgatgtttaatgatcaaatcagggtaa

SEQ ID NO: 32325 - DNA, 201 bp, Homo sapiens
caactcaggaaaaaaaaaaaatatatatatatatatatatacatataaaatttactggatcctgtttttcagccaggactctgtgtgttggagggctttaragctcccagacctttcatctattacactttcattagtgttctcatccaatctgtcagttttaaataccacctgtgtcctgataacttccttctgtatatt

SEQ ID NO: 32326 - DNA, 201 bp, Homo sapiens
aattaataagttgtggaaatacataaaccttgtaagggggtcatgtacttatttaccagaaagatgtctagtttatagtgagttatcatttaaatcacatwtgtggaaaaggtatgcttgaattttttttaagttggaatttttttaaatatacacatatttttaaattttgtattgatatataatagttacacatatttt

SEQ ID NO: 32327 - DNA, 201 bp, Homo sapiens
ctggatcctgtttttcagccaggactctgtgtgttggagggctttagagctcccagacctttcatctattacactttcattagtgttctcatccaatctgwcagttttaaataccacctgtgtcctgataacttccttctgtatatttccaactctgaccctgccctgagcacaagacccttatccaattacttaggagac

SEQ ID NO: 32328 - DNA, 201 bp, Homo sapiens
atttggtaaattttgtacattccagaaatacctcgaagaaagcacagattattggaagctgttatgcattcagccatgcctttatatattttgcctatgcrgcagggtttcgatttggagcctatttaattcaagctggacgaatgaccccagagggcatgttcatgtaagtcgtggaaatagtccggacctggtagctca

SEQ ID NO: 32329 - DNA, 201 bp, Homo sapiens
tattactttaacagaaagatagctttttactcttttggactcatacttgtagttggcaccaccctttaatttcctctattctgttaatgaaagattgtaayggagacttagaaaatccttctaaatacctaaaccaaatctctaactcttacactagccatcctttcacgggctttgcccattcatttaacagtatataaa

SEQ ID NO: 32330 - DNA, 201 bp, Homo sapiens
gaggttgcagtgagctgagatcacaccactgcactccagcctgtgtgacagagcgagactctgtctcaataattaattaattaatttagtttataaaagtwccctttgcccctctttctacctagtcccgctgtttaaatgactcccttaatatctgttatgtgggaaaaaccagctgaagtagactcacattgaatcctt

SEQ ID NO: 32331 - DNA, 201 bp, Homo sapiens
gcctgctaattcatttgctcttgagcctttcctaataatgtcatgtcataatttctcatatgacttcaccaagagaaactagaagaggaattgagggcaascacaattagaataaatattttaggtcctctcacattaccattaactgtctgttactaagtatgcacatttttcttattttcctgaaagaatattaatgaa

SEQ ID NO: 32332 - DNA, 201 bp, Homo sapiens
ttccactgaaagtcttacataatttatctgtagctaatctttcttttttttttttgagacggagtttcactcttgtcacttaggctggagtgcaatggcaygatctcagctcacggcaacctccacctcccagggtcaagcgattatcctgcctcagcctcccaaatagctcggattacagatgcctgccaccacacccag

SEQ ID NO: 32333 - DNA, 201 bp, Homo sapiens
gcctaggcgacacagcaagagaaaagagctcggccctttacattaaatccctaaaatagtttacattttaaatacgaatatatacataataaatgcacttrcacttttaattttaaactagtcctccttatcacattgacttagtgatgctttttatattactttaacagaaagatagctttttactcttttggactcata

SEQ ID NO: 32334 - DNA, 201 bp, Homo sapiens
aacataatgaaaccccatctctacgaaaaatacaaaaagttagccgggtatggtggtgcgtgcctgtaatcccagttacttgggaggctgaggcaggagartcacttgaacccaggaggtggaggttgcagtgagctgagattgcgccactgcactccaacttgggcgacagagcacagctctgtctcaaaaaaaaaaaaa

SEQ ID NO: 32335 - DNA, 201 bp, Homo sapiens
tacaggtatttaagcttcttaggatcaaccatattcatacaaataattattatattagagactgaaggaaacattatggtggcatcataacacctaagaaytgaaagagacatcatctgacccaaccattaacctgaagtaggagtcccttgcacaacatccctgtcaagcgtccatccccatctcctaccaccttttcct

SEQ ID NO: 32336 - DNA, 201 bp, Homo sapiens
tctatggaacaagtttaaattgaaattcagtataaacttgaatggggttaaacttagatcagtagactaaatctcaataagacattttccttaagcttatyatccaaaagtgtcatttttctatcttattttctgggaggaaaggaagctaagaatatttgtcaggaaaacttactgacttgatatacttaatatgtcccc

SEQ ID NO: 32337 - DNA, 201 bp, Homo sapiens
aaaatattgattttgtataaaattcctagcaaatgtgattacaactttataaataggaaatagtaaaaaatgcttaactaaagatagactctttctttagktttttgttaatagtaactatgattctgtcattttcaaacatcagctttattaccaagaacttatctgtaagttagggttgaagaggtggcagggtgttag

SEQ ID NO: 32338 - DNA, 201 bp, Homo sapiens
gtgaacataatgcttactaatgttttattcttctgtctatggaacaagtttaaattgaaattcagtataaacttgaatggggttaaacttagatcagtagrctaaatctcaataagacattttccttaagcttattatccaaaagtgtcatttttctatcttattttctgggaggaaaggaagctaagaatatttgtcagg

SEQ ID NO: 32339 - DNA, 201 bp, Homo sapiens
gatttgacttaggtaagtttactaacatctaactcaaactggtgatcacaggtctttctctcttccaggtggttcagcatgcccttgataaagccaggacrggaaggacatgcctagtggtcactcacaggctctctgcaattcagaacgcagatttgatagtggttctgcacaatggaaagataaaggaacaaggaactc

SEQ ID NO: 32340 - DNA, 201 bp, Homo sapiens
ttatacagaagaatataaattttaatttttccaagcatactttgaacttcctttctgttcatggaatgcttttagtggaagaatttcaaagccatgagacygtttaatgagagaaactgtggttaatctagtattttgatggttaatactggacattaatcctctgtctagcattagccatgtgaatattaggactgtaac

SEQ ID NO: 32341 - DNA, 201 bp, Homo sapiens
gtttgaacccgggaggcagaggttgaggtgagctgagatcgtgccattgcactccagcctgggcaacaagagtgaaactccacctcaaaaaaaaaaaaaartggggggggggcatgactgtgtttcaataaaactttatttacagacactgaaatttgaattgcataccacttttacatgatgcaaaatattattcttctc

SEQ ID NO: 32342 - DNA, 201 bp, Homo sapiens
tttgaacccgggaggcagaggttgaggtgagctgagatcgtgccattgcactccagcctgggcaacaagagtgaaactccacctcaaaaaaaaaaaaaagkggggggggggcatgactgtgtttcaataaaactttatttacagacactgaaatttgaattgcataccacttttacatgatgcaaaatattattcttctct

SEQ ID NO: 32343 - DNA, 201 bp, Homo sapiens
ttttactacaaactttgtggattgaccaatctgccatgtcctgcttcctcaaaatttactttccctgtcttccttcctttctttgtctctccctttctttstctctccctttctttctctttctttcttgcttgcttttcttgtattttcttcctttctctctctctttccctttcttttcctccctccctccctctctct

SEQ ID NO: 32344 - DNA, 201 bp, Homo sapiens
acatgtttaaaattaaaagggctctggaaacatgcacaattttcaaaatgaacttggccagtatgctacagtgtgttacaaccttcccaagtcattcttcycaactctgtcaacttcctttcacaggacacatgtgaagggaatttagagtttcgagaagtctctttcttctatccatgtcgcccagatgttttcatcctc

SEQ ID NO: 32345 - DNA, 201 bp, Homo sapiens
gattgtttctggaaagtgagcaaggaaatgtacaatgcactgccagcagcctcatggaataaaacacggagcagtgatgagagtccaaaggcttccccctacacacacacacacacacacacacacacacacacacatatacacacaagccacacacaaattgtgtatgtttgatgaaaattcatttggtggcaaaatgat

SEQ ID NO: 32346 - DNA, 201 bp, Homo sapiens
attgtttctggaaagtgagcaaggaaatgtacaatgcactgccagcagcctcatggaataaaacacggagcagtgatgagagtccaaaggcttccccctacacacacacacacacacacacacacacacacacacatatacacacaagccacacacaaattgtgtatgtttgatgaaaattcatttggtggcaaaatgatg

SEQ ID NO: 32347 - DNA, 201 bp, Homo sapiens
tagacctaataatttacgaggtttaatattttgaaactaatatgagttggaataataggaaataactggttgaattaagcctattttaagattttttaaamactattaatactagtatagtcagatctttctttggagtagtacatctttattttttattgtaattaaactaaaaatccattataggtcttaagttaaatg

SEQ ID NO: 32348 - DNA, 201 bp, Homo sapiens
ttgtttctggaaagtgagcaaggaaatgtacaatgcactgccagcagcctcatggaataaaacacggagcagtgatgagagtccaaaggcttccccctacacacacacacacacacacacacacacacacacacatatacacacaagccacacacaaattgtgtatgtttgatgaaaattcatttggtggcaaaatgatgt

SEQ ID NO: 32349 - DNA, 201 bp, Homo sapiens
aaatgaccaatttatttaatcatttggaaaatgcctggacatacaggtatttaagcttcttaggatcaaccatattcatacaaataattattatattagasactgaaggaaacattatggtggcatcataacacctaagaattgaaagagacatcatctgacccaaccattaacctgaagtaggagtcccttgcacaacat

SEQ ID NO: 32350 - DNA, 201 bp, Homo sapiens
acaggaccataaatgaccaatttatttaatcatttggaaaatgcctggacatacaggtatttaagcttcttaggatcaaccatattcatacaaataattaytatattagagactgaaggaaacattatggtggcatcataacacctaagaattgaaagagacatcatctgacccaaccattaacctgaagtaggagtccct

SEQ ID NO: 32351 - DNA, 201 bp, Homo sapiens
gatagaaggtagatatgttatagcaatagggtacatgatttagagcacaggctctggagtctaattagctgagttagaatccagattctatgctaacaaaygtgtgatatgagcaggttatgtcaacctttgtagacttcaggtttctcatctgcaaagtgggaataatacgagtattcacttacaaatttttgtgaatat

SEQ ID NO: 32352 - DNA, 201 bp, Homo sapiens
tattaacttcatctcttagggatctgtaaagtgatatgtatagagagagaaatgcatacagaccaatttaggatagaaggtagatatgttatagcaatagrgtacatgatttagagcacaggctctggagtctaattagctgagttagaatccagattctatgctaacaaacgtgtgatatgagcaggttatgtcaacctt

SEQ ID NO: 32353 - DNA, 201 bp, Homo sapiens
tttatttttaataacgaaagcaacccaaattgaaggcaacccaaatatttttgaagaatatttaataactgcagtataatgtacaaggaataaatcaggayacaaaactgcatgcacgtaataaaccaaatctgaatgtgtataagtatttatgtctagaagcatgtagattttaactttatctaagctttttctaatgat

SEQ ID NO: 32354 - DNA, 201 bp, Homo sapiens
attttgttagatagtatttagattctaaaatagggctgaggagttcaattttattggcatacatgaaaagatggtggatagaatttcacttaataatcaartaatgggtatagcattaacctccgtagcacaatataattatctgattaacttctgagtttaggaattccatggtatactactccaggcagaaatatcaat

SEQ ID NO: 32355 - DNA, 201 bp, Homo sapiens
aggtgtaaatgagaacaaagatttttcacaaagatgttcattacatctttatttttaataacgaaagcaacccaaattgaaggcaacccaaatatttttgragaatatttaataactgcagtataatgtacaaggaataaatcaggatacaaaactgcatgcacgtaataaaccaaatctgaatgtgtataagtatttatg

SEQ ID NO: 32356 - DNA, 201 bp, Homo sapiens
acacttggacacaggaaggggaacatcacacaccagggtctgtggtggggtggggagaggggggagggatagcattaggagatatacctaaggtaaatgaygagttaatgggtacagcacaccaacatggcacatgtatacatatgtaacaaacctgcacgttgtgcacatgtaccctagaacttaaagtataataataaa

SEQ ID NO: 32357 - DNA, 201 bp, Homo sapiens
gaagcaatttggcaatacccatcaagaatgtaagagtatatacacctttttaaatttcttcagaggtttataacctgttactataatcatttattttgacycaaattatcccagattcagccagtggaagtcccttcaagttgggagaattacaccttttaaggtgtaattccagttagaaatttaacaatagggcatttg

SEQ ID NO: 32358 - DNA, 201 bp, Homo sapiens
atcgatgatccctttcttctctcccagcaaggcggagaggcaggcctcaatggaaagggcacagctgtggttcactggatggcagagcagttgctgtggtrccttgctggtggggcttgctggaaatctgccctcaagggtggcaagggagaccttccacaggacggtgctgagcttcagaacctgtcaggtgctggggaa

SEQ ID NO: 32359 - DNA, 201 bp, Homo sapiens
gccttagggaatctccttttgccatctactcgattccccagcgatctcctccagtcccaaggcttagatggccaaacacctaccgacaaagcccaggcttrcaagcacttacccgacctgaacgccacactccagactggtcttcccatctggagcttgagatgaccccgcaccaggagcatttagtatttaaggaaagac

SEQ ID NO: 32360 - DNA, 201 bp, Homo sapiens
cgggttcaagcgactctcctgcctcagcctctcaattagctgggactacaggtgcccaccaccacgcccagctaatttttgtatttttagtagagacgggstttcaccacgttggtcaggctggtatcgaactcctgacctctggtgatcctcccacctcggcctgtaatcccaaagtgctgggattacaggtgtgagcca

SEQ ID NO: 32361 - DNA, 201 bp, Homo sapiens
atgacagagtgagactctgcctcaaaaaatttaaaataaaatttcaacagaaattgcaagttccctgtcctatgttctcctagcctctaaaatagtgtgcrctattgcccatgtgaatttataaaccacaattatatttaggcttgggtttcattctgattacataagactaattacttaggtagattaacaagaaacaaa

SEQ ID NO: 32362 - DNA, 201 bp, Homo sapiens
tgctatgtcagcagggtttaacgtttcagagatcataccacactagaaaacaaaagttgcaaattataatcttaaatttcaaaaagcaaccaaggtttatrgttcctcagtaaagaaatggagtgtttcaaatcctcagtgttgtgctcaataatatgatgaaagttgaagaactaatgggtacctggtacctaatatctg

SEQ ID NO: 32363 - DNA, 201 bp, Homo sapiens
tgtaggcgagcaaaggtcggactacaatcgtggtagcacaccgactttctactattcgaagtgcagatttgattgtgaccctaaaggatggaatgctggcrgagaaaggagcacatgctgaactaatggcaaaacgaggtctatattattcacttgtgatgtcacaggtaatgcttatgtgacataatgctatgtcagcag

SEQ ID NO: 32364 - DNA, 201 bp, Homo sapiens
ggaaaagaattataacattatctgtcttttctcaaagaattctcagtagtaaaaaaaaaaaaatcactttctctttcatcattcgaaaaatgcctttccamcaaattataacatttcaaagtcctctctatttattactctacatgtattcaattgaccttgctataattcatgcctcattatttggtaaattttgtacat

SEQ ID NO: 32365 - DNA, 201 bp, Homo sapiens
gcgtggtggcacatgcctgtaaatccagctactcgggaagctgaggcaggagaatcacttgagtcagggaggtggagtttgttgcggtgaaccgagattgygccattgcactccagcccgggcaacaccagcaaaactccgtctcaaacaaacaaacaaacaaacaaagaaaagaaaaaacacagtggagagcttaagagt

SEQ ID NO: 32366 - DNA, 201 bp, Homo sapiens
atttaaatattattctgagtctgagaagggggtctgtgggtttcactggatttgtgagagggtccatggcacacagagtttgagagctgctgccccagtgrgtcctgatacacagttcatgaaacgctaccccatgctgaaagctcttggggggcagagctccggagtcttgaacctcgagcccagcatggaaatcacatc

SEQ ID NO: 32367 - DNA, 201 bp, Homo sapiens
ttttctttttctttttttttttctggagatggagtcttgctctgttgcccaggctggagctcagtggtgtgatctcagctcactgcaacatccgccacccrggttcaagccattcttgtgcctcagcctcctgagtagctgggattacaggcacacaccaccacgccaggctaatttttgtatttttagtagagacggggt

SEQ ID NO: 32368 - DNA, 201 bp, Homo sapiens
gtacagaaaagcacagaaacatctgccctgccttagttccctacagggtctcatcagaggtggtttcattagccccaaccctttgcagcctggcaccttcagacatgccaccagctggctctcctaatatttgctgtggggccatgtgatcatcaggagggataggtcctcaaacaggcgatgagctcaggacatgggcat

SEQ ID NO: 32369 - DNA, 201 bp, Homo sapiens
aagtcctgttggtttcttttacccaaagataaaaaggtgaatatactgtctcctccaaagcttccccacctctctcaccgccggtggcagactctcccccrtgtgattgggacacatggctacctggtccctagccctttcagataattgtggaagttggaatgcaagttcagctgggttcttgatgagtttcagtgaatt

SEQ ID NO: 32370 - DNA, 201 bp, Homo sapiens
agaactccttccagattaaatttggggaaggactgcctgggggtgcttttgtactggttggttttctgtgtagagagttcatgcagccgcgggtctgtacwgattggagctgaagtcccaggttagcaccaccaacaggggctcccctgccacagcgcaggagtgggggcccaggatgggtccaggcaaaggcatcagtga

SEQ ID NO: 32371 - DNA, 201 bp, Homo sapiens
ttacctctctctaagtgtgaaccagatttggtgactcactgctaacaaatagaatttggtgcgagtgatggtttctgatttctgagactaggccacaagaygcattgtgcctttctccttacccctctctcttggaccactgcccctgggggatgccagcttccatgctgtgaggatattcaagagccctatggagaagtc

SEQ ID NO: 32372 - DNA, 201 bp, Homo sapiens
aggtaccaagctcggtgtccctatggtgccatagcctgggatgtggtccgccctaactctgttttctccttgacccacagtccctgctttgataaccacasgcagctacgggaaagagtgggaaaagtgagatagtcccaagaaacaggcaacagcagggtaagtgaaaatcaatcaacctaaagtcaaactaaaatttgt

SEQ ID NO: 32373 - DNA, 201 bp, Homo sapiens
aggaagaagtatattttgcagcatgacctgtaacacacacacatgcacacacaattgacatgaaagtttcatgaatctgtacttaccttttatgagcaatscatgctgactttgattcgattctagtttattctactccagtctattttattctttcattacaaaattgctagtcatgacccatgaaatatgtcaaaaccc

SEQ ID NO: 32374 - DNA, 201 bp, Homo sapiens
ctttgctttgagaaacactgctatctggtgttgcctttttgcaatgtcagcctgtggttatatttcctttgttgttgctaaggcaagatttgctcactcaktgttcagtggcacatcacttcctgagttgctgtgtgccaggccctgtgcttggtgatgggatacagcagggaacatgacaaatgaggaccctattgttgt

SEQ ID NO: 32375 - DNA, 201 bp, Homo sapiens
gatcctgggcctatgcgaggggtgatgatggttccctcttgtgtgcgtgctgccagtgagacgggtagaacacgtgcagggtggtgcctgcctaattttcygcaaaatctctcacctgcctggcaggcagggcaggagatcgtggtggactttggggataccccttggtccagctgtccagccagtgcctgaatctggtct

SEQ ID NO: 32376 - DNA, 201 bp, Homo sapiens
aagaaaaaaaaaaaaaggagattttctttgcagatccttttatatctttcccattgggcaccacgtgaaattattaccgagtttaaaaaaaactttttttwaaaaaatgtagaagttaatgtattatttctgcatatcggtctgtggactaagctttatacgatgcattcattctctttatttacctcaaatgtgggaagt

SEQ ID NO: 32377 - DNA, 201 bp, Homo sapiens
tgttcagatgtccttgtcttggaggacttccttgactcctgcctaaaatagtttcttgttacaccacccttggcactctttctttttttccctgcctctcyctcaaccctggccactcttgacctgctgttttttctcaaagcacagatcactagttgaaattacatggttgcatgttattgtttattgtctgtttccccc

SEQ ID NO: 32378 - DNA, 201 bp, Homo sapiens
aagaagggctgagcttacattatctccagctcagcaggtccttggaaattaggttgttttaaggaaataaagaaatgtgatatttcaacaagacactaggracagcggttgcctctgcagagggaaactgggtggccaaaggatggggtaagagggaaattttcgggccaggcgctgtggctcacacctgtaatcccagca

SEQ ID NO: 32379 - DNA, 201 bp, Homo sapiens
aattaattttttgcctttcctatggtgctgatagttattgactcttttttctttgttttttttttttgtttgtttttttttctgttttttttttttttttttgtttttttgagtctaggtcttgctgtattgcccaaggctggaggacagtgatgcaatcatggctccctgcagccttgatcttctgagctcaggtgatcc

SEQ ID NO: 32380 - DNA, 201 bp, Homo sapiens
ttattttcttcttttaaaattatttaattaattttttgcctttcctatggtgctgatagttattgactcttttttctttgttttttttttttgtttgtttktttttctgttttttttttttttttttgtttttttgagtctaggtcttgctgtattgcccaaggctggaggacagtgatgcaatcatggctccctgcagcc

SEQ ID NO: 32381 - DNA, 201 bp, Homo sapiens
taattaattttttgcctttcctatggtgctgatagttattgactcttttttctttgttttttttttttgtttgtttttttttctgttttttttttttttttttgtttttttgagtctaggtcttgctgtattgcccaaggctggaggacagtgatgcaatcatggctccctgcagccttgatcttctgagctcaggtgatc

SEQ ID NO: 32382 - DNA, 201 bp, Homo sapiens
ttatttaattaattttttgcctttcctatggtgctgatagttattgactcttttttctttgttttttttttttgtttgtttttttttctgttttttttttktttttttgtttttttgagtctaggtcttgctgtattgcccaaggctggaggacagtgatgcaatcatggctccctgcagccttgatcttctgagctcagg

SEQ ID NO: 32383 - DNA, 201 bp, Homo sapiens
gtgagctaaaatagaacatgaggctgagaaatgcagggtaggggaagaggaaggagggcagagctgctctgtgggcccccaggaagtgtggctctgagagrgctgtggcccttatcagcttggggcctacaagcatcaaattgagatgtcatcttgagtcaaagaaagatgaccttgatggggcagttatgggtttcagtg

SEQ ID NO: 32384 - DNA, 201 bp, Homo sapiens
ccgggtccaagccattctcctgcctcagcctcccgagtagctgggattacaggcacccgccaccatgcctggctaattttttgtattttttgttgagacgrggtttcaccatgttggccaggctgatcccgagctcctgacctcaggtggtccacctgcctcggcctccccaagtgctgtcagaatgtagtaaggtgatat

SEQ ID NO: 32385 - DNA, 201 bp, Homo sapiens
ggcagaggtagcagtgagccgagatcacaccactgcacttcagcctgggcaacagagctagacaccgtctcaaacaaacaaacaaacaaacaaacaaacaagactgtatataaaaagcatcacattagacatgtgaatccttttgcaagtaatttatttccccttcaggttactgacagtgtagctgtggctcattttcac

SEQ ID NO: 32386 - DNA, 201 bp, Homo sapiens
gcttggtttagcgttctgctgtcgctggcttgacattcttaatttttgaacaaggggccctgcattttcattttgtactggaccccacaaattatgcagcyggtctcatctggaggtctagaatgatgctatgtcttatttgaccgtctgatatttaaaataacaatagagtcaacgttttaaaatcaggagagttcacac

SEQ ID NO: 32387 - DNA, 201 bp, Homo sapiens
gtgcctggcacgtggtgagtgctttataaagtgttgctattttataaagctatgtctgatgcatagtaggtgccaacacatgttcattttccttccttttycccttccctttatttatttatttatttagagacagggtcttgctctgttgcctaggctggagcacagtggtgcaatctcagctcactgcggccttcacct

SEQ ID NO: 32388 - DNA, 201 bp, Homo sapiens
aggcagaggtagcagtgagccgagatcacaccactgcacttcagcctgggcaacagagctagacaccgtctcaaacaaacaaacaaacaaacaaacaaacaagactgtatataaaaagcatcacattagacatgtgaatccttttgcaagtaatttatttccccttcaggttactgacagtgtagctgtggctcattttca

SEQ ID NO: 32389 - DNA, 201 bp, Homo sapiens
gaggcagaggtagcagtgagccgagatcacaccactgcacttcagcctgggcaacagagctagacaccgtctcaaacaaacaaacaaacaaacaaacaaacaagactgtatataaaaagcatcacattagacatgtgaatccttttgcaagtaatttatttccccttcaggttactgacagtgtagctgtggctcattttc

SEQ ID NO: 32390 - DNA, 201 bp, Homo sapiens
ggaggcagaggtagcagtgagccgagatcacaccactgcacttcagcctgggcaacagagctagacaccgtctcaaacaaacaaacaaacaaacaaacaaacaagactgtatataaaaagcatcacattagacatgtgaatccttttgcaagtaatttatttccccttcaggttactgacagtgtagctgtggctcatttt

SEQ ID NO: 32391 - DNA, 201 bp, Homo sapiens
caactttgcatcagtgaaaccacgcaggatgtgctctttggaattcgactgcctttgttccacatgaggtttccaacgttcatccacgtggttgcacttgyagcattagctggttcattcttgttgctgaaatagttagctattactattattattttgagacagagtctggctctgtcgcccaggttggagtgcagtggc

SEQ ID NO: 32392 - DNA, 201 bp, Homo sapiens
tgaacctgggaggcagaggtagcagtgagccgagatcacaccactgcacttcagcctgggcaacagagctagacaccgtctcaaacaaacaaacaaacaaacaaacaaacaagactgtatataaaaagcatcacattagacatgtgaatccttttgcaagtaatttatttccccttcaggttactgacagtgtagctgtgg

SEQ ID NO: 32393 - DNA, 201 bp, Homo sapiens
ttgaacctgggaggcagaggtagcagtgagccgagatcacaccactgcacttcagcctgggcaacagagctagacaccgtctcaaacaaacaaacaaacaaacaaacaaacaagactgtatataaaaagcatcacattagacatgtgaatccttttgcaagtaatttatttccccttcaggttactgacagtgtagctgtg

SEQ ID NO: 32394 - DNA, 201 bp, Homo sapiens
ccaaagtgctgggattatgggtgtgagccaccgtgcccagccattatttttaaaagcctgatcaaggagggtaacagaaaggaggtgatatttggacggayacccaaaggaaatgagggaggagccatgtggatctctggaggaatagctttccaggcagagggacggcgagtgcaaaggccctgaggtagagcgtgcctg

SEQ ID NO: 32395 - DNA, 201 bp, Homo sapiens
gaagtgcagtggtgtaatcccagctcactgcagcctcaacctcctgggctcaggtgatcctctcacctcagcctcccgagtagctgggactacaggatgcrccaccatgcttggctaacttttgtattttttgtagagacggggtttcaccatgttacctaggctggtcttgaacaccttggctcaagcgatctgcccgcc

SEQ ID NO: 32396 - DNA, 201 bp, Homo sapiens
ttgagcatgtgctaggtactgttctgggcactagggattctgcagtgaagaaaacagctgaggtcccttcccttatgcagacagtaaggtcccttcccttmtgctgggaggaggcagacatcgggcaaataaatctataatttgtcagatgggagatgaatgttaggagagaaagcagagtaaggatgatgtcctgggggt

SEQ ID NO: 32397 - DNA, 201 bp, Homo sapiens
gtgaaggatggattgtggggactggcgacagatcagcgtgttgtgggatcgcggagctgaggtcaaatttccaggacagtgcctggctcatgataggtacycagtaaatatcagttgaaagaataaggtctgaactaagtcagtggcaatggagatggacaggagaactaaaagggttaggattcttttgattgcaagtga

SEQ ID NO: 32398 - DNA, 201 bp, Homo sapiens
ttggaaattaggttgttttaaggaaataaagaaatgtgatatttcaacaagacactaggaacagcggttgcctctgcagagggaaactgggtggccaaagratggggtaagagggaaattttcgggccaggcgctgtggctcacacctgtaatcccagcactttgggaggctgaggcgagtggatcccttgaactgagtcc

SEQ ID NO: 32399 - DNA, 201 bp, Homo sapiens
cttgaacctgggaggcagaggtagcagtgagccgagatcacaccactgcacttcagcctgggcaacagagctagacaccgtctcaaacaaacaaacaaacaaacaaacaaacaagactgtatataaaaagcatcacattagacatgtgaatccttttgcaagtaatttatttccccttcaggttactgacagtgtagctgt

SEQ ID NO: 32400 - DNA, 201 bp, Homo sapiens
aggagtttgagatcagtctggctagcatggagaaacgctttctctgctaaaaatacaaaaaattagccaggcatggtggtgggtgcctgtaatcccagctyctcaggaggctgaggcaggagaatcgcttgaacctgggaggcagaggtagcagtgagccgagatcacaccactgcacttcagcctgggcaacagagctag

SEQ ID NO: 32401 - DNA, 201 bp, Homo sapiens
tagtcccagctactccggaggctgaggcaggaggatcgtttgaacctgggaggcggaggttgcagggagccgagatggtgccactgcactccagcctgggygacagagagagactccatcttaaaaaaaaaaaaaaaaaaaaaaaggtgttccttcatgagcctgggcctgtaagggtggggtgaagcgattctaaggggt

SEQ ID NO: 32402 - DNA, 201 bp, Homo sapiens
ccagaaggcagagccgtttcttgcgtaccataaaatgggacatttaccttgggtactccctttggagtgtgttgctggaacttgtgcagggacttagggartcttctggggaagaggccagcaatgtgttggggatggagacgaggagcactcagtgttatgttttggagccttgtcctacacctgaggacctccaagtct

SEQ ID NO: 32403 - DNA, 201 bp, Homo sapiens
tagacaataaggagggcagatggtaaggaggctgggcagtgtggttcagaggagaaagcggggtttggataatgcagaaagacattccttggctgggcccygtggctcatgccagcattttgagaggctgaggtgggtggatcacaaggtcaggagtttgagaccagcctggccaacatagtgaaaccctgtctctactaa

SEQ ID NO: 32404 - DNA, 201 bp, Homo sapiens
aacccgcttccctcccgaggcagggagagacggtccgctctctcgaagacaatgtacaattttgaaaaaaaaaataaaaaagtcttggtaaatagattgasgaggctccagcctcctgggcttttgggaggcccaaggcatttttcccctctgcccaaaccaggtatcttttgcccattgctcacaagtcaacgtgacccg

SEQ ID NO: 32405 - DNA, 201 bp, Homo sapiens
tcaacctaaagtcaaactaaaatttgtgaacatgtttccttgaactaagtttcttttttttctttttctttttttttttctggagatggagtcttgctctrttgcccaggctggagctcagtggtgtgatctcagctcactgcaacatccgccacccgggttcaagccattcttgtgcctcagcctcctgagtagctggga

SEQ ID NO: 32406 - DNA, 201 bp, Homo sapiens
ggaggctccagcctcctgggcttttgggaggcccaaggcatttttcccctctgcccaaaccaggtatcttttgcccattgctcacaagtcaacgtgacccrtgctattaccattccccaaacttttcacgtcaaaccctggccgggaaggtggtcaatgtagccagtccatcaagcgatttgtcccatatggattctcaat

SEQ ID NO: 32407 - DNA, 201 bp, Homo sapiens
attatctacccagttcaaagatcctacagtctctttagggctgtcttgtaagtgacttggataccagaggtaccaagctcggtgtccctatggtgccatarcctgggatgtggtccgccctaactctgttttctccttgacccacagtccctgctttgataaccacaggcagctacgggaaagagtgggaaaagtgagata

SEQ ID NO: 32408 - DNA, 201 bp, Homo sapiens
ctgagactacaggtgcacgccatcacatctggctaatttttgcaggatgaggtttcaccatgttgcctaggctggtctcaaatttttgggctctagcaatyctcctccctcggcctcccaaaatggtgggattacaggcatgagacattgctcctggctgactaactcttttatctactctattaaaaaaatcattcactt

SEQ ID NO: 32409 - DNA, 201 bp, Homo sapiens
tcaccctgaggttgaagtctcactttctcccaatccaccatacataaaccctctcttgtcaaatgctttccttagagaatgcagtatgcaggatgatttgrgatggaggccacagctgcaggagagtggcattctgcttggaggcagccaagagcctggttttgctgtgaaactggattaaaagctgcctttctcttttga

SEQ ID NO: 32410 - DNA, 201 bp, Homo sapiens
tcacaatgctgaatttgacatttaaaattcccatgcatatatgggggtatgtgtgtgtttatgtacataaacatacactgtacattcttttttttttttttgaaacagaatctcgatccgtcgcccaggctggaatgcagtggcacagtcttggctcactgcaacctctacctcccaggctcaagtgatccttctgcctca

SEQ ID NO: 32411 - DNA, 201 bp, Homo sapiens
agaagggtataatagaaaacaagggctctattcacagaggtgggggcagcagtacaggacaggaggaaatggtgttattggagcctgtgagagtaggatcygcagccaagggcccccttccccaaaatgggggacaataaacaccttgggtgcactctcctcctgccctctgctcctctcatccccgctggtgttccccac

SEQ ID NO: 32412 - DNA, 201 bp, Homo sapiens
gaatgaagaagtgtcggtcccagcggggacatcattagaaataccacctgtggtagacatgtgaagcacctcaaggatgggggaacccagcacgttccttwtgtgatgatgaaatatttccgacatacaccaccaatgtagagagataatacaacaaaccctcgggaaaagctaagaaacaaaccttgacaattgccactg

SEQ ID NO: 32413 - DNA, 201 bp, Homo sapiens
cttttcctgatcgcctaagaaaagtagccctgttttctttcccctgtcatacacattcgcctatattattttcttcccagaactggtttgttgtgtatctyccagaggaccaggtctgccttggtcactgtgatatccctagcacttaggccattgcctggcacatggtagatgtttgataattatttattgaatgaatga

SEQ ID NO: 32414 - DNA, 201 bp, Homo sapiens
ctcacttccaatggtctcagtctcagctacaggtctggggttgctgcttattgaccaggctcatctcacacccctggttcatattcctgaatcaatgggtsgggggagggtgggggaatgcactgttttgattggccggtgctgggtcaggtgcatatccttggaagtggaggcatggtcagtcctacttgaaccacgtga

SEQ ID NO: 32415 - DNA, 201 bp, Homo sapiens
acctgtgtgtgctggtctggggcgagaatcctgggccaaggggcagcggaggggagaaagaagcagatggccacgaggccagcaaggggctgtccgactcrtaccccacagccagcattccctgcctctacccgtacacttgttttggctgcaggaagctgttttaggtggaaatcatttgatgtgtgtaggtgctgtctt

SEQ ID NO: 32416 - DNA, 201 bp, Homo sapiens
ttaattaattttttgcctttcctatggtgctgatagttattgactcttttttctttgttttttttttttgtttgtttttttttctgttttttttttttttktttgtttttttgagtctaggtcttgctgtattgcccaaggctggaggacagtgatgcaatcatggctccctgcagccttgatcttctgagctcaggtgat

SEQ ID NO: 32417 - DNA, 201 bp, Homo sapiens
ctttgacagcttcaggcttccctctaaccagcctaacagctgaagagaaggcctctttccccatagttccagcaaatatcctaggatatttgtggtggtgmgcacacccgaagtcccagctgctcgggaagctgacgcaggaggatcacttgagcccagaagtttgaggttgtagtgaactgattgcactacaagaccctg

SEQ ID NO: 32418 - DNA, 201 bp, Homo sapiens
tgagcacaagaggcgcaggcaggaaggagagcgcctggtgcgagagaggaaggagcgcacccagtaagcggtgtcgggggggtcgtgaagcttggagggcytcgaggggagggaggcgcttgggttgaggtagggcgccagatttcgcaaatcaaaatacagcacacccagttaaactcgaatttcagataaacaaatctt

SEQ ID NO: 32419 - DNA, 201 bp, Homo sapiens
tgaaggaaggaagaaaagaattcatcaactcctcatgaccaccctgtaaagcagggacaagagacctgagtcatggagaagagaagggactcctcaaggtygcacagcccagaaggggcagaaagggtgatgaggacctaggttttctgcttctacaccccctgtcccctcaaccccccaggtgggaagcagcagagacat

SEQ ID NO: 32420 - DNA, 201 bp, Homo sapiens
ttgtgtccaggatttcgaggctgcagtgagctaagactgcaccactgttccccagcctgggtgtcagagtgagaccacatctctagacaaataagaataawttttttttttttactgggctatgaaatcctaaagtctggaaactacccttttcactcaatgggcttttgaaaggtaatgattttaaaatatgtccacaaa

SEQ ID NO: 32421 - DNA, 201 bp, Homo sapiens
tcttactatttgtatggggtaaaataaaacaaagcaaaacaaaacaacacacgcacgctacacatcggttatatgtatgtgtgtgtgtgtgtgtgtgtgtgtgtgcaaaaatgatctctggaaggatacgtgagaaactggcggcctctagggacagggggacaggggtccaggggtataagggaaatttcacttttcatt

SEQ ID NO: 32422 - DNA, 201 bp, Homo sapiens
actcttactatttgtatggggtaaaataaaacaaagcaaaacaaaacaacacacgcacgctacacatcggttatatgtatgtgtgtgtgtgtgtgtgtgtgtgtgtgcaaaaatgatctctggaaggatacgtgagaaactggcggcctctagggacagggggacaggggtccaggggtataagggaaatttcacttttca

SEQ ID NO: 32423 - DNA, 201 bp, Homo sapiens
tgtattaatacagaatgatttccaagatacattaaatgaaaaaagcaagatgcagagcagtgtatatggcactcttactatttgtatggggtaaaataaaacaaagcaaaacaaaacaacacacgcacgctacacatcggttatatgtatgtgtgtgtgtgtgtgtgtgtgtgtgtgcaaaaatgatctctggaaggatac

SEQ ID NO: 32424 - DNA, 201 bp, Homo sapiens
acccgggttcaagccattcttgtgcctcagcctcctgagtagctgggattacaggcacacaccaccacgccaggctaatttttgtatttttagtagagacrgggtttcatcatgttggccagactgatctcgaactcctgacctcaggtgatctgcctgcctcagcctcccaaattgctgggattacaggcgtgagccacc

SEQ ID NO: 32425 - DNA, 201 bp, Homo sapiens
gtgtattaatacagaatgatttccaagatacattaaatgaaaaaagcaagatgcagagcagtgtatatggcactcttactatttgtatggggtaaaataaaacaaagcaaaacaaaacaacacacgcacgctacacatcggttatatgtatgtgtgtgtgtgtgtgtgtgtgtgtgtgcaaaaatgatctctggaaggata

SEQ ID NO: 32426 - DNA, 201 bp, Homo sapiens
gtggtgcctgttttaatcctctcatggatcgtgtaaagtaggtgatcttttccccattcacagatgggaaactgagcttcaggatagtcacatgacttgtycaagttctcatgattaggaaacgttggagctgggctttgaactggactgcaaagcttgtgctcttgacgaaataggaaggcagaggctgtggtggggagc

SEQ ID NO: 32427 - DNA, 201 bp, Homo sapiens
atcatgacggctttggggctcagaaaaaaagatcttcggctctaaaagctggagggcaggctggccttaatatccagctggactcccatggctcagggaaygcaatccagtttccagatgttggctcctatgtttctgccccaggaagtcccagaccaaaggaagtcccaacttcgaacccttggcttagtccattggaaa

SEQ ID NO: 32428 - DNA, 201 bp, Homo sapiens
cgtgtattaatacagaatgatttccaagatacattaaatgaaaaaagcaagatgcagagcagtgtatatggcactcttactatttgtatggggtaaaataaaacaaagcaaaacaaaacaacacacgcacgctacacatcggttatatgtatgtgtgtgtgtgtgtgtgtgtgtgtgtgcaaaaatgatctctggaaggat

SEQ ID NO: 32429 - DNA, 201 bp, Homo sapiens
gacaagacagcagctggaggtcacacaaagatcacaatttcatctcaccacatgcataaaaagacactgggatttgtgtgtgtgtgtgtgtgtgtgtgtgygcgtgtgtgttgcgcacatgcgcaatgcttattttcacctttacaggaaggactagagacattaactgacgagagatgaataggacccacgaatgcaccc

SEQ ID NO: 32430 - DNA, 201 bp, Homo sapiens
tcgtgtattaatacagaatgatttccaagatacattaaatgaaaaaagcaagatgcagagcagtgtatatggcactcttactatttgtatggggtaaaataaaacaaagcaaaacaaaacaacacacgcacgctacacatcggttatatgtatgtgtgtgtgtgtgtgtgtgtgtgtgtgcaaaaatgatctctggaagga

SEQ ID NO: 32431 - DNA, 201 bp, Homo sapiens
ttattgtctatttttgggagacaaggtagttgggaaaggaataaataatttcagtctgagcaaggtgaagcttggaaatgattggtgaggatggtgtggargcagggagagagtggggctggagtgattagtaaggccttgaaagatagacaccactgtattttccaagttatttacagaatgtttccatgtattctatac

SEQ ID NO: 32432 - DNA, 201 bp, Homo sapiens
gatggagttttaccatcttttccaggctggtctcaaactcctgggctcaagctatcctccagccttggcctcccaaagtgctggaattaccagtgtgagcytccacacccagcctcaattacaattggtggccaccttctgtgtgcccaattcagctagaagcactgggggatggaagcaaggctggagttctggtacccc

SEQ ID NO: 32433 - DNA, 201 bp, Homo sapiens
ggtttgattatatgttctttgttatttctggcactgtgagatgctgagcctgaacaatagattccccgccccccttttttttctgagacagagtcttgctyttgtcacccaggctggagtgcaatggcacaaactcggctcactgcaacctccgcctcccgggttcaagtgattctcctgcctcagcctcccaagtagctg

SEQ ID NO: 32434 - DNA, 201 bp, Homo sapiens
gatgagaaagtaattttggatgtggtgtcttctcaagccataggcaaaagagaactccttccagattaaatttggggaaggactgcctgggggtgcttttgtactggttggttttctgtgtagagagttcatgcagccgcgggtctgtacagattggagctgaagtcccaggttagcaccaccaacaggggctcccctgcc

SEQ ID NO: 32435 - DNA, 201 bp, Homo sapiens
ctctgctttccagatgagttgactgagatacaaagaggtgcccaaggtcacatacctagcaaatggcagaaatgagatttgaccctgaactgctcagaccyccaagccaagctctaaactctagtctagactgtttcttactgaacatgcttttccggtgcagggattatcacactgttggaatatgagctctctctgggg

SEQ ID NO: 32436 - DNA, 201 bp, Homo sapiens
ttcggcccaggtgcgggacgcaggcggtggaagggaaatgagcacaagaggcgcaggcaggaaggagagcgcctggtgcgagagaggaaggagcgcacccrgtaagcggtgtcgggggggtcgtgaagcttggagggcttcgaggggagggaggcgcttgggttgaggtagggcgccagatttcgcaaatcaaaatacagc

SEQ ID NO: 32437 - DNA, 201 bp, Homo sapiens
tctgacatccagaaagtatccaagaaaagggagcttgcatggtcattgaaccctcacgagtcccttaaaggccagatttggttactctcattttatagatrggcaaaccaactcagagaggcagtgtgacttagtcaaggtcacacagcagggtttgacccagatttggcttacattatccctctagactgcctcccgtgg

SEQ ID NO: 32438 - DNA, 201 bp, Homo sapiens
gcaaacaacaaatctaatatttatgaaataccaaatgtcaggaaggtactattttaagtgcttgaagtaaattgtctcatttaagcctcataataacgctrtggaacagtgttatcatgtctgttttacagatgaggaactaaggcacagagaggttaagtgacgtgttctgggttgcacagctcttaaacagcagatctg

SEQ ID NO: 32439 - DNA, 201 bp, Homo sapiens
ttagggcccacaaagacattttaattttaatttcttttaaaaccagaagaaaaaaactgatgctataataataataataataataataataataataatawtattagtggatcacaaatccagcctggattttacttgtctttatacagtgcagtcacaagctagagggagggtccctgaaagcaaacatccctggagccc

SEQ ID NO: 32440 - DNA, 201 bp, Homo sapiens
cccatcttgtagcctggatcagtactggagtcagttatttaatgctacatcctgggttcgggtaaaacgacctaaaatgtgagtcccccgcttcaggaagygccgctgtaatgaataaagaaccttttgggggaatcatagctcaatctcttcctggttctaagcgggcaggttcaggcttccctgcggtggggttggagc

SEQ ID NO: 32441 - DNA, 201 bp, Homo sapiens
ctttctgagtgccttcctggtgccaggctctattctgggtgctgggaacacagctaagaaaaagacaagaggcagggcacggtggctcacgcctgtaatcscagcaatttgggaggccaaggcgggtggatcacttgaggtcaggagtttgagaccagcctggccaacatggtgaaaccctgtctctactaaggatgcaaa

SEQ ID NO: 32442 - DNA, 201 bp, Homo sapiens
aaggaggtgatatttggacggacacccaaaggaaatgagggaggagccatgtggatctctggaggaatagctttccaggcagagggacggcgagtgcaaargccctgaggtagagcgtgcctgctgcactgaggagcaagagaggccattgggcaggagcagagtgagtgagggagagcgtagaaggaggtgaagtcacac

SEQ ID NO: 32443 - DNA, 201 bp, Homo sapiens
agagtggggctggagtgattagtaaggccttgaaagatagacaccactgtattttccaagttatttacagaatgtttccatgtattctatacttcttaaakatcatctcaaccctgtatggttgatgtccctacatatacacttatgtgtttcctgtagacttagtactcttagggttgtgacacaatttaacttaagtta

SEQ ID NO: 32444 - DNA, 201 bp, Homo sapiens
cacttgaccagaaagactgagactgcagtgagccgtgatcatgccactgcattcctgcctaggtgacagagtgagaccctgtctctttaaaaaaaaaaaaagaaaaaaaaaggagcgtgaggaaaaaaaacccttatgtattggcatttaaatattattctgagtctgagaagggggtctgtgggtttcactggatttgtg

SEQ ID NO: 32445 - DNA, 201 bp, Homo sapiens
cagagggaaactgggtggccaaaggatggggtaagagggaaattttcgggccaggcgctgtggctcacacctgtaatcccagcactttgggaggctgaggygagtggatcccttgaactgagtccaggaattcgagaccagcctggacaacatggccaaaccctgtctctacaaaaaagcccttcaaaattagctgggtct

SEQ ID NO: 32446 - DNA, 201 bp, Homo sapiens
atcgcagcaatttgggaggccaaggcgggtggatcacttgaggtcaggagtttgagaccagcctggccaacatggtgaaaccctgtctctactaaggatgsaaaaattagccaggtgtggtggcatgtgcctgtaatcccagctactgaggaggctgaggcacaagaattgcttgaacctgggaggtgaaggttacagtga

SEQ ID NO: 32447 - DNA, 201 bp, Homo sapiens
cacctccccagaccctcagaactgactctggaatgcccttgtggcctctgagggtcgctggctctgtggccatccccagggtgacttacaagggcccagtscccatacacttttagggcccacaaagacattttaattttaatttcttttaaaaccagaagaaaaaaactgatgctataataataataataataataataa

SEQ ID NO: 32448 - DNA, 201 bp, Homo sapiens
gatggcaataataatagtaactttaaaatgttatcatttgtaaaacacttattatctgccacgtactgggcttacaggcttacaacggtgcctggtaccaygtgggaggcgcttaatcagtgttttttttttttttttctatttttttgatgggggtcttgctctgtcgcccaggctggagtgcagtggcacgatctcgac

SEQ ID NO: 32449 - DNA, 201 bp, Homo sapiens
ccccccaggtgggaagcagcagagacatttggatctttggctcgaccagccaccaagaacgggtcaagtgtgcagcaaggcccagagcacagcgtctgagrgtggtgagagcgattcacccaggcagccaggaggcgagactgtttacaggggctagcggctgtcgccatgacaaccggacagcctacagcttcctgcgtc

SEQ ID NO: 32450 - DNA, 201 bp, Homo sapiens
tggcagcatctgacatagtttatgactaacccgcttccctcccgaggcagggagagacggtccgctctctcgaagacaatgtacaattttgaaaaaaaaaataaaaaagtcttggtaaatagattgaggaggctccagcctcctgggcttttgggaggcccaaggcatttttcccctctgcccaaaccaggtatcttttgc

SEQ ID NO: 32451 - DNA, 201 bp, Homo sapiens
tataatactggcttacatcgattgagcgcttcctatgagttgaggattattccaagctctttatattccttcattcattcagtgttgagcatgtgctaggyactgttctgggcactagggattctgcagtgaagaaaacagctgaggtcccttcccttatgcagacagtaaggtcccttcccttctgctgggaggaggcag

SEQ ID NO: 32452 - DNA, 201 bp, Homo sapiens
gggcccacaaagacattttaattttaatttcttttaaaaccagaagaaaaaaactgatgctataataataataataataataataataataataataatawtagtggatcacaaatccagcctggattttacttgtctttatacagtgcagtcacaagctagagggagggtccctgaaagcaaacatccctggagcccagg

SEQ ID NO: 32453 - DNA, 201 bp, Homo sapiens
ttttcactgacctctagttgaaatacagcacttcctttaggtatgaatataggcaacaaatcatagtaatatgtttcatagtaattatgtttcacacacakaaaaatcacaggctgggagtggtggcatgcacctgcagtcccagctactcaggaggctgaggtgggaggatcgtttgagcccaggagttcaaggctgcag

SEQ ID NO: 32454 - DNA, 201 bp, Homo sapiens
tagggcccacaaagacattttaattttaatttcttttaaaaccagaagaaaaaaactgatgctataataataataataataataataataataataataawattagtggatcacaaatccagcctggattttacttgtctttatacagtgcagtcacaagctagagggagggtccctgaaagcaaacatccctggagccca

SEQ ID NO: 32455 - DNA, 201 bp, Homo sapiens
tttagggcccacaaagacattttaattttaatttcttttaaaaccagaagaaaaaaactgatgctataataataataataataataataataataataataatattagtggatcacaaatccagcctggattttacttgtctttatacagtgcagtcacaagctagagggagggtccctgaaagcaaacatccctggagcc

SEQ ID NO: 32456 - DNA, 201 bp, Homo sapiens
cttttagggcccacaaagacattttaattttaatttcttttaaaaccagaagaaaaaaactgatgctataataataataataataataataataataataataatattagtggatcacaaatccagcctggattttacttgtctttatacagtgcagtcacaagctagagggagggtccctgaaagcaaacatccctggag

SEQ ID NO: 32457 - DNA, 201 bp, Homo sapiens
ctccctgtgtggctgcaggtactgtgtccagttccagttggggtccattccagggagctgcgggcaggcgagggcaccccatgcccagtggacaaggtatytgagtcagggccacacggtctgtgtgaggagtgaatggcctgcccaggacaccaggagccggcgctgctacggggacggtggtggggccaaagggtgagc

SEQ ID NO: 32458 - DNA, 201 bp, Homo sapiens
gggagtgtaaattcgttcaaccattgtggatgacagtgtggtgattcctcaaggatctagaaccagaaataccatttgacccagcaatcccattactgagyatatacccaaaggattataaatcatccttctataaagacacatgcacacgtatgtttattgcagcactgttcacaatagcaaagacttggaaccaaccca

SEQ ID NO: 32459 - DNA, 201 bp, Homo sapiens
cctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaagaa

SEQ ID NO: 32460 - DNA, 201 bp, Homo sapiens
aaaaacaagcaatggggaaaggattccctatttaataaatggtgttgggaaaactggctagccagatgcagaaaactgaagctggaccccttcctttacaycttatacaaaaactaactcaagatgtattaaagacttaaatgtaagacctaaaactataaaaaccctagaagaaaacctaggcaataccattcaggacat

SEQ ID NO: 32461 - DNA, 201 bp, Homo sapiens
tcctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaaga

SEQ ID NO: 32462 - DNA, 201 bp, Homo sapiens
atcctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaag

SEQ ID NO: 32463 - DNA, 201 bp, Homo sapiens
aatcctaataacctcaaaatatataaaataaaagatggacaacattataaaaagaaatagacaaatgtacaataaataaaatattttaacacaactcatttagtatctagtaagacaagtactccccccaaaatcagtaaagtatctagaagatttgaataaatattaacagattggattcactgaccttgttacaagaaa

SEQ ID NO: 32464 - DNA, 201 bp, Homo sapiens
agttacaaccacagtgcatgctaagtgcttagctaagaggggaaaggcattaaatttgtgggcggaagaggtgaacagaaatgtgttctaattgacagctrtcaggtttggtactatctgaggttttgggtatcggctaatgtcttggaacatgtcccccaaagataagtgggtgactactgtatattcaaaataagcatt

SEQ ID NO: 32465 - DNA, 201 bp, Homo sapiens
gtctaggtaagaatttctttgtattgcttgggtttgcacatttttttttttttggttgttttttttttttttttttttttttgacagaatttcactcttaycacctgggctggagtgcagtggtgggatatctcggctcactgcaacctccgcctccggggttcaagttatcctcccacttcagccttccaagtagctgca

SEQ ID NO: 32466 - DNA, 201 bp, Homo sapiens
ataacttccaaatgtgaaacagcctaaactaaactacctagaaattttgttgctgacataatttaaattttaaaatgctgatggatgcttccagtgtgcayggtcctttggaattttaaagaagtataagagctctgcacccaaagtgtatgcatatagaagtaggtggtggagttttatgaaatctacttattaggaagc

SEQ ID NO: 32467 - DNA, 201 bp, Homo sapiens
ttagagctttcatgttttttctagaaatcttttgtccaagtcctccagttattcctaatgggagacacacaggaaaacctctggaagtctttccctttggraaaacagtaaattacacatgcgacccccacccagacagagggacgagcttcgacctcattggagagagcaccatccgctgcacaagtgaccctcaaggga

SEQ ID NO: 32468 - DNA, 201 bp, Homo sapiens
gcctcagcatccatttagaatatgtttagctttctcatgccagaagcagggcttagtcacccttaatgccctttctagttctgtacctcctcccaattttkcaacgtggtcgagccagatatctgccttatacaactgcctcctggtgaccacctctctatgggacagctagataaaacctacttgactagcgtccctgac

SEQ ID NO: 32469 - DNA, 201 bp, Homo sapiens
aagcgcagagactccagcccagctgcaatgggggaagaggatttaccgacagaaaaaggaaactgacgtacagaaaacagaagtgaggtacagaaacagccgattggttatagctcagcgtttgccttatttgaaaacagttcaaacagttggccacatttgattggccaaaactcggtgattggcgtaagagtagtctgc

SEQ ID NO: 32470 - DNA, 201 bp, Homo sapiens
ttcagaaaatttgcatttatattctcaagagatcttgggttataatttgcttttattttaatgtccttatcaggtttgggcatcaagattatgttggcctsataaaatgtgttaaaaattatttattttttctagtgtctggaacaatttgtgtaacattatttttccttatatgtttggaagaattcagcagtgaagcaa

SEQ ID NO: 32471 - DNA, 201 bp, Homo sapiens
aggtatatacatatatatacgtatatatacatatacatatataggtatatacatatatatacgtatatatacatatacatatataggtatatacgtatacrtatacatatataggtatatgtatacatatatacacactatatatatatacacatatatatagtgtgtatatatgcacacatcttaatcatgcagttcaat

SEQ ID NO: 32472 - DNA, 201 bp, Homo sapiens
gtatgtatatgtgtatatatgtacgtatatatacatacgtacgtatatatacgtgtatacgtatatatacatatacatatataggtatatacatatatatacgtatatatacatatacatatataggtatatacatatatatacgtatatatacatatacatatataggtatatacgtatacgtatacatatataggtata

SEQ ID NO: 32473 - DNA, 201 bp, Homo sapiens
tgtatgtatatgtgtatatatgtacgtatatatacatacgtacgtatatatacgtgtatacgtatatatacatatacatatataggtatatacatatatatacgtatatatacatatacatatataggtatatacatatatatacgtatatatacatatacatatataggtatatacgtatacgtatacatatataggtat

SEQ ID NO: 32474 - DNA, 201 bp, Homo sapiens
tgacttaaagtttgtccacttgtcatcttgcctccaggctgtcttaatctttgtacttgaactgttccactcagggggtaagaagcaaggaaagagtagcscaaagaaaagagtaggaaaaggaagaggctatttcttcctaaggaggggaagaagttgcctggtccttcagggcaaacattaggccttttccagagcaga

SEQ ID NO: 32475 - DNA, 201 bp, Homo sapiens
gtgggaaaaagggactgagggaggggtggagggaaggcagtaaggcacagttatgtaaatcaggaagaaaaatgtattcactggagacgacatgaaaacawctgcctctgaacactaaccagtatctgtataattgacagtctccataagttcatgaggggtacatgggcatgcaaagttcaaaattggaaatgtggatat

SEQ ID NO: 32476 - DNA, 201 bp, Homo sapiens
gggagagcaccatccgctgcacaagtgaccctcatgggaatggggtttggagcagccctgcccctcgctgtgaactttctgttcgtgctggtcagtatccrcttccacatatcctaaatgggttcagaatatgtggacccaatccctcatgtttctgtaataagactatggtatttgtttgtgagcttaactttgtcataa

SEQ ID NO: 32477 - DNA, 201 bp, Homo sapiens
tgaagaagaaatcaaaattccaaatggtgttgtatcaaagaaatattaatgaggcacaaaactagttaaatggggtcactaaaactgttttatttaatatrgaaataaaatatcaaagcaggactaattcttgaaagataattcatgtaatatgaaaagaagaagaaacttgatataaaaaatagattttatcacttcagc

SEQ ID NO: 32478 - DNA, 201 bp, Homo sapiens
ggaatgggggaaatcaaaagttaagcttgggacataactttagtgttcctcttagatatccagatggatatgttggagagtcccaggctgcccatagatakgtagaagccatcattgtatctgctatgcttgaaatcaggactgaaagagatcttcacctagggagtgagtgctgctagagaacagatgcatggactgagc

SEQ ID NO: 32479 - DNA, 201 bp, Homo sapiens
cttgacataaaaaataaggagaaaatggtacttcacaccagtataaaatctatatatctatatctatatatatctatatctatatctatatatatatatawaatcaaattttaaaagataatcagaagggcgaaaccacttggtccataaaacaaaagaggggtgagagaaacaagagctagcaagctttctgtctctctt

SEQ ID NO: 32480 - DNA, 201 bp, Homo sapiens
tcaaactcatcagttataatagtaaatgtgaatgattccaatccccccttttgaaagacaaaggcttctaaatatggtcagaatcctatttacagtagcaycaaaaagaataaaatacttaggaatcaatttaatcaaggaggcacaagacctgtgcactgaaaactcagtaactgaaaatgagcaaatgatgtgatagac

SEQ ID NO: 32481 - DNA, 201 bp, Homo sapiens
taaaaattcaaagttttagaaaacggagtaccttagatcttgatcaaagagaaatttaaaaacagccattgcagattacctggagaataacaatcgctaaygatcctcaagtgcatgtgcctcaagcattcttctaagtcctttacttgaattgatttacttagtctttaaaagaccctttgaaatggatatcatgcatat

SEQ ID NO: 32482 - DNA, 201 bp, Homo sapiens
ttgggaggctgaggtgggtggattacctgaagtcaggaattcaagaccagcctggtcaatgtggtgaagcctgtttctactaaaaatgcaaaaatcagccragtgtggtggcaggcacctgtagtcccagcagctaaggaggctgaggcaggagaatctcttgaatccgggaggtggaggttgcagtgagccaagatcgca

SEQ ID NO: 32483 - DNA, 201 bp, Homo sapiens
tacaaggggtacctgctatgaaaggccagagaggcagcttatgatgggcaccctgagaatggagtatggagagagatgataaaatatgtcttgctactcakgagtgaattagcacaaacacatgaagatttgagtggttaactgaggatataggcactccgataggaggtcagaatgtgaaactacaagctgaagttcttg

SEQ ID NO: 32484 - DNA, 201 bp, Homo sapiens
tagcagaggcctaatacatttattttgcagtttctactttccttaagaagaaaagtacgcttaattggcaacacagtcacagtatgacaactgtagaatcrccttggattatactttaaaattttttatggaattgagagctcttgttttctttctagatatcttttgtccaaatcctccagctatccttaatgggagaca

SEQ ID NO: 32485 - DNA, 201 bp, Homo sapiens
ttgttgtcccttaacttcatgagaaaatcaaaagtctgttcagcctctcagttgccccgtcctgattcagctgcccattcccaaacaataagcagcccagktgccaagcccaaatacccagctctcaactggattctcatcttctcctagatcatggcccaggaatgcttcactagtttgttagctttctgatgctttaac

SEQ ID NO: 32486 - DNA, 201 bp, Homo sapiens
tcttcaggaagcataggaaattcccccataactaacaagtactctggaactgtcctttccacagtgtgtcagccgcctccagaaatcctgcatggtgagcrtaccccaagccatcaggacaacttttcacctgggcaggaagtgttctacagctgtgagcctggctatgacctcagaggggctgcgtctctgcactgcaca

SEQ ID NO: 32487 - DNA, 201 bp, Homo sapiens; identical to SEQ ID NO: 6312

SEQ ID NO: 32488 - DNA, 201 bp, Homo sapiens
gcctcagaatagacaaagaccttagagtttgtctataatggtctgcctcctacattttattttgattttattttatttaaaaactatttattagagttgaygtcccactctgttgcccaggctgaagtacagtgatacaatcatggctcactgcagcctcagattcctaggctcaagccatccacgtcctacattttatcc

SEQ ID NO: 32489 - DNA, 201 bp, Homo sapiens
tagaccaatggaacagaacagaggcctcagaaataatgccacacatctacaaccatctgatctttgatgaacctgacaaaaacaagcaatggggaaaggaktccctatttaataaatggtgttgggaaaactggctagccagatgcagaaaactgaagctggaccccttcctttacaccttatacaaaaactaactcaaga

SEQ ID NO: 32490 - DNA, 201 bp, Homo sapiens
ctttagtcattggtgtgcaatcagagaaattgggggaaatctgtaaaacagatttggtctcaggtgacagtctcattacctgaataacaatggtacaaatygggattaccttcctaggaaatatgtagatggagaatccaccaatactgataacttcacattggatagccagagctaggagaaaatacctcatgccctgta

SEQ ID NO: 32491 - DNA, 201 bp, Homo sapiens
aaatggccatactgcccaaggtaatttatacagtcaatgctatccccatcaaattaccaatggctttcttcacagaattacaaaaaaaaaaaaaaaaaaaactactttaaacttcatatggaaccaaaaaatagcccatatagccaagacaatcctaagcaaaaagaacaaagctggaggcaccacgctacatgacttcaa

SEQ ID NO: 32492 - DNA, 201 bp, Homo sapiens
atgaggcaagaacccttccagagtaagccccaatttaggggcatgcctgtcccgaaacagtatgactgtactttagtcattggtgtgcaatcagagaaatygggggaaatctgtaaaacagatttggtctcaggtgacagtctcattacctgaataacaatggtacaaatcgggattaccttcctaggaaatatgtagatg

SEQ ID NO: 32493 - DNA, 201 bp, Homo sapiens
aaaatatccgtaatctgataagcaacttcagcaaagtctcaggatacaaaatcaatgcaaaaatcacaagcattcctatacaccaataatagacaaacagmgagccaaatcatgagtgaactcccattctaaattcctgcaaagtgaataaactaccttggaatacaacttacaagggaagtgaaggacatcttcaaggag

SEQ ID NO: 32494 - DNA, 201 bp, Homo sapiens
ggccataggcaggctggggaaggcttctataagaaagtgacattttagcagatgcctgaaggaagaattgaagtcagagtgaagataaaattgcgtcacayagaaggaatgtcatagacgggaaaaatgtgtgtctttgggaaactgaaaaaggggaaagggccacaccttggtgaggggaccaagtggcacaagatgagg

SEQ ID NO: 32495 - DNA, 201 bp, Homo sapiens
ccattatctcagcttaaaatatccgtaatctgataagcaacttcagcaaagtctcaggatacaaaatcaatgcaaaaatcacaagcattcctatacaccartaatagacaaacagagagccaaatcatgagtgaactcccattctaaattcctgcaaagtgaataaactaccttggaatacaacttacaagggaagtgaag

SEQ ID NO: 32496 - DNA, 201 bp, Homo sapiens
acagtgtataacatctttgtcttactcttctctttggataactggactcctttacttttcttcttggtatttaaaaatgttacttttactagaaagtttamgagcttcagaatctaagtttacaaatgacattggtcacacatttattgctgtttatccactttaagaaacagttttgctattttgtaaaacaaattggga

SEQ ID NO: 32497 - DNA, 201 bp, Homo sapiens
ctaaaaactctcaataaactaggtattgatggaatatgtcccaaaataataggagctatttataacaaacccaccactaatatcatactgaatgggcaaawgctggaagcatgcgctttgaaaaccagcacaagacaaggatgccctctctcaccactcctattcaacatagtattggaagctctggccagggcaatcagg

SEQ ID NO: 32498 - DNA, 201 bp, Homo sapiens
cgcagatgctgagcgggtgccgcacgaaattccttgcctttgtgtattcacagcctcggctggctatagccaagacgtggcgttgatcctagtgaaagggracttggggatccgacaaacctgagttctggtcctagaaacttaactgtgaggcaacttagcacacctgagtctgtttgctcttctgtaaaatggggacac

SEQ ID NO: 32499 - DNA, 201 bp, Homo sapiens
gataccaaaacctggcagagacacaataaaaaaggaaaatttcaggccaatatccctgatgaacattgatgcaaaaatcctcaataaaatactggcaaacraaattcagcagcacatcaaaaagcttatccacaacgatcaagctggcttcatccctgagatacaaggctggttcaacatacgcaaatcaataaacgtaat

SEQ ID NO: 32500 - DNA, 201 bp, Homo sapiens; identical to SEQ ID NO: 6286

SEQ ID NO: 32501 - DNA, 201 bp, Homo sapiens
gaaaagatctaaaatcgacgccctgacatcgcaattaaagaactagagaagcaagagcaaacaaattcaaaagctagcagaagagaagaaataactaagawcagagcagaactgaaggagatagagaaacaaaaaacccttcaaaaaatcaatgaatccaggagctggttttttgaaaagattaacaaaatagaccactag

SEQ ID NO: 32502 - DNA, 201 bp, Homo sapiens
agtgaggaataatactggttagacttcttcattcagagcccattattgcctcttgttactgcctcgtacccactcccatttctacacaaaacagccttgtmcacagtcaaaatttcaaagtttccattgttgtgatgtttagaatgataaaatacttaaggccatcctctgtgaagtctccctgaattttcctatgttcac

SEQ ID NO: 32503 - DNA, 201 bp, Homo sapiens
gaaaacaaagacacaatgtaccagaatctctgggacacagccaaagagtgtttagagcactaaatttatagcactaaatgcccacaggagaaagcagaaaagatctaaaatcgacgccctgacatcgcaattaaagaactagagaagcaagagcaaacaaattcaaaagctagcagaagagaagaaataactaagatcaga

SEQ ID NO: 32504 - DNA, 201 bp, Homo sapiens
atggaggaatatttaccaagcaaatggaaagcaaataaaagcaggggttacagtcctagtctctgataaaacatactttaaaccaacgaagatcaaaagaracaagagcattacataatggcaaaggatgcaacaagaagagctaactatcctaaatatatatgcacccaatacaggagcacccagattcataaagcaagt

SEQ ID NO: 32505 - DNA, 201 bp, Homo sapiens
tttgtcaccaccagacttgccttacaagggctcctgaaggaagcactaaacatggaaaggaataactggtaccagccactgcaaaaacataccaaattgtraagaccatcaacaatatgaagaaaccacatcaactaatgggcaaaataacaaatcagcatcataatgacaggatcaaatttacacataacaattctaaca

SEQ ID NO: 32506 - DNA, 201 bp, Homo sapiens
tgtggcctggagtttacgttcttgggaagtttttttttttccaaccattttcctgtaccatgtagacttttggctgaagtataacatatatatatatatayacacacacacacacacacacacacacacacatatatacatatatacttatatgtatatatgtatatatacgtatatacgtatgcatacgtgtatgtatat

SEQ ID NO: 32507 - DNA, 201 bp, Homo sapiens
atgtggcctggagtttacgttcttgggaagtttttttttttccaaccattttcctgtaccatgtagacttttggctgaagtataacatatatatatatatacacacacacacacacacacacacacacacacatatatacatatatacttatatgtatatatgtatatatacgtatatacgtatgcatacgtgtatgtata

SEQ ID NO: 32508 - DNA, 201 bp, Homo sapiens
tatgtggcctggagtttacgttcttgggaagtttttttttttccaaccattttcctgtaccatgtagacttttggctgaagtataacatatatatatatatacacacacacacacacacacacacacacacacatatatacatatatacttatatgtatatatgtatatatacgtatatacgtatgcatacgtgtatgtat

SEQ ID NO: 32509 - DNA, 201 bp, Homo sapiens
ggtatgtggcctggagtttacgttcttgggaagtttttttttttccaaccattttcctgtaccatgtagacttttggctgaagtataacatatatatatayatacacacacacacacacacacacacacacacacatatatacatatatacttatatgtatatatgtatatatacgtatatacgtatgcatacgtgtatgt

SEQ ID NO: 32510 - DNA, 201 bp, Homo sapiens
gaagatagtagagcaaagcatttaggcatgagggaaaagtgaggagcaacattagacaaggcgagcagtttgagactccttaaattctcaaaacatgtacytaaataatttatgctgagagattcataaataatgtcatttttaaaaatttattatacttttaagttctagggtacatgtgcacaacgtgcaggtttgtta

SEQ ID NO: 32511 - DNA, 201 bp, Homo sapiens
taacacagaatcttggcagcctccaaatgccagcacccagtaagagttaggagggcatcggggtccagcagacattgagaattttcgacaattgcatgcaraaaataagtcctctcttctttcctttttcccctagaatattcatgcttactcttcagcagcccaaattgcccttttgagccttcttcacgccatcacaga

SEQ ID NO: 32512 - DNA, 201 bp, Homo sapiens
aaaatcagcattttttaaaaaaatccagccatatatcatctggttaatcatgggctctgggctctgagctggggtcctgatggctgctgttaatatttccrgcaagctcattaccttgtttatgtccacctagtgctcttcgcagggtgcacatctctacacgggagctgaccggcatgggcaacaaagcacctgatccca

SEQ ID NO: 32513 - DNA, 201 bp, Homo sapiens
acaattagctgtactttgtttctctctccccagtatgtcagccacctccagatgtcctgcatgctgagcgtacccaaagggacaaggacaacttttcaccygggcaggaagtgttctacagctgtgagcccggctacgacctcagaggggctgcgtctatgcgctgcacaccccagggagactggagccctgcagccccca

SEQ ID NO: 32514 - DNA, 201 bp, Homo sapiens
agctttcatgttttttctagaaatcttttgtccaagtcctccagttattcctaatgggagacacacaggaaaacctctggaagtctttccctttgggaaarcagtaaattacacatgcgacccccacccagacagagggacgagcttcgacctcattggagagagcaccatccgctgcacaagtgaccctcaagggaatgg

SEQ ID NO: 32515 - DNA, 201 bp, Homo sapiens
ggaggtagggtggaagtctctctgctaactttgatattcctgtggtttttctctccaggtcactgtaaaaccccagagcagtttccatttgccagtcctaygatcccaattaatgactttgagtttccagtcgggacatctttgaattatgaatgccgtcctgggtattttgggaaaatgttctctatctcctgcctagaa

SEQ ID NO: 32516 - DNA, 201 bp, Homo sapiens
tactctcagtacctcatataagtggaatcatacagtacctgtccttttgtgacttatttcacttagcataatgtcctcaaggttcattaatgttgtagcaygtgtcagaatttctttcctttttaaggaaaggaagaaattcattgtgtgtatatgcaattttgtttacattttgtttatccatttatctgtcgatagaca

SEQ ID NO: 32517 - DNA, 201 bp, Homo sapiens
gtgtaaaaaaccaattagggaagctcaggtatatgtaaactaaatgaacagtgaggatcaatcagaggaaagcacaccaaatgggaagagaggttctcaarccagtccatggatttacctggaacttgtagctaggctttaaactgtcttcagcttgaaggtcgggtttcaccgggatctgccccatctgcctaggatttg

SEQ ID NO: 32518 - DNA, 201 bp, Homo sapiens
ccctaagcatgaacgaacaggactataaataaaggcagatgttgagtcaaatactctccaaataatatgccctctcgtgacaaaggactgtcttatttaakggcttgtgtttttgatggctcatcttgtctactgatgccacaatagctggcttagcagctgtgtaggaggtgttatggttgatacatagggacagagaag

SEQ ID NO: 32519 - DNA, 201 bp, Homo sapiens
tgccatggcaacgacctagaagttaccgcccctttcctggaaagttctaaataactcgcccctcaatctgcattgatccactccttaatttacatgtaacygaaatgggtttacagcagtataaacacagttgcctgccaggaacccttatgttgctgactctgggtgtgctgcctgtgagttagccctgctctgcaagaa

SEQ ID NO: 32520 - DNA, 201 bp, Homo sapiens
gcaccatgacagtttacaaatgccatggcaacgacctagaagttaccgcccctttcctggaaagttctaaataactcgcccctcaatctgcattgatccaytccttaatttacatgtaactgaaatgggtttacagcagtataaacacagttgcctgccaggaacccttatgttgctgactctgggtgtgctgcctgtgag

SEQ ID NO: 32521 - DNA, 201 bp, Homo sapiens
ccttgttagtgagatgtggctactgaactaccaatcttctcttttaatagctgcactctgcaatgacgatttttaagccctctggtaagcataagatatarcaaaggaaattgccccatatctaacaagtgctctggaactgtcctttccacagtgtgtcagccgcctccagaaatcctgcatggtgagcataccctaagc

SEQ ID NO: 32522 - DNA, 201 bp, Homo sapiens; identical to SEQ ID NO: 6310

SEQ ID NO: 32523 - DNA, 201 bp, Homo sapiens
atggaaccaagttggaaaacactcttcaagatattatccaggagaactgccccaacctagcaagacagtccagcattcaaattcaggaaatacagagaacrccacaaagatactccttgagaagagcaaccccaagacacgtaattgtcagattcaccaaggttgaaatgaaggaaaaaaatgttaagggcagccagagag

SEQ ID NO: 32524 - DNA, 201 bp, Homo sapiens
ccactgcctgagccacttctagaagtagaacagattctgccatcatcctgctttttaatttggtatatatgcctccaattggcagaacctaaccagagccyagctatcaaggaagatgaacgatttatttttaaggcctccattgttagctgtcaaaagacagtgcagaagtgtgaggctgggggccaacagaaatttaac

SEQ ID NO: 32525 - DNA, 201 bp, Homo sapiens
aagaatgaaaaggaatgaacaaagcctccaagaaatatgggactatgtgaaaagaccaaacctacgtttgattggtgtacctgaaagtgacggggagaatrgaaccaagttggaaaacactcttcaagatattatccaggagaactgccccaacctagcaagacagtccagcattcaaattcaggaaatacagagaacacc

SEQ ID NO: 32526 - DNA, 201 bp, Homo sapiens
gcacaagaacttcatgaagcatacacaagtatcaatagccgaatcgatcaagtgaaacaaaggatatcagagattgaagatcaacttaatgaaataaagcwtgaagacaaaaaaagaatgaaaaggaatgaacaaagcctccaagaaatatgggactatgtgaaaagaccaaacctacgtttgattggtgtacctgaaagt

SEQ ID NO: 32527 - DNA, 201 bp, Homo sapiens
aaagaacataaatgacctgatggagctgaaaaacacagcacaagaacttcatgaagcatacacaagtatcaatagccgaatcgatcaagtgaaacaaaggwtatcagagattgaagatcaacttaatgaaataaagcatgaagacaaaaaaagaatgaaaaggaatgaacaaagcctccaagaaatatgggactatgtgaa

SEQ ID NO: 32528 - DNA, 201 bp, Homo sapiens
cttttaaaaactctggagtggacctccatcaaactccagcagacctgcagcagaggggcctgactgttagaagataaactaacaaacataaaggaatagcrtcaacattaacaaaaaggacgtccacatgaaaaccccatccaaaggtcaccaacatcaaagaccaatgatagataaatccacgaagatgaggaaaaacca

SEQ ID NO: 32529 - DNA, 201 bp, Homo sapiens
agacattatggggttcttgctcttgacttctccttgggacaagtagccacaccaaaagccattgcctcaactgagaaggggcttttaaaaactctggagtrgacctccatcaaactccagcagacctgcagcagaggggcctgactgttagaagataaactaacaaacataaaggaatagcatcaacattaacaaaaagga

SEQ ID NO: 32530 - DNA, 201 bp, Homo sapiens
aaaaagaaaataccctcatgaacccaacatatacctgaaatcgcttactagagtgtaaacattggttaagctattttaacctttgattagtttatctatarttcttttaagctgtaatatcctcttcccaaattcaaagcaaattagaaaagggaaggagtgtccccaaatagaggcattccaaggaataaatgtgtttct

SEQ ID NO: 32531 - DNA, 201 bp, Homo sapiens
tagtttgccccatgggattatctattgtttgtcccgctgtttgtgcccgcttttgatagaaattgttctttgttggaatagatacaagcaatgttttgggraaaaataaacatgagaatcatgtgttttgggtaccatcctataaatatttatgaggagagtctgtgctataaatagagagaaatgcttcatagaaataaa

SEQ ID NO: 32532 - DNA, 201 bp, Homo sapiens
atatgtagacgtatacatatggacacgtatatgtatacgtatacatatggacacgtatatgtatacgtatacatgtacatgtgtatatgtatacgtatacrtgtccatatgtatacgtatatgtatacatatgtatatatacatatgtatatacatatatatggaacatatgtatatatacatatgtatatacatatatac

SEQ ID NO: 32533 - DNA, 201 bp, Homo sapiens
aacattagacagggtgagcagtttgagactccttaaattctcaaaacatgtacctaaataatttatgctgagagattcataaataataagtcatttttttwaaatgagcctcatatgttcaataatcagtagactactgatttctcctagtctacccatgtataatttccccaatggaagatagaactttgcttcaattct

SEQ ID NO: 32534 - DNA, 201 bp, Homo sapiens
gaggaaactggaacatatattaactggcaagttcaaaggcaagtataactagtggttatgaatatataggtaacacattaagcaaaaaatatcagccagamacggtggctcacgtgtgtaatcccagcacctttgggaggttgaggcaggcagatcacctgaggtcaggagttggagaccagcctggacaacatggtgaaa

SEQ ID NO: 32535 - DNA, 201 bp, Homo sapiens
cacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaaccgaaattatt

SEQ ID NO: 32536 - DNA, 201 bp, Homo sapiens
tgaaattacactctcattatggtgacagtaggtctttcagattttgttcgacagtttcccaccttctcactgaagtgaaatgaatgactaggcagcaccttgctacatagcatgaagagaggagacccatagttctttaccaccctatgtcaggtggccgctgagagaagacttgaaaggagatgagcatagatgtatgga

SEQ ID NO: 32537 - DNA, 201 bp, Homo sapiens
ctgtcatctccttagcatattttcagcaacaccaatcatagcaccctgtaattgcagaatacctctggtgaaactcctgaatgaaacttagagctttcatrttttttctagaaatcttttgtccaagtcctccagttattcctaatgggagacacacaggaaaacctctggaagtctttccctttgggaaaacagtaaatt

SEQ ID NO: 32538 - DNA, 201 bp, Homo sapiens
tcctaagaatgtaggctccttcctcagcgctgtgtccccaggatcctgatgaagggctgacacaggataagtgctcaattaatatatattgactaaatgawtaaataacccttcaaaatggttatttttcttcttcaaatgttttgctacttcattaaagttgtaaagtttctactgtccaggaactgttactatccggaa

SEQ ID NO: 32539 - DNA, 201 bp, Homo sapiens
tactgtcatctccttagcatattttcagcaacaccaatcatagcaccctgtaattgcagaatacctctggtgaaactcctgaatgaaacttagagctttcrtgttttttctagaaatcttttgtccaagtcctccagttattcctaatgggagacacacaggaaaacctctggaagtctttccctttgggaaaacagtaaa

SEQ ID NO: 32540 - DNA, 201 bp, Homo sapiens
ctcaaagacaaactgaaattactttttccattttataacagttttatgtaatttatttgagatccaaatgtgttttgatttcccaagatcagatcaactayattaagagagagcctgagatgccgttacaatatgttgtgtgaaattacactctcattatggtgacagtaggtctttcagattttgttcgacagtttccca

SEQ ID NO: 32541 - DNA, 201 bp, Homo sapiens
agatctatcaattacctttgagtataataatggttgatacaaaatgagtgattcctctgcccaggcactataatacaggctacatgtgaattttaatcctkaaaacaaagttattaggtagttcccagttgttctatgtttgtctgttttgttttgcttgagatactgtcttgatctgtcactcaggttggactgcagtgg

SEQ ID NO: 32542 - DNA, 201 bp, Homo sapiens
ctactgtcatctccttagcatattttcagcaacaccaatcatagcaccctgtaattgcagaatacctctggtgaaactcctgaatgaaacttagagctttyatgttttttctagaaatcttttgtccaagtcctccagttattcctaatgggagacacacaggaaaacctctggaagtctttccctttgggaaaacagtaa

SEQ ID NO: 32543 - DNA, 201 bp, Homo sapiens
tgagatccaaatgtgttttgatttcccaagatcagatcaactacattaagagagagcctgagatgccgttacaatatgttgtgtgaaattacactctcatyatggtgacagtaggtctttcagattttgttcgacagtttcccaccttctcactgaagtgaaatgaatgactaggcagcaccttgctacatagcatgaaga

SEQ ID NO: 32544 - DNA, 201 bp, Homo sapiens
tgctgaaattgcgaagcaaagctcaacctgggcaagggatatgatgtttctttggggttcttataaacagatctatcaattacctttgagtataataatgkttgatacaaaatgagtgattcctctgcccaggcactataatacaggctacatgtgaattttaatcctgaaaacaaagttattaggtagttcccagttgtt

SEQ ID NO: 32545 - DNA, 201 bp, Homo sapiens
agagagagagagcaaggcagaggtgctacacactttggaacaagcagatctcgagagaactctatcacaagacagcactagggtgatggtgctcaaccatwagaaaccacctccatgatccagtcacttcccaccaggctccttctccaacactgggaattaccatttgacatgagatttgggaggggacatagagccaaa

SEQ ID NO: 32546 - DNA, 201 bp, Homo sapiens; identical to SEQ ID NO: 6299

SEQ ID NO: 32547 - DNA, 201 bp, Homo sapiens
gctggtctcgaactcctcagctcaagcaattcacccaccttggcctcccaaagtgctgggattataggcatgagccaccgtgcccggcctctatgttttayagagaatatgtgccttagacacatcagataacattctgagacagtaacttgcagacaaaactggattgcaagtccacctcactccagagccttggctttg

SEQ ID NO: 32548 - DNA, 201 bp, Homo sapiens
aggattgcttgacctgggaagtggaggttgcagtgagccatgatcgtgccactacactccagcctgggtgacagagcaagactctgtcccaaggttttgtyttggttaacttgctgtccctttttccaggaattccttgtgggctaccccccaccatcgccaatggagatttcattagcaccaacagagagaattttcact

SEQ ID NO: 32549 - DNA, 201 bp, Homo sapiens; identical to SEQ ID NO: 6306

SEQ ID NO: 32550 - DNA, 201 bp, Homo sapiens; identical to SEQ ID NO: 6308

SEQ ID NO: 32551 - DNA, 201 bp, Homo sapiens
tgttttaccatactcttccttctctcagtcatatcttgtgagccacctccaaccatatccaatggagacttctacagcaacaatagaacatcttttcacartggaacggtggtaacttaccagtgccacactggaccagatggagaacagctgtttgagcttgtgggagaacggtcaatatattgcaccagcaaagatgat

SEQ ID NO: 32552 - DNA, 201 bp, Homo sapiens
gggtagagattcctttttctccctattcccaagggtagaaagactgtaattttttagcttatgtttgtctaaactttctgttaagtcgctatcaacagctrgactcacttgtgcactgggacacgactgagtttgtcctgtgcaattgtggtagaattgacctcgaggtgcccaatctataatagttccgaattcactgtt

SEQ ID NO: 32553 - DNA, 201 bp, Homo sapiens
cacctcaatattacatcaccaggcattgattagtccagggaaacactgggtgatgagccctgaaaatggacattacagcatcagagtatttacaaactccytaaagaagtcatttttctattccaatcccccatttgatgcttgagaaagctgaagtccagaaaagggaactgatctgctcaaagacaaactgaaattact

SEQ ID NO: 32554 - DNA, 201 bp, Homo sapiens
catacactggcatggtattcagccataaaaaatgacagcataaagaagcacttaatgactagaaagagatgtattttacgtggaaaaagaatcagatgaayggcatatatggcaagatctcactttattaaaaaataatacacctatgtagtgagggccaggctgaggctgagagaaatacagtgtataacatctttgtct

SEQ ID NO: 32555 - DNA, 201 bp, Homo sapiens
tggtggcagtaataaccggggaacagatgagctggaggcctcatcaggaggggtgtcccttggtggaaggacaccattcccggccttaaaaggagacgctycagcacggctggggaagcacgtggataccttgtactaaatccactactgcagctcattcttaactgtaagtagaagaggaggacatgctttctgaagctg
